United States Patent 7,868,149 (PLANT GENOME SEQUENCE AND USES THEREOF) - sequence listing, part 121

SEQ ID NO: 67336 - DNA, 3860 bp, Oryza sativa
tgcccagcctgacgcagaccacgacgacatgactgtcatcgacacgctgtccacgcactccgctgctccgccgccggattccccatcgacggccgcacctccttccttgccgtcggctgcgtgttggtgtagtccggctgtccagaccaccgcgcctccttcctgcctccgccacaactcccatcgcgagcggaacctcgccacgccggcagacgacgcagacgtcgcggcgcacggccaagccgttggcgccagcctcaccgaggaagtcctcccgatgctggaggaggtgtgatttatggcgggggtgctccgccagctgctccggccgccgccactctacctgccgcccgcccgctccgccactccatcctatttcaggcgtgcacgggagggagagaatagagaaaagaggggaaaaagtcgagggttcactgacatgtgggacccacgtgggtcccacgctaactcagctgctacatcggacaaaaccagtgtcaaaaccaccgagagacctaaagtgaacggttctataaattgagggatgtcatatatctggtttttcggttgagggatgattttgtaactcgattacaagttgagggaccttcggtgtactttttccttctcaaaaacaaaatttaaaatgtgaatatcatttaggaataagttcacttcgtgaccctcaaaagtgatcgaaatctaatccgtgaccctaaattacaaaaccggatatctcgaccccctaactctcgaaaccggtgcaatttgactcccttgttttggaggacggtttcgctgacgtggcgcctacgtggcggtattgactcggtcttctttccacgtggcgcttaggtgatgttagaaataaaaaatatatgtgggactcatttgtcattcaccaaaagtatgggtgggacccactgacatgtggggcccacgtaaatcattctctcctcatcctccccctctctctttctcttccgttggcgagcggcggccgtgggatgggggccagcggcggagatgttccggcgaaacagaaacgacgaggaggagcggtgtggcgacgaggagcagccgcggagcatgattccggcggcggcaggcgggtgcctttctctgagccgtggcatagagactggagaaattctatatcagttcttgattcatctcaccggtgattgtcatgcaggcatcaccgctgtatatctcggagatagccaagatccgctgtacatctggctgattatcaaatataatcaagcttagttactaactaatggcagatttagtttaattgtatagtaagagctgtacctggatgctggattggagttatggcaggctgtggtggcgcgagtcagaaaagcagtagccgatatcggcgtggacgaacacccaaagcagctcgtcgtgataattgatgccggtcgcttcctcctcgcccccacatgcgttccacctcttcctccacccggtccaccgcgtcctccacgcctgcctcaccccgtgggccgccacgacgcgctacctcgaggccgatcggcctccactgcgccatcgccatctccgccgcaggaatcatgctccgcggctgctcctcgtcgccacaccgcttgaagaaggaaggagagcaagagagaaggggtcgtcgtcgccgctgctccagcgcccgccctcccgcctgccgccgggtgcgctggcaacgtctccgcggggaggggtgggggaggccgacgacaacccgcgggagaggggtgttggtgatgccgtctgtggcggcggccaaggcggtggccggcggcaagtcggcgcagactccatcgtccgtggagaggagagaagggaggaggaagatggggaggagaggattatgtgggctccacatgacaggggctcccacatttttttccgtgtgtatgacaaatgggtcctacacatatttttttatttctaataccacgtaagcgccacgtcaacgtcacgtggaaagaagaccgagttaaaaccgtcacgtaggcgccacgtcagcgaaaccgccatccaaaaccacccagggagtcaaattgcaccggtttcgagagttaggggttgagatatccggttctgtggtttggggtcacggattaaatttcgatcattttgagggtcacaaagtgaacttattcctatcatttacagccagaccggcccaacctagctaggagagcaggctttgcatggcccagttctggcccatgtttagattcttgaaataatctattggcagcggttggctggagaatttgcatagacagatcttcctcctttcgtgcaagacatcgattgttaattagcccgatggaattgacaaagatttgggcaagaaaagttgcgatccttgcaaggtgttggattcgacttgtataacttgaactgcacttctttcatattccttcgttaacagttggttactagtcctaattaattcagtagcaattgcccaaactaaactttacgacaaatctccagctagacacaaaatgttcttttgaatgaagcggtccataattactgctagatagcattgctcaaagctagacggcagtgatttcttttgaatgaagttttgcaaaatgaaagagtggacaattgggcatccttgggaatgttggtaggactaggaatgcagctggtaaatcttgatagaaaacaagcacatgttttgtcaaagaaagaaagaaagaaagcatgctctgacgaaaaacaatcaagcagagaaaaccatatataacaagatatagagctagcctcatcgccgaaatgcagcggcactagcctaaattacatctctgctcaactacaacgatcaccttctcccgaattaactcagcaatatggcagtattgctccatccctctccaagaagtgtctgcttggcctttgcaattgcagtgtgtcttttgctcccatgctgctttggtagtgagtgcctcaataattctagttcttcttggttttctgcatgataatcttcatgctgctagctagctagttggtgccattgcataactacattaggatacagcatgcatgtcagcaacaaactctgaagttagccacagctttctctaacattaacacgatcgttattaatttcatcgtcgcatatgcaggcaaagctgccgtggaaatgttcgagaaggcttgccattgcttcgacgatcacaacgtaagcacatatatatagctataaacagaatcaagttaattaattaactgttaactgtttataatcaagtgtgtttcttcatgcatgcatgtcgcaattgatcattgaaccgaattaataattttgaatttgcaggtgtacagcgagtgcaaggaggagcttcggctgggggtggagggggcgttccatgtggggaaggagagcgtggacgagtactgcggtgggccgtgcctgatggagacgaagatggcgctgcagtgcgtggaggaggtcgcccacgacggcttcaggttctacagcggcgcctcgctgcccgcggtcaaggccgcgctcgacaccggctgcagctacactcctgacagaggtaaattatagtatattaatttagtccaacaaattatatattctcctttcctgaaaatatttttttttaaaaaaaactctcaagatcacgtgcaaaaaaaaaaagtttggacaacaaaaactataataggatatctctctgtgtaaacatgagtgtttaaattgtttaaattctattgacgcgcacaaattaagaaaatatatagaccgcagcatgaaatttctcaaatgtatatggaaaaaaacgattttataaattattctagtataaaattacacattt

SEQ ID NO: 67337 - DNA, 2388 bp, Oryza sativa
gcgattaaaaaataatttgttttaatttttttatatgtattcttactatttaaaagctaatactgaaaaaaaagtggtgaaaacatattaaaattaacttcaaattaagttaagtttcaaacttaaattttactttgacttattatttttttatccttttaagaccaccaacggggctcttgattttttttattacccatatatacgtgcagggacgtttgagattagggagcgtaagcagtgcggcgacgagtactaccactacagccaccacgagcagacgacggagcagcaatacggtgggtactatggcagcgaggagggcgaatacccaactacgactagtacgcttcctgcttcagactactgctacggcgccggcgccagcagcctaggccttcgctacagcctgctgcagatgctcatgctcttctccgcttctatggtgcttctgctgcttgtaatataaggaatacaatactccgatacagttcatcgttttatatctatactttttactattttttagaatatgtaaaaggattacgcacttttgtattaagaggtataaaatttatacaaacagcagcaaagaagagacgggaaagaaaggggaaaaggaaaatatatgaacttaagcctacttgctattacaatgtgacgactgaatgaccaaacaccctaactaggaaactttggcgataggggacaggcgagatgccaaagggtggcctcttgcaccatggccgtgacaaccttaggccagaaccgagaacggttgttgaacacacgactgttcctttccttccaaatagaccaagcaccaagagtcacaatcgtatcgaacccatgacgacgctccctcgaaactttgagccggcaagagtagtgccactcatggaaggaatcagcgccagaggggaaacactgagggaggccgaggctcgaaaggacagtccaccatagctggagggattcagggcacccaatcagaatgtgatcgattgtctcttccagttggtcgcagaagacaataggttgggttcggcagcccacgcttctccaatcggtcagtcgtccagcagcgtcggtgagcgaccagccataggaagtagcgatattaaatccaataaggcaatccagcgaaagagaaaaagaacgggaagaaaaacaaaaacatcaccgggaagccgccgccgacgtcgccgttggatccgccgcgggaagccaccgccaccagatccgcccgtaggaagccaccgacgctgacatcgctgccgttgctcatggtgggggagggcgctgtcgccgacagaaacaaagaggccgagagggagggacggccgtcgaggagagggagaggggaagggacggccgtcattgtcgtctctgctgctgtacctctctacggccgcaccgtgttggcaagacggaagggagagggagaggcgccgccagtagggaaaagagaggggaggggaggggagggggagaagcgccgccggtagggagtgggaatgatctagggttagggtttttttttttgcatggggggttttgattgatttggaaccgatctgagtcgtttatcaaaatgaacggctcagattgatcgagcgttgggccgacctccattgtcgaatcgcagcattgctgggccgcacgcgggccagcagtccaacacaaaacatggttagattttcggttacggcccacacggcaagtttgaggaggagtagggggatatcaattagactttagttgcttcctgggctgaacgcttgctcgcggcctgaggaaagcggaccggctcggttgcgggttgaaaaagaaaatgggctaaaaatggctcttataaaaaggaggatttttatttaaataaatattgaaattatgtttgtattatcaaaattagcaattaagatctggaaattctaagaaaatttcaaaaagtgtaagcaatatggagaatttaataaaaattaaatccaaccatataattttatttctcacacttattttacttgtaaattaacttaattatatacctacctacttagaaaatacccaaaaattctagaaaatatgtattttaattaattagataatgtaaatctttctcaatctttcctcaattttctcgtcttttcttcccgttgtaacacacggacactttttctagaatgtatgtcatagtttctaaaagaatattttaacaaaaaattggtaaacttttaaacttttcgctacaattttagtgcagtcatctgtccgccactaacttgatgcctgctgcaagacaacgatcaattatttttttaatgaactggcgagccgccaattttattgaacagagaaggagtaaaactgtacatacgcaaagcgcaa

SEQ ID NO: 67338 - DNA, 2330 bp, Oryza sativa
tgttgacgatcgttaatactgattttgatactcagtatcataataaataaatgtgaaaactttcgatggcctgtaacaaaattcaaagatcaactttcgatgatatgaaaccaattttgcttataaactatatcagtgatgggatcctatggcccctaggtatccctcaccggatccgcttgtacgccgatggtgtggtcgcattccttaggccggttgctggggaactagctgcagcacaagggatcctggctctctttggagaggcatatggtcttcataccaacttcaccaaatgttccgcaatcctgatcaactactcgaaggaagaggtcgcagccctcgatgactccctcacttgcccggttgaggagttcccatgcaagtatttgggtttgcctctctccatcaaaaagctgcgccgtgaggacctccagcctccaattaacaagattgcgcagtggctgccactgtggagatcaaattggctccagccagccgggcgcctagcacttgtcaaagcaatgctgagtgcgatccggtttacttgctcatcgccattccccccccccccgcgaaatgggtgctgaaagccatcgacaagatacgacacggctttctctggtgcggtatctttgcatgcggttggcaaccgcatgggggagaaggtctgcaaaaatcacccttttcgcatgcggccggcccaaccacatgcgaaaatgggattttcgcatgcggttgcttatacctaaattcagcaaacaaaaaaaaaataaaaataaaaaaacctaaaccctagcccgccaccgcacggtgccggattcgtcgcccccgccgcctgccggagttgccggcaccggatccgtcgcccccgccgcccgccatcgtcgccagcataggatccatctcccccgccggccgccgtcgtcacgggctccggatcggccgccctcgccgcccgccgtcgtcacaggctccagatcggccgcccttggcgccggatccgcgcggggcggcgccgcccgaggcggcagagccgcccccgccgccgtccgaggtcgtcgtctggtgaggaggggggaggggcggtgaggaggggatggcggtagtgccgccacccgaggtcgtcgccgccgcgggggagggcgccgccgccggatccgcgttgaaggagtacgggggagtcgccggcgacgacagagggaggtagaggcggcagatccaggcgagcggccgctcccgcccgccgccgcctcgcgccgcgccgccctcggccgccgctgttagtgatatgccctagaggcaatcatagagatgattgtatcacatactatgtttacatatttatccgacattgttccttgaaatagataactccttattggttaatgaatatgtgattctttcatgagactctttatgttgttttgttactatttctaaaggatccctgatcaaatatcatatgtggaacaaatatgtttatatgatcagcacatgtattaattgatgatcatgtctcatggatcatggtatagagataccaaattaataatgtggacacatgttggtgaacatgttgttcgatagacccaacatgagacactgcaagagccatatgtgttgtgtcatcagtgatctcatttagtgttggtgttgaatctttagacctgagattatcatggttctcaacatgtgtagtagcttacttagggactgctaaacgctactccgtaaatgggtagctataaaagtagttttcgggtatgctatgaaacatatagtgggatatgaataatcaagatgggatttgcccctcctatggagagatatctctgggcccctcgatgttgtagattatgaaagtgcatggccatgccaaaggtgattgaggagtcaatcacaagttatataatctatcaacaggttcgagtgaatgattgagctattagaggatgacacatatctagccttgagcttaatcgatatcgtgaggcaaaggggttcatacaagtatacactagaggttcagccgatatgatctttatgtatgccaggtgggtcaatacgttctgctaggggccgctgttgacgcgtggaccgaaaaggagttttcgggttacagctgagtatatatgaacctatagggtcgcacgcttaatgggccggaataaggggattggatagagatccaatatgagcttaattcggatagggatccgaataggagtcctacgggccttggaggcccgagtgatggatcctatatattcgtgaggggcatgaccggcggaggcataacatcacgtgagaaaccctagccgtcactt

SEQ ID NO: 67339 - DNA, 2196 bp, Oryza sativa
tattatgttgtatatgaggtgatcggaacatgagatgaaccgatggtcacccatcccaaattgctccaggctagtatcagagccgccttgtatagtttatgatctagatcagtgcatatagttgatgtgcgggtgtagtagatgagatttattatgttgtatatgaggtgatcggaacatgagatgaaccgatagccgcatagctttcataggtcatagactgccctcacagaccaacacatatcttttctgcacactttgtcctcactcgtgtgcacccgggaagaatttcccgatcggtcacccatcccaaattgctccaggccaagcacgcttaaccctggagttctttggagattggcttccggaaaagaagttgcaacttgttgatataagtattctattaatcctattaagccctaggccgggatgttacaccctcccccttaagagagatcgacgcccccgtcgatcaaccctaggccaggaacgtcctctcttggccacgtccatgtgtccagtgccagcgcatgtgccatgctgtgtaaccactcccggtctacaccagccatgcgcaccatgcctgcgcaactgcgacacacgcgcccgtgaaaccgcgagattcggctctgataccattttgtaacgtcccgccttcccccaggccgggcccgcttacatctgatagctttcataggtcatagactgccctcacagactaacacatatcttttctgcacactttgtcctcactcgtgtgcacccgggaagaatttcccggtcggtcacccatcctaaattgctccaggccaagcatgcttaaccctggagttctttggagattggcttccggaaaagaagttgcaacttgttgatataagtattctattaatcctattaagccctaggccgggatgttataaatgtctagtactcaccaaggccaagcgcgattgtgttcatcggatagtccgatgtccactggaactgcacgccaatgagaaaaaacgagccaatgagattgactcggcttcggcataatttgattacgccgttaaggttttcacatagcgaatcgtagatgagatctatgtaccccgggactgccgtgtgcgttgccccttagatttcgcttggggtttttatatctatcttacctttattgctgttatatatttgatatgacatggtaggatagattccctcagaaaaattaagtgaaatttatgctctttcaataattgcacctatttcggttgtgatcataagtgatgggtttgacatagcaaagtgtcactttttatcatgataaaataggatagatgtcggacatctatatgcggagattattggtttacttgacaagggtatcaaaacaattttggaccttggggcataggttgggttggacatggagatgtcaccccaacaggacatggagatgccctcggccggcaccacctcgcgccgccctcgactgctgcgcgccacactgcgctggctcttggtctgagagtgagatagatagagagagagagagagtgaaagagagaagactctaagaggagaggaagggaaggactagaagataaaaggataggtgtgaaaaattttaaactggtggagagagaaggaagagggaccatttttacatgcggaccacttaagcgtccgcatgcaaaaatcatgtgttttttaaactttaaattgatttttatgacattaaattaactcatatcaaaaagttgtcaaaaacaaatttgtagaatacattgagatctaccaattttattttggttatttctccatccgagtttgattggactatacaaaatttgagttttaaaatataacaaattaaaataatttttcgggtagtaaatgattttaaatggaaaagtcatcaatagcaaagttgtatagctcatcaagatctacaacttttgttttggtcatttttatatttgactttgtttacacagtttgaatttgaatttcaaaatatgacaacttcaaacaatatttttaaatactaaacgacttcaactgaaaaagtcataaataacaaggttgtataactcatcaagacctataacttctattttggtcattttttcatccgacaaagtgatttgcaagattgtttacaaaatgtacctctcttatatagttttataagaatatataagagatgta

SEQ ID NO: 67340 - DNA, 1743 bp, Oryza sativa
ccgcggaacttgatcgccgctagatcgtacgtcctgcgattgggaaaggagcagaaaaacaaaggtaaaaggagcagaagcgagaaatgcccaaaacaagacgaatccaataccaaacccgtccatgctgctcttcttttgctccccttgcctctctctcctccttcctccttcgttgagctctcgaaaatggaaagaacgagcaggagacgaggaggcttaccatatgtgcgattcccatcgcccggtgcggcggtagaacttgacgccgcagtactgcgagctgcgcgaccgcggcccgcgtcggattgggcgtcgcgtcgcccgcctgcgcccagcccgccgccaccacgtcgccacaccatcccgccgccttttcctgcctcgccccaccggcacgaagggggcggggaggacggcgagctcgcgcctaaccacacctcctcctcctccgcctcaacactcccagctccctccctcccacctcaccaccatgccccaccgcggcggcgcggcgtgggcgagcgctgcgcagtacggccggcgtcgggaaagggcgccgacgacaaccatgcccgctgctagggggccaccacctccgccagccgccgcgcgcgtgcccgcctgccgccaccgccgctccgcgtctctgcttcgccggccggcctgcgagagaagagtgagagagagagatgggagaaaggaagaaaagagggggagaggggggttgacgtggcacgctgacatgtggggcccacgcgccacgtaggtcaaaactgggtcaaaaccaactaaggatctcgggtaaccggttttgtataggtaagggaccatgtatatctggttttggggtttaaggacgtttttgtatcgcgctgacaagttgagggaccttcggtatactttttcccatgcaaaaatgagctcatttttgcatgtggccctcttaagaggcccgtatgggaaaaatcgatttttccatacgggccacttaagcggccgtatgggaaaatgaccctcgatttttgcagacgccactagttatgatccgtttgcaaaaatcatggggcctcgtgaagaaaaataacttttatagtagtgtatctatgtttttttttttttttgctttatctgcctcatgatgcactcgtatggacgaagaattagcgcgaaatcgaacggaaacatgatgaggatcggaaagttaccgattttttaagtagttaagatattgtccgtagtaggtaccaaagtttctataatttctgtaccctaattcagtttttttttttttttttgctattccgatacattttgcgagaaaacaacgtatgcagcagtactttattttctaatttttgcgacgaacattgaattgacattgacgtagtaggggttttaatctctatagagaatcaagggggcagcataccccaaataaatggaaaattaatcagctcgtatctgatacgggtgtaaacgatggtaataaggtcgtgatatccggcctgctatctggtgccatgcatatttctcagcatttacagctgacgatcgagcacaaaatcacagggatgcaacgatataatatcttaccatgtgtaggcaaataatcagtacgccttcccacagccacgcccgcctataaataacgggccggcattccaccgtagcaaatcatccattctcacaagcatatagccactatcataacaaaagcttcaagaattcgtagctcatggc

SEQ ID NO: 67341 - DNA, 4387 bp, Oryza sativa
tcagcagtgaacctacctagcttggaatgccagaaatgagcagaaccaccaactgaaagacataataagatgaaacacgcgatcgattgatcgaagagaaccgaacaagctagacatgagaaaaaaaaaggaacataaattaaaacaatgaaattaagacaaaattaaaccaacagatatgcgggtcaccaaaatggagtatttgtgcctcctaaaagcacatagtaatgaataaagttattgaattattgttgtaaaaacaacagaaatgcgatggcagattggcatggataacgagcaaaactttgtcttcctatgtgtcctcctagattttgctttaggaaagatagacttgcaaatataagcatagacctgggaattcttttttttttccttgtgaagaaaatatacctataattatttttcacggaactaattaataccagtgaatcagaatctctcgtcgaggaattgcttgggagaaggaggattttaagcatatatggacacaataagatcgatcaaaattttagctcttggattcaaattttgtaagtgtacaagagaagagacaagagaggcggtgagatgttgaaacatgcagaaatcagggtatatttgaaatcagggtatatttattcgagtgcatgcataccatatacgagcccaaaatttatgccggttttgggccaaatacgggccttccgaacagacaaattatggtccttatatatttgcggtggatatttctataggtagaaaataaattatgttcttaattaataaatctatatactaatatatggttcgccatttttatatattaagatgccatgtcgagcacaatctaattaacatagtacagtataagttatcatatcctagctgccaacgaaatataatcaagatgttacctttcaaaattcaaacagaaaagaaggaaaatcgcagtatacatatagtagtacctctggtatcatataattaaccggaataaagtacttaccatacgacacagatacctttacataactggtgcaattaatacttttgccaaaaattaaaaaaagaaggttctgccttacaaaaacgccattagaattccataacacgatggggatcgatcgatcgatcgacgtccaacgtcgcacccgataataaacttaccaataaaggaattaggtaccaaaatttttttgtacctgaggtactactcccgtatctaagataccaaattttacatttaaaaatatgatacctttgataccttcttaataacgatgataaaattaccctaccaataattacaacgcacattccatacttatgcctataaaaatacagctccatcgcatgcagccaagacgcactcgcccatcgtcgtcgttgcacgaagctagctagctagcatcttcaccgccgcacaagcagacacagctagacgacgtcgtcaacaatggccaccggcgccgccgctgccaaccacggccgctgctccctcctcctcttcgccgccatcgccatggtgctgctggtgttcgtggcgacgacgacggccgcggcggcgcgagatgttcgtcgtcccgccgccgtggagaagaagatggcggctgtgatgaggcacgatgtccccagcagcgggccgagccccgtgcacaacggcgcgccgactcctccggccgccgccgacgagcccacggtggccgtgacggagcgtctggttcccaccggatcgaacccgttgcacaacatgcccagtcctctacaaggccgcacaccgaccaagaagacggttaattaattgagatgattccatcatgctcaattccaagtggttattaattaggaaatttaattatatagagaaattttatagttcttgagtattttttacaaatcttcgtaccttatatagtatcggaaatataaaatttggtatccctccgtaccttctcgaggaccgtaaaatctcttagatagatatgcatgtatcacagatgcttattataattattaatcaggtaccatacaatatgttttgcgtgagtaataaataaataaagagatttgcccctagttagtcgtactgttaatttatcatgtgcgtgattttgtatttggttttaatttgtgtgcaatggaagattttgagtttgaaattttcaatattggtatgttgcgtacttgcgtgttgtgttatgcgcctggccggaggtttccttgatattgattgatgatccctcttatctgacgatgtttgccacgtacgcattcaccactaacactgagaaactaattattttttttgatagactgagaaattaattattggtaacatatcgagaggattagattgcttgttcgatgtcaacactgagaaattaattattggtaacatatcaagaggattagattgcttgttcgatgtgtggaatttgctggtttactgttcattcttatcaaattcgctttaataataataataataataataataataatattattattattattattattattattactattattactattattattattattattattattattattattattattattattattattatgcgcgtgaagtactgaaacctgttgaaaaattaaggcattatattaagctgtgtgcataccttcgtctttgaacttcgatcggttttctgaactctctctccttttcttcgcttggtagattctctctttttttttctttctcgctggtaccgtttttttcgctgtttctttctctttttttttctttttcgctgtttttaccgtaccgtacgtaacgtaattagtttagattagtttttttactagtgattagtttactagtaatttttaattcttaactttaaaatttaaaaatttggacttgaaactttttaaatctcgagttgaaaattttctaatctcaagttgaaagttttcaaatatttcaaatctggacttgaaagtttttaaatcttgagttgaaaattttcaaatctcaagttgaaagttttcaattttttcaaatcttggcttgaaagttttcgaatctaagttgaaagttttcaaattttttaaatctggacatgaaagttttcgaatctcaagttgaaagttttcgaatctgagttgaaagttttcgaatctgagttgaaagttttcaaatccgagtggaaagttttcaaaatttgacttttaaatttaaatcttaaatcaaaagttttcaaatctaacttaaaaattttcaatctgttggtacaaaaatctcccaaaaaagaaaaaaaaatcttgagaatcttccctaattactagtcattagtagttaagtgggtgttaactaatagtactatagataattagggaggtgaggtgctcgctgctggcgcgcacgcgccagctagcagccccctgaggtatatatttcgtatgtatgcaaagaaataaagaaaataaacgttattgatcaaaagaagcccaacaagaaagcctagcaggctgcctccctcaaattcgaacccaatttacaaggttgcctaatttgtacattaactgtgctgtgatggcatgatactaatcgatatatacttggttggtagattgtactgcatatgttctttcacaaagtacatcataataaatcaagaaatttgctaaaaatcttgtcgcaagttctaattcaataagcagtactaaaataccatattgttgatcatacgtatcaaatattatgctcgcgtgttgtaaaatttttttttaccccctttccatttcgaatacccaatctcaaaatcttgggcccgcccggtatgaaatcgattagtccgatggtagttatggccgtaatggccccattgttttgcttatttgtggaataagctaattaaacaacatatttgtaaacgaaaaataattcataaatacaacttttatatacttgctcttagcaatctaaaagtaaaggttgaataataaacttcgatgaaaaaaccctaaaattaacttcaaatttaaggttgaaaatttaaattttagcttctattaagcgttgacttagtccaacgttagttactcatacacaaattgatctgtgcgactaactttcaaatttgaaactttcaactctaacttgaaaactttgaactcaaaattaaaagtattaattcaaaactttaaaaacctctagccaaattttaaaattttcaattcaaaatttcaaactttcagcttcaaattctactcatattttaaaactttcaaaataatttattttttcgtttttctataatagttaaataaaacgctaagtatactaggctaattagtgttctcgatatctccaactacaaaaataaataatttattatattattaagac

SEQ ID NO: 67342 - DNA, 2007 bp, Oryza sativa
atggttgagggtaaaatagggagaaatttgaatgagatatgattgattgggcaattagtactctagaattacaattatgtatgtatatatatatatatatatatatatatatatatatatatatatatatatatatatatatccctattctttagaaagtggcatatatatgtctatttttactaccttttctctgtgtgtcgggcctagctgccggcccatcgtgccgggccgacccaacatgccggtggggggggggggggggcaggcatggcccggcggtcaggccgggtcgtgcttgggccaggccaaaatgccgtgccatgggccgggccatcgggcctcgggccttttggccatctgtaatgtatatctaatcatcagccctcacatcattttcacaatattttaacaaatatgtctatcatttgtttgttttatgataagtattgataaaccctcatgtttcattattttcttttccttttactcctagctcgatcatcgaaaaaaatatattaaaaattgcttagtagttgccgtagcaaagcgcgtgaaatcacctagttagataaaatgttaagacaacttaaaagcaccattaaacttgagtcgtgttgtttcaacaaatttaattatatagagtagaacatcctattatcgatgggttgtaccataatggtatttgtatagtatgcgagacattgataccaagttatacgtagtcgtaaaaagatgggagttgtggatttttatactggttcaggctctaagatgggtaatagtcctaatccagtttgataccagcgatcaaccgaaaccaatgaaagagaaaactgtaaatttaccactgatttgaatcgttattttaagactgtcgctagtaaaagattaaaaaataacactagaagtctagaaccatcgttcaagtgatatcatcgcaaatttgagaaaactagcggtaaaattacaaatgcccaatggaagacaatggaatagatcaccgccccgcttgattcacccgtccgatccaaatccaacggtcatccttccatctcccccatccccacgcctcctctccttccacgagtcgccgacgaggcgaccacgccatctccatctcctccacgtctcgtcgccatctcctcatgcctacccactgctagggtttgcccctaagccccccaccctctccgccatggctctccctctccacgacgccaccacctccccctccgaccccgacgacctcggcggcggcggcgaggaggaggaggagaggctcgcctcgaagccgctgctctcgtccccgtccacctatccttccgcggggacggaggagggcgtcgaggagctggagctcgaccggaggtacgcgccgtacgcgaggcgggacgcgtacggggcgatgggccggggccccctgggcgcggcgggggcggggcggctggcggtgggcgccgccgtgctcttcccgctccggctcgccgcgggcgtgctcgtgctcgtcgcctactacctcgtgtgccgcgtgtgcacgctgcgtgtggaggaggaggagcgcgagggtggcggtggcggcgcggctggagaagtggagggggacgggtacgcgcggctcgaggggtggaggcgtgagggcgtcgtgcggtgcggccgcgcgctcgcgcgcgccatgctgttcgtcttcggcttctactggatccgcgagtacgactgccgcttccctgatgctgaggtatgtagtccttgatgattctacttctccacgggacgcctcctccgagttttgtgtttaccgttgcttgcttcatatctcagtagattgatattgtgaccaattttgtttacaaaaaatgataatatgtcacttcttaggtagcagcgcctaatggctggttggattatgaatgtcgattttgtactctggctgttgaaattggaaatacatattagagccgttctgcaatttactttatatctactgggtgagggttgggtaatgct

SEQ ID NO: 67343 - DNA, 977 bp, Oryza sativa
acatatccaacacaatttaacatttttactgaaaggcaaacaagaatgtagaactatggtatatgatctgaaagtatatttaatacatcactctctaaattgcttcactttttatgtaattattttcttatgtatcatatgtaaatactgggctgttgcattcttctattacagaaggcacaactacaaatggtgattatctcctccctttcaagacaggagcatttcttgcaaaagcaccagtgaagccagtcattttaagatatccttacaagagatttagtccagcatgggattcgatgtctggggtgagtatcaatgacttttatatctttttattcatatacccttaaagctggcaagtgtttggcttgaaggccatgcaaggcagtgtctgccttgccaaattttacttctttggcttgtatttggccccacttggtttatcgtcaaattcttctaaggtttcttactttctttagcattggctctacttcattctcttttaaatacttggtaatgattatccagtgctatgcgccaagccatctatgtgctttttagaactttgtgagtttgatgtcatttttactaatcatatgctgaacaatttcaacttgtcgctccttcatctgtttaacttatctatatctcatgggaaacttgtatctgttcaaccttactgaatctcatgaaaaattttcaggctcggcatgtatttctgctcctttgtcaatttgtaaataaccttgaggtgatccatttgcctgtgtattacccatctgagcaagagaaggaagatcctaagctgtacgcaaataatgtacggaaattgatggcagtggaggtatatacatttatctttcaaaatcttaaaaatggttttcaccatccacattttctttataatccatttgtatcacctgaaatcttattccattctaactaatattacatttttatttttgttctcaggg

SEQ ID NO: 67344 - DNA, 1619 bp, Oryza sativa
aaattcaatttttggcttactacggtccaataaatccacttggatcgacttccattttatctatatttaacaaatgatacataaaataaaataaagttgaccgaagggagtacttatgccatataacaacaaaaagaaaaaaaatggcaagaaacattcaggataaaaacacagagcaatgataaaaataataaggaaaaatttaataaagaatgttgtgacttagcggttttagctgtagaacatcgtacaaaagtagcttttggaagaaaatactctacaaacgtaaaaattaactcatggatgccgtacctattaaaatattgatttctaatttgatgggagagaaacaatagttcacaactttcacattgttcctctcccctatttaatcataaatcacctttatagtgtttttttctaaagtcacttgtgtaatgtcgtacggtgaagatatcgaagtcatgatgtcatgtactcatgtaccaaattttgccaaatacctatgtttacgaaccaaagtcattgataagagtcacgtacgtgtaccaactacttaggcacttgggtagtacaaacaagacaaaattttgagctattttcaagtacttggacaatctacctatatattatgtccgattttccaatctgtccccacaaatcgagagaagggggagagatcagtacaagccgcaccatggcgaaacaaagcaacataattcttcgtgcttatcttttcctctctcgctcgctgtggatagcgaaagaaaacgaaacgaggaaaagaaaaataaaaaatggtccccgcgagcccatctgggccgtccggtcgattccgcctcgtccccgatgcacggctgccgttccaccacgtcaccccccgggtggtaagcggcgaccagacaccgccgtgggcccccacgtcccgccatcgatgacaccggggacccaccgcgcggtggtcccacctgacagtgacgtggtcgggtgacggggttcgttgagtcaaaaacatgtggcctaactaataagctggtaaagttctacacgtacacgtaaacgaggactacgtgtcaatgactcgtgggccccacggccttggctggtgaccacgaatccgctcgggtccacgcttgtggctgacatcggggccccgcacgtgagccgccgcgccgcacgtgcacgacgggcgagaaagtcttcacccaaccccactgacacgtggaccctcggaatcattcccggtcccaccgtcagtgagagggggacgccccacgtgggccccacgcctccccgaggaggaggaggagaagcatatgagagagaagagagaagggcaggtgaggtgaggcgaggcgaggatgtcgtgacgacggaaaaacggagcagccgaggcgaggaagccgccaccgccaccgccgcgaccccaatgcgcgcgcctcccgccgcctcagatccccacccctaaccctagcctccgcctccgcccccgccctcgggccgcctcctgctgccgcgacgagcgcgccacggccgtcgcgggcgaccccccggaggcggatgcgatcgggcgccctcgcgtagcgcccccgggcttcaccttctcctaggggtagggg

SEQ ID NO: 67345 - DNA, 2067 bp, Oryza sativa
gcttgatgaagcatggtgagcacataggagtttgagcacttaaagtcagtgcatatagtggtcagaatatacagtggatgcatcatgcatgcaggggaatgatggtaaaccggtgcagattttgtgcctttctctttgtgtagctttactcggacacttccaggattcagggagttgagaaaatacttgtcggcaacgaaagatctgctctctgcttttagatgtcgtaacggtttcggattgcttgtttggacggttctgttatctgaggcttttgattggtctctcgttgttgttttgcgcaccttgaatctatcagtacctccaatcaaagtggggctgggagcttcacatgtgttgagcggaattgttgggaacttatgagatcgtgcacattgagaatggaaggaaagcatgcagcgtgctatttgctgttgcatgaattcgttgatgtatgataaaagcattagcatacatgaacatgtgaaaaaagccaacagactttgtgatgtccatgggtgtagtatagtgtgggtaatacttccaagcctggatttctgatgttattggtacacatttgctgaacctaaattgcctggaacatcagctgacgtacatgctttgaattcaaaaaatgttttagctgcattcatggatgctggcatatgtgtggcccgttatgctctgaagaatgccagcaggtcatcctatgtacgtggccaacagcattggtgcattgataatgcacttacttcgtactttttactgttgaatttgcatctttgtcaatagaagtttgatgagtagcatattttctgaaatgcttatgtctggactaaattgttttctactataccaagattcttcagaagctaaggtttattacatcagttctttgttctatcattactaggtagtgtaataattggaagcttacaacagattgctcagagggaaggttttcggggaatgtatcgtggtttatctccaactattctggcactcttgcctaactgggcggttagtctttacccttacattatagctccacttactccattgatgagatgtttttaaattctatgtaaaaagcaacgatgctaatgataatgctataagttgatctgcatgcaaacccatgtatggcaccgagtagagtagtacactacactatagatgaatcaagtgtctatgatctattgtggagctaatagtatccttgtggatttccaggtctattttactgtgtatgagcagcttaaaagcttgctttcttccaatggttagtgttttaccctgcatatgacttacttgacagcatatcatttgtcagttcttatgtggtatcgtacattcattttgcagatagaagtcatcacctgtccttaggggcaaatgttattgctgcatcatgtgctggaggtgcaactactattgcaacaaatccactttgggttgtgaagacaagatttcaggtatccttggaccacaacttgtctggaccagtagtcgatccaagacgcctgatagcataattgcaatttcaaaatgctgcataccaaatattttgtctggcctatattaggcaagtgtttaaaacctgtaagcaattcccatttctttcctaatgttgactgatggtctttacacaggctgaatgcccatttggaatggagctatcattaattataatcacttataaatatgctgaatttcttttagatcttttacctgtccatactaagcagtcaacatctacatgctatactcagacaaattgattcaaagattttattttgagtcatatcatcatctgtatccttttcccttttgtagacccaagggatacgagctggggtgatcccgtacaaaggtacacttgctgctttgaagagaatagcacatgaagaaggcattcgtggactgtacaggtagctttccatggaagtccacagatgcaagattttacaccgtttgatgataatatgttttgtgcgctggctgatatttttctttttcttttttataaagtggacttgtccctgccttggctggtatcagtcatgt

SEQ ID NO: 67346 - DNA, 1073 bp, Oryza sativa
gcgcccctctacctactctccaccggggaaaggggggaaaagaccccacttcacctttttggccttcaagacgtgccttctctcggaagctaagccataaccgatccttgagcggaacccagcgccgtcccccgcctgacacggtggtcagcccggtcattccctcataaatgatcgaagacatgcaacagcccttcctcgagcagcactcggatgtgacgggtcacacctacccccattccgccggggtcaagggtgacgtgatgatatgattaccctatccatcggatgtgacggaaacgggccggtcacagaccggtcacatccgactggcaggggttagccagacgcaccacacgtctgccgcgagggacagttggggtgctgtgcatttacggctgttcagcctgtgctcccctctgccgcgtggcggccaggcgagggcctcggggcgaaggtgcgatagggcttgagggggcgatgtcataccccgagggggcgacgtcgtaccccgagggggcgacgtcgtaccccgaggccccccccgctgcttctatgatacgcgtggcgtgtgagtggggccatccggccaagccacgtggccagaggaagagtaattctcctctacctcacatacccccgggcccatatctccgatagagggagtatttctttttatgacggatggtggcctacgtaacatcaatactttaaagaaaaaatattaacaaactcggttttagagattgtgtcgacaacaatctccccagaccgcccgcaaccactaattgccacactatgcaccgccatcaccgttctttcttcatgagccaccattgttcctaggggtgggtaaaaaaaagactgaaccgaaaagatcgagactgagaccgaattttgtttggtcaattcggttagtctcctcagttaaccgaatagaccgaattaacaagaaatgtctaaatgcaacctacaatccactaaattcaataggattaaactctaattttcacatccctacttcttcaaggcatgcaacctaataagagtttttattcatacgtgtacaacat

SEQ ID NO: 67347 - DNA, 1185 bp, Oryza sativa
tataatactcccttcgttccaaaatataaaagattttgggtggatgtgacatatcctagtactacgactttgaacatgctacattcattcaaaatcccttatattttgtgacggagggagtataataggttatacttgcattggttgcttactttttaattgacagcctacttgatatagctagttagtaccaatctatactgcatccctgtagcctgtacatgttgatttatgcagagatgaaagctcacagaggtacagattgagcaggatcactgatgattgatgaaacaaccaacctacctgatctgatacacccatctaaactaaaagagcattactaatatttgtaataatatttcttcctacatatccacaatgactctcatttggatgttaattaaccaaacaatagatctctcagcctgccattaggcactgaaaatgttgcagattcatctcctcctgacacatgtagtgtgtggccaatactgacaatgactgtcaggtaacaaatcagctcaaacatctgtaatcacaattctgacagtgactaagcaacatttaaagagctcacacattattagcactaattaattttatttatcctaaaaaaaagtgcagtaattagctagcaaatccagcctatataatccccagccaaaactgatcatatcctccaagcttgaacgccaagatcgagatcgccggagatgaaggcgccgccgccgccgtcgccggtggccaagagggcgcgcgtctcgccgttcgtcttcctgctcgtgctcttcctcctcctcttctccttcctctacggcgaagacctcaaggagctcctcggcagccaagctcaagcgcggccgagcctccacttcaatgccgccgccgccggtgatgggatcgagctgccggccgccacggcggcgacgaccggtaatgtcaccacgcatgcatggtgcatctcgtcgcagttgatagctagctcgaatttgttttgacgtgttgtgcgatgggagcagaggggaggacgacgacgaggaggtggcgggggcggctgccgttcgcggcgaacggcgacggcgaggaggaggaggaggagtgtgacgtgttctcggggaggtgggtgcgcgacgaggcggcgcggccgctgtaccgggaggcggactgcccctacatcccggcgca

SEQ ID NO: 67348 - DNA, 2926 bp, Oryza sativa
taagtaatgcatccgcacttcatcgtcatcaaatgataaatacaacagagcaaaaatgacccattttagttttgttctgtcccgggccaccaaaacctcaggacggccctatgcatatagatgcacgaatgcgagtgagttcttattccttcagtaacctaagctagctactagttcacttgatgatattgaaatcatggtacctagctagtaactcgttattactagctcctataataatgtataagtatgtatattaattatttctctatgccatttcattaattaattttgttgtccgtctatatctccggatcatcgtcgccggcggccttgtgcctctcctgcttcactcctgccgccttcagctgcagctcctgtccttttccccacaggaacgcgtagagccccacaatgatcagcagtgccccgatcacgctacacaaaaatagttaagaaaaaaaaagtctcagattaaacacgggtattcatatattttccgtatttcctaccctacacttagtaacaagtaatatacatgacatatatatagctagcagcgagagtaatatatatgctacgtagtatagggaatcgaggtacactcagtgtttaggtgttacttttgtaataattggctgtaactccgatgagcaaaggccgggatgttttattccattatctaaaaaaatagggaattgagctatatatatatatatatatatatatatatatatatatatatatatatatatataaaattgcccaaactcacttttgaggggaaaacactccataaacatgataatttggcagtagacaccgcgccgattaaaataataattttcgattaaagaggagggagaaatcgcgtgaaatttctaaaatacccttgggcccacaagccatatcttccatctctcttctctctatccctatccgacacggctgaggggatgatggtggccggccgacgactcctcttcacgtgtgcggctagccgggaactcctctccctgcgtggcgctagccggcgaggtccttcccccgcgtgtggccagccgacgactcctctccccgggcgcgaccggctatcgaacaactatccccccccccggcgcacggctggccagcgagctcctctcccgcgcgcaccgaccagaacgaggaccaggatctccccgcgcacacggccggtcgacgagctcccccccacctcgccgaaacccacaggacgccccaccgctccgcgccaccagatcggcaagcgtgacggctcgtcgtcttcttccctccattaaatcggcagatcaactcatcgtctgcatttctcagttctccaaccaatttcccgattcatcgatctcatcgttcgttcgctctagctatcgagagtgatggtgtggtctgttcccgatgatggtgctgctgccgaccatgctgctgctgcggctgaggctcccgggcgacggatcgtggtggccgtggacgagagcgaggagagcacgcacgcgctcacctggtgcctcgccaaacgtcgtctcctcctccagcggtgacacgctcgtgctgctccacgctcgccgcccccgccccgtctacgccaccatggacagctcaggtacctcaatcgaaatcactggacacgcttttgtggtctctgctcctaattcatcaagccaacacctgggttgttgttgcagggtacatgatgacctcggacgtgatggcgagcatggacaagtacgccgccgtctccttccaggtgcgacagacatggggcggcgccggcgattgcaacggcatcggccatggaagtgtgggaggaggggatagggagatggaagatatgacatgtgggcccaaggacattttagaactttcacgcgctttctctctcctctttagccagaaattattattttaattatcgcggtgtccaccagcaaattaccacgtttatgaagtgttttcctccaaaagtgagtttgggtagtgtcctagggctaaaaccacatataaacagtgtcctgtagcaaaatttgccacatatatatgaccatcaagataatgagtaatattggcggctttgctttagtcgccaagaaaattaactggctgccaaaaaaattatgttttcttgtagttatatactcccttcgtctctaaatatttgacatcgttgattttttagcatatgtttgaccgttcgtcttattcaattttttttgaaataggtaaaactatatgtatatataaaagtatatttaacaatgaatcaaatgatagggaaaatattaataattacttaaattgttttgaataagatgaacggtcaaacacgtttaaaaaagtcaacggcgttaaatatttagggacggagggagtactagcttatgatagttataccttcctagatagatgtttgcgccgagcaacagtgagtccatgacggtggtgatgatgagcgagagcgagttgaacatggaagggtagatcggcccgcgacgcgtgattgcccacgagatgagcacgaaggtgataccggtgttgaacaccccctgccacaccacgaattacatgatacatcgataaatttctttagataacggaaaattcattccgacctttactttaagaaagctatgaccaattattattatgattcattatctaaaaattattattattacgatttaagtcaacaaaatgactatgaattatcgatataatgcaactaaggcatatactccctccgaaaaaaaaaatctaattgtaggatgaatatggacacatatatatcctataattagatttttatttttttggagtgagggagcatatacataccgagtaggcgacggcgagaaggcgcaggtcccagctgagcttccactccgaccagtcgccggtggtcaagacgccg

SEQ ID NO: 67349 - DNA, 2761 bp, Oryza sativa
aaattaatttgcagtatagctagtgaacattacttggatatagatatttttgcaaaacattttttgtgtgtgccaaactatcatatatatatatatatatataggaagaaattagatcctatatacagctatgatcaaacatgcatttccatatgccaaaagactcaaatcgattaattaataatgctaattaacctgcacgatgaaccacaaggcgtagctcaggcagctgccgcacagtagcagtgtgccggagatcgtcgtgccggcggggctcgacgacgatgacgacggcggcgccaccgcggcggcatgggaggcgcagcaggtgggtgggccagaggtgcagcagctgacctctgaagaggctgacgaccatcgtgccgctcacggacaggaccgtgcccaggaccttcatcttgccggcgcagcttgctatcgccagcttctcagcacttgatgaaaaagaaaaaaaaaggatgaaaaattgcaaatatatgttgaatgtcaccatatattgacatgacaactgttgattaattattttgtctattagtaccttgtatatggtgagtattaattgtatattttagtattaatatatatcacgaggtaaatttaaaaagtatatatgatgtcatacttctatatatagtttatatatgtgtgttgttaagttttttttaaaaaaattatatattgtgcatagttaaaagaaatgtaccggaaaataacggcgataatgaaagtgacgatagggatgagattcagaaagttggcggaataggcggcgttcgtgtcacgcagaccgtagtagtacatccctgttgccagtagaactctacaaattgtcaaaaggttgttagtttcaaaatgttagtttcaaaacatagaggaaattatattgtgaggtttggttttttaatttcttaaataaaagggcaattcacttttggtttttgctacaaaaggagtcgctaagggaacagacaaggtggcggcatatagcattcggagacgatggtgatggaaggatatttcaagcatgcatggatgcaattaatagcttttgtgctttagatggttttcattcaagcttggagtagcattggtatcattcaagcttggagtagcattggtatagcatatggctaaaacagtaaaacttttcctcccaataaaaaagaggtaaaactgtgtgatattagtagtggacggttgaatgtaggccttattatgcagaggctagaataaaaaaaaaatctctgtctgaaaaagttataatttaatgcaaattttgcgatcatatataagagaataatgttgagcatgacaagtaaaaacttagccttgtcgttgagtataacagtgctaacccgaacgttgcgttgatcgaaatccagccacacactacggcgttcatctttttcatcattcctctgaaacatacagaagaaggaagcacaggtagaaaaccagaaatacaagcacataaatctataaacgagtagcatacatttttccacacaccaatgcattgtacatcgctacatatatatttgtccaatactcaccccagaaataaacaagtgtggtcatttttaagtattgcttccatacatcgtcaaaactaataaatttctattgcatcatggtatatctttagaagccataaagttcatctaaatttgaggcatgtcatctttagatgatataaatatatataatgtgcctggtttatagttagttctagactccattatcaaaagttctacaagatgagtatacgttaattacatttagaataactttagatgcatatgtcctctatatctatatatacttcccctttaatttctccatatttatttatctatcaccatttggctagatgtagaaatcaaacggcctgatgcgtcacgagcttttgcgtgtttacatattattgatgcaattaagagcaaaagaggtgatcatcaagaggacggcccatggtttcactccacctacatatgcggcgaccatacaatgcagggctgaattcaagtcattttttgtctctttctaacttagtgtttctgttgagtgtttgacacatgcagtgagatgatatttgtccgtatccagccaagtcaattggctcttttcttttcttgcaatttttctttctttaggctgtttttgacacacgaaacgataggatgtattagcacataattaattatgtattagtaaaaaacttaaaaattacattaatatatttttaaagcaatttttctataaaaaatacaatgtttaaccgtttgggaagtgtgcatacaaaaagaagaaagtgtgagttggcaatatagacataagaatacaaccttaaaatcgtcaactagttgggtgggcggctaaaaaggtagcctccagctacgaatgctctcgaactttcctcgactggtagtatacgtacaaagaaacatatatagacaaagataatagcgtaagccatgtatagtattactctagtagtgcaattaaatatatttattatttctttttggaatgaatcaattaattagaaggcatgaatgctatactatgtctttgctcacggctggcactgagatttcgcacgtttcccacgagtttccaaagcacctctctctttaattctcaatttctcatatagtaaatgaattggatcaggcaaataaaatcgtcgttcgatccagcgtggattagatttttttttaaaaaaatggtttgatttctt

SEQ ID NO: 67350 - DNA, 3293 bp, Oryza sativa
ttattaatccaagtgataatatttcagcaatgtgtactaatttatatgtacacgtatgatactggattattggtggtaattaacaaagaagaaagagagagagagagagagagagagagagagagagagagagagagagataatgtggcatttactggacctttcgaagaggacggcgagcggcgcgacggcggcagcgccgacgaggttgcggtagacgaggaggacgagcggccgcgcggcgccggcgccgagcgcgagctccgacaggagcagcgtcaccgcggtgaacacctgcaccatcaccatccccaccggcagcagcaccgccgccgcgcccaccgccgccgcctgctcctcctcctcccgctgctgctctactaccgccgcctcctgctcggccacgccgaccaccacgacggcggcctctcccgtcctcgccggcgacgccatgtatattttgctttgctagctatagctagagctaggggcacgatcgatcgatcgatcgacgcgatacgaaatggaaattaagaagaaaagtgagacgcgacgagtcgatcgaggatgggagtgtgcgagaggcgagcgattgattgagcttgcggtggtataaatagcggggggagagatcgagagagagagagatgatatatggggcgcagaaacggacgaaggtagggatagatgggttggtggctggaattgacgtggcggtatatcagtatcagtgtgtgcatgcggcatgcattctcccatcggccggtcaacttcaactccacctgtccatcagtggaactggaagtgcgtgtggaatgcaaccggctaccacttacataccattgtcagcattgttaccatgtgtctagtgtgtaacgtaaacttcattcgcagattgcagaagtcaacatttgtcccgaaagcaaccatcaggcccttgttcggttacacagggattcattccgggccggttatgataaatataacaagaaatttataatagatacaacaagagaccaggaatatttattccgggtcaggaactaatttacttatattaggtataacaaaacatccggattagttccacacctcttgactagtggattgattccggtctattattgtccctatcatgagtaaattggttcccggcccggaataaatctcggtaaatcgttgtatatatcctaaatttcttactatacttgtcattctcggcccggattgaatccttgtgtaaccgaacaaggcctaagagtaaattttatagaatccaaactattatatggtccaagtttcttaaagccgtataaactttggccgatgacacataacctcaagtattatggttataacgttttacaaaaccacattactaataattttgagtttggtataccatgtacacttttcagttctacaatcacatctcaaatttatgagcattttattcattatataaatgttacattcatttttttatttcaatacaatagtatgtcaaaatagttaacggtgtggtttgtgaaactttaggagtatataatacctatagtttgtgccacatgtcaagatacctgtggttttgtgcaacttggactataataggtgtgtttaatgaaatttattgtatctttaatttatacatagtattcttctaccatgcttggtccataaatcaagaagtttaattttatccttcaatactttacctacttaaccaccaatactatatattttcctattaataagagactctttggttattttccttcctcgccgaagttctcttaggattctaatattcaacttacttacttcattcaaaacataagcactttgaggttttgcgcatggattatgaaagtaggaagatttgaatgaggaatagtatgattggttggtatgaaaaaatagacaaataaattaaatagatgatggttgtgattggtttccagttaaaaattcgcattgacaaatatttgattatacagtagccaaattgatacgaaattaaaataagagtataatgcattggcagcccttaattaaacttatcacgtcatgttatctaggttcttaaactttgaaaatgcacatctaaatcccaagactatatcatataggttcaaaactatcacatacccccttcgagtgctcgtgtggctaacacttcactcatttaatgacactcaatatgtgaacgtcgacgtcatgcggatactcaaaggggcatatcccagccactaatactggagaggactatggatcggacgtccaatgttttgcataacgtcggacagtgttgcatgacatttgtttcaaagtgtttcacatgtttcatcttttgatgggaaaatatttcaacacaatatggagaaaaaatgattcatcatatgaaaaaaatgtttcaactgttgaaaaaacatgtttcaacataaaaaaagatatatgtttcaacaattttaaattatgatacacaatccaatcaatactgaaacattttcttacaacaaatgaaacaccaattttgacctactgaaacatgcagatgattaaaaaaacaaccactgcaacattttagtctaaactaatgaaacatccaatatgttaagctgaaacatataaaaagaaaaaagcagcctagatatatttattcttcttctccagtggtaggtaggccaccatgttgatgccgggatcgatgccaccccccactttgcttacctatactccatgaagactctctattgccttctcctattgttgacgaagatgaggccgagctcaccacgccattgtcaagcaagctaacgctgagctgctcccttcatggccggtgtccactcccctggatccggtgccccttagatcaacgtaatagctaattcgacggggagacgacgctagtgagatgccagtgggtggtggatgtcaatacgccgccctaccgtgtcccggctatgcggcggacaacaagatgagttgtcgcccttgctggccatcggcgtaggtctctctatagctagttgctccggtgaatatggggacagaagagaggaaaatgaatggttggaaatgaggataaggttgactgccagggaaaaaagatggagagagtggttaggtgggaccaactaggcacgcgtcatcgaactcaaagggcgcatccttggctagtagattggtcagaggtctgacgattgtagaatagtcctcgatgaaccttctataaaagctggcatgtcccaagaagctgcggattcctttgatgttcacgggaggaggaa

SEQ ID NO: 67351 - DNA, 8280 bp, Oryza sativa
  unsure (1)..(8280): unsure at all n locations
tgtatggtacgggatagataatcccggcatgcaggagtttcaagacttctttctttacaacttctcgcattgcattattgagccgtcgttgaggttccctagagggagtactctcggggtcaataggaatacgatggatgcagagcacgggattaatccccttaagatcttgaagcgagtagccaagaacagaacaatgcttttccaacacggcgagaagacgttgagtctcgtcttcaaagagcttgtcactgattatgacaggggcctctctgtcatggtgtaagaaagcataatgtaggcttgggggtagaggtttaagctcaagcggaggccaaggtggtggttccatgatcggcaggtcgagagtctcaccgggatccgcttcctctttgatgaaatcagggacctcatcttccagaagggcctcgggagactcgtgagggggaactgcaataacctcttccgttgactcaatttctggcagagggtctgtcaagacgatccttgcccgtgagaatggaattgaaaattcagtctctcccagtgttattttgaggctatctaatcggggtgtgttgatgagaagttgctcaattggcagcccgattaggatgtcaaaatcttggatttcaaagacgtggaaatccaagatcgcctccttgtcttcaaagcagacaggcacatcttgcataatcccaaatcttttgatgatatttccgcttggatgtttgaagaatttgtttgtcggggtcactgccttatcgcttaaataagcaaatgcaaaagacccggaaacgaggttggccccgacagttggactgtagagaatactngacgtcgttcccnnttccagatggcaagnngaatgattcgggngagnncggtatttaattcccgnaanattntancctntncgngnnatgnananagnncntccntngncnncntncnccntntnannacncantntncantncgncntnncatntantnnggttgnnnttaacntnncccggnnnatagtttnnnctcgtaggnannacctgagttccataggatcgggaggtggcaaaggaacgagtggtttcctcttgctaaaatagttcaaggtattgccatagtcttcatcaaaaccgtccttgaacaggattgtggcacaatccggagtctgaatttcttcattctcgacggacggctgctcaggaaccttctcatcaatcgagctagcgaaagtggatggttcagcaaggggctcgatcgttagaggttcctctatcttggacacggatgcctccggctggggttcattgggttgcgtcatgaaggaagtattttctagaatgcggtccaaaattttctttccttctgacggtgttttgtgcatgaacgattgacggagcgtggggctcctcaccgggagaccgcgcaggcccccctttgccggttcggccgggggcgctaagtgaggttcttcgccctcgatcaatctggagaatgttcgcgagagagcaagtgcacgagacacgggcgatgtagacaggttcgggccgctgagaagcgtaataccctactcttgtgttctggtggatctgtgtgtgaaggagttatagagagccggagagctagagagttcaggctccagaacccctctagcctcctttttttctttctcccccctttttggtgggcaaggtcctccttttatatggtgggccggaaccttgggggccaacggacgttccgaaggctcgccacaaaggctcgacagccggcaccgccaaccggggacacggggggctggcccccgtgcccggaccgaagtggcgctccggacgaggaagcgccctccgatgcgtgggcagcacggcgatcattgcgccggccctcgatattgaagcgggcatctggccccctacgcacatcttcttgggttggaggcgttgacgagggaatggcggacgaacggcgggtaacggccgccgctcgccgcgccctccgcctcgacgacacggagccagcagtagcaacgccagtggccttggtggcggaggaccgccagccggcgcctaggcgctgctgcgccgtcatgaccaaattggccacgtcatctagccaacgttgggttggagtctctggatcagggatgacgggcgggtgacgcaggagcgcgcccgcagcctggagcgcgccctggggcgtgctgccatcaccgtagatgaggagacgacgctccccgtctcgccgtccttctccatcgcccgcgtgcggcgaagtcgcggatctttcgacctcctcgagcgcctcctcccgcccaagacttcggcgagagggggacagtggagtacgagctcgacggcgcgggttctgctccccgtcgtcaccgctagcgctcggagagagattgtgcgccattgcctgttcggccatggggctgagcgggagaagcttggcgcacacgaaagagaacgagggcttagaaagacacacgcgccccctacctggcgcgccagatgacggagcgtggggctcctcaccgggagaccgcgcaggcccccctttgccggttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggagttacagagagccggagagccagagagttcaggctccagaacccctctagcctcctttttttctttctcccccctttttggtgggcaaggtcctccttttatatctcaaggggataccacatgcaccacttctacctacttttcttctgggtggggacctaccctatcttgaccaaaacttggcttgcaccttcgcctggaagctaaatcacaacttgtccttgagtgaggctcagcgccgtcactcgcctgacaccggggatctccttgttactccctcattaatgggcgaagatttgccatggctgctttccaaatgaccatccgatgagatgggtcatacctacctccactccaccggaggcagatgcatcgtgggagcacggttgtctgccgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccgacgggacggggcgaggcgtgtgtcaggccgcctgttgccacctaacccgtgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccactcacgtggcgccaaacccacagggggtcggggcgccccagccctcggggccgaaacgggagcggcccgacccctcggggagacagagggaggggcggccacatcactctcgggcccgaccccccccgagggggtcaggccacatgggtgactgcagctgccccaaacctctagtcaagatacccccggtcccatgtcaccgacagtagcccccggcgttacgccagggcgatcgcccccctcgagggaagcgctcgggcgtgacgccactccttagacctggtgacagatggggccggtctctacaggcggcagaaacccagcggtcgcaaatcgcgcacatcggcaaggaaaaaccgaccgacaataatgagcggctttcttcaagaccgctacattacttaagtagcgcgcgaaccgggacgagccggttcgtttcgcctggagatgtgatgacggtgcatcggtcggcgagcgtagttaacgcgcgcacgatatgtcccatctcgactgccacggccgcacatccgcctcgtgcgccgcaaacgggcgagcgggattagtggaggcgtgggcgcgagagacgagggggcgaggtagtgggcgcggggatcgaggagccgggcatagcgttggcaagggtactaagacatcaaggaagggatttgtttccttcctctcgtcactcttccctttgcctttgccacttgtgctctgactctccgtttccggcgccctacccttgccatactcgctcgctctcaagctcctcctccgccggcgtcatggcacggggctccgcaccgctcgagggtagcgtgctgccgccttcccgcatcgtgagcgagaggcaggccgggctgccgcgccgattcatgccggaatctgccaccggccgggaggtggtcgcgctgggcgagggacgcccggcgccgcattacccggggcggtccgtcttcttcctctctttcgcaatggcagggctggtcccgccattctcttctttcttcatggatgttctggagctttatgatctccagatggcgcacctcacccccaacgcggtaatgacgttggccatcttcgcgcacctatgcgagatgttcatcagggtgcgcccatctctccggctgttccggtggttcttcaccgtacagccggtgtcgccaccgtcggtagtcggtggctgctacttccagccgcgggggccggtgctgaaccgctacattccctgcgtccttcgcaagaagtgggacgactggaagagcgactggttctacacccctctcccctctgaaccgctacgacgccgttcttgaccgcctggcgggtctgcgatcccaggggctcacgggggccatggtgttcggcgactaccttcgtcgccggatcgcgccactccagcggcgcgcccggggcgcctgggagtacaccaggtccgaggactacatgaggacccaccaggggggcagatgggactgggcccctgaggacttcaagatggtggtccaacgggtgctgaatctcagctccgtggaggcatccctcatcccccaaggtgtcctccccctctgcagcgatccagagcgcgccaacatcctgaccatcatgcaggcggtcggggcgtcaggggagcgggctcctcgaggccacgatggcgcgggcgggagccgcaggggggaacaatctaccccgggagggggtcgtgcttctgggccccgtgacgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgagggggagcgaaaaaagaagcggctccgcaagatggggggaccaaaccatgccggggaaacctcatctcccccccaaggtggtcgtttagccgacctcctcgcaggttcgtccccgcgcccactgtggccgtattcattctcccaaggcgagttttcacttacccgtttctttttgtcttctggtttttcttccgctttcagcgagattccgtcgcgcctccctcaccattccaagtccggccggtctgaggccgaggagacagcaaccgtggaggcccggaggcgggaagctgtccggcgagaagccgcggaccgcctccgggaagctgaggaggctgcccaggaagccgtccgggttcgccaggctgaggaggccgctcgggaggaggccagactccgccgggccgggaagtcagcccgggaggcagaggcgacgcgcgcacgccaggcggcctgccaagcccccgacccgactccgcccgaggcgacgacgacttccgaggccacccacgatgaggccgcgggcgcgccgctcggacccgacccttcgggcgacgttcgggacgagccagcctcgggggacgcccctgagtccggcacgtcgattggcgggccgagccgcacagcgcccacaccgaggcggctctctcctctgccttccgccgccccactgaacacagagcccctcctgcaggccctggccgccgcgaacacgacggtgctggacgggttaggtgcccagatggaggtcttgcaagcagagcgggcggagctcgacgcggcgtgggcgtgcgtcgatgaggggcggcgctcggtggaggccatggtggaggcgggccgcaaggcataccaccggcacgcctcagagctcgaggtccgtcggagggagctggcggagatcgccagggaggtggaggaggagcgggagactgccctcatcgccaccgccgtgctcaacgaggcgcgggacgatctccgccttcaatacgggagccgggtggcggagctagagaagaaactcgacaccgcccggggagtccttgacgccgccactgcacgggaacggcgggcgacggagaacgaggcggcgtcccggcggcgcgaagtggcccttaaggctcgcgccacggcgctggaagagcgcgcccgcgcgagggagagggacctggcggaccgcgagaccgccgtcactatccgggaggcaacggtggcggcgcacgaggccgcctgcgccgaagaggagtccgcactccgcctccgcgaggacgcgctcaccgagcgggagcgagctctcgaggaggccgaggccgcggcgcagcggctggcggacagcctgtccctccgcgaggcagcacgggaggagcaggcgcgccgtaatctggaaggcgccagcgccgagagggccgcactggatcagcgggccgctgagctcgaggcgcgggcgaaggagctggacgggagggcgcgcagcggcggggcggccgcgggcgacggcgatctagccgcccgcctcgcagctgccgaacacaccatcgccgatctgcagggcgcgctggactcgtccgccggggaggtcgaggccctccgcttggcgggcgaggtagggcccggcatgcttcgggacgccgtctcccatctagaccgcgccgggcggcaagcggccctctggggcgagcggaccgcgaagtacgccgccaaccaggggggcctcgcccagcgcctctcagagatggccgggactctccagcgcctccccgaggagctcgaggagacctcgcccggggggcagtggagcttgcactggcaagctaccaggccagggacccggacttctccccgtgggcagcgctggacgagttccctcccggaaccgaggacgatgcgcgcgcgcaggtccgggacgccgccgaccacatcgtccacagcttcgagggtacggcccctcggctcgcgttcgccctcgactccgacgaggagggcggcgacggtggtgtggacgacagcgaccacgaggccggcgacccgggagcctcgaagtgagcccccaggcccccgccaatcttaaatagtttttcctttcttcttccgaggccttcgggcccccttcttgtataaactaatttaatctgcaatcaaataaagaagaaatttctgtgtcaattttatttgttgtgtgtatgagacgaggatggtctgtgccgcggtccttctgtgtcttggcttgaacaagggctcgtgcccaggtcccagcctcaaacggcgcgggtcggggctagtgcctggggagatccacgtgtcgagactagccaggccgggagcgcggtgaccgagggttatggggacccgattgtgggcctttgccgattcccccccggagttcaccacgtcccggggcacggctcggttctgggccccgtttggcgatttccgccggctcgggccaccgagggcagggtcgagcacgagcgtgctaattcaagccaagactcttcaaaaggaaacaatggcacagacacagtccttaggaaatcaaaaaagcttttattgaaatacggaagagaaaaaagataagtatatgcatatgtggtagcccccggccaaccctgcacgcccgaggggggtgcgaggttggccagagcccgagacctgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtga

SEQ ID NO: 67352 - DNA, 5121 bp, Oryza sativa
cctcgcagtacatagtggcccgaggggacctcagggtgacctcggatgggagaactgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttctgcgttggcgcgttccacttggccattgcttctggggtgggcgggagaggcgaagcagagcttaatgcccatgtcttcgcagtagtcaccgaagagctcactagtgaactgggtgccgttatccgtaatgatacggttaggcaccccaaaccgagcagtgatacccctgatgaatttaagtgcggagtgcttatcgatcttgatgaccggataagcctcgggccacttagtgaacttgtcgatagcgacatacagatactcgaacccgcccggggcccgtataaacggacgcaggatatcgagcccccagtcagcaaacggccatgacagaggtatggtctgcagggcctgggccggctgatgggtttgcttggcgtggaactggcacgccctgcactgccggaccaggtcgaccgcatcgttgagagccgtcggccaatagaaaccctggcgaaaggccttgccaaccaaggtgcgtgaggcagagtgggctccgcactcgccttcatggatagcggcaagaagctcgacgccttgttcccgaggaatgcactccaggaggactccgttagccgcgtgccgatagagggtcccttccaccagcacgtagcgcttggagatgcgctggacgcgttcactcccttcgcggtcctcgggtagagtcttatctgcgaggtacgcctggatctcagcgatccaagcaatcaatctaagggagctgggagcgctcccctagggtcccgaggcctggactccgacgggcctcaggggccgttcaggcgcgtccgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcaaaatggcgctccatacgccgcacctggcgcacgtaagcatccatctgcgggtcagagcactggtactccttggagacctggttaacgaccaactgagagtcgcctaacaccaggaggcggcggatccccagtccagccgccactctgagtcccgcaaggagtccctcgtactctgccatattgttggttgcccgaaagtcgaggcggaccaggtatttgaggacatctccgctcggcgaggtcaacgtgacccccgcaccggcgccctgaagagacagggagccgtcgaactgcatcacccaataggcggtgtgaggcagctgcgaagggcccgagctggcctcggggatggagacgggctcgggagccggtgtccactctgccacaaagtcggcgagggcctggctcttgatcgcgtggcgtggttcaaagtgcaaatcgaactcagagagttcgattgcccatttcaccacccgtccagtaccctctcggttatgcaagatttggccgagggggtaggacgtaaccaccgtgacccgatgcgtctggaaataatggcgcaacttcctcgaagccatcagaatagcgtaaagcatcttctgggcctgagggtatcgggtcttggcgtcccggagggcctcactaacaaagtagacgggccgctgcaccttttggcggggccgatcctcttcgccaggggccgcatctccagggcgcttttcgtccgagaggccgcgcggggcgcactcggcttctgtgtcgacgacctcggggtcggaaggcgacaggcgtggccttcccgcagtggccccggggccatcctgggggtcgggggctcctggcaccgtcggacaagcgggcagagggccagctccggtcgtcgggggcctcgggccaccgttcggctcgggggcctctcctccctgctctctcccgggtcgagtcgacatagggtggggatgcgcggagcgagggtcgtcctcgtcgcgctccacgaccaacgccgcgctgaccacctgcggagttgccgccaggtagagtagcaacggctcatctggctccggggcgaccaggactgggggagaactgaggtacgccttcaactgagtgagggcccgttcagcctcctccgtccagataaacggcccgtagcgtttgaggagcttaaataggggtagcgccttctctcccagcctcgatatgaaccgacttagggcggccatacagccagtgacgcattgcacatccctaagcttgctggggggcgcatccgctctatagctcgtatcttctcggggttggcctcaatgcctcgggcagagatcaagaacccgagaagcttgcccacaggcacgccgaacacgcacttgtcggggttcagctttatgcgggcggtgcggagactttcgaaagtttccgctagatccgagagtaaggtctcctggttgcgtgttttcacaaccaagtcatcaacataggcctcaacattacgtcctatttggctacccaaagaaattcgagtagtacgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgtgtggcagggggtaagggtccttaggacatgccttgttaaggtcggtgtagtcgatgcacatccgaagcttgccgttcgccttgggaacgacgaccgggttcgccagccactccggatggatgacctctcggatgaatccggcctccagaagtcgcgccacctcctcgcggatgaaggcttgacgttccggggcctgccgccgcactttctgccggaccggccttgcgcccggccgtacggcgagacggtgctcaatcacctccctggggaccccgggcatgtccgccagtctccaggcgaagacgtcggcgtttgcccgcaggaaggagacgagcgcgtcttcctatttgtcgtccagaagaccaccgattcgtgtggtcttggacgggccgtcgcccagggcaacctgcttgatcgggacctcgtcacacgtgatcatccgctgcctcggggcggctgggacggaggtgctgagcctctcgtcgccacccgcgggcttggatgccgcggcgaggtggtccgcgcgctgctccatgcaagcaagcgcgactttgaggtcaccatggacggtgatggggccaccggggcccgacatcttcatctggagataggcgtagtggaccgccaccatgtacttcaccaacgcaggcctccccaggaccgcgttgtagggcagactgaggtccgccacatcgaagttcacccgctccgtgcggaagttggcggaaccaccgaaggtgaccgggaggtcgatatggcctagcggccaagtgtgccccggcgtcacaccgatgatcggctgggacggccggagcaccatccccggggccttgatggcgtcaaaggcagcggaggaaaggatgttgagggctgcacccccgtcaatgaggacacgccccaacttcacattgcaaacggtgggggaaaccaccatcgcgatctgtcctccccgggcaacgcacggtgggtggtcggtctggtcgaaggtgagggcaacctccgaccaccgcgcccgccgcgtcgcctcatgggtaggggccacggccagaagctctcgcttcatggccttgaggctccggcgagaagcgtgagcacacgctcccccatcaacggtggcgacggtggcctcaggctcctggaaccctaggtcatcgtcgccatcgttgatgtcctcggcgggggccttctgcttggcctcacctcgccggttgccggcgggagccgccggggtattgccctcacggcgctcctgcctcctctcctcctcccacttcctcgtccgctcagccaaacttttgaccgcgcggcagtccacgaggtcgtggagggaggtgttgtgcacggtgcaccacttgccggtcgggcgctccctactgggagcgccggcctccttttttttgtcgctcgcaggcctcccctttcgggtggcccgcgaagcgccctcgacggcgaggacgtgaccctcgtcgtcggaatgggccgacctcttcttcctcctcctgtcccgccgccctgaccgagcagtgggcccgggggcggccggagctgccacaccggaaccggaggagttccaggtccaggcctcctccttgcgagccacacggtccgcgagctgaaaaagctccgcggtggtctggggctccttggaggcgatcttctcgagcatgcggttgtgccgcacgcccccctgaacgcgtagatcaccgcgtgtgcagggatgcacggtatggtgttgcggacttgacaaaaccgctgaatgtacgagcgaagagactcatcgtcccctcgctgtaccgcgtgcaagtccgcttcttcacctgggcgcggatatgtgccctggaagttcatggtgaactgctggcacaaatcctcccaagagtggaccgacgcgggtggcaagttcattagccaaccccgcgcctatcctttcagggccatggggaagaaattcgccgtagacgaggagacgacgctccctgtctcgccgtccttctccatcgcccgcgtgcggcgaagtcgcggatctttcgacctcctcgagcgcctcctcccgcccaagacttcggcgagagggggacagtggagtacgagctcgacggcgcgggttctgctccccatcgtcaccgctagcgctcggagagagattgtgcgccattgcctgttcggccatggggctgagcgggagaagcttggcgcacacgaaagaggacgagggctagaaagacacacgcgccccctacctggcgcgcca

SEQ ID NO: 67353 - DNA, 1883 bp, Oryza sativa
ccgacaacgatcctccagcgattatgtccagatagaatgcagactccttatccaaacccgtatggaaatgttgaagaagcacatacccgggtaaggacagggttggtccagactgcactaaattagtgaatctggaccaggctgcaccaattgattcattttcgatctgcttaaaactgagaatttctactcgtagggcagtaatacgagtaactgggaagaaggtaagacagaatttgtctcacaacttttcccaactaccgtttacacatccaacggtagaggtgtaccattgctttgctctctcttaaagagagaacgggaacaatttccaccgcacagtttcttgtctcatgccacgaatcttaaggcacgagcagacttgttcaaagtctcgcagatgatggtagggattttctagatcaaacccagaaaaaggatttttccctaaccatactgattagttcgggatgaatttcatagccagttgtataaatgggctctgatgaaggaggtggctcatagaattcaccccgaggagcagacagctcaaaaagcggttgctccatggtcgagaagagtttgacaggaatacttctttaggatagcaggggtagatgtagaattaaaaaaacaaaaaggatacgaggatgaataaggtacggaaatgatcagcaaccatttccccggaaacggcgccagaaatgcttgttggtatttcttatggtcacagataaaatttgcaagcgcacagatataccgatgtagcacttcccctacggagtattccaagggtatcgaatccaatggaacgtgtgtgatcagatcttcctccggttcatccaaggacaccaagcaaatgataggccaggatagagaggatttactagtgagaaacagtgtctagggaaagcttaactttaatcctaacgcaatacttcaggcactggcaacccgctgttcccagatgtcgctctactacgtacccggacagggaggacttaagtgatctcgagggctgtcaccacctctacacccacctcaaacgtactgtgggatacgcagtaattactggataacaattacttaaacatcacgtctaagcaattactgtctactttagtgtttataactcaccaaagcaatcactatatttagttgattatagtgaacaataattccgtatgctatttaggaactaaccaagagataattctcacaaaataaatctaaattactcaagaagaatattatattgaattcagagtaaaaaatagaataaaagaaataggagaagattaccgacaactccggaattcttccgactcctactctactctcttccgattgtaatatacaatatagtacaatagagcctcttataatttagctcaagcttggaagtgtgtgtgtgaagtgagagagtgaagcctttatatagaggtaggtatgacggttgtgagaagctgaaatgtccgaactgccccgcaaccgccattaggagatgatcaagaccgtccacgccaaaccccagcctggatggctgagattaggagatgatcaagaccgtccacgccaaaccccagcctggatggctgagattgtggtccggccgaacctgggctgggcccatctggcttggctcttggcccatgttctcccctgatcctcctctattcattcttcggtattttggctgattcactgatgttttgatgaagttcacaacccatccttgcagggatacacatttctcctcactttagtctgattttcctcccaacatcggggtttatcgtctgcatacaaatatataccaacacttgtggaatatgtgagattaagcacatatcactatgttggatgttttattatccgaactt

SEQ ID NO: 67354 - DNA, 1259 bp, Oryza sativa
atagtacaccctccactatattcgagcatcactatgtcaccctccactgtcatggcatgtgagtgcaaatcaacataattttacatgagaaacgttttgtttgtttttattacgaacagagcccaaatattttgatgtgaaaagtacgatagacaaggaaattacatttctgtcttgtgtactagctttttactctatatcatttattgaaaagttatagccgactatcaatgcttatatatttagcggcgctggcaagatataccacaccatcactaaaggcattgtgagtttgtgactaggataccactcaaacattgatataagatcaaaagctttgagatgcttcttctgctgtcttctttcctttccttggtctattcttttcttctttccctagcctacccatatgctgctgttattctgttgaaattcttggtgatgcttcaatgcttaagatcaccttttgtagctcgccttctctttctttctttttttctttctttctttctttctttctttccggcagatttgatgatttgtcagtctccattggacatgaaatgctacactatgctactactggatagagttcctttccatttcaatcaaaactgcaagtacatttcagaattatgataagaaaaaaaagagaatagtacaaaaggtgatggaaagtttgagttcctcctacgtaccagctgatgttaaagtagggttcacaatctcaatgaatttcgatccaatttcatgaattttgatcatctcgagatggttctagatgcgcatcttgttcgaaatttgtcccaatttatatgaaatgcttcaaaattagcgaaaattgatgccttggtggggctcgggtttcacttgccaatcaagatcgtaacccctgtgttagcatgttggcgccaactaaggggtcctggctccttgtgttaggcatcctgcatggcgaatattcatattatagtgtttttcatcttttgttttggttctcttttcatgatcgctaaagaggacaattaaaatccccgcaaaaaaaagaggacaattaaaatattgttttgatttcttttaaaatcaaactttgaaattcattttaaactttaaaaacacttcagtttacagtgtgcagtatgctatagcagaatcaaactctccaatgacaatcgagtacagtacggggttctgattaaaaaaattaggatacaagtatgtttacgggagacttgatttcgctggttgtctgggctgga

SEQ ID NO: 67355 - DNA, 1215 bp, Oryza sativa
atccaggcacgccctagtccctatagtttccgcattcttctgcaaaaaagagcgtcgaaacatgtaaaataactacattatcgactcatcaaagacattttcgagaagcatgcctaagaatagatgaactatcatcacaaaaagcgcgcaggtgcgacctcacgaccagctggggagatggacacgctccacgggctattgtgaagcggtcctctccgccataaatgaaacagatttatggggagccccagccagcatggagttgaaaggatgtagacaagacaccagtgttgagtcattggtgccggtggcaccttggatgcgtgtcgaacatgccctgcaccacctgattaagccaaacgggcagaagcgaggctgtggcattgtttcagacagcccgggttccaccaagcccaccactcgccatgtgttgggatagctggcgcgacccagctgtctcggacagaagcccgggtacacggggtaatgcagatttcaaatctcaatagggttttcttgaagatgtgttaggaaaccagccgacaacgacaagatagctgataagacaagacaaggagtatatttgtaataatgtgagcccctacttggactataaaatgaaggggacaagctacagatggagggctggactctttagatcggtataattcattttgcagcctgaaaaagcctcctttgtaagcagctgatctagggaagacaacgaaaccaacacatgagtagggtattacacctccggatagcctgaacctgtataattcatgtgtcttttgcatggcggggagcttgggccccacagatccgatcttgcttgaatctttttctaagtattgcaccacaaaccccttggttgaatcttcccacttgggggggaggggtctccactcctcgttgtccaaggaatcactcccttgacacctacataccccttaaaagttgcccaagtccttttatgctgctgagttttattcattctcttgcataccctagactttttgcttcgatcccttccataccttttctgttggttgattgttagttgatcattaaattcttataaaaaagtctattttgccatttagtacgaagaaacatgtaattatttatattattggagtatagaaatttactgtatgaaacttttatatttatgagtttgtcatgcgagatattatttacgacaaaatttattta

SEQ ID NO: 67356 - DNA, 807 bp, Oryza sativa
tatgtcaactttttatattaccaaaagaacttgtaaggatatgatcaagatgaaaaataataacaaaaggaaatatcaacatgatatttcaaatatttcaaataacaaaagaacttgtaattccataccctacttgcaacaaaatatttcaaataaatgctcaaacgtcataaataccttagggggctctaataattgtgtcctcaactttgctatttttgctttcagttgtccaagatggtattctgtatgacaaccagaaataaaaattattcccagataacaatatgcaagacatttctcacacagtattgagtatgggtgggaatgtaagagatcagagataatcgttcattagctaaatacaacattgttaatagcaagttcacgttcagatacataaattgcatatatgcaaacagagatactcaattactcagttatgcctgttcttctagcaacaaatttggcatctgactgttgatactggacgagtatagtgtgtgtcaatcagaaaatggataaagcagggtatgcagtaaacataaatcaggcaataaaagacgaattccctgagtccactcgtcataacatggatgaatttgtgccaagcaaagaacatgtggcaacaaatcaacaatttcggatctgaacattgactagtggatgcacaaataaatggcccactggccatcattgatccaaatgtccataacactgaataccaacatgaagagaaattttagcaacaaaataaactggaaggttgagaatcgtcagtggccagtataactaattaagcagcaa

SEQ ID NO: 67357 - DNA, 1153 bp, Oryza sativa
ggtgtatatgtggcaagtttgttactttgtaaatgcatataatttatagttaaaaatatcactaattgaataatcaaaatttcaatctttgatcgatgaggtatagcaaaatacaagtgtgccaatttatggaataaccacccgatcaatttataaggctatgaaaagatgtatataagggattattcatgtgatgatgtatgaaacaaatgcaacaatcgtgttcaatgctatatacgatttccgactttgttttaccattgttttttttgtcttgttttagtttgtcgtttaatttagcaaggatttgatcaaacgtgaaaattgtattgtaatacacatgcattttttttgctagttagaaaaaagaaaatcaagacaactgagcgagtatctaacaattgacaaaagtatcaaaattgctttttacaaagaaaatttccaactgtcaataatgcatcgatgagtgatacttttcttcatggctgcatcacaacactctcctttctctccttcctttccccttttgtcgccctccaccctctcaaatcaaagcaaaaaaaacacaagagcatttcccatctctcccactccttccgccatggccgactaccaccgcccctaccggagcgacctcgacctccgcccaccgccgccgccgccgtcctccgcctccttcccgcactccaacggctactacctcccctcctcctcctcctcctcccccaccgccaacggctacttctcctccaagggcaccggcggctttgcggccaacggcgaccggcggatcgagatctacaccacggcgccgcccccgccgctgccccctccgccgcgcctcgcgctcccgccgccgcccgggaggcgggacggctacctgggaggtggcggagcggggggtggcggtggaggaggcggaagcggtggcatgtggtgcttcagcgacccggagatgaagcggcggcggcgggtggcgagctacaaggcgtactcggtggagggcaagatgaaggcgtcgctgcggagggggctccgctggttcaagggcaagtgctccgagatcttccacggatggtaaaaaccctctgtgatccgctctcctcacgccatggctaatgatggctcctcctccacttctcggaatgaaagg

SEQ ID NO: 67358 - DNA, 26020 bp, Oryza sativa
  unsure (1)..(26020): unsure at all n locations
tggatcccccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcgtaagtcaagatacctcgtcgctttcggtcgtatgaacatttatgtctcttgacaaaagactgactctcaacaaaatatatggactacttcccgttttttaaatgtacgacgccgttgatttttcaaaatacatttgaccattcgtcttattaaaaaaaattatgtaattattaattattttattgtgacttgatttatcattaaatgttctttaagcatgctttaagtatttttatatttgcacaaaaattctaaataatataaatgtttaaacgttaataaaaaaaagtcaacggtgttatacaattaaaaaaaggaccccgcaaaaaaatacattaaaaaaaggaggttgtacatatgttatctactccctccatttcaggttatcagacattttgactttgatcaaagtcaaactactttaagtttgattaagtttataggcaagcataagaatatttataataccaaattagtttcattaaatcaataattgaatatattttcataataaatttgtcttcggttgaaaatgttattatttttttctacaaacttagttaaacttaaagcagtttgactttgatcaaagtcaaaacgtcttataacctgaaacggagatagtattaagtatagagaatcatgtcggtgaaatccaacacgataaaaatctgaactaaaagtctctttcaaatggtcatcaaattcccgttcgaacggggcatttcactggccggttattacattctgtccacaagcacaaagccagttagctgccgaaactgaaactgaaaaatagctgccgatcgatatttttcacacatgcacggagctaggttaggccccacacccacaggccggtgggccaccacaagatttgtgccctgcaccacacgctgatcactaatcatcactaatacagtaacataccatctaacagtcgaaagaaattaagacattggcttaattaaatgtttctggtgctgctgcaatgtcatcagtacatcctaatctgtctttctgtccgtgtctatatatcgctcactcttaaggattactcagtattctcaccatgaaaagatgtctttttgatatctcaaataagtactttaaacattaattactatctgtttaaatattaaatatgtatatagatatatgatatccatacatgcatatttaccttgaaagatattatacaatattacagttttcaaatgttttataacaaaattagcgatcaaagttctatttcaaagattatataagacaatactccctttacttttaaatacgaatgttgttcacttttagatatgatgtttaacgatttgttttcattcaaagaatatagtgtacataagaaaaatacaagttatgctatctttgataacaaaacaagtgacaacgtaacaaatagtattcgcatactacatctatcctacaatataaggggttctgaaaatatcggtgcattaccataactcccttttaagacggagatagtaattctttgtaaacaacacaattggtcaaaagtcatataaaaaatcaacaatgtcatataggagtatttgaaaacagtggtaggagcaaaccatcgtcagatggaggggcatcatcatcagcaatgcagcatggtgatcttctcctcaattaagctccatcgcatgctttcaatttggggcagctgggaggggggggggggattgaatgcacaaagcgacccatcaaaaaggtcccagagagaggcatccccacaataataattagtaatcccagtctcacatatatgacaagggcccctgattaattgttcagttaatgactgggaaatggtccatgacctgacctgactccatcctctctctatctctttctgtgtgtgtacaacgctgaaaaagattttgtctgcttgtaaactggacaagaatctcttgttgtgttgcaggaggagtatgaaactatgaactgtttggctgctgcccctgcttctggttagaaagagaaacagaagaaaggacttggttatgctaatcattgctggttttgactgacaggtttgcttcctggatttttgtcaatgttggaaccccgacaagtgcccaggattaatttgatctgaaaggtcgtcaaattttaccaaattaaccccttttacaatgccgcagtaattcctttacggacttacaatggcatgaccaaaatggttgccccaaaatataagttggagattaatcattttaaaaatagaataatagtatcaaatgataaacatgttgctcgaacatattaggcaggcacaactgttgtaattgcctctgtatgaaaatatattcgactcccagcaaaaaagaacagagaagaacggagattcatcccatctcagttaatttaaaacaagacgatatcctgccattaggaaatacaaaggaatgacttaactgcatcaaagagaaactatttacacttttcagagctcagcccatccaaacaaactgtcttgttatcatgggcctaatggaccattattaattcttaaacaatgctacgtatgatatatcaattgggccgcataatttttacttactgggccgtacgttcacttggatttcttagaaacaagtctattttgcctccctcatgttcttgcccttggtcgaatcacatccctcaaccgcaaaaccgggtataacgcctcacccatctccgaaacccggtgcaaatcgactcctcaggtagttttgtaagcggttttgtcctatgtggtgcttaggtggcattctacatagaaaaaaaatataaaaacatgatagtggccccacatgtcagtctcactttctccacctctaccctctctctagtctccctttcttctccggggtccaggactgacggctggcgaagaggagaggaagaggtcaggggcggtggatccgccttcttacactcccacaccttggcctctgcctcttatccatggtggtggagctctacctccgcctcctatctggttttgctatggattaggctctagcatgcttctcctcgaggcagtcctgcgccagccatgtctcctctgtgagttagcaaaatatcacaaaatatcaattgactaatgtgtgaagggaatacgtctccacgagctgtgcgagctagccacggggctcgaggccagcgccgcgccgttcctctggtcctgagggaggaccaagcagcacgccgtggggctcgttgtcccgtgggcactgtaggtaggtgttttgtgccacgcatcggtgggcgcgctcatgacgcacatctggtgggcgtcggtgatggagggcgtgtcaagcggcgtacccatggtgtgccgcccattcttcggcaaccagaagatgaacgcgctattggtgtcccacgtttgggggttcgggatggcgttcgacagggtgatgacgtgcgacggcgtggctacagtagtggtgtcgcttgttggcgggaaggatgggtgccggatgagggcgcgggcgcaggagttgcaggcgaaggtggcaacgatgtttatcgagccaaatggaaactgcaggaagaacttcgccaggcttgtcgagataatctgtgcatcgtgaatcaatcatgttggccttcaaactgttttgttgactgtttgcttttaaattttggatatttttggtgagataggaggcggaggccaagctccactgtcacggataggaggcggagaccgaggtgtgggggcatgggaaggcagatccgccgcccccgacctctccctctcctccttttcgcgggcttcgtcggccgtcagtcctagcccccggagaagaaagggagaccaaagagaggggtagagagagagaaaagggtagaggtggagaaattgagactgacatgtgcggcccactgttatttttttttctatctaaaatgccacctaaacaccatgtaggacaaaaccacttacaaaagcacctgaggagttgatttgcgcctattttcggtgatggaggatgtgttatacccggttttgtggttgagggatgtgatttgaccaagggcaagacatgagggatgcaaaatagactccatggaattattggtgtagaaactgaaagcccataattggagtattttcatgggctttttatctgcctctgtttagtggatctgctcctctagcgaattcggcccattttgcgtctctgtcaattccaacaattctctgggctggttgaacttatatatacagctattatgtgcttctgctaagcatttgaaacaagtcctctatcagaaaaaaaacgaaagtttgaaacagattaatttgaaaattttggctttgaggtgaatcctgataaattcgggggagaataagttgcccacggattggataggaatcggcgatagcggggtccacgtgcatgtttccagttttttctcccacgcgcgcacgtttcgtttttttttctgttttcctttctttttttttttggaaaaaacacgtttttttcctttattttaggatgcggtaaattatgatagcaacggagagttgactgtaacaaacttttaaagcgaagatttaaaatttttaacttagacttgaaaacttttaagtcaagatttggattttttgaaactttcaacttagatttgaaaattttcaaatcaaaatttaaaaattttcaactcgtatttaaaagcttttaattcagatttgaaaacttttaactaaagattggaatcttttaactcaaatttaaaaactctcatctcaaaattaaaatcattcaacttaaattataaaaactttcaaacttggacttcaaagattttaattaaaattctaaaaacttttgactcaaaaattgagtcgaaagttttcaaatttgagttgaaagttttataattttgacttgaaagtttccaaagtttgggttgaaagttttcaaaattcgagttgaaagttccaaatttcacgtagattttaaacttgtagtgaaaatgggaaaaaaatctgaaaaagagaatgttaattaataccgtgattatcggaagttaaaaaaaaacttatcacgatttttcctccgaatccgcgtgcgcgtgtacctcccatcgttttgttgcgcgaaaaaaaaattggactcgcttcctcgctggtgggccggaatagaacgcagcgaagtgggctagaaatgcgcgctagatcgataagtagagcgtttgcgctaattagcatttccggacaaattcttagggaaaacttgctctttcaaataccaggggtgaaacaaactggatcgattagccactaacagcctgaggctcctttttcttcaaaatggacaccacagcctaacgtttaggttcctttttgttcaaattttgcatttgggcattgtccttgagactactgtagattttggactttggacgaggaaaatctgacccaaggagctcagcacacttgatgtactgtcaattgacctaattattgtctctctcaaactaagaaattaatcactttgtacttttctcacaaaataaagaacatggctgaataccttgaaagaactgtatattatattgcttttatatagagtatgacgatgactcatgacttcatttgggtaatgaaaattaaagaaattacactctgctatttcccctcaaaacaatcagcaaagcatgcaccattgtaccaaagtcagaccaaagcatccaaaccactggggatagaatatcctgctcacatactagctggagttgtactttccattgacctacatcttggtaatcagcaattagtaatctctcctagaaaggtgcaaagatcccccacctgtatatagatataaattcttggaagtcacattttagaaaaacaaagacaaaaccccagtccttggtagccattgacaggccccatacctagatgttcatatcagccaaggtctacatgccagtacggtttcatagaagcgatttatcatgcaataattctgtgacacaacttaatttgataacaaggatgcatatattgttttttgttaacaaatatacctatactttgataccagccaaatgtaactcaaaatatccgtcctttctttgaattgtggcaacttatgatggtgataaaagatatcaaactcggtgcaagcttgtcgccagtggacaccttcaaaattaagagtatatatttctacttaatttgtaagttggtccaaaattttaatttcttaaccaagtcactgatcaaactaacccatcataggtgattccacatgccaccacattgcatctagatccattgctaacgctcatacttgaccttacagcatgcctaatataaacattgaggttcaatttacaatggtggctagttagacttgacactgaagaagagctgtcaaaccaagtgcatgaatcctagctcgctatcaatggacaccgaaaataatagggtatttctacttaatttataagcaactcgatccaaaatctttatttcttgtagtgactcgcgccatcgaacggacttactagcgaagagctataaaatatattttaaaacatgtttctagatctgctgttttttgacgaaaaccaacaggagagactcctactgaaatgaattgccaaacaaatattgacaaacaaactgtacaaagaagagggaggagggcggggggggggggagattacatatcacaaattataagctgtctagccatgatttccaaaaaggtttatcctgagctttaaccctatgcaaaagtagggtaaaatcatctctaaaaagagatttccaagagttgaaggaaggctggacgttattaaagatgaagtcatttcttcttcgccagatgttccaaagagctacggcaatgacctcaatgaaaaagacatgggggaaattcctttttgcttcaataaccataggcatgaatcccaagtttgattgccattgtattcccacaaaattccagcatctagtggcaaaaggacaacagaagaaaaggtgcatgaagtcctccaaaactgagagaccacacaggatgcagtttggtccggaagggatactttgattattttttttctttgcagcaaatcttttgtgttcagcctgtctaccatcaaaagcaaaaggaaaaactttaattttaaagtgcatttgctcttccaaatgagggtgaggggtaactccactgtaagatgatcaaagaaaagcgagtagaccaatcttgattgaaagccaggatgtgaccatttgtaaccctagtgatcagcattatttagagatacatgagtaaggagatcattcagagcatgccatacatgagccaacatgctctagatctgctgttgatgctcatacgagctttattaccacctaatattaaaacattacagttccttatactgatagctaccgagacaatctttttttaagtaacggattaaaaccgacctccacatccacagagcgaatgtacgcaaccaaaactatcgagacttactagtactgatcagagctatgaaatctatttttatgcatgctcttgcaaattgatgccttgaaaattaccactgcttctacttaaattataggtataataatcaatttacgcgtcgcacccctgcctctagatccgttgctgatgctcatgcatgtacacatgcatgagccgaacgttagggttaattagggttcgtttaatttgcagtgccattttctgatcgatcagctcgtgcgtgtcctcaagaatcaagatccgtcacatgagcctcacgctctccctgatcgatcagcagaaaaactaatcaggcaagcattagtagcttcgtttagaatccagtggcggtcaaaagctgcattaataattaactaatctcgtttgcaatgcctataatttgttcagatatatgcgtctctcctgtgtctctgctagagctaagggttgacttgcattgcatgcaatgctggcatgcaggcaggatctgggtctgggacggtggtgattattaaatttgataatatagggcgagtgttcatgtgatgatgatgaccgcctaatattatgtgtaagtatggaatggcagtgacgacatgaaaattccaaattagttttcataaatcgttctgctgcatgcatgtctagatgctgtaggcgtcggtggatggcaaaagtctaactacaaaatgatctgtattccgtcagaagattatcacagtgttgtactataaagacttaattaaaatgtaaacgtcgcgattttgttccatttattagtgcatgtgtatacgaccacttcaaaagaaggatatatatgataaattccactaaataatgtcgtgtgtgggtgtatgaaaagaggcggaatttaagtggaaaaatggtttaaacagaaaaaaaaagggacgagaaagtagtgcatgcatgtttggttctttaccatttacaacattactaattttgtttttgacaatgacaagaattggccattacccaaaattctggaaaaggttggctaccaaagttgtgggttcaattcaactaggccagataatttggtgatgctaacttttttctttcccaaactaaatggatgactagtttttcggcattgcgcaattatatatatatatttcgcattagactacaaaccaaacaaggccctaatattttgcaggggaaaatttaagaatataatttgacgagaaatattaaccgtcctggtaaaaatcaaagaatcaaactgtgacagaaatattcaattatttgcattgcgcgtgagcagggcggtgcacatagcggaggcaacgtttgacctacacagattaacaaatgctatagcatgaaaacagtgtcaggggaaaagcataagtaacatggttaattgagatcacctaggacacaacaccgacataacttaattattaattaatttatataaacccagatacattatgcacagttatgtttgattagacacttggggttggtgtttgtcttgatgagtgattcttgctgctcctgcttgatggcaggatttggttattctacttttagggttttggggttcaggctacgaatatgataacatttgtgtacaaggacacttgctcgatcaggctgcagtagtggtgtcttgtgctcactataaaagcatccagcaagttcacctagatggtgatcagtttagtagatggcagtcaatagtgatcagtttcattagtgatgtgtcgagcaaattactcatcagttagctggaccaattctgtaccacattagaggaagcttatgcttgctcagtagcaaagaaactacaaagcaacctagctcattaactcacaattctgtccagctcttgattttgcagtattgggcatgagctgaactgattattttggaaattccttttgtgaagctgaacttagtgttttcaggccagatcgatgcatggtaaactgtttttagtacagtaggtcgtaatatttttttgtaataactcataaatgtattaattaatcaggtttgcttttacggttttgtaacaaattaaagattgtgaacggtgctccaggtttctttagaacaacacacttccaatagtattatccaaaaacaacttcttgacacggtgaacactactccaggcctctgcacatattgagaatgtgatatcaccatgatgttcaccttgccactaattcatactcatgaacaagcccatctactcggatcgatgttggactaccttcaattagcctcatgtctccagaatatgaagaaccagggaagggatcaacaagatactaagttccttacatacatatatataaggttcaatagaaacacaaaaggagaggtgcaagtcgatctattatgaccagaagaaagagtacagttgtttgtatttcattttcttcttccaagccgatgtgctctgcatggagcttacagttgggaagagaactcaactagctcattgcattcttcttcatcaaggataaaattaattggattggatgcacaaaagtagtttgcagctagcttcctctaccaatggaaggtcatccatgcatgtcctcttggatcaacaggaacagggatcaaggatgaactcgtggttcacaaacatattgaagcagagatacctttgcataccttcgtatatagtaatactaattactatctccatttcatattataagtcattttgatttttttctaagaaaaatatagcaatatttttaacataaaacaaaggaactatcaaaaatatattcaatattagatttaataaaactaagttagtgctataattattactatatttttctataatattggtcaaattttcaagaagtttgaccttacaaaagtgaaagagaattataacatgaaacggaggaagtactaataaaatatccgttagaaaaagagtttaggggtacaaatgaatgtatcatgctcaccagatcttgtgaacgtgagggtaggtgctaacatcaaaatttggtaagccccgaagtcatcatcggtctagagtcagtatcggctttagagtcctggaatcggccgatgggaattatcaagtcttcaatagttggattctaagtagaatcgattaaagaaattaatatattaaatgaagtttatccaaaagtgaccgagtttaaaggaggatgcggcatggcagtttatctattaattaggaagagtctattagtttccttttatctttaggaaaatgtgtttagtgtctgataaagactttatgttttccttttatctttaggaaagtttctttcttgtccaagaaggactaatatctacctatgggtataaatatgtacaccaagggtcattgtaaactatctcacgatcaatacaatttcggcgcatcgccaccttttacctttctactttttcgatgagttcttacttcgaattagggtatcgatttcgatcttctgacaagaggtatgaattgtctcagcggtttgcgctggcggattagggcatcgctttaaatgttctaatctatcttctacagccgctggttatcatatatcctagttaatctagcttagcatcttaatttgatcagatcacctgagattcgttttagggtttatgtcggtatcggctaaattatcttgctagattagattaactaagatatccaccactcttaaaatttgtcaaaggcatgattgtttaggctttatgtttctttgcatactttgagttgcatcgaccttagtcgtgcttagaaccataaaaactaacctgcctttgattgccaataagggttccatcggggtttcagctgatgagttttctggacattgcatcggcttacaagaattgtatattaggtggttttagccgatcacaacaaaggtttcattgtttatctaatcttgtggattttatgacatcggacctccagccgatgtatgctttgatcttcatatcagtgtttattctatcatatcattgttagccgattggtttctacgagattatattattgctttattatattaccattagccgattgtctttatatcatcatctacattggacatatagctgattgctcaaaaccctatcggcatcggctcactggtgatcttcaatttatatatcttgtcagttgcaagatcaaacagactggcacgtccacatctcatcaatttttggacctacattagagctaagcagatctcccaggccgttgtgttcatcgacttagttcgcgccaacacagacccgacaccatcggccgagcgcggattttccgtcagcagtaggttatgggggtgaaaattttctacattgtccgtacattgtaacgggtcagacctatataattagagataggataggagggtaattgagtattgcacacggtggtaggagcagatggaagggatgttgaacagtccatgaggacctaagctccagagtgggatgggcagcagctgtgccctaaccgcagaggcggaaggcaactgtgccccaagctcggaagtatatgcgccccaagcccggaagtaggcagcggtattgccatgagctcgggttctagcccgctgccatatgaagtggcccaggctcaccttcgttgcatactgatcgatcagatgacgagttggtaggcccccgagcatctgatagaggggctctggttaccactttaccaacataatatatttggatggtttatagtaagtttagagcagataacgtgaaagagagagaaaaagagctgagccagaaagagagagtgtgcattggaaattagcaaacgaaatggaaaaatcactactacaaaatgggtttttgctgacagtcagaataagttttttacaagcagttaggctagccgtcagcgaccataggccagaaaaaatacacaatcttcataggcgggcatacaaccgctagcgaaaatttattttcattgacggctaggttaagccgaccaccagtgaaaatgattttccccgacagagctaggttaagtcaaccgcctgcgaaaatcatttttgcctttaaaaaaagaaaaaaaaaacccttgcatgcaactcgcttctgactgccaacaaagattattttaggcaaacgaaaaataaaaaacccacatgcaattgcattcacaatttccacatcaaaccacaaatcaagcaaatatgggaagaacaattcatcacaatttcatcccaggtgtacaagaaatccattcacaatttcatagctactctaagatttagcaatcagtctgttctcatcgctgtttcttacaaaaattgtgaacagagaagtacaagcaaatatgcagcgattatttgtaagaaaacattcacaatttcatccaagatttagcaatacacaagaaagatgagagagaagaggtcactggtgcattcaccgatccacggttgttgccatcaccgagacacgtgcgaacatcggcaccaaagtcggcgagctccgtggatttgagagaggagggttggcaccgctggagcttgaggcctcaccatccccctccaccaccgttgggggcggagtgcactcattggagctctgacccggcgggaggttgggctcgtcggctagcgacacctccacaatgagccctttattcaacgccatggccgcaagagcaccgtcgaccctccccttcacagcggctggaccaggcggcgaatctgccgctcctgagatcgccggtattggatccgccgttgtcaagctcgatggcgacggatccgccactcctaagaccgccagtggcggatccgcccttttcgagcctgccggtggtggatccgctcctcctgatctcattgcagccgtagccgtcgccgtcgcccccacaatcgttttggccatcgccgccgccatgtacgccgtcgtcgccaaggacgagggagagggggggggggagggagggaggaatatggcagggagaggagggagggaggacttatcggtggggaaggagagttagatgcggtggagatcgagcttttcttttaatatgatggtcctctttagcaaccagcagcgaaaatcgatttttgctggtggtcgtttaggtgagccaccagtgaaaagggatacattttcattggcggcgctcttaaccacgttgttagcagagatccattttcgctggcggcccataacccctcatccctcgttacattgttgccgatggttttgatgtatggccgtcagagaaaatgatagggtgacgccatgaaaaatcgatttggtagtagtgaattagacaaagttataagctcatgttaattataaactaggactggtgcataggaaaataatccataataatttttttaatccaattccttttcttcaaattatatatgtgtgtgaaattttttcaaggattcaatactccaaagatcctatgaatttccttcaatccaaagatatgaattgagtttctaaataggataataaaggttggtataggtattctttcggaacagagatatatacaactagtaactcccatatgtgcaatacgatatcaaccatgattgattcgtctgatcaatttacagttagacttgaaattttcatctgaaattggagagagaaaatgtagatgtgatttacagatcaaataaattttggcaaccaatcaagctttagtttatcttttgaacatttcaatcattgcacagtctcctaagtcctaccagaattcatataagaaaaggctggattaccaaataagagctgcttcaatagagatttctttagacattagctagttactagctagttagcgtagtagaatcaaaattatatacttatccggacataagagaatgtcattttagaatatgcatacgctctaagcgcaagttattttttattatattattgtttaggctatatgttttggacctctatagccaagtatattataactagtgcttaatttaatgatgttactgttgtgtaattgtttttgcatttacggggaagacttaaattgtcaaaatcatgtgtctgtttgactataacatgcctaaatcgacattcttttgggtgacggaaaaggaccactagtgaagaaattgccggtttcaaaccactcatcaataccggttttagaggcagcaccattatagcggaactaattatgagggtagtcactaacgttggttctaaaaccgatactgatgacacccttattgatgctaattctgattaaaacgaacacctctaatgggtgctcccggtttttatttctacaaatgcggaaaaaattataaaaaatattttgcatttaactaggtttctatctacgcacggtcgcaaattgattctcacaattcacaagattttttcacgcaatattcacacacaagagattcacaaaatctaaacccaggacatctctcaatttccaaagccttcttaccatctcacctatcaaacacacacgtcgtcttgtaagcaaatcgacactactactaaatgaaagttatagtacatatttatcaccatagataagctcaaatgaaaatatttttcaaccaaactcgtatagattttatctctgtccgagattgcttagaaatttccaaaatccgcttgttcaaatagaactgagaagtgagaacttaacacattttgtgatatctaaacgatcttaaatgaaaaagtcaactacaaagtttagatcttgtagaaggacctgtttgtgcggaaaaacctcttataggtgttaattttaagtgaactgcaacctataaagacattacggacgtggtgttctgtactaatgtaccattctgatgtgatataagaacacccaaattcttcaatcaagtgatctatggttcttcaggttcttgtgtagctggtttcctagcattagaaattcttcgagttagagctactggtcaattaaggttatcaaggtaggacgatttatacatttgtagtccaaaataagacaatagttaatagatttaaatatatacaaactatatttcatattttccataagacttatggaaatggagctatatatgccaaaccatcctaaatatagctagcttgcaaattaatttcaccatggactctataaatgcctgcaactacaaataatttactccctctgtttcagattatataaaaaaactgtgtagtaacatttttaacccaggacaaatatattatgaaaatatatttaatgatagatttaatgcaactaatttggtgttataaatattaactatctttgtcaacaaatttaggcccagtttagatcccacctcaaaattttttaccttgtcacatcgaacatttaaacacctgcatgaagtattaaatataggctaacaaaataactaattgtacagattgcgactaatttccgagatgaatcttttaagcctaattactccatgatttgataatgtggtgctacagtaaacatttgctaatgacggattaattaggcttaataaattcgtctcgcagtttacaggcggattttgtaatttgttttgttattagactatgtttaatatttcaaatgtgtgtccgtatatctgatgtgacacggcaaaaattttcacccttggatctaaacacacttagttaaacttgaagtagtttgactttgaccaaaatcaaaatgacttataatctgaaatagagggagtaattaccgcagcatcttcacttctctaacaagttctacctcttttaataaaagaccttattttcagactaaagcaattgttaaaaaaaacagtgtaattatctttagacgtgtggttcattgatactcatgcttgttttctctcttgtggttagagaccatccccgccttcaatcgttatgtgcaaatgccattaattttagtttaggcatgtcaaaagtctaatcaagtatacaagcctagaaaaaacttagtactctctccattccaaaatacttatcaatcattctaaatgtttagcataaattaagattcaagaaagaaaaactagtatccttcattaaatgatgtacggtgtgatagttggagggtattatagggaaaaaaattgaatgaacgatgatgaattgggcaagtagaacttaagagtgataaatactttaggataaattttaaattataaaaagataactattttgaaatggaggttatagtcattatgagagacatacatcttcattctcatccatactaagattgtgttcttttcctaacttttcctacatttgcttaatggtttttgcacacacgcttcctaaactgctgaacggtgtgtttttactaaagttttatatagaaaaattagaaaaattactttaaggaatcatattaaccattttctaaattttttatgctaatacttaattaattacacctaattgataacaccgtttttcgtgcgtggacttggaacgcaggctgatatgtgtcaatgacaggttaaaaataagatctctttacgacagaggcgttagataattctgtagctctgttgtcttgaagtatattcttgagacttgagagagagagagcatgcacgtacgtacaatataagtatacatacacatggataaacgagcaacatatacgtacgtgtgtcgaacttaatatatatatacccctatttactagctagatgtgcattattgatggctctaggtctcgctagctccaacaacacgatcggaccccaggtaagtgcttgcctcgagatctgcgctaatgaatgtgcctacaacggaattagggcctgatcaaccaataattaagagcttaataatataattatgtggatgaatataccaagaccgcaggttagcatggacttgctccgtttctcaaatgattgttgtcgttgatcgattttttacgtcagttcaaactcggtaagcttaattttactaaataactgaagtgactgtttatagcaacgaattttccaaaataacagtcgttcttacacggtgaattacctacacttacattatacgctgcaaatttcagaacttacattgtaattactcctctgaaacattgtaagttttgaatattcacatggtaatttttctaatacataatgtatatgagtattattatcaatttgaaaaaggagatagaagagatggaattagcacacttgtttacacatagaagatagagcaatcacatagagaaaaaaaggcgattgaaattaaaattaaagaaatgttgttgcgattgaaattttgttgctagaaaggtgtattattaattaattagtagatttttataaatattttttgacatgttgccttcacaatcttttacaaacatatatattaggatttttactttattatattctctcttcatctttcagaaaatttgaacaaaagtttgaaatttaaaaattctatcgatgcgtatgaatgcaattagttagctaggaaatcgtttggccagcgaggacaatgtgtaaggacatggaatggcagagatcgataagagaggagcaaagaaatcattgatttgaccaattttgacccaagttctccagtggagtcacttaatacagacccacttgtaaattaattcgaaattacacggaggagagtaccatgctcaagaaaggttagtagtagttactccacgggctaaaaaaaaggttgctactactccctccgtctaattttgatagttatatttctaaatctgaaaaaatatttttgatagtcatatttcaattcaacaacctatcatcttaatgactttctcagatttaatacataactattcattcttccatacacgattgactacatgggcatcggaaaatgtaaatattaatgaatcgcttgtttacgagaaatgactagtagcatatttaaatagatgataagtagaattacttatcattagtctgtgtgccaagatgaaatatgagtatcaaaagtagatggagggattggttaattaatactccctccgtcccattttgagtgcaattgtaagttttccgtatccaatatttgacaacccatcttatttgaaaaaattataaaatttctttaagaaaataagtcatgcatagaatactattcatgttttattatctattaataataaaaatactaatcatattttttaaaaaaagaacggataatcaaatattgaacatgaaaatttataactacacttaaaataaaaagggagagaaaatgaaaagggaaggagtaactatacttatattggtactacacaattgtatatatgattctagctgggcgacctctcgtacagttgtaccggccatcgtctagatttgcacatgtgagaggtcggtgtatgcatcgtgggttgcggccgatggaagcttcagatgatcgttggcgccagcccacgtgaggttctgaattcgggagccggcctagctacctaccacccttctcccgccagccattgccgaggagattgagcacgtggcagctagctttgcatcctgcatactaggtgttagcatccataagtagggcattaaagaaaaggcactaaagaagagagaagaataaagggccgagggacctagttattaagacccgaccgggaaaaaccggaaccacagcccttgccggtccggtccaggtaaaagaccggcatgcaattgacccctccccccggccatgaaccggttagagtacgtgggatggggtccggtccagataaaagaccagcatgcaattgacccgcccccccctcctcggaaatcgcaacaacattttttatcaacattggaatttctatttttcttgtccgttttcacttttttctatctttcttgtcctattggaattttttttgtccgtttccaactttttttttgtctgtttactctttgtttgttttgtccgtttacacaaaacctaatcgtaatacccttctatttttctttttttcttatttttttcgattaacatgggattttctagaccgtgagagcgaatatggagacttctttttcttttactctatagatataatagatgtcacctccaatattatgttgttttttttaatggagggagtagagaagaaatatacttaagccttcgtatcgctgctcttctgtatagactaaacacaagacatatatgatagaaggcattgcacattagaggatgcagatcacagttgtgtgctttgctccacatgggaagaaagagaaactttgagatacatgttcttcatatatctttttagtggagcttgctagaagagaattggcataagttgaaattgcaatctggattttttttttcatatgatagttcttgctaagatcagattcagaaacaaagggttcttcaagattatattcatagcatattggcacctttggaagcaaagaaatggtttcattttttttcaaaatattaatccaaaagaaggatagttggtttagaagttttaagcgagagattcttccatatctctacataatgaatgaatctgttctttcaatggtttctatcagggtacgacatttgtaatcttggagttggaccttttgtagttgttttctttttatcctaatctaaaatcaactactggacacaaggcctgatagtattttcccttaagaaaagaaatgtactcaagccaaacactgggtagcaagggcatatagagacggcaccttcgaaggctataggtcggtatatcgtgagattattggctaagtcaccgtatgtaccttgttgtcgacaaaaatatttcctaccactgaaataataacagccaatatatctcaattccaataacgttgtgttagcaagtacaaccgattaccattagagtttgtctacacgggcggagctaaccccattcgtcgaaatttctaaattaaaacattgtttagatctgtagatcactgtgctgtacaatggagctaacccgccgggtgtcatttttggcttgcttcgcctttgtaaatgttatattttcttaaagtttattttaatttccgtctttttaatgcaattgcaaaattgtacactttatattctagaaaatctaaaaatatgctaaacatattaaaataattacattcggatggaaattaataacaaaacacaggtttgatggatgctgaacattactaaactataatacttgaagttattttaattgtatttatatttgacatgctagcatgaattttattgggacggaaaaggggttgaatatcttgggacatggcaacaaatattatatataggagactaggaactctttgtctagaaaaaggacttttttgtcaaagctttgtaatagtttttatatggccattaggacatatagaaactactagcaattaaaactaccatttgattttttttagataatggaactaccatttgatgaaacttgctgactaagatttacttagaaaaaacaaagattttagacagcaagagttgtttaattaattgtattattgttagagctagcttgacttgttagctagatcgaggtacgttgacacatgtgatgaactaaagctagcccaagtggcacaattgcacaagaactgatctgatccactgagatacctaatcagttacgtgtttgcccagaaggagccaaaggaggacgacagtacattaagcaagtcatatgtggactaccgatgacaattatagaggcagaagcaccaattcatgttggaagctttactaccacgtttatgaaataataatgagcaccaatttaccaataggagggagtgagattaattaattaacctgcataattggagcaatcaaaaggaaaacacatgggcaaatggttcacctcgcaactacatagtttcctttttccagaaatgttatggaatggaagttgtctattgtgaaggaccacatgaaaacactatttcggatgggaattattgcattagccatcgtaaagtaaactttgttaggatcatgcatgtagatgttttgttcacctcatcagacttaaaatcatttctctataaattttataagtctaggcatttttaatcaataaaggaaaaatgatttccacatacgggtgtcataacaatcgcctgtagaaacaaattaatcaacaaaggtggctagatatgaagacgtaccgcccatatgtaaatattagtgcagttggtcttcaaagcaaaatagctcaggtagattgttaggacgactgcccatgtaaatgtctgtttatatatttgggccttcacgaaaaaaaggtatatatgtcctagagaaccccaaaccaatgccgtcatgttgctgaaattcctaatccgtcaacactcaacaggcatgagctcgaccacgaccacactccgaagacactgccaccgcaacctccttctcgacacagccatccactccactgccgccagcctgctcattatccctaacacgccggcaatccagaggtcaacccggccaccgccgcacctcctagatgccgccaccgccggtagcgacctggtcttccttccaaacgtgtcggtgataccgagttcgtccctgacaacgccgctagccacctccaccttccttaatcctgatacactgtctccgacggttagtgtgaattgttaaaataaatgaatatagtttaaatgtgaaattaaaatgatacttagaatatatgtatgtgatttaaaataagtgtatatatatagtttagaatgtaatgataagaccaatgtggtaaaaggaaactgaataaccgttgcgatttaggtactctaaggaggataacaataatagttttgagccctacactgaagaggagactacaactagagatttacattccacaaccgacataacagggtgtccacgtagaatatccgaacaacttctacaccaaattggggcaactagaacatgctcccgaaaaaaaaatgttaaaggccaatccatctacacatttggttcccacttcaagtaaagggggtgtgtgggggggggtgtggaatggatggatcacaacatgtgtccaaaaatcgtcggaggaaggataagtgtgacattatagtggcactcaactgcaggaaagaaccataagacctatgatatcatcatccgatgagagtgggggtgaaaccaattgagtacaacttgccgagccatgtcccatgcccgcagccaccctgatatggggagaacgacattgattttgaccctgccaaggaagtatatattaacatgatacgttgcattttacatttcattttccattgtctatttctttataacaactatcaatgttttataggtctggatcgatggaagataaacttgtcgaaagtcgaggcaagaaaattccctcccttagctacccaacccaagggtgcctcaacggagaataggattcttgtaatccgaattttgggagaaaaaactctcgtgtctccccttgtgtgcaatttgtgtttcacctgtgatttacctttcttagctattcattactttcttctaagcttctttaagtattgggaatccttgagaaccaatatttgtgtctcaaaaagaaagaaccccaaaagtttcacaaaagaacaccgaaagttccgggcagccctctcagtcttttgtcgcgagctgccaggaaatttcggggcctgtcatctaactgtgtcaattgaagaaaacttcaggaaagcctattcacaccccccctccctctaggctacaccttgggctttcatagagtttgctcaaaagaatgccatggaggaagccaagaaattgagcgaggcgaaaaaccaactccccaagagaaattagttcccccgtcgcttgggatctagtaagtaagatggggaagccgatgaatggaggaggaaaaaaataggatgaaaggatcgggagacagttaacatcaaaatttggtatggttctttagtagattcggctaaggaaagaaaccgattggttgatggaaatttgtgtagataaagctgaattcaaggaggaaccgtgaagacaatggcaaggcggattcatattttttagtatatttcttaaataggcatgattagttatttccttgtgagtacaacatttgtgagttccttaggttggatgggaggtatatagtgaaccccaactagttaagtcaatatttataattgaacaaatagtgtggttcttaattatattgatttttaatgttctaactcttttagttattgttttattacaacggcccacacaaccaacctctttcaaacttaatggaacacatattgctaatatacaaagtttgatgttgctagattatccaccgatagctattatacacaatgctgccacgggactgatagctatttttcttgaatgaaacacagcaggggaagcccccactgttaatatattaaaaagaataaaaagaatttacaacagcagaatccaattcttaactacatcttgatctctctcatttaatctaaaaagcaacaacagataatccctcttaaggagatttttccaagaagaaaaggaaaacttcttattataaaaaatgaaactattctttgcttccatatattccaggctgcaagaaggagtttctcaaagaaacaatatccagaataattagctttagccaccactaacatgttatccagtttcagattggtatcccaggaaatacccaaagagttccaacaaacagtagagaagggacagaggaaaaacaaatggagcatggtctcagtgcattgaagttgacaaagcatacagtacagatcacaattagggggggcacaatgcttatgatccaacagaaacttagtattcagcctgtccataagcataagccatccaaaaactttaaccttagatgtgaatttgcttttccaaagccaaacaaagtgttgtggtgacttcaaagctctgaaattgaaagcataaaatttctgcgatgtaaatttcaaactgccccaaatataagaccagctatcacaatctccagaaaggtcaattctagacattaggtccgataaaatcaagagctcagagtaagcttgatgagaaaccggcagatgaaaatgatcctcaattggagagattaagaaattctgaacagatacattcctattcaccacaaaagagcataaccttggcatatgcaaagaaagaggtggaccatctgaccaaacatcatcccagaaagaacaagacaatccattacccagagtacaccttgatattcctctgaaaaggtccattaacttgcgaacatccttccactaaaaagacccccttggaggagacagatgagggatcttgtcatagtaagaagatcagataagagacacccaaggcacttgtcttctattataaaacttgtccaaatatttaagtaaaatagcctgattctggatagacaaatttattacacccaaacccccttttaccttaggcttacaaaccttgtcccaagcagccaaagactttttactagaattgaaatctcctcctctccaaagacaatgtctcctagccctgtcaatattctcaataactgttttaggaagctgcagtgtgcacatataatatgtagggtgagaagagaaaactgaattaaccaaggtaagcctatccccataagaaagaaaggctgaatttgcagacaatattctctcaattctatcaactagaggagcaaagtcaatcactctgggttttgtggtacccaaaggcaaaccaaggtaagtgaaaggaagggtaccaattttgcagccaaaaactccagccaacatctcagccttatcatcattcacattaatagggatgagacaggatttatgataattcactttaagacctgtaccttgagcaaaggtttgcaacagggcctttaacacaaaaagttctttaccacaagccttaacatacaacaaagtatcatcagcatattgcattattggaaagttatggtcatcccccatgggaattggcttagataacaagcccttttgatgtgccatatttattatagactataagagatcagctccaagcacaaaaagcaaaggttagaggggatcaccctgccttactcctcttttgcaatgaaagtccaaaccagggacaccatttaaaagaactgaagaggatgcataagacaaaattttcctcacccaacaacaccacttatcagagaatcccatagcagccataacctttagtatagctcatgctctatagt

SEQ ID NO: 67359 - DNA, 20458 bp, Oryza sativa
aagtcaagctttaaagaatatttctctctttgactgatgacattgaagcagagactcaaaattccaagctaaacaatcttgaatcgtcctgcccttaataaagccatactggttctggtgtattatagaaaggatcactttttgaattctatttgccataagtttgtcaaaattttcaaggatattcccattaaagaaataggcctgtaatcatttataatctctggatttagtttctttggcactaagataataaacgaatgatttaaaggatcaagagacaaagaaccagaatggaaatcatcacatagcttataatagtcatgacagattatgggccaacatttcttaataaaaagaccactaaacccatcaggaccaggagccctgtcagtaggtaaatccttgatgagctgatcaatctcttttttgaggaatggggtatgcagaatatccaaaccttcatgggcatcaataagtgaatttaaatcaaaaggcatatcctcaaacatggaaacccccattcttgatttataagccctccaagcaaccacagctttgtcatcatggctagttagaaatgtaccatccacatccagtaaagaagatatagtattctttctaaaagattcagtggccatagcatgaaaaaacttggtgttctctcctccgaatttggcccaacggatagttcatctcttttgccaatataattgcttatatttcaagtataagagaagcttagaacgaataaacactctgaaattccactcaagaagggacagatccctaagctcctctatactatccagaaagagaatgatagcattacagtttgctataagcttctgcaagttagacagattcttactccacttcttaagaccattcctcaaagcattgagctttgcagagatattcctagccgaatccgccagaacaccatgattagaccatatagaatggacaagatcaaaaaaatcctcatgctcaatccaaaagttttcaaatctgaaaatattggctcttgggatattggaacctatctaaaccacacagggggggtatggtccgaaattgatctaacaagaggcttaaccaaagtgtttaggaaagtgatagtccaactagttgaagtaaagaaccaatcaagttgctctaacaaaggctgttgctgcatgttgctctaagtataggccctgcccttaatagataattcaactagacccaggtcgctaatgacatcattaaaaagaaaaatatcattcatatcttaccctggcctatttctattcaacactgacctataaaaattgaaatctccaaggagaagccaaatgtcatcatctgcaatttgcaagctatggagccagattacaaaattttctctttcaacaccagcacagggtccatacaccgacagtaaagtccaggataacccagaatgactagaggaaaagcaaattttaacagcaaaactctaaatttcaatctgagaagcagtaacgacagagctattccaacagacaagaatactgtcagggttacgggtaaggtataccctctacccttcgatatacgtcacgtatcgatatggtatgtttgcgcgtatacggacattctcagcataggttaaggaagtccatcatggagtctacagatggaaagagtcctactcagatagaactgggtcgtcattatatcgtgtcgggtccgatgtctccgagtcctacttggagaccagttgacctacggtataaaagggaccacccgggtagacctaaggcatcgaatttcagagccaacacatccaccacaacctacgaagctagagcttatcgaagccaagtcgccgggagatctagtcggatcaactcgactacgatcttgtcggtatcgtcgagcttcactattccctttgtaatctgtggtttccatcatataatcccatatcaactggattagggctattacctaccaaggggcctgaaccagtataatccctgtttcctgtttgcttgatgtcgtactacgtagatcctcataccagcgtaccccaataccctctatatccggtctacgggtatcccccgtcgacagtggcgcgccaggtagggggacttggcgctcaaggttctactactatgacatccagcttcgtcgacaacagcgtcaacaccaacctcaaccaaggagttccaacttcaacaacactggtgtggactcaagtcgacgaaatcgtctttctggtttacaccacaatgccgatctcagctggtccgccaatggccggaaacgagaacgcagcggctacaacccggggtgactccatgttgaaggttcctcccgccaaagcggagatcggaacgtcgacgacatccgaacccgagaaggatcctagtgcggccaagccttgtctttctgacaggaatcacgagccgacgaggattacttctgaggtgacaaagtcttggtgtcctatccacaaaaccaggaaacataccctgcaagcctgctgggtctttctcaacgtccattctgaaattcgtgcctgcaaagagcgtggaattcagcgtacctctccaactcgtgatgtctattgtcctattcacaagacaaagaatcacgacctctcgagctgcaaggtctttctcagcgccatgaagacgccacctcctaaggtccagcagtcacgcatccccatcagggatgaggacaaggaacaaggagcgacgccaatttcagatcgatttgttggggtaatcgacatcgatccccatgaaccatcagtcttgcacctactcgaagactatggatcatcgacgagtacgccgcgtgaggtattgtctatcgacgatgtcggcacgtcagcgcgcaccaaagcgaaagcggagaatcaagtgactactccgacccagcacatcagagccgtcaacgcaatactgagggaaaccccctacgatcccattctcaatgacgatctcacacattggacagaatgactacgggaatcagtgaccaacctcagcaacgcgttcgaagaggccgctgctgcagcgcacccggaacagccaccaactggcgatgcaaatggtgaagaccctgaacggcgggaatcacctcatcgagcgacccctccacctcgcggcaccagtgatctccgcgatcacctgaatggccgccgagaggcacgacacacacaagacaacgagaaccattcccggcgtcatatctcttcacggcgtcacgataacgaagatcgaggaggccgttcaagcgaagaccgagaccgtgataaccgccacaaccgccacgatcacgacgatcgtgaacggcgggtgttgggcgatactagtcgaggacgtcgcaataatgacgacgatgatggagatcggcgccgagacaacagcgggagacgacgacaggattctcgagaacccagccgacgtccccgtaatcgtatgccggaaccaagcgacccatcgtcatcgtcatcatcctcgtcatcttcatcatcggatagacatccacgaaggacgcatgatcgccgacaacccaccgcccccagcgctgggtgtagagctttcggtcgttcacttcaggatgtccgatggcccgaaagattccgacttggagcaatagagaaatacgatgggagcaccgagtcggaagagttccttcaggtttactccacggtactctacgttgccggagcggatgacaacgcgttggtgaattacttgccaaccgcattgaaaggctctgcacgttcatggctaatgcttcttcccccctactcgatctcttcgtgggcaaacttatggcagcagttcgtagccaacttccaaggaacttacaagcgccacgcgatcgaagacgacctacatgcgttgacatagaacccgggcgaatccttgagggattatgttccgcgctttaacgagtgcagaaacacaatccccgagatcaccgatgcttctgtaattcgcgctttcaaatccggtgtcagagatcgctatactactcaggagttggcaacgaggcgcatcacgactactcggagattattcgaaattgtcgaccgatgcgctcatgtggatgacgcactgaaacgcaagaacgacaaaccgaagaccggaggagagaagaaaccagccaaggacgcacctgagtcaagcaaaaagaaaaatcgcaagagtgggaaaaggaaagctcaatcagaagttctcgcaacagaatacgtggaccctccctagcgcccagacccacaaggcagcgacatgaagaaagcatggtgccctatacacaagacggacagacattctcttgatgattgcctcgtcttcaaaaagtcgctcgcaaaacacatggcatcggaaaaagacaagcgagtacgcgtggttgagaaggacgctgacgcgcctactcaggaatcggactcagcatacccagattccgatctccatgtctcacacatctttggaggttccacggcatactcctcaaagcgagaatacaagaaagtggaacgtaaagtctgttcgacgtggcagggggctgtcacgcccggaatttctatccaaaattccaaacgcttacatgtgtataaaccctcgtccaggaatcagccgaggcacaaaataacaaattgataatagagtacaattattactctaattaataagcgaatataaagtcattacagaggtagatagttcctctcaaacaaataaggtctaagcagcggaaaataaaataaacagcgcaggcgactccatcccacaagcagcttgaccagggctacgcctaatcctccacaccatcagcatcactgtagaactcctcctctgatgaatgattgcaaggtgagtatatgacatactcaacaagccacgcagcaaatatgcaaatgcaggggataacaaaggatggcataatatagtctcatttgcataaatggcattcaataaatacttcagaatttagaaaaacagtaaagtatttaattaaacaatattaatccaacgctatacaacatacccgttgcataggcccaaccattctgaacaaccattcccggctgcacagttctatctccaaaccaggaatataccattccaaaccaggagctaaacaagttattaacaattacagcatcatttattatggtgagaggtatgagactaatcacaaaagacattgttagacccgcccataaccgcgggcacggctattcgaatagttttactctggctagaggtgtaccactgtacccacaagacacaacctcaacatcatgtcaaccatgcgtcgcaatacttaacaagtacctgaatagagattgtgacaatacccttcgcataacataattcaaagcagtgcaccgttcctggatcataatcacccccattataaacaaggcatggactccccagcgacccccgtgggcttatctccgccacttcacagtctggtgctctacaatgaaccacactatacaaaaggtaaagccgttgcccacgctggcttgtggttggcacggttaatgtttcacaaccgaaaatcgtgaaccggtccttaattgtcatgagcacaaccatcaaaaccatgtgctcacaacccaccattatcatattttaattggcatcttaattaatcaacctatcatgattaaccatcatgagctaccattaagccatcattaagtaatagtgaatcattaattatgccattcatatgagctagtgtctctaagcatggctaagcatcctaattacttcagctaaaaccatataatgttctagctaatcaaattattaaccaggggacaaagtataggtaatcaataacaaaaggctataacaaaggcaataggttattcccacccaatgacattcaaaaataaatgcaatagttgaatagaaacaatagctttaaacgggatcaacatgctcaaaggattgtttgggatttgtgtgacttgccttgctggccttggaactcctcaaagtcttctcctgcaaaatcggactctccgggaacgtcggaatctaagcagaaaagaccaaaatcaccaaaacagtacataaacaatcataaacagcacatgtggatatttttaacatgtagatctcaattttagaaaaatttagagacttgaaccaactaaatctgagctaagatgaattagtaatgaatttttaaagattaaactggattaaattatttatttagattttaattggattatgacgcaataaagaattatatttgaaaggaaaaaggatttattgtgtcagcgggctcgggttcacggtggaccgagtgcacggaaacggtctacggatcgaacggctaggatctaatctaatccaaacgaacggccgagatcgatctaatccaccacgggtctacggctgacgtggcgctgatgtcgacgatgacgtcatcaccggcggcggctcggcacctcgtgctagccagcgaatgatggcgcggcgacgcaaacggagggcacctacgcgtagagggcgacgcggcgaactcaccgagggctcggacgacggcggacgacaacggacggcgacggcggcgaggtcgaagcggcagagacgttcgggtcgacgatgacggcgatgctccggcggtcttcgacagaaacaaaggacgggacgaggacggtgacgacttggcgatcccgacggcggccttcccgagggacgacgacgaccggagcggtggcggcgcacggctggactcgcggcggcgacggcggcgcacgggctaacacggaggcggcgctacaagcggcggcaagctaaggcaaaggtggccttttataggggctagggggcggcgatggaggcccacggcggccggcggcgagaaggaaggtttagggttaggagggaaaaacgaatccgaatcgagatcaaatccaccggtttccaaacaaaattagccgaagattccaaaagagaaaaggaagaggagatctcgaggatcatttcccctccattgatttgatcggatcgttaaagggtcgacggaattttggaagggggcggcgacggcttgcgcgctcttgggcgcggctacggcgggaggtagacgacggccctgacaggtgggccatcattgggagaactgcactcgcgaagttcatggccgcatctcactatgcgtatcaagtgttcaagatgccaggactgaagggaacaatcactattcaagggaacgctaagctggcagtacaatgcgacaagcggagcctcgacatggtcgagcacatgcccagcctgcctgccacagcagagccacccaagaaagtgagcaagacaaacaagacgccgaaaccagacggcgcaatcaagatcattccactctccaatgccaaccccgacaagaccatcaagatcggggcatcactaggcgagaaataggaagtcgcgctcatcaccttcctccgcgacaatgctgacgtgttcgcttggcagccgtccgacatgccgggggtacccagggaggtgattgagcacaaactcatggtgcgacccgatgccaagccagtaaagcaaaaactgcggagatttgcaccagatcgaaaacaacccatacgagaagagctcgacaagcttctcaaagccggtttcatcatagaggtactccatccaaagtggctagccaacccagtcatggtacggaaggccaatgggaagtggagaatgtgtgtcgatttcaccgacctcaacaaggcgtgtcccaaggatcacttttctcttcctcgaatagaccaactgatggactcaacagctggttgcaagttgttgagcttcctcgatgcttactccggttaccaccaaataagcatggcaaaagaggataaggagaagacagcattcatcacgtcgttcggggtattctgctacgttaagatgctattcggactaataaccgcaggaaacactttccagcgcacggtccaaggtgcacttagcgaccagctcggaaacaatgtcgaggccttcgtcgatgacattgttgtcaagaacaagataagcgactcattgattgacgatctgcgggaaacgttcgacaacctccgacgatatcgcctcatgctcaatccagagaagtgcacgttcggagtaccatcgggcaagctactcggcttcctcgtctctagcagaggaatagaagcaaatcccgagaagatcaaggcaatcgagaacatgaagtcgcctacaagactcaaggaagtacagaagctaaccggatgcatggcagcactaagcaggttcgtcgctaggatgggagagcgaggacaacctttctttgctctgctgaaaaagcaagacaaatttgtatggacacaggaggccgaagaggcattcattgcactcaagcgctacctataaaatccacctgtacttgttgccccctaacctaatgaagaattatttctctatattgttgccacgccatattccgttagcactgtcattgttgtcgagagagagaaggtgcaacgaccagtctactatgtcagcgaagctctccacgacgcaaagacaagatatccacagatccaaaaactgctctacgcagtaatcatgacatcaagaaagctacgccactactttcaagcccacaaggtcacagttgtctcctccttccctctcggcgaagtcgtgagaaacaaagacgttgtcggccgcattgcgaaatgggtagttgagctaagccaatttgatatccacttcgtgccacgaacagccatcaagtcccaggtacttgccgatttcgtagccgattggaccatgcctgataacaagttagacaaccaaatcgacaatgaaatatggacaatggcgttcgacggcgcactcaacagccagggagcaggggcaggattcatcttgacatcaccttcagaagatcaattcaagcatgcaattcacctcaacttcagggcaaccaataacacagccgaatacgaaggactactcgctaggataagagctgcagctgcactcggagtcaggcgactgatcgtgaaaggggattccgaactagtcgcgaactaggtgcataaagattacaagtgctctagccctgagttatccaagtatctcgcagaagtcaggaagctggaaaaaagttcgatgggatcgaggtccgacatgtataccgtaaagacaacatcgaaccggatgatctagcacgacgtgcgtccagacgagaaccacttaaacctagcaccattctggacgtcctgacgaggccatcagtgaaagaggcaagcggcgaagatagcccggtcgcccccgacaccagctcgggggctacagaggcagagcgtgccgttgccgatatcgagaccacggacgactggcgcaccccactcattaaattcaagcagccacgaagagttgcccgaggacgacgcagaagccgagaaaatatcccgtaaagcaaaagtctactgtatgatcggcaacgatctatacaagaaggcactaaacggggtactcctaaaatgcgtctcgtccaacgacggcagacacctcctgctcgacatacatgaaggggtctgtgggtcacatgccgtcggtcggacattagttggaaaagctttccgacaaaggtttttctggccaaccgccctcaaagacgcttgcaacatggttcagcagtgtgaagcctgtcaattcaacagtaaacacacaaagctgccagcacaagcactccagactatccctctcacttggccgttctcgtgctgcgggctagatatactcgggccattcccacgaggacaaggcggctacaggttcctattcgtagcgatcgacaaattcaccaagtggattgaagcgacacccacgggggaaaacaaggccgacaacgccatcaaattcatcaaagggatattctgcagattcggattgccccaccgtatcataacagacaacggctcctagttcatcagtgccgatttctaggattactgcattaggttgggagtcaagatctgctttgcctcggtttctcaccctcagagcaatggacaagtcgagagggcaaacggcatagtactacaaggaatcaagacccgcgtctacgacaggctcatgtcacacgacaagaagtgggtcgaggaacttccatcagtactatgggccatgcgtaccacaccgacaacgtccaacaaggacacacccttcttcctcgtgtacggctaagaggccatgctccccaccgagctacgacatcaaagtacacgagtacagaagtactccgatgaggatcaggaggagcagcgatacgacgatgtgaatctactcgaggaacatcgcgaacgagttgccgttcgagcagtcaactaccaacaagcccttcgccgttaccatgagaagcgcatccgagcacgcacgctttcgatcggcgacaacgtcctccgacgggttcaaaaccaagcagggcacaacaagctctcacccaagttctgcggccaggcgcattcaaaatcgcagacggcgatggccgcgagttggcaaattcctggaacattgatcaattacgtaaattctatgtataagtcaatagtatccatacttgtaagacatcttacagcctcaataaagcctattattcaggtacagacgacaatcaaagtgttccttcccgatgatcccttacccagatgacacctagcattgaaacctatcctcatgtccctttacgccgtcttgacaatgcctccgaggaacccaagggaacttcggctagggacgcccagagccgataaggccttgtcagatcctgtagagacgaaagaccatgtaagatctggtcgcgtaagagttctcgccgtgcgtattaaccaagccatgtaatcggaaataaactttccaacttcatggctgggggctaggatcagtgcttgttcaaccgaggcaggtcaaaggtccaagagccttatcttccgagaagaattctccgatgacaaggctgggggctagggagagtgtataactcaaacgactgatcgaagtcgcgaagtgagaagacactcatacacactacgtctagagtaagaaagcttagtgtcgacgtttgatgtcgcaattctggtatttgcatagtatggggattgtcggtgctaggatatatgtgagactgaggtaaaagagatggagacgaggatttttatataggttcgggcccctgaattgtcaggtaatgaccctacatcctgttggccggagccggtattgctcttattcatgataatcacaccagtacaatgtttggggtagcctatctaactactgtcgacatagcggactgacgatctgactcgtagtcgacaacagggtagccttcctcctcaaatccgtgtccggcgagatcagagatagcgctttcgtttctcctgacagtatccgaagacaccgtagggtactagccatgcctatccttgaagtcgatatccgacgtcttgtcttgaagtatgttggattgtatgttgtggcttctgttgttccgtatattgtggtggttgttgattgaggtggtcgtctgttgattgtctatccgtattgatcgtctcatggtgggtgtccccctgtcctcctaggggggcttgtatttatacccataggtgtccccttgtccaagtagaactagggaaaccaatatggatacaatccgagtagtccttgttgtttccatgtagaactctggttgtctttccttatccagaactccctcgaggtcagttttcatataagacatggtatgtggtgggttctgccgagatttagtcaactactattaggtatgtggtatccataacgctgccagtagcccccgacttcaataaaaatgaacgagttcatattctcaaccgcagatcttggaggaactgttatcgagctaacgtgatcgttcttggtgagttcagagataacgttagacttcctttgtcagccttgtgcaggcaccgaaagggtttgtctaagtcaatctctgatgtcgaccgagaaagtacagagcatacaacttagtctcccgccttgctgtaatcgaggatttggattgaagtcaagaaattttatctcggtgggtacaccatctcttcattccgtattccttgtcgagatccagcaaccgttctcgagtgatcgagaaggcgtagagtctatgacggagccttgtcgacatttgtcgtactcgccttagtcgatcttggtgtagaaccatagagacatggagccttcgtcaatgtcgaatagaattttcctgaaatcaatactcagaaaagaatattagatagaaatagccccccgagcgaacgctcaaagggtaacatgttataatataacagactagtgaattgaatgtacagaccagtgttttgtatatgagcgtcttctctcttaccgactccgaacagtcagtttatagagtcatacactctccctagcccccagccttgtcgtcggagaatcgttctcggatgacaaggctcttggacctttgacctgcctcggtcgaacaagcactgatcctagcccccagccatgaagttggaaaactcaatttccgattacacggcttggttaatacgcacggcgagaactcttacacaaccagatcttacatggtctttcgtctctgaaggatccgacaaggccttatcggctctgggagtccccagccgaagttccctcaggttcctcggaggccttgtcaagacggcgtaaagggacagtaggataggtttcaacgctgggtgtcttttgtggtaagggatctctggctaagacacttggcgatcttgtgcacctgatatcaactttgttgaagcaggggtaatgggagaatcgctacatcgctggtcgaggaccaggcagtagtcgtaactcgaccacttgaagtggaagtagtgggagaaacgctacatcgctggtcgaggaccaggcagtagtcgtaacttgaccacttaaagtggaagtagtgggagaaacgctacatcgctggtcgaggaccaggcagtagtcgtaactcgaccacttaaagtgaaagtagtgggagaaacgctacatcgctggtcgaggactaggcagtagtcgtaactcgaccacttaaagtgaggcgttagagatcactgcgtcttactgattcgagaaccaggagtaggagtctcttaatcacctataggggcgctaaagttggtttattacatgtgcatatcatgtggccagcatgactcacacacccaacttgtagcatatccggatgtccgttcgcaatcatgtcgggtgatcaagccgacggcgttcgtgaggaattatccgttaacaaccttttctcgagtagtccagcgatggccggcgctatgagataggtcgtcggtcttctttggtaggttgggcgcgacgactctgcatttgtcgagatcgttctcgataatgcggtgtactcgaccacgagctactcgagtgctcaattgttcctgaaaaatattttctaggagacaagatgtatagcagataaaatcgagtatgtactcaaaaactgcatggatcttctagtattatcaggatataacgagcagatgtaaatatcaggcattatgtaaaccgtaaacaagcatgatttatacagaagaaaatagagcgagcccccaacgttagaccgtagtcgatttaacatcggggatactcgcgcaacagatattattgtataaagaacatgctctgggtaaacataataaatcatggatctgataatgatgtatgatctgaatatgtatgataaattgcatatgaaattagtagatcaatttgaaaaaccaatctaccaattaccttattgcgtactcgttggacatcatacgatctgacatcttttggtacgccgcgaagcttgaggcttggttgatctcgatagaccaagttgttgatgacgatgatggttccgatctaatcggaagatgtacttggacaggttggatctccccacagccgaagtcgtcgagtagcttgttgtcggagagtccatctcttaaacccatctcatcgaaatcctgaagcaccaaaattcccctacctggcacgccactgtcgacgtttgatgtcgccattatggtatttacatagtatggggatcgtcggtgctaggatttatgcgagattgaggtaaaagagatggagacgaggatttttatacaggttcgggcccctgaattgtcaggtaatgaccctacatcctgttggccagagccggtatagctcttattcatgataatcacaccagtataatgtttggggtagcctatctaactgttgtcgacatggcggtctgacgatctgactcatagtcgacaacagggtagccttcctcctcgaatccgtgtccggcgagatcagagatagcgctttcgtttctcctgacagtatccggagacaccgtagggtactagccatgcctatccatgaagtcgatatccgacgtcttgtcttgaagtatgttggcttgtatgttgtggcttctgttgttctgtatattgtggtggttgttgattgaggtggtcgtctgttgattgtccgtccgtattgatcgtctcatggtgggtgtcccatggtgggtgtccccctgtcctcctaggggtgcttgtatttatacccataggtgtccccttgtccaagtagaactagagaaaccaatatggatacaatccaagtagtccttgtcgtttccatgtagaactttggttttctttccttatccagaactccctcgagatcagtttccgtataagacatggtatgtggtgggtcctaccgagatttagtctactactattaggtatgtggtatccataactctgacacttagttagatttcttttctattccacaagtatttcttacaattccatcaaaatccaaaactatattacactttttccaaagacatttgtcacaggacacggagactaccaggaaggccaacgccagtccatcgacttcgccaggccatctatctccgtaggagttctccaagaacgagaaaacccttcgcggaggaactcgaggtgcagctgcggacgatgatctcgtatacaggccagcacgtaccccccagcatatcggcttgagcgacgacactcctgcttcaaggtctcgtcgatacgttgaccgatgccttcgagctgggcacagaccccattcagccacgagatgtatccggccgccgattcctcgggatccgcacggggtactcagagctctctacagactctcaacatggatgtgcagcaactcttcagatacgagttgaaccacacctcacgaccccggagtgtctctacggcctggtcctttctcacctccagtatagtcctctcgagttccgcgacctcaaacttcgtcctccaatactggatgcgacgatccaggtcaacaagcgcactctcgagatctgctcagcatggaaacgactaagtcaagctgctcttctatcatgagaacacaacaaatcaagtcgatccagacggaagggcaaaggaaatggtaacaaagacaaccaatctaagggagtcgccgccatgcttttccacaggtgaacttcgatctacatcgccttctggcacatatggttcggacgcaagtaacgaaatgactactggcaactcaggttgcccacgctgctggacatcctcgacatcaacatctctacaaaggacaacaaagtactcgagatcaaaatgcctaacaaagctaaggcaatgaccgcacacactagggcggttgggaccaataaaagttttacaaggcatgactaaagagtacaagagagctaagaccctactcctcaaaaagcaggaggacggactcccccagatcgccgacctcctccatcacatccttgcgcgtgtcgctagccgccccctgatccaagatcttccgcagatcgagttcaggatgcaccagcctcacacacgcaaggacgtggcacgccctggtgtagatcccgttagacgtctcctctccgatcctggccgcatgcttggaggggatctcctccatcgccgtcaccagctccgcaagagaagacgtcagcaagaactcatcgggattcgccgggatggtggacttgataccgcacttcccggcgagctggtgcagaccagtataggtgacccgcaacgagccatggatttccgacaagttgttctcaagctccgacatgcagtgctcgagcccctgccgttgtcactcgttgtcggccaccagttccctcatcttctggaggtcctcgcgaacctccgccagatcgcgcgccagccgatcggcgcgctcattcgccgatgacgcagccgccgccctcgcctccacgatctcgcggctaacaccgcgagcaccagcctcgaggaggcgccccatctcagcctggagctcctcctaggtaaggacggcagccggcgaaccacgaccagccacgagatcgctggctgggccgctaggtgtcgcctcacggctcctgggcacgaccacgacatccgtcgaggccacggcaggagatgtgctggaggtccctccagacccatcttgcgtcgccttcgcccgcgccagaatagtgctacgtcataagcagaaataccacaagccataaatgggttacctagccacataattacagacagggacccaactcttaggcctgcgaaaggctgcgattgagacaaagttcgacgaaatcacgaaacctcaaatttattcacttacttctcgctgagcgtcacaagccgctgccctcgcggaggcgggggagacgcgtccgaggcctggagtacaatcaatatgatgtgaggtggaagttttccgactacgtgatcaaaaaacgagagaacttactgagggagtgggtgtcttccgacgatgtccgactacagagaagaatttcctcccctttttcggaacgtcgccaccactcgtcgtggcagcggcaacagcagcgtcagacgcctccttggcgaccttctccttcagcgacgccgccacctgatggtccacgactggcccgatgatatcagtcagagggagagcctacgtttcatgaagtcataatgcgatcccggaagaaaaatgcaaaaggacagctaagtacacttacattgatggcagcgtcgcgctcggctgccccggggacgggggtgttgctcgccgttgtcgggccgctgatcatcagttggccgatgcggcgctccacagttgcgctattcaagcctgtagatcgagaacagaatccgataagccgggaagaacacgcgcataagggagtcaatttaactaaaaaggaaataccccgaggagaaacctgggtcgcgtcctctagcctagaataatcaaaggcagaatgggctcgagcctgaagaggctggatccgcctaccaatgaagtcggcagcaacttcataccctgacaacccctgttctcggaggtcatcaacgatatcgatgaaaattggagggacggggtcaaagcgggtttggtggtccaagatggaatcttgtctggctgttcctaaggtacaacgaagacaggatccaaatcctctatctgaatatagaaccacctcccccgccatttgctgtgacatgaggggcactgaaaggggatgtatcgcgacttcaggccatcccgaagtcggaaaccaacacacctggacacctttttggattccatccagcgtaactcatagtaaaagcggaagaggtcaagaaacggctccaccccaatgtaggcctcacaaagatgcgtaaaaatactcaggaaggcgatggagttggggttcaaatggagcaagaaaagaccatagaaattcaagaccaaaaggagaaattcagaaggcggaggaagaaaaccacagagaataaagtcctcaaccgcaaccatgcgacccaggacaggttggggttcagtacctcctacttccctctccgcggtcccgcgaccgggaagggcgccatcctcctgcagtttcttcagtgacgcactggtggaggtagtcttgtcgagatccatggccaccggagatcgccggagaaaagaccgagacgagttggctagggttttttgcgggagcgaagaagacgagggacgcttggaagctggagagttttttcaacaggcggacctcaaatgggatccccaaaactcccttaaatagacgcacctccgccggtgcgaattccaaggaaaggagagagatggccgccggaaatttctaggtccgttacacacggcagtttttcggacttcaatttacattcactcatgaccgttgaacttcactcgacgttgtcgatcactccttgtctcttggtccccacaccgagaacaacgacaatttcgacatcagaagtcgcaatcgatttcacgtgttcatttaagcaaaagtcgggggctactgtcagggttacgggtaaggtataccctctacccttcgatatacgtcacgtatcgatatggtatgtttgcgcgtatacggacgttctcagcataggttaaggaagtccatcatggaatctatagatggaaagagtcctactcggataaaactgggtcgtcattatatcgtgtcgggtccaatgtctccgagtcctacttggagaccagttaacctacggtataaaagggaccccccgagaggacctaaggcatcgaatttcagagccaacacatccaccacagcctacgaagccggagctaatcgaagccaagtcgccgggagatctagtcggatcaactcgactacgatcttgtcggtttcgtcgagcttcactattccctttgtaatctttggtttccatcatataatcccatatcaactggattagggctattacctaccaaggggcctgaaccagtataatccctgtttcctgtttgcttgatgtcgtactatgtagatcctcgtaccagcgtaccccaataccctctatatctggtctacgggtatcccccatcgacaaataccaccagaagcaccccttgagggagaataagcaaacttgtcaaaatgtctaggagcaaacttcctgatgtaagaatgatcaaaaagagatcttttagtttcttgtaaacaaaagactgcacaaccactttcctccaccttattatgaatagccaaccacttatcgtcggaatttatgcctcttacattccaacacaacaccttccaattcctgaaacttgcattcatttaaacttaagataaaggagagtcacacacaaaccaggcataacctagtctacaacagcaaaagaccaaccagaagcaccccttcagggggaacatatctgcaaactcaccatctaagataaagacagaaattgtccaagactctccaacaccagctgttggatcttgaagaactattttgctaggaaccgaatcaagatccctgtacataaatctaacaaagacacgtccctgaataggatcttgctcccaccaaacgtcaagctgaccaaaagtagaaaccaccaggcaaatatattgcatagtaatgatgtagtccaagggaaagtcaagcaatagaaaccaaccctttctattaaaaggagcagcgcgccaattagggccttggtcgtgacgaacaaatttgacttggtagattccatcatacacaaaaaggaggagacaacactaacaggtctcggattacagcagacgcaaacttgaacaggccaaccgcagttgcatgaggaaagctacgtcgaacagtaaaatgttgagcttgttcaagaaaatcagtaatcaatacctgatgatcatcccagagctcttccggaagaataggctcaaccaaagccaaagcaaactcctcatgatatcggggggggctcgtagcagtagtgagatcaactctcgaaatgcgcaaatcacttccttgatgcaccacttggcccgcacgaagaaaacgaaggggattcggatttgtgttcgccataggcacaatctcgggagaaataatcagattcggttgcggaagaacagcggaagaggaagggacgtcctgcttcggagaagaagaactcctctttttctttttaacccaaacaaatttattccgagattgagagacattattaacaacaaccacctgttttttcgcattattacgggccaaacttttagcttttcctgttccaacagacttgtgggccgaggacttaactataggcttattagaagatttatcatgggctttgggacaaaaacgttcaacatgacccaaggaagaacaaccgaaacatctaacaggcaactttacagaaccgagcaatatggccatgattcaaacatcgaaagcaaatcaaagagcccaatttggaattcaaattacaatccggaaaaggaggatcatcatgcatacctt

SEQ ID NO: 67360 - DNA, 27203 bp, Oryza sativa
aaccaccaatagccaccctaagggcgagagctacagaagaagtagttaaccggaaagaagccctgtggagatccaacaccaaccggaaaggagaagaattgaaagaagaagaaaaatgcaccggcgttccaaaacaagaattaacctcatcacggatggaattccctggaaagaaatcccatccccccggaggcgaaggcatgaccatcgccgatcagaaggaatcaccattgcggtcgccaacggagtcgccagagctcacagaaggagtcgccattattcaaagttgttcaaagttgttcacaaaagggtatatgcgaaccgactaatagctatttttatcccgagactgacattgcctcgcatgaatcactttgtcaatgggaaagagcgaggtcgatcaatctacatttagttttgtggataacttaattaaactgtttaggatggtgttataaatattgatgtgattggattgtggtgtaaatactcttatatgaagttttattatattttctagtgatatgttatgaaatgaggatggcatcctctttttctatttgatatatatgatgagattatgtgatgatttctaagatgaagtatataacttgtgatgaaatatggttctaatgtatagagaaatatgtaatccctgtaattgtttaaagagataggggcagttcacttcagtgaatggctcatggaaaaaaaatttcgcgagcggtttgcttaagtgatctgcccatgaaaacatattttcactgacaatttccttaagtgatctcacatgaaaaatgattttcacagtcagtgttatgaagaaaacaacccctgcaaaggagtctccacatgcggctccatttaagcttgtgtaaatagctgatttctgcagatcctagactgtaggcggctggattaacgcttgtacaaagttcactcaaatgaacgacccgtgataaaaaaaaaatttcaccgatggtttgcttaagtgcttcacccatgaaaatgtattttcacatacagtttgcttaagtgttccacccataaaaaaaatcttataggcagtataagaaaaccacccatgagaagttgtctccacatgttccatgtaagcttatgtaaatatccgattcccacatgccctagactgtaggctgctagattaacgattgtacaagataggttatcagacgtcggcagaaatgtttcatgtaacaatgattagatcaaaatttatggggtgtatgagttgccagagtttaattgagtgggtaggtgtatttccaatagaattttcataataagtttaagggttttacatctagtccatgtcttctttaaccaattattaatcactactaaaaaacaatttttctgtacaaggacctctttagatttcagatggactgtaactggtcgcgtctgtaaaaattatcctatattttcacgtgcaccttaagaggaccacatggaaaatcggtttccgtagaggggcctcttaagtggaccacacgtgaaaatgagcttattttcacaggtgggccacttaagtggaccacacgtaaaaatatcattctcctttacagattttttttctcccctcctctctctctctctcttccctctcactcacttcaaatttttcacctcctcaaggtaataaatagcgttcgtagcacccgaaatagcggcctctatagcggtagcgaacctctacagtagcggactgctaatagcgtattggaacttagcggccgttatagagcttcacgaccgctatagcgcttgctatagcgcttcgcggccgctatagcagcccgctattgactttgttggatcactataatgcttaaatagtgttcttcacatagggaaagaataacttaacattgtgtaccttctttatcttatatatttatatgctatttcataattttttatgttatgaaatgtataagtaactaagcatacagtctaaattttaaattttaagtgaaacttgatgttaatattgatatacaatctaaagttatggttatttttttaattccactattggagcttagcgtccgcaatagcacccgctatccgcaatccgctacccatacactaatccgctaccaaccatctatacactatttattaccttgcacctcctctatcttcctttcccttttattttcactcctttctctctgactttctctcctttctatcttcctctcctcacctcttctccgaccacacggcacgcggggcacgggaggtgacggcgacgggcagcggcggcggcaacggagggctcgggcagcaagggagggcagaggaggcgcgcgatggcacggatccaacagcgaccgccctctccccgcgcggaggatcctgcgctggggaggcgcggcggctatcgcccacgcgcaggagcggtggatctagtggtcatgagacatggtggcctttgcctgcgcggatccgacggtggccgtcctccccccacacggcggcggtggatcgcacggtggggaggcatgggggcggcggctagcccttccgcacgggaaaacttttttcgggccgtttgcaaaaaaaatatattttgtagtggtgaataaagggggcttatttgtgtgtgttgtgtttaatggtacatgtacatagcaattgaaaaatggaaacctaaactccgaggtgatgcgtttgatgccgtgtcatgcttatcatgatcttgccttcatgcaaattggattgatcgcataaacacttgcatgcaatggcactcactcacataaatactactgtaatacccattgttaattggcgcactgcaacattgaagcttttgatggtgtccctctttaatttccttaatttcactagctaggtaggaaccaaatttgcatcgagattgtgaaacggaggtgaaaaaaattgcaaccaaggacaagtgctccaggccacgaggggcttctgtcctaggaatttgtgagagttttgagataccgcgtcgatccataccatcatcatttgactatgatcaaatcaggcttaaactttaataatgcaactgggtttgacctggctataattagaggcgagcttgttgtactaaaatttggttttattagagcatttcgaggggaaatctttcgctagttatgagtttttcttgaccatgcatgtgaagctgcgtgtggtttcacacttttttctttatgaaacttatcaatgcctttgttaaccaactgtaagtttctctagtcgatctggttatttccacattgcaagggacacatacacacgtattggtcactaattaactctccccataaattaactaggacgtgatacaaaatgatcattatatatattaattaacttgtgtacccccttcacttcggcaaacatatatgtaatgagagaacgacacttagcaagagcatcaagattatatttaagggaatagagaagtactcattatgacccgtttatcacacaaaattaaatatacagaagtatcattaatttcccttttttttttacttgatgcactggatatcaaacattttctttttcgattacactgaaggcgtatgcacataccactgcataagcacaccacactcacgcatctgccattgcgcatcctaacacacgtttcaaaatatgaaaaccagcggctaatcctaggcttacaaaaatactattaattagaaatgtatatattcacatgaacgtagtattcgtgagtaccaggatttgaactctcatttaagtagtgcacccacagctagcagtactccaccacacaactggtgctcccctcactggatgtcaacattgatatattcttagactgaaatgtgtttgatgctttttataaattagttttatgaaaattatcattagattgaatgctttcataatattaaagtctaattttattatataaactctgttttcaaaaagaggtgtgtcattgcagagtgtgtagaacatcaaaccatgaaagcctatctcactcttgtatatgcacaaatgctatgatttgatatatgtcaaaatgacattagtacattaatttcttctcatggaaaatactttcgtgtatgtgtatatgtaaataaattatgagtggatttcccctctcagtcaatacctatgcgcgcgaggggaagagaatcatgcgaaatggaagtgttaaggttaaactacctgtagtgtatttaacaagtgagtgtgcaatgatcaaagtaatgcaaaattctgtcaaaacatgtgatacatgttttccgaacgttagattgcttgattgacttgtttgagatgtgtgacaagtaaatgtttcaagagtatgtatacatgatacggcgaccacgagatgtatgcaaaaggtaaactgattatactacattagattactagtaccaaagatcacatcaagcagtaaattaaggaaacgtaaattctgataccagaggttacaccgcctaatataagaaacaaccacgatatggaagcatgaagtattataactcacattaatcaggtctcatgcatatattggattcacataatatttaagcacgcaaaatagtaagaataaaattttaacagttacattagacatgactaaaggaaaatggtataggtgtggcaaaatatatcaattataggaaaaaaagtttaattaccatcaaggatgaacacaaatttgaaaccacaacttctaaagaaagggaaaagctctcttgtgggcaagataaaaaaaattcgagctagcagcacaattgacaacacaattgatttaggaaaaaaatattaggaattagaaaatgcacaacttgaacggtccaccaagttcactgttctttctgtcgtgtagcgatttttttcgagatggtgcactttcagaactctcatttgtagacattattgtaaaaaactttgttaaattaccaagaacaaaattaattacattgacgcttgtgtacagctttattaagtcaaccaaattaaactcaaaagcttacttgcaaattaaatttgtcaaccaaaagttagagttaaatgtgctgaaaattaatgccattaccagtttacttgtaatttctcaaaaatattttagtgaactcatccgtccaaaattgatattaattcaatcaatattccagtttaggtcatgtcaaatccgagcccaatttaagcccacccaattaagcccggttaagtcgatcgagcttggcgaaaattaagagcatgtgtaacagtgcaagcaggacagccagggcaggcaaacccaatccccagaaattccaaggaagcttcttaatcaggcatgcaaagccgcaattagaccctggcttaacggttaattcacacacacaatactagtatacatttctgtccaagttaacaacaattagcagcactggccctgcagcaagcagcaacgggctaatagctagaatagctatagctcttcattaaaagtgtcccacatggcatggactcgatcgacgcacacggtgccggcagattccccaattcttcccaagctttttttaacccaagatcacacctccattgccaagaaatttaatgcccaaatcaggtcaaaacttgcagccacagctagtgtactactctcccagcataaaataatagtaattaagaacaagccaagccagctactacactgtgttagctactcctaaccagtgcaaagtgttagtgttaatctctctataaaaccctactagtggcctacctgatgccttactctggagtctagagtctggagcttgtagtgcagcagctagctagcatcagcagcagaagaaaaagaagaagatcaaagtagcaattggtgtgtacaccctagtgctacttctactactactgatcaactggtagctagtactactctccactgtatctctactatcctcaaatcagctagccactgagtgagctgatctctagacaccagagtgagtgctactagctcttgtgtttgtgtgtttgtgtgtgtgcaactgtgcattggtctcctccaaggcagtctagtctgcacctttcttggatctgaagctcataggcaccttaattagccagggagagtaccattttcttggttctctcatcatcagggtcacagaacaaagaattacagggtgagtagtactgttcatatttgatggttgattggttggttctgccaaaattattcatcttgttgtgttttgtttgtagtagtgtttttagctcatttgatttatctttttttgtttgttgacaggtgagtgagtgagtgagtgagtgagtgagtttgttcatcagaggtaagactgagaaattgaagttaaatcagcagcaacagcaacactgcactgaaaagcacaagatcttgtacctgagggggcaagagggcagcaagcaagggtaacctaaggaggaagcaacctcacatggtgagttgctggaaccaagcctagcaagctgcactttccaacggctagctcatcgtcggcttctccggcgccgcgacacggacaccgaggcgacggcggcggccgcagaggaagagttagctagctcgagctaggtgaggcagcaatggcgcctcctccgaacacgtactcggagtcgtggtggggtggcaaggaggagcggggcacgccggtggtggtgaagatggacaacccctactcgctggtggagatcgacgggccgggcatggcggcgccgtcggagaaggcgcgggggaagaacgcgaagcagctcacgtgggtgctcctcctccgcgcgcaccgcgccgtgggctgcgtggcgtggctcgccgcggggttctgggcggtcctgggcgccgtgaaccgccgcgtccgccgcagccgcgacgccgacgcggagcccgacgccgaggcctccgggcgcggccgcgccatgctccgctttctccgcggcttcctcctcctctccctcgccatgctcgccttcgagacggtggcccacctcaagggctggcacttcccccgctcggcggcggggctcccagagaagtacctccggcggctgcccgagcacctgcagcacctcccggagcacctccgccgccacctgccggagcacctccggatgccggagaaggaggagatcgaggggtggctccaccgcgcctacgtggcgtggctcgccttccgcatcgactacatcgcctgggccatccagaagctctccggcttctgcatcgccctcttcatggtccaatccgtcgaccgcctcgtcctctgcctcggctgcttctggatcaagctccgcggcatcaagcccgtcgccgacacctccatctccaacgacgacatcgaggccaccgccggtgacggcggcggctacttccccatggtgctcatccagatgccaatgtgcaacgagaaagaggtaatcaattatattgacaatgttttaaatagcgagctaaggcatttagcggttagcttctcaaacagctatagcgacagctgtagcaggctaaatggagctatagcggctaaattgtacataagaacaaatagctagaacccttctaaaacagctatagcgggagatttaaaaccctatgtacactacatattgatatggagttgtttccgagcatatgattatgaaattaatgttgtgttgcaggtgtatgagacgtcgatatcgcatgtgtgccagatcgactggccgcgggagaggatgctggtgcaagtgctggacgactcggacgacgagacgtgccagtatgctgatcaaggcggaggtgaccaagtggagccagcgcggcgtcaacatcatctaccgccaccgcctcaaccgcaccggttacaaggccggcaacctcaagtccgccatgagctgcgactacgtccgcgactacgagttcgtcgccatcttcgacgctgacttccagcctaaccccgacttcctcaagctcaccgtcccacacttcaaggtaatatacataccccttcattctaaagaaaagtccaatcctatcattgaatctggacgtagctagagtttgtctttttttttttagacagagtagtaaatagtacatgtcacactcttcatcttctttaagcaatatatatgtggagatttcgttgagcaactgaaatcatccgatttctgcaacaaaccgtacactgattgagtaatatcgaaacactcttctgcaccctgtttataaattgatactagctagtctaatagtatatgtgccaaatgtgcatatatataagtatatgtccaatgggattgaaagatgtgtgccttcagttccaagtctcagatctcaatggccagaggattgcattactataagttagccagtgttgaatcgcgggtagaaatattccctaagagctcgagatcagtatagtatacaaatgtgttgagattatgctttggtattagagcctaataaaagccatggcgacttacaaggtctgtaataaacctctgcctaattaattagttagtgattatttataatagtactactactaacaacatgttaagaggggtatactatttggactttggacatgcaagtaataagcgtttctgcagttagggcatgcatgcatggaccatgtaagtccaaatcatagattcggtacagtagttgacctccaaagattggctctccttttgactaaactgatgcgtgcgttcacattactatacatgttgcacaactgccgaatctagcgatacagtagtctcatctttagaataaacttaacttcatgatgcaaaatatgggacccatcagtcagtgagacacattatcacaatccattaatataaagggtctcttatgtttcattaattttatgcatggattatacatttttagaccgttttagatcggagatctacaagtcgcgaaagatgaggctaatacatatcgaatcccaaggtcaatggaatcattttgtgatttaatttgcttcttctagaataaccaattaattaattaattaattaacaagcggataattaggtcaaacatgttggagatcgatcaatcaaacaaactaaactaaatcgaaatgaaattttgtgtacgtattacaatagggaaacccggagctagggctggtgcaggcgcggtggagcttcgtgaacaaggacgagaacctgctgacccggctgcagaacataaacctgtgcttccacttcgaggtggagcagcaggtgaatggcgtctacctcagcttcttcgggttcaacggcaccgccggcgtgtggcgcatcaaggccctcgaggactccggcggctggatggagcggaccaccgtcgaggacatggacatcgccgtccgcgcccacctcaacggctggaagttcatcttcctcaacgacgtcaaggtatgtatgttaaccatgcatccagccatccacatgtccatgctccatggttgtttaatcagggttttaaatctccgtctaaaaagtgttttagctatttactctcatgtaaaatttaattgctatagctgtatttatttagcccgctatagttatttgagaaggccaaccactaaatatcttagcctgctatttaaaacattggctatggctactatgattgaacgatgccatttgttgcattcttgtattattctaggtcctctgtgagctgccggagtcgtaccaggcttaccggaagcagcagcaccggtggcactccggccccatgcagctcttccgtctctgcctcccggccgtcttcaagtccaaggtaataacctcatcgacgccggcgcgccggccgccgccattgctaatgagatgaggatgatctcgagctaattcagctctgacactatattatatgatatttgcagatctcgacgtggaagaaggcgaacctggttatgctgttcttcctgctgcggaagctgatcctgccattctactcgttcacgctcttctgcgtgatcctgccgctgaccatgttcgtgccggaggcggagctgccgatctgggtgatctgctacgtgccggtgatcatgtcggtgctcaacatcctgccggcgcccaagtcgttccccttcgtcatcccttacctcctcttcgagaacaccatgtccgtcaccaagttcaacgccatggtctccggcctcttccagctggggagctcctacgagtgggtcgtcaccaagaaggccggcaggacctcgtcggagtccgacatcctcgccctcgccgaggccgccgacgccgacgcccggccgccaccggccaagctccaccgcggcgtctccgagggcggcctcaaggagtgggccaagctgcacaaggagcaggaggacgccacggcggcggcggcggcggcggcggcgccggggacgccggtgaagaagagcaaggcggcgaaggctccgaaccggatcttcaagaaggagctcgcgctggcgttcctcctcctcaccgccgccacgcgcagcttgctctcggcgcagaggctgcacttcacttcctcctcttccagggcgtcaccttcctcgccgtcggcctcgacctcatcggcgagcaggtcagctagcggccaccaccacaattaagaaagaagagccaccgctgccgccgctgccgccgccatgcgtgcacagcgcgccggctggctggccggaggcgaagacgacgacggccagccaagacacttccatggatcgacagaggattacatttttagccttcttctccttatttttatccctttgatatattttttgttcagagataaaaaaaacagagtgcgtctccatgttacaaagaactcttcttttctttgtgctttaattagctagtgctttgttgctaggagaggcaagcaggccgcatcaggttgttaattacattcagattaagttgtgtcaattcagtagccacatcttgctaatttgccacattatgttatgatcaacatggtgatattttgtaacagatactgtactacatatcaatggataaatcaaatcttgtatgcaagtttaaagtgttcatcaatatctgtgcttgatgttggacgaaattgctatttaggctgtgtgttcggaggtgggtattgggaacctatttcccatgcacagaaaacggagcggtccattagcacatgattaattaagtattagctatttttttaaaaaaaaaggattaatatgatttttttaaacaacttttgtatataatttttttatataaaaaacgcaccgtttagcagtttgaaaagcgtgcgcgtggaaaatgagaggtgagtgttgggaacttgctcttgcaaccttagcgcagctgcgttcccaccgcacaagttttcaggttttgagttaaactttttttctaattcaagatgaaagtttgcacaactgaaagtttcttataattctaagttaaaagttgtatgatttaatttggttgaaagtttcatatggaagtgctattaaaaggaaaaatagtgtgcgctctaattagcaatcacttgtattgaatgatttatttattataaggcaaaaggcctgtccccaatagtatggagtagtacgacggagtagtagagttgagctgaaatcagttgggctgaggacgcacgcatggtgagcccaactttgtgcatatccagcccaaaactaggccacaaatggaccaattgcataatgacataagacaacaaattccaacaggccagaatcaacattcaaagcccattacattcatgttgcagcctgcaacagtagcgtaacaactcatctttctgccaagcagtgggctgggaaggagtacttctaggggaataagttcaccagagctccctcaacttaacagcgagattttttgaggtccctaaaccacaaaaccagaaatgttaatcccttaacttactcaaaccatgcaaaggaggtcccatggtagtatttacacctgattttgctgacgtggcatcctagtcagcaaaaaataaaaaaataaatatgcggggcccacatgtaagtgagagaaaatggtgtaggcccacatatctcctttcttttatttttctcttctcttctctcctctcgagctggcgcgatggcagactcgggcgtgaggcgaccggcagcagagctagggcggcgacagcgggagagggggagaaagacggccggtgcgatggcaagctcggcagcggagagtagcggcgcacggcgcggcggcaggggagaggagcggcaggagagggggcgccggcggtagaagctacttctgatatgtgccacccctgctgtcgccgccgcagccgagcatctggagcacctacctccgcgtggcgcccgcagcgagcaccagggagacctgaacggcaggggcagacacggccgcgttcccggtccccgccgtggcgaggatgcgccccgcgagtggctggcagaaggtgcgctgcgccgcggctagctgctaccgccggtgtggccgacttgttcttcctcttcgtcctcctaccccttctgctcctcctcttcctcttcctcctcacgccagttgcccttgccgcgctcgcggcggcgctcctcgctctcaccgccgcggccaccgggcgacatgtgcgggaacatgtgcgggtacacgatctcgggctccccctcgccatctaggacatacgcgaccttgaccgaccgggtgttgtagaatggcgcgttcatggatccctgcaatacaacgcaacgaaaccacgcgatcatataccaatcaatccaatgcgcagtgaggcgagggtgcatggcgaggcgcgtggacgacgacgcaaacacaccgcggtgatgttgacaacggcgacgcgaatgtcatgctcggcgaggtcgaggaagctgcgggtgttggcctcatagaggcggccgtggcggttggcgaacctaggcctctgatccaggatgttgaagggaccgcacgacgactcgccaaatggcagcagcggctagtgctgtccatagccgccctccgacacgtagtgaccgacggagtagagtggagtggcggcggcggcgaccttgtctccctccgtgctcgcccgtcgccgcctgcctgctccgcccgctgccccacccgcccaccggcctcttaggctcggggaggaagaaaagaagagggaggaagaagagaagaggagacgataggacaaagaaaagagaagaagaaaaaagaaaaagaaaagaggagaagagaggacgctgacatgtgggtcccaccatatgccacgtcagtgaaaccgtagaaaaattaggtcaatactgcctagggacctttttttttacacggttttttatagtttagggggtggagatttctggttttgtggttaatggacctcaaaaaatctcgctgttaagtttagggacccctggtgaacttattcctacttctaggcgatgcaggcatgctgggcttttacctagcaggctgcagacgtcatcggggataagctgggctggccaggggcagctggaagccgctttgctgatattaggccggcccgatatcctaattagctttgtgtccctaaattatgggcaagtctgttttgtctccctgaaccacaaaccagatgttttatttcaccggttcattttgtgtccctagcagtttagactacgttttagtgtcggcgtatattggggtgtgcctatgatcgctcggagtgatcaccccctattcaccccccccccccaatacgctcctctctctcttcttcctcaccttattctcttcctactacaccataaattttaaaaaaaataaaaaataaagttggaaaaaattatgtatagaaatactatatgtaaaaaatatttaaattcaaatttaaattgaaagggatatataaacttttgacttataaactttaggtctataaactttaggtgtataaactttaaatgcatagaactactatatataaaaaatatttgaattcaaattcaaatttgaatctgatatataaacttttgacttatatttggatctctaaactttagatgtgtaaacttgaggtgtataaactttaggtgcataaatttattaaaatagaaaagtaatacggtgccaaaaaagaaaaccacgtggaggaggggaagttgatcgctccaagtgatccatcgccctttagcctttttgcgtctatttggcacattaacctgttcttcagttcacttcagaaaaaaaaaaacaattggacgcaagtgtcatcctctctctctgttgacaaaaaaatcgaacacatcggcctgggagatctgcttagctcctatgtaggtccaaatattgatgagatgcgggcgtgccagtcagtttgatcctgcaactgacaagatatgcaaatagtagatcaaaacagtcgatcggctgataagccgatggagtagttccagccgatgccgataatagccgatgccgataccagccgatagcgatagggtgtaagcaatcggctatatgtccaatgtagatgatgatataaaggcaatcggctgttgataataaaatataacaataatatagttcagtataaaccaatcggcagataatgatatgataaataagcatcgatccgaaggttaaagcacaaatcggctggaggtccgatgtcatgaaatttacaagattagattaaacaatgaaacctttgttgtcatcggctaaatccaacctatatgtatatgcaatccttatgagtcgatgcaacgtccagataactcaccggctgaaaccccgatgaaacccttattggcaatcaaaagcaggctagagattatggttctaagcacgacttagtagatcaaacttaactgatgcagcactaagtatgaaaagaaacataatatctagacaatcaagccattgattgtgttttcagggtggtagatgtctaagctaatctaatctagcaaagcgatttagccgataccggcagaaaccctaaaacgagaagcagccgatagtgctaaattgatatgctaagactagactaacagagacatatgataaataggtagacaaatatatcatccaaatcagagcaatccaagaggtcgaatgtattgatgcaacctttaacgacaccgatgtagatgagacaattgcctgggccggcagaacattggacttatcccttcgccagagatcgaagacgatgcagccccgcatcgggtgccaagttccgccggaacgtaaaaacaaaagtagaaaaggtaaaaggtggcgatgcgccgaattgtattgatcgtgaagatcgattacatagaccccgggtgtacatatttatacccatgggttgatacaagtccttgtcggacaagaaagaaactttcctaaagataaaaggaaaacataaagtccttatcggacactaaacacaaaggaagctaacaaactattcctaattaatagataaactaccatgccgcatcctctttaaactcggtcacttagggataagcttcctttagtagattgatttccttaaccgaatatagcaggaatccgactattggcgacttgataactcccatcggctgattccgagatgctgcagccgataatgattctaagccgatgacgtctttgccgattaccaaatttcactgttaacactctcactcttctagtgggacccatatgcaagtgaccacgtcatcttcttttctctatgcccttttaactctctccctcctctcttctctcttccctacattagcgccgcagtagcaacaccgacctctagcaccgtcagcaactccatcctcaccactactgcataacaccttaaaggtgccagttgcaaaactggcatacatgtcggtttcacatccgacaccaatgacattagatcattggttaatgtcattggtgacggttatagaaccaacacctttgtgctctctccaaaaatttttttaaagaaagagaagccggctcgaagcattggctcattgagccggtgctttcgagcgtcctcctacaagcagcccctaatcccatacatcaatatcacatattaaccacaataatccctatcctcatccatcaaagaccacagatcaacaacagcaatcctcatccccaaccatcgcagatcacagattaacaacaataatcctcatccctatccatcacaggtcaacactagtaagatgaagaactacacaagatgaagaactacccaagcagtcgcggagccaaggcccggccagcacgggcaggtgcccgggctccgccgcatatgcatcaatgcattagaactaactatggtgcctagccattaacctagctgcgtacatgcaccattagattagcactaattatcatacttagtcattagctaataccccaattttacttctatccatgataaaatgctatatgtatttgtgtttacgtgttaatttgttttctatcgttaggtttgcctaggctaaaaaaaaatttctaaatctgacactgtacccaagcaatatgaacccactctctctggatcctataatagatgccgctattttaaagaactggcacctacaatatattataggtacgattttaatttataacaggcaccaatagtcgttcaaaggtgccgatttcatatttttctctctcatggaggtgggaaactgtcaataggtgcccgttttttaaaaactagaacctatgagcaggtacctatgagggttttttaagtagtgcaccactgttggcagtaacgaattaaaaagcagagctaggcggccgcaatgatgtacctggaccatgatgccaagtgtgcgtggccaacactggggaacatttgaccatatcaacgcctctcctctcccaagctcagtcagaaaaaagaacagatcgacgtcatcgttggagagaggttccaattctagctctatgacatccactacggcaggaagggagcaggagaggagggcagccacgaccgctcaggaagaggtggagtggagcttgataggggaagggggtgtggaagaaaacaccgagagggtggtgacctcgcaagatccactagtgcataaggcatcgtctactccgccccgtcgatcttcctcccatggtgagccggcatggagagttggaggtcgaggtttgtcaaggcgaggatgggtcctttcgacaacgacgcaaggagaaccaattggtgctaagctcgaccccaagcagccacagcgtggaagcaggacgcaactgtctagatggcaagtggaggcgagcctctatgccaggccttccacctcatcggcggacaatcattgattcctcccttggtcaacattgaagagatgaggacaaggaagctaaggtgttcatgacaagtcaacgaggttccctctaacttaagtcaaaaggacgtgtgttcgtgacgtgtggttccatgagggtgggtcccacttatcagggatccatgtccctcttatttaagttaacgtagttttaatttaaggtacctttgtctactactatcagtctagcaccttgacgttggtaaggtagaatgaaatttacagtaaaaaaagtaaattttgtaaagctacaaatattttaactacgtaaaataataagatttataaggtgttgaatcacaaaattacagatttgatactaaaattatcataaaactacaaatttaaaactaagtatcacataactacagatttagtaacaaaaatatcacaaaactataattttagtaacaaaattatcacaaactataagtttagcaccaaattaatcgtaaaactaaacatttatagctaacataatagtagtgctaggaatttaagctataaatagtagttttgtgataatttcaatattaaaactgtagtttttgtgatattcagctctaaattcatagttttgtaacaattttagtgtgaaatatgtagttttataacgattttttgtgcggaatatgtagttttgtaaagctataaaatagtagttttgtgataatttcaatgttaaaactgtagtttttgtgatactcagctttaaatccatagttttgtaacaattttagtgcggaatatgtagttttgtaatagttttataggttttgtaatagtttggttaaaatacctgtactttgtcaaaattactttaaaaatagatcatcaagcaagtgcttagtcatagtggaatgtgggaactaatctatactgcaatccttcagatccgctgtcgcgtgggacccacctgtcatccctaagaaagaaaccgcaccgcgtgcacccaaaaaaaaaaggaaatgctgcgaaaaacaaataacgcgcacgcccgccggacctaacccacgccgtgccggccgccagacgccactgctccgcccgcctgaattcaccgccgccgccctcccccacgccgccatctccacggccctcccacgccaccgaagccacgccgccgcgccgcccgcctcacctcaccgctgagccgcacttccccccgctgcctcctcaactcctcgccgccggccggtaccctactccgcttgcaaccgtcgccatcggagccgtggatccgtcgccgccctgaatttcacctgcatccgcccgcttgtgacgtgtttgattttttttttgtccccggtgattcgattcaaattcaatctgatcctttgttggttttgattttttttgtgttctatatgttgttccctgtggtcgtcctttcgccgtgttcggttgttgcaggagcggatttgattggaagttcccaagtcgaggtctcaaggaagaggtcagtttcccgtctacagtccggtcgtttgatttagtcacttgggtcggtgattgatttcagatttgagtggttgattacaaccttcaatcgatggatggatgatcatcggtttctatcagtccttacacgaggtgattcgataccctgggttgattgttatttgtaaccgctgatctggcttgtggtatgtgtttgtgctcctctagatgatgcaggaaggagagtgcctgttgagatgaaccgaattggtggaggtttgattattatggtccaggttcatggttgctttgattattagttagattcatgatgaataggggtggtggaggtttgcttgttatggttcatggttcttttgattagttcatgatggttttgaaattattctgacacgaaagtttgtggtgccgtgacaaccctcactggatttcctttggtcagatcctcaaaatgtgcagatttctaagtggtttcgagatagatgtacgagagattgtcagatggaatagcaatgctttgtttggattctgacccccccccccccgcgcgatttgatttatgcctgaaaagtctgatttgggccgttggttgttcttcagaattgttggagttgcatctcatggtgagtcctatttgctgcatgaattggaatcatacatacaggccgctggcagttctttttgtgtgatcaacaattccccttaatcaaattttccatgtttttcgtcagtaattcttagttcttgcagatagcacataacaaagatggaatttgcaacccaaacctgcctcggtctacgagctcaagacaggctttatccctatgcactcaatctttaattcatgttttctgtacttaggctactttcttccaaaataatattcttgctctctgtaggtctctgaataggagtaatttttttatggcccgtctcagtgaagcacaccaccattttctcttcaattcgtcattagaagttaaatacttacaaagttgaatttcttcccaaataaatgttctcttgcttattgcaggcctatctcataattttgcaagaccaaccttcaccgagtgaaatctttaaatcaccgccattctcttcaattcatcattagaagttaaatacctcacaaagatatatttaaatccaatctattactcactacaggtttctacataatttctatggccaatctgagtgaatcctttaaatcatctcccctttctcttcaatttatcatcagaagttaattgcttgcaaagttgaatttcttctcgaatatttgatgattctgaacaaaatctgctcgaaagttgccacaaatggtctgagagaatagtgaaataagaagaaagtaattggccgaaagaaagctctgcattcgatgtacacctcaaaataatttgagtttttgccgttccatatgaattcattgttagctgcaagtttctatactagatgaacaattcttacatgtgtgcggagtgcactaaatttcccctgaactcccctgattcacaagcatttttaatagataaataccagcacttttatgcatgtgctgcttccttcggtgttatgtatatattaaacttagaagaatttcttctacacaatacagttgaccttttattggttcatgtaaaatttaattgttctgtttgtttctttacagggaagctatgaaattatgagaagtagcatgcctaagttgactctcttctgcttgatatgatgtcctgaacatgcattgttcaggtgagcatagttatctatattgagatcccttccgcatcgtgatcgcgtccggcccacaccccggtcatggccattctgtcctctaaaccttccagataaacaatttaagtacgtctccactggtatattttggtattcatttttggatttttttttctcttgtcttttagaacttgccaattttgttgtttctcaggaaatagttaaatgagtattttggctttgctgtttatcactacctaggaagacatgtcatgatttcttttgcttatccaaagtgtcaaacattttattttattagatcctatgctaaactatgtaactgctgctgatatcattttgtaattaatactctgcattttgtctacatgattttgaatcgaggcagcaggagcaaaacagctttgttcgaaggactcaatgctaggaatagcatggggttaaggcattgaatattcctctcccatgctctggaccgtttttctgttggcggtctaagtcaggcattgctccagtattagcttttggatggctttaattttattttgtgaaatttgaatctgataaaagtacatgaataaaaacttatgttatttcttatttcatcattgtaaactatgagatcaatctagccccaggaggtgtttgacaatatttgaatgtttattgaatcaactacctcttggatatgggatcgtctgagaaaaatgtgtgttcaatgatctatatagattctctccacttctggggctacagtattgagcttgttatgaaaatcaaagcttgaatttccataaagaatcataaaaaaagccacttaaagcatgttgtataatatccaaggtactttagttattcactggaagggatcaaggtaatataaagccacggttttgtatactatacctggcacttctgatatagggaatagttttcacttttagggaactaccgataaatatgtttatttttccaaattatcacacctttttttcctggaccatttatctttcctatgctaatataattatttggaaagtctcgcaatcgtattatcttttctctgataatatttcttttatatatttcacaaggttgcatagctgaaaatttgcagcccaaacatttcttctttaaatggcatcccataattaaatgttaaactgtttcttgctaacttatgtatttttcgagcttgcatggtgaaccatcaattctgaattatttgtacttgtctgttttgtcaattgacattcaagcaaccaacaagcacctgaagctatcctgatatacaaaccctgtgtggtctatctataaatgccgatattctttttatttgtttgaatctttagatagataatacgcctaccacaacgttttcttgaatgtgtatacattgggaactagcatgtatacttaaaatcaacaacaagaatgtatgttaatccatacataaatatatctatctggattggatgtagccaatctgtacatgtactaaatttaaaatagcgacggataataatgattcttccataggagtgtccatgacattaaaaatgccattgaagaggcaaatgaacacacaaaatattaggcaaataaaaagggatttgcaacaccaattggcactcctaatgcttaacatgacttttgtgcacgatctacataacaaaaacttttatatatgtctatccgtgacgtgccttgcacgtgcacgctcactagtaataaaaatggaccagctgtggaggaaaactaaggtgaaattttttatctttttagatcaaagaacatggtatatgtggacaacataacactacctgatgtcaaagaaaaaacataaccctgtgtatgttaatctgtatagctgaggcatccaccagagcatgcatgtgcagtatattattggttgaatttggaaaactagaatacgcaccatataacatatatcggtcaacattatcataatccccaaataaaaaagataactttaacaacaaaaaagatgcatctggcatgcagctactaaatccaaatgaacaaaattcatatctcccaaacaattttggtcaaaatggattaaaaactcaagacgatgtcaagaaatgaaaaaaaaatcgacatgctgcatctgcctatttaaagctcaagaacattcagaagaatggcggcgaaaccaaacacaacaatcgcatgatcagctagagatcgaaacagagaaagaccgtgacccatggcgagcggcggcggcggcgtgaggctgaaggccgggacgcggccgccgtgggtggggctagcggcggcggtgtgggtgcagatggcggcggggaacgcgtacacgttcccgtctactcgccggcgatcaagacggcgctggggtacacgcagcagcagctcgccgtgctgggcgtcgccaaggacgtcggcgagaacttcggcgtcgtcgccggcgtgctctgcaacagcttcccgccctgggtggtgctgctcgtcggcgcggccttctgcttcgtcggctacggcgcgctctggctcgccgtcagtggcgccgtcgtcgccatgccgtactgtttggtaagcactcatctgattccaaccagaattcaatctttggtattttcaaaacttgtattgggatgctgatatggcgatattttcaaaactttggtccaaaattttaaacaaaatttagtaacaaatattaccaaaattcatgaaaaattaaaaattttggccgaaataatatcatatcgaggatggtgatatgaccgaaatttcagaccctgattccaactccatcaggttaaactacatgaaatagtttctttaaatgatttttcgagaaatattaatcactcttattttctatagcaagtttataaaaataagactatataagtacaaacgaaactattttagcaaatctagccataccatttttaactattaaaaataattctccgttttatattataagatgttttatttttttaaaaaaaattatttgagtatgattaaatttataaagaaatgtaggaaacaaatatactatcaaactatagtcaatatattagatttaatgaaactaatttaatttaatgatataaagagtaaatcatcaatttttctatgatcaaatcttttaccttaacaaaatctcaattaagtgcaacaaaggttgtattaattccgatgctattgatgacatcacataacagctatggattgtgctagcaatggcaacaaacagcaacgcgtggttcctgacagccgtgctggtgaccaacatgcgcaacttcccgctccgccgcggcgtcgtcgccggcctcctcaagggctacatcggcgtcagcgccgccctcttcacccaggtcttctccggcgtgctccaccgctcgccgacgagcctcctcctcctcctcgccaccggcctccccaccatatgcctcgccaccatgtacttcgtcaggccctgcacgccggcgacgctcgacgccgccacaaccgacgccgacaccgaggaagacggccatttcgccttcacccaagccgtgagcgtcgtcctcgccgtctacctcgtgacaaccaccgtcctcggcaacgccatcaaactctccgatgcaaccagctacacgcttttcatcgtcaccgtgcttctgcttcttgcgccgctcgcgatcccggtgaagatgacattgttcaggagttcgccgcggcggcggagtacagaaacaacggaggagccattgctgatcccgccacatgtggtcgtcgacagcggcggcgatggcgacgaggaggaatctgacaaggtggatttgctgctagcggaagggaagggggcggtggtgaggaggacgaagaggcggcggccgaggagaggggaggacttcgagttcagtgaggcgcttgtcaaggctgatttctggctgctgttcgttggatacttcattggagttggaacgggtgtcaccgtgctgaacaatctggcacagattggtgttgctgctggtattggtgacactacggttttgttgtccctgtttgcgcttggtaacttctttggccgccttggtggaggtgcaatttcagagaaatttgtcaggtatgtgtgttatatggaaaaaaatagctaatttttagaaaattttgttgaaaagagaccgaaatttttatagagttattggcctgtgcattgtaacggtttttttattcggtttagtaaaaaggatttggacagagtgggttgattggtcttctatactatggttgggtttttaagaaatcggttttataagatggaagtatttttagaggatgaagtgcgggagaggaatggaaggtcttttttttttaagtagttgagaaaatcagaacagtccaaatatttattaccaattcttttttaaagaagtgttattctgttctgtggttaggtcgacattgttggttcctaggccaatatggatggcgttgacgcaaaccgtcctcgtcgtcgcttacctctgtttggcctatactctcggcccagccgtcgcctacgcttgcacggccaccgttggcctttgctacggcgtgcaattctcagtgatgattccaacgacctcagagctgttcgggctcaagaacttcggcctcttctacaacctcatgtccctggcgaacccgctcggcgcagcgctcttctccggtgagctcactggtcgactatacgacgaggaggccgcgaggcaacaacattctggtggtgtgtgccttggcccaggatgcttcagggccgcgttcgtggtgctcgccggtgcctgctcggtggggacggcggtgagcttggtattggcggcaaggatacagccggtttacatggctctctactctggcgggtcgttcaggttgcctaacgcgtcacagcaacattgagctttgcatttctttgaattgagttgttgttgcatgtcacgcgcgcgttacattaaattttggataattggattgctagcttggtttgtgaatattgatgacatgcatattattgaaaatggtttatgatatgtgaacaagggatttactagtttggtttttgggatcttttttttatgctggtgaagttttaagtttgtgagtattaccttatagataataagaagagtgttctatatgaaattacgaaattcgctagtatgtcacaaagtttagtggcgtactcacttttaccacaaagttgacgattattgcagattattcataaagttgagtgggaatgccatatcatcctttaagtactagaattactctcgtcttcttctccatcttctttctatctatcccctctcgttctcaactcttgcggcattgccaccaccactactcccatatcatcctcaactcctacggcattgccaccgccactgctctcatactgagcttttgatgcttgtcaacctgcctcaatgccattgtctaccctctccgagctctccgtagccgctactagagctcgcttgctctcgtgcttgcttgcctatcggtgaatctactgtgcgtgtatgctcggccgctggctttgccgtcagtcgttcgctgcgccgattgctcacgcgtgctcgccaatgttcagtccgttgccgctcgtccttgcggcaggcgcttgctagtgctctacgtcaacagcttgtcgatactcagccaccatctctcgccagtgctctactcacggatgcatgtcgtcgtttcgtcgagaatccaagaagagatgggaaatgaaagaagattagggtagaaaaagaaggtggggggcaaacgagggtattctgctgaactttgtagcaaatctgtaatgccacttaactttgtggtagatgttgagtatgctctccaactttgtggcgtatcagaatttttcatgaaatttgtttatttgtgttgttcttttcttatgaaaatgacatttattcagaaattcatgccaaataatttggatgatgcagaccgtatgttttataaaggagctacgaattgaaaaaaaaatacatctcatattcacatacccattgatcaatttaatttatgtgttgtttttgtcccatgttagacttcttcgtcttacattaggatatctcaatttctatctggagatggctaaatgatttctgacatcaaattaacaaaagatcgtagatgagatcgatctcttgtcaacatcggggctgttcaaattaatgcaattttcaaccatactattttttaagtaaagttgtcaaaaaaaaatatagtttgttaccaaatttaataaatacagaagaaatccttccaaaatttggtaaggtttatttttggttataatttaaacaggcccatcgacatggcaaatgttctctctctcttttagaaactatggcaagtgttctcgttggggaaaacgaaaactgaagtgaattttggcccagcccaaaccacaaacctaaatcgacaaaacaagtcttaatcaatcacaggccgatctgcgttaacagagaggaaacaaaatcatcccccaaccacaaaaccagatatccgatattcccttaactaatcaaaaccggccacaacaggtccttaggtggttttgactcc

SEQ ID NO: 67361 - DNA, 12023 bp, Oryza sativa
  unsure (1)..(12023): unsure at all n locations
tcagatggggcccgcttgtcaagtgtctcttctacctccctccctgtgcgccaacacagagaggagaggaagagtagcgaaggacgacgtggctccagcggccggcggtagggaggtcatcggggcgaggagatccgacgaccggccggaccaggcctgcgcctcccgccgagcccgttcgggctgcccatcctgggccacctccacctgctcacgccgctgccgcaccaggcgctccaccgcctcgccgcgtgccacggcccgctcctttacctccgcctcggctccgtcccctgcgtcgccgcctgctcgccggttgtgatattctgtcatggtaattagcagtagatggacaggcatcagtgacactgccgagtatccataccggttgtgatatactccctccgtttcataacgtaagtcattctagcattttccacattcatattggtgttaatgaatctagacatatatatctatttagattcattaacattaatatgaatgtgagaaatgctataatgacttaaatcgtgaaacggaggaagtagaaatagaataggcggtgatactaatttcaggtaaaacgaaatgaaatcacagtacaattcgcatgacataataaatccattgttgttaattgacagcgctacgctacgcataccatttactctgagcaaatcatacaccaattgattctaacaagttactatactctactctgcaagcaactggttaggaaatgaaaaaaaaaaggaaaaagaaagcaaggatcgaatctaagcagctgattccaacgagcaacaaggaaaatgggggtagaagtagaagcggggcggtgagaccagaggatggaggcgcaaatcggtgagctcggaggcgacgccacccgccacctctacctcgatgcggccccgaatccacctgctccgggcgcgtgggtctcttggtggccgggaaggagaggcacgggatcgacgatctggtggcggtggcggcggtggcccgacgaggaggaagaggcgacacggggcggggagaggagcagcccgctgtgcctctgcggctccgcttgatctccggcgaagctcctctaccgccgccggcggctggtggagaaaggtggacctcctcgccccgacgacctcctccccattgccggccggccgctgctgccgagccgctggagcctcgccgtccttctgaggaagagacacctctcttctctgtgttggcgcagggaaggaggtagaagagacacctgacaagcgggtcccatctgaggaaggatgagaagaggggaaaaagagttgacgtggcatactgacacgtgggccccatgtgggttccacgctgactcaactgccacgtaggttaaaaccggagtcaaaaccattaaagaacctattgtgaccggttttgattagttaagggacgccgggtatctggttttgtagtttagggacgattttgtaactcgaggacaagttgagggaccttcgatgtactttttcctaacagagatgtgctttagcggctaagcctaagctaattacggcccacgaccacgagcccggctgaggcccagggcccagagcccagggcccatcctctgcgccgctgccacctcctcatttcacctcgcttatcgcctcccaaatccactcgtccgtctccctccacccatggcggccatggccaccccgcagcaatgctggctccccacccgcgcgcgcgctccccctcctcctcctccacgcgcaccctcctccgcgtcccccgtctccggagctcccgcctccctccgcttccgtgggcgccgcgccgcgtcggcgtcggcgtcggcggcgaggaggaggaggggagcctccctgccctgctcccccaggtagcataccagcatcacttctcgagagtaaaattgcgccgtacgcgcttcatcccgcattggcggaggagctccgcttcatttcgatcttttttttgcttatccgcttcgcaggtgcgcgttggagacggctggccctggctttgatcccctagggctgtacaacgatgggccttcgaggaatgacacgcagtccccgctgtcgaacttcttcggagtactgtcgccggtgttcgggagctcgagcggcggcaggaaggagaagtcctatggacgaggagcagcaggttgccaagttaaccccttcctattttttgtgcgtgtaactttgagaatttgttgttaaatgcttttggaatatctgtactaatttacctatgcagtaccattctacatcattgtaggagcgtgttattacttattaggataaatgcgtagtttgagctgaagacgatgttatgttagtaaattgttagtgaagaaattattgaaaattttccatctaagtaatatgatgaagttctgagagagctaccatgtaatttacgtagtacttagattttttttaacacagatgtaatctggtaatggtaaatcctagagacttcagtatgcgtgaaaggaaacctcttgattacacatggttttgacataatgttatcagcaggatcttgcttgttataaatatgtggaactactactctaacttttcatgttgtttgtaaaattaactcaagttatgttcatatttttctatcagtgcaaaaacttattttacccatgcatgcctcataggctgttactgttcaattacttacgagcattgacctatgttgttcatgtatctgcagcttgaatccactttaaggctcagttcgttccctccctttcccaacctcccttcctcgttttccgcgcgcacgcttttcaaactattaaacggtgtgttttttgcaaaaaaattctatacaaaagttgcttaaaaaaattatattaatccatttttgaaaatttttttagcaaatacttaattaatcatccgttaatcgctgctccgttttccgtgcgtgggagtgaggttcccaaccctcactcctgaacgcagcctaataagtttaaccaactagaattcctatttaaaatgtgtcttaacccaagtagttcccttttgagcagctgcaattgaagatagttccattgacattggtgacttcttcaagggtcctctacctgggaagttcttgaagctccttggttatttggccttgtctcgacttggtatttatatacctctgggtggagtgaaccgggatgctttcgctggtaatcttgaccagaacagtctactaggcactttggattctttttctggtggaggtattggccgacttggaatatgctcccttggcattgttccatttatcaatgcacagattgtgtttcagcttcttgcacaactttatcccaaattgcaagatcttcagaaaaaagaaggagaggcaggaagaaagaaggttcttcagtatacaagatacgcatctgttggttttgcaattgtccaggttagattcttggagcacttatcatatttatttgtcaacatgattgattgaaaattggaagacgtgggatgtcggtttccagggtgccaagggggtacagttagtctcgtctagatttcggagtacttgagcaaacatatctatatgaagctctagaatattatgtcgctagtcgttacattatataccaactgacctttacttgataatatacctttaacctttttgacttgtattgaacatgtcacaaaatatgactgtgaatcttccagattttaggaatgctgggtgctttgagaagttaaagttttttgagaaactatattttttatacagcaatgacctagctctggcgtagaggacaaatgcttaacatatcacaaatactctggaacttatttccacatgctaattggcaaagtaaatatgctgttgaagcacataaaataaaaatcaaccttttgttttacccaattaagtttgtgctgttaagttaactatggaaaaactctgttctgctttgcctggttgtactatactcctagtacttcatagtattttgtggttattagttacaaaatattccttaatttgattgaaaattcggaatgttctagtaccttcctggctggtttctttaatttgtttacttcttgctaggctattgggcaagttctttttcttcgtccttatgttaatgacttcagcacagaatgggtcctcacatctgtgacactactgacgcttggatcggtgtttacaactttcattggcgaaagaatatctgatttaaaactcggaaatggaacatctcttcttatatttacaagtataatatcgtatttacctgcatcgtttggaaggacagttgcacaggcatttcaagatgggaattatgttgggcttctgacaatcatatgtatcgttccttttcttagttcttgggattgtttatgtccaagtaagcaggttttaatttgtcaagatacatatggaattcctctcaaattgctcattgcttatttgagatcacttgggtggtttcaggaagccgagaggaaaattccgctaaattatgcttctcgatacagtagtcggagtggagggctccaacgatctgcatatctaccatttaaggtttgctgtgcttccatttaattctatttaatgtctatatttccatatattttgtgcaagggttgagtttgagcttcagcttttagttgatactctggatgcttctcatttgaatacttacaattcagaactttctccaaatttattgatagtattacatttgcattgtgacttaccacatgttggaagaatgacctatcttcatttgatagttgtggtttcgtgcaaaataagggataattctgaaagttggtatgcagactcctagttgttattcttgattatatgttgtctgtactcttctaaccgttcatttgaatgacactcaattcacctttttggttcactttctatttttctttgtttattactttaaaccgttccattggcacttttgggtgtctgacttaacaatctaagggcatgtttgggggagcttctagctgttgcagcttctcctagaatcagacgctcccccaaacagtccagcttttggtctagattctgagaagctgtagttgtagaatctagaaaatgaactagaagctagaagctgggaaactcagcttttccagattctcagaagctgcctaccagccagttgcttctcagaattttaagctctccaaacaggccctaaataactttgtagagggtgtatggacgaattaaagccagaggatatcacccatatgttctgacttaacaatctaaataactttgatctaacaagagttggagcctgtaggaccaagcacacaattattctgttattttttagcaaatgaaataagatcaagcttctaatattttttttcttaacctctctccatcattgggagtcataattgttctaatttccattttatttgattttttatgtcctaccttacaaattaccaaaggaaatattgcttatgacttactatgctaccattatgagcaggtcaatagttctggtgtcatgcctataatattttctacatcttctttggctttgcctggtactttggcacgatttactggcttagagtttcttaaaaaggctgccatatccctaaatccaggaggtaaacaaggagtttctataattcttttgaaatttgttgtctttatatgggagatggcaatgcaatagacattttgtttgcatgtaaatcactttctgttaacttcatgctgcaggtgctttgtatattccaactaatgtactgcttatagcctttttcaattactattacaccttccttcaattggatcctgatgatcttagtgagcaattgaagcggcaaggtgcttcaataccgcttgtacggccagggaaaagtacagctgccttcataaaaacagtgagttattgttcttccattagaataaatattgttctttcaccgcatccgaatttttagtttatgtgcataatgtatatgttcctgctcatcagctcattcttgtccatctgcttggttaattcggtgcaatggttgtctgttacagaaattggcaatggtccttatctttgtgtagttatcaatggaaactgttttcgtagtgacatgatgtattaaagaactccaaaactcaggttgcaatcctctaaagaagtcagtaaccactaaacagtctgttgtctcctctgcagtgttagattcatgtgaggcacacctgttcatgaagatattctgttttctttatcataggaaatttggagttgtagtaattgcacaacttatgccaaccagactggttaaactcattcatggctcatatcatcagaaaatatcctagatcctatttataagtatcttgtggtatggccaaatgctagtctttggtggtggtaaggtcatttgctacattcagttggttcagaaccacatacaagagaatttaggatgcaatttatagtcaagactttcatccttctggatttatataaatcatagatattcctatgttggttatgtgattcataaactgtatgatgtaaatatgccatcccttggactggacaacatttccctctgttagcgggcatccttactacttctatctttttgaagatcacagtcagtaacttttttgccagaactgattgctgcgcaagacagtgggacatacagttacatttgatatgttatgcatgtgaggggcaccttttactttcttgctgcgtatcattttggagaaattgaacataaaaatctcaaattcaataagaaatccaatcacaactaaagtatatcaagtactgcaaaccattagcttctatattgtgcactgaaattaaattatctcattgcaggttcttagtaatatatctgtcctaggatctgccttccttgctgttttagctgctggaccatctgtggttgaacaaatcactcacttaacggcatttcggggatttgctggtacatcagtgcttatccttgttggatgtgcaacagacacagctcggaaagttcaggcagaaataatttcacagaaatataagaacatatgagttataaaatgtcaaaccgtaattgggaaagatggttaatgacactgaacattcttttacgacatgataccaaaatgataatgttgtattataattgggtcatgtggtagcatttaagactgttcaattttatgcccgttttccttctatcgtgcatatcacttgtatgtttacttgaggagcagaaaccatacatccttatgtacataaatatattagaattatttacctcagaatatgaactttctaccatattgctcagacctcatcagctatagtagaattggctgagtacttaatacatgttgagacgatgagaagcagttatttttgttttacatatgaggctattgcaaactctaatatagctggcatatgcttacttgtggacgtgaccctccccacatttggtagccttttctgcgatacagtatttaataatttaagtgagcactaagataactaagtgaacagttattggcgaatgagagtaaacatccaggaactataattatcatacagaaacgatcaccacttgtataattagtacgttactatttgcatcatttgattatattgaatgcagtttgtgttactctggatgatgatcttcagagaaatcaggttcttcaggtcgctccttctgtgcttttttgaatattgatgctatttttgagacagtaactgtttctctgtgtgatacagtgctagaagaaccattaatgtcctcacatctcgtgtcattgaagtcattgaccaatgagaagaatgacttccacctgttgcttagacctacttctgccattttttgtcgattctggcgccttcgccatgctgattggataaagcgagcggcccatgttctccactggtatgagtgtaacctgaatgtgtgctgcaggtgcttggaatgcatcatcctgaatgtgctggctacgcacttaatgtcatcggcttggagggagaatgcttccaattcggcaattgttttaacagttcttgttgatgatggatagctgtctctagagctgggaagcaatgcccatgtaagcaactcctcaccacaaaaatcacctggttttaggatgatggagttgaagaagccagttctgccaccatctgttgtggagctctctagcttgccacgaataatgaagagcatcaccttgacagggtctccctcacgggttatgtaggtgccttcagtgcgaaggaagtaggtcatgcgttcacagatggcatcgagtagttgatggtccattgcagaaaaaaatggcacctgaaattaaaattgaagggagcatactttagctgatcattattttaggatatatgtttactgtctatcattagtttttgttcatttttgtccttaaacatgaagagtaaggatgagtaaaggtgatgcttgtgattgcagaagatatttgcaggaacaggactcacgtacacgttcgacaagatcaaggcacaggtaccgttttatatctcgatgaagatctgctggtagttgtctcaagattgaatcctcttcaactccctgcgtagcaaaccacttgtatttgaagaattgacnnnnnnnnnnnnnnnnnnnnnnnggtatttgatgatctatcatccaatcttccatttctgtttgccacattctccaatcttcagtatttttagaaagagatctcatgtgtatctgtgaagcatttctttttcttattttgtgtactacataagtatataaagtgttactgaaagtgttttacaagataaattacctgcatgttgcctattagttgtgcaaacaaaccaatgctgagaagggttaaccctattgcaaataggttttcaccaatgaaggaactagtcaccaaaggattgccatacgtgctgtcaccaaaaatatatacaaaataacatttcagtaatctcaaaccatgataagtctgctacaaatattgcaagcagcatgaaagaatttgtaagaacaggtcattatgaggttgatgctagataataattgctttctgggtgtaatgcctttttggagcttgaaaaattgaaaatgcattcagtaagtatcgaaatacgaacgtcaactgttgaagtccccaccacagggagtagaaatatttctcagagaatgaagctgtggtcactccattttgtattgcttgaatgaatatgccatagttgatactgacactattgctgttggcgttacaatgtgtgaacacatttgtgctatttgcccaactttgactgttacttgatgtggcatatttgcagtcaaggaagtgtaaatcacacagtcctttgtgtgccattctgtcctcaatagagcactgtgtttcccagcatgtcttttgtcgatccactgcagttagatagaatattgctccaaccacctggtggaaacatggcacaagtaatggtttaatgagataagttgcaacttttttttctataggatgatttatgtttggcatattttccaatcgtttatttgatgaagtgtcttgacttaaaaatgcctagtgaaatattgacgacattaattctagccaggttgtatggggctaaaatttatgttttgaaatgggccatgatcctaaccaaattgtcattttatctgtttgcagcaatatctgctgcaaatatgctcaacgttatttatgtacttataaaatcattatatgacagttgtttttgtaatccaggcgaaataactaacacttacgtgacttgccaccaaataaagaactagactgtagatagctccttcccacccattttttgcgatgaaacccaccatctccatgatactaaggctgagaagaattacgatgtataatctgatggcagattggaccaatattataagaaagaaaggggcattgatatgcttgaagctgatagatggcatggctatccaaacaagaacctgcacatagaaagaaataatttaccagcacaaaaaatatcacacctttttctgattactgctgtactatttccaactttcaaatgaaagagacatacttgtggaactggcaatgcagctactaggtcaatgaagaagtttgttctgatgtatctatttgcaatctttttaggatctgtgacaagctcacccctgccaagcactttggagcttggatcaacatgtgcagtggagaaacttatagcaatatgagctatgaagaatatgtcaagaaaagaccgtagacaagtgagtataatggcgagatgatggtccattgtcatacacaactggcggtctctgcgctcaacaattggcaggaagaagaagagaggatcaatgaagtgagaagcaacgcatgagacgaggaagacacggttccacatcagcacaacattgcctccagggtctagcatactctcttcgcggcttatccagattctggtaaaatcctttaacttgagcactatcttgctgctcattgttttaactgaacctgtggccaagttattctgtctgtgtcttgcttcgttctcaataagattaagcctgcagagtaaaaaaaatcaatgaaaaattatacgacctaagtacaaagaactttacttttttgtttcctggagatgtttatagttacagcaatgttggtcaacatatgattctgcaatcattgtacttaaagactggaggtagttgccagtgacttgacaattggcagtaaattaataatagtcattgagtaactcatgtgttgctacatttgtaatgacctaattgtttataatcaatcttgtcagtactaaaaggtgagtatcaacattttctagtaatccctgattaatgcatttttttttataattaaacggtctcgtgaaatgcattcattccaaacttgtatcagtatattgtcggtctgtggggttactgttttattttccccgctgtgaaaccttaactgtgattataccgtactaatgtactagcccaatgttgtttctctataattcaatgcaaaaacgattcctcataggtcaatctgtctcttttaggctcttctttcttacgctatatccaactgagtcccctcttaactcttgacagtactttgcctaatcttacacttttacaaatgacaagctcatcctagtctctttgctcttggaaattctttaaatgattatacatgagaccttgtatgtatatgatctgttcgataataacacagagattcctatattccttagaagcaccacgaggtgctgaatacgttagtctgtgtagaaaatatacctatccaacgctaagaagtgtagtaccacctcaaacattttttaagctctagtacgatgcagcaaatgaaggtgaactgcgttaaatatatgagatccctatttacacctaactgaagtatcagacagtgataaaattaatgatttaaaaagacaacaaaacctcattaaaattaatgttcaaggtgaagaaaacagaattatcggtaggaaaataacaacttaattaatgcttgtaaataacgagcaagttctcattctagcaaaaatatcaatttgaaaataagtcgctaagcgagcagctggtgcatgatttgacacttcaaaaactttacactcatttgcgtcaaggctcaacttattcggtttatatagaacatacaccatccatcccatagaaaaccaacctctggttaggtttaaattccaaaagttgtttttttaggatggaggaagtaaaatacaagtaagacaaaaaaaaaaagagaagatgaaacaaactagtacttgaggaattcttttggaaataaaaattgcactctgttgttgaaagattcaagctcaagagcaaactgaatttatcccccaaaacgtctcatgaaactcctgattcaatactacatcaaatttcagcgaaataactcgagatcatttgacacatcatcaa

SEQ ID NO: 67362 - DNA, 15356 bp, Oryza sativa
tttttggctggcatcatgcaggtgataaaacggtcatgaattttggttttattatgagagctaccaacaacctcattgtcctcggctgccacgtgtaacggtgccgaggatgactccttcccaattgttttgtttggctgacatgtagggcccatctcatagctaaagttcctttctagacaggactctccagtggaggtctattctattctaccactctaccagacgcctttgtatagtagctcctgcagtcagtgacgtagaattggccgatcactctataattttaacaaaaaagatgtgaaggaaaccatcgttgatgcagcaactctaatactagcgcgggatcctctaaaataataaaagttttatcgttttggaccactttttagtaaaatggatccaaatactagtaacaaaaagtaggtaagttggtatttgtcatttgggagtccatagcagcaaatttggctaaaaagcaccggccccgtgcatgagagaggcagcagcaattaatagcaaaactttaccatacatctaaacactaacttataaaattgcaatgccaaatcttttgccaccaaaacttttgctaaaaaaatttgctgtagcaaattgatctaaacatgctcttatttcgtaaacggtatttctatctaaacacacgtaattgaataatgattaatgaatactccagtatttacggccttgagcaaagttttgatactacatttttttaagataaaattatctagttcatatttagcttgctactaatatgaagtaaattagtcaaatcttaatagatggcgaagaaacatggagcatgtgcactaccgattatttggcttcaatttaaaccatcataattaataaattacgtttatctataaaaaacatccatatgttttttttcaatgaaaaaccaaagaattgaacccaaaagattaaaaggatggtgttatgatggtgatgctattattctattctagtagataaaaaaagagagaaatatctcaacatcatggttagcaagtatgaagtaacaaccgagcaagtagagccatccaaaattaatagtttgatatataatttgatactgaatatagctagagccctctgttttttgtttttgttaatggaagaagccttgtttttatctgaacaatggcacaagtaaaagtaatgttctggtccttgattttgttatacaaccatcctgtttgattagcaagtgccagccaacggttctatgatgccagcatgaaagcacaaaaggaagaattttcttttgctttctttttttttccccatgatcagaaggtggcaaaagcttgcttccttaatcaatcttagtatctttaggaaacctctatttttccgggatggtttgtccttagttatgttgtacattatacttggttcatgacatcacctgtaaacatatctatcacgctgcatcttgccagatacgtcatcgaagaaaatgatctacataatttattatcatttgagttagagttctatttagcaactacctttccactgagcattgattcgatgctaaagtactaggtcattaaagggtagtgttaatgattaaaaataaagaaaaataatgcaagcacgcccgaccaacaaatccagatgtgtgccatgatatttttctttacgagttaaatgtgcatgtgcaatactacttttttttttcaaataacgcatgtagggtttgttttgattgcatctaattttcgcggtttgtttgattgcatccaatttgtgcgctttgtttggactaaagtcaatttcagccctaaaattttttacaactttaataatattgaatggatgcttggtttactgctaattttttccacattagtaaaagttctattctaacaattttaggcgttgttcagcagtggtttttgcagcagcagtagctgcggcacgtgtttgcggctgcgacgcataactatggctagtagctatagctgcagccgcaaccgaacaagattttagtggtgccataacttgataaggttttagtactactaatattttttaccaaacataatacaaaggtagaagctcatataaagacatgcaagctcatccgtgttgcaaatatttaaaaaaatggcttcaaaccaaaattataaagaagctcctcatgaaaaatgtgttttcttacatatttgtatccctttggatataagttctttatataaaagtaggaaactaaaatgcaaacagaaagatgtagtaggaaatataaaagtatgctacttgcaccgtacaactctatttttaaaccactaaaaagttccattgtctttaaatagagttgttgccgttgtttctaaatagttgtcagcatagttgtgcatgtgtgttattcattctcaatacacgttgactttttaatagggacaagtgtacttatagattgaaactttataatactttaatataatttgtcatgaattatacgctaatcatgatttgttataacatataaaaatggaaactaacagtcaaaattaacattttgacacaagacaatcacttcctaagaatcaacaatgaaattacaatatgaacttggacatcgaaatacaattgaagttaatttactttgtaaagagacaatgttagcctctcaataaaaaccgatcgaaaaccacgaaatctcgatatttcgatgtgtgacaaaaacatattccaactaaaatctttttaaatgattttcagccattaaaatttaataaaaatagtaaaaatcgattaaaacttaggagaaaaaaaactatcacaccgcttgaatccagattcggctctgatatgcatggccctgttcttttctccaacaaaagttagattaacttttggatactcgtggcacgcttttcaaaccgttaaacggtgtgtttcgtgcgaaaactttctatatgaaagttgttataaaatatcaaattaatctattttttaagtttataataattaaaactcaattaatcatatgttattacagcctcattttgcatgaaacacttaattttcatcttcatcttcagaagattcaaacaccaataataatagtttttccttattgtacaagctgaccacgaactccaactcgaaccggacagtttttcctttttaaaaaaaagctcgaacctgaccacatcttggaccaaactcaaacccgaccccggccccgacgagtcggaactcgaagcatctcgcctcgccgccgccgccgccgcacgcccgacggaagcgagcgcctctctctctctctctcaccggcgacgggatcgacggcggcgggggcggggatggtgggctggctgaaggcgctgtgctacggcgcggggggcatggcggtggtggggctcgcggcgctcgtggcgctgcaggagcgcctcgtctacgtgcccgtgctcccggggatcgcgcgggcgtaccccatcacccccgaccgcctccgcctcatctacgaggacgtctggctccgcgccgccgacggcgtccgcctccactcctggttcatccgccactcccccacctgccgaggcaagcacctccacatacctcctctcgacctctcctagattttgtgcagttcgtggtttgctccctggtgtgttagtacttaggttagcctttgtttttgggtctcggttggtggatctctgtctgcgaggcttggttgggaaggcccgcgttttgatccgattcgcgtgcgtggcttcatctcttagcttcctcgatcgcgattggattggcggatctcggtaggaaattaggaattggggtttcactagaaaaaaaggggggcttaatggtgatgaaatttgtagcgggatgatttagttatctcccatgctcgcgaagattcttttgtcaatttctagggtttctgtgtaatttggttacataggtctgtcttgtctggagtatgaactgattgactgatgttatgatgtagtttagtgggaattgagttaacaagttccctttttttgggggtgattttgtagttgatactctttgttgtatgcgatgcgatgtgttggtgcttagtattaggatttctctattgttctatcgtttatatgctctgtagtgcaagccccataaatgttcaatgtacgataggtttaaacttttatattgtgatgaagaattgatcgtgcttcgttgcttccttcccattcacttgttctacagtcattagccaatcacattgcaccatatggtttagtttatgaacttagttttggaagacatgcagtttagaaagtactatactgctttccgacgatagataacagcatgcgtggctaccaaaatagttcatgtgagcagagttgattgaagcaggcgggggttggaaattatactggcggtaatttgtcgatgagaaaaatgtggaaaatgctacatatacatccaaaatacacatcagcatccttggctcttggtcccaagaaacgtgccacacaactgaagctatcttctgattagctgacctcagttgttgactccttaggcccacaccacaaccaaaacagctagctttaaaattaatgtttacacatatgcatgctataattattcaaggcatcaatgctagttgttagtgtcattgctataatctagctagtgatatactagattatactgctaaatgtataccatgaaccagctattgttgtctatgcataagttcgcgttcttctattttgttggttgaacgcatcatgtgctggtgttttgagttgtcatgctaggttagaagagatttgattatgttctttgtttctaattagatttcataatgcttaattgtatgagattgcaataattttaacctttaggagagcatttgaataattgttttgatttttatcctcttgcgcaactgtcctcccgatccagcattcctatgatgacatgaaccttatactgtgtataactgtatattcttacacattattctgctcattcttcagtactccacaaattttacatcatctttttatggcttgcttatgtgttttccttatgcaggtccaactattctgttcttccaagaaaatgctggcagtatcctgaaattttctatatagacactgaaagttataccacattttacaggcttatagacgatggggttatattcttttgaattcctttactcttaatagatattgcacatcgtttggactttgttcgactaatgatgcaacgactacagtgcaatgtatttatgctttcttacagagggtatggttctcaacagtataaactagttctgttatctttgttgcaccctttttgctcaaagctctccatatgttgtgggtccaaacatgcttcttcctccattcactagtgcatctaaaccttgaattatatttgtaggtatggtgagagtgatggttatccttctcagaagggcatcataaatgatgcacaggtttgctgattcgttcaatcggttttatgttaagttttctgtttctgtctattctcttactgctctctttttaataggctgcacttgatcatctagttcagaggaaggatattgacacatccaggatagttgtttttgggagatcgttaggaggtgctgttggagcagtgcttgcgaaaaacaatcctggcaaggtactcatgataggaaatcttgtgtactctcatgtttctgcataaaagttagggaggcccctctgttctctctgctattggatggatgacgctagtatcctccattgcacctatatttcatgcctaagtaatgtgggtcaacatgcacatgtacatgaattagggatcgatcagcttttccaattttgttctgatacagatctagtaaaaaaaatctagtttactatgtaatgacattatatcacggtcattactccaccagcaaatttcaaattcactgatatattgaaataactactcctttgtagaaatttgaagaacttagttttctttggaagtgtggatttcaggattccttctccaaacatagtttcaccaaagaaaccgaagttttatgtgcaatctgctattttttaagttaaatcatatcactttttaatgtcaatattaaggattgaagggaaaaggtgaactgatctatgtgatgaagagtaatgtcagcagcaactgtgtgtaacacagtgatcccaagatagactgatagagagactatagtatctttaatattgagaagttcccactggcaatgaactgctttctacttgctatacattctttttgtagccacactgaaaaatgccccttcttttcaagtgctagcaaccaactgtagtgtctgaaagcaatgcacaatcttgattacattgtactaacatgatatgatggcagtggcacgcatgtttaacaaaggaatgtgttataaggcggctgggacagaatctcatatttattggaaaaagagtatctcctagatctattttcccccttaaaatagactggctgcaactggctaactaatatacgtcaaaacaactcctattctctcatccattaagggtgtttggatgagataatcttcttgaagtaaatctgaatatcttgaaggtatgttaaattctgattttcgaagtcgagtaaaattcattgtatgtgttgccatatgttgcaggtgtcagctctaatactggaaaacacctttacatctatattggatatggctggtatcatgctacccttcttacgatggttcataggtggcagttcttcaaaaggtccaaaacttctgaactgtgttgttcgctccccatggagtacacttgatatcattgcagaggtgagtgactatatcaacatccaagatctattgttttcacgctttgattaccgctctcattttcttcttttctattttggaaaattagattgtaggttgcatatctttagagaatacatatcaatttcttatgtgattcaaatattctaatttgcttttttggcatgcatatttgaaatttaagctaagattttttttactacattatttcagctactgtatatatatattgacaagagttagaacttagaattattaaaatctataaggcctcagatctttgtaaatactctttccactttttggttactattttaccgagacctgatgctgtgcgttatctattgcctagttgatgtgtccctttcttatgctcgcttaaccttttcctcgcaggtcaaacaacccattattttcctttctggattacaagatgaattagttcccccttcacacatgaggttactatatgaaaaagcttttgagcataataagaattgtagatttgttgattttcccaatggcatgcatatggatacctggaattctggaggagaccgttactggaggacaatccaactgtttctggaccaatatgctccagaagtacagagttgtaataccagctgcaaaagtgaaattgctaatgatggtaattttctatcttgtctattaaaaagtttctcaagacagttctgttatcaagttttccatttgctttgttgacagggtcaatttattctgaagttctgtattgtgtttactgcattagacttttcatatgccgacaaatattttttttaataaattaaatgcacttcttttggatactacccatagttcatttatgttgtttgcttgccatttgctgcctggctttaccccttgtattgggtgactagatttaaatccatttggattgggggggatcagaacccattcattggatggacaattttctctgcccatctgaagggatttagtatttgtttgcttgaacaaatcattatgtgatgatcggtgattctgtctatctgtgtacactatgcagttttagcagtgttgatgtctgactgctggcaaatattttacccatctccttcaaattttagaaccacgtactatttttgctgttgactggagaagtttgttttgacgaattcaatctttttctagatgaagctgaagagtgaccagaacatctggagcggccttcttttttttttcttccaggctccagttttctggtgtgatgcgatttaaatcctgatgaactgaagctcactgcaaacaattaattcaggcaattattctccattcaacctgaagaaggcaaagttgtgaataccttgaggttgctctccatcctagcactacatttgtctctggagctatatatagatttctgagaagacctagcctttgaactgatgattccccctcccccccttgatttaatctgtgatgttgctttgttgaagttttttacaatatactgtagcgcattaccatgtcataatctggcctcggtgtataacagtgtaatgcataggtttttaggctctggttcagcaatttggttttgtgttttttattattggtgttatagatctggttgcctgcttcttaagcctgttataccaaaactgttgcaatatcaataggccatgtcttcaccggcagtaattttttagcattacacgaccttattgactcgttgctttatccagtttgatagttgtaggattgtcacgtttgaagagtgaacctgatgcatttttcttaacactggcatctactatgaaatgaagcagcatgaaggaactgactttgttaattgagtcctcagctcgaatttaggcgcgtatctcttttcctaatcaaatatgcacctaaattcacaattttttttggtttcctgtaaaatcaaacgattgtggacacggtttggaatggagtgcgaagatggtttgcattatattaagaaaccattcagttcaattcacgcgaattcttttaattttatttggtaaggtatcagacttaacggtacccatatatctttactaaattttagggtctagttggtagtgcttaaactcctaaatttaacttcaaggatgaagctatggagctatctaaatcaaacttcatctcaatagttcattttttgagagtattctaactatgtttactcctttttggatggagctaaaatcgtaaactgttttgttgagctacagttctagaagagatgaagttatgccaaacgagacgttggcattaccaaactttaccaaatttggatgctcgaatttagtagtagcgttaattttggcaaccgaacaaactacacaagccgccgatatgagtctgtcgggctgaccggtgggccccacgcgccagtaaaatctggaaaaggaaacaaaaacgcgcccgccccgcccgccctaggcttagcctaactaagctgggaagggggtggggaaatttcgtcgtcgcgatgggccggggcccaccaagtggaggcgcgggggggcgcgcggacacgccccgttctctccaatccaaccacttaagtcgccttccctccccctcgcgtccgcttccccctcctctcttctctcttttaaacccctccccctccaaaagataccaaaaaaaaaacaaataatgtcagaataaaacgcggcgcagcacacaccccagctcctcctccggcgacgagaaaaaaaaatggacgcgcagtacaacccgcgaacggtggaggaggtcttccgcgacttcaagggccgccgcgccggcctcgtccgcgcgctcaccgcaggtacgcgccgccgccgccgccgccgcagccggaggtttttctagatgcggaccgtttcgagattttttttttatgctgttatgttagtggggagttttttttttggtttttttttctggggttgtaggatggttcgctgattggtttggtgtggttttttctcgctgcagatgtggaggatttcttccggcaatgcgacccgggtgagtggaatttctttttcccgcttctgttttttttttcctgcctttcgctttcgatgcgcgttggaatttgtacagggaacgcatttgtttcgtccacgaatgcgcttagctcgctgcggatttatgcgctgcagtagaattccgcgcaaatctccggtttattttttgaatccgacggtttgaatctgtgtctcgttttgaatacacgagtactactagtagttaagcagaatacgcgtcagtacgtgaagctctcggaagtcagaattcgaatcaaatgccctaattcgtgggggtttagtgggtaatggacggttgagattaacctaaaccgacacttccagtgagaatgtgagagtgagaccttcaacttcacactcatgaggccatgaaagctatagcaggtagcagtagactagtagcttggcagtgaaatggaccaagggaagaagcagtagcacttggcctggaaggcgccacaatctgtggaggctgctgctacatttgagtttgggatttttggttgttgggttcagcagcattagtggggtcctgtttggtaggtggggtttgattcttgtggcctaaataatggggggttgatgtggtttctgggattcttgggagcacatgtcacaggcctacaatggtaggaggaggtcaaccttgctggctttgctgcaagcaatgctgcttgtggtgtgtagtaggagtacagaagtaagccggtggctgggcagttggtgttgtgaccagcgggttgtgatcccaatggttcttggctaaacatggggtacagtacagctccactgttgcatacagccaagagcggtgctgtggcccgtggggatccactggatggtggtggtggtgtgtgattgattttgatcccacaacaaagacccagcatttgatcctataaccggcagcattcacccatcctatcctcaatttaacctctgttgaaacatcgtgttgctgacatcatgctgcctcgtgtcattatctctgctttcttctttacattagaccatcacaacaccactctctgcacactgtactgcttggtccattgaagcctgtaagactaataaatgctctgaacaccttactgtggaacgtggaggaggtcaggggagggcattgtgcagtgaagatcctcagttgttcccaaataatgaaagttgtccttgtgtggattgggcctttgtttggtgaattacatcaactacttgtcatttaatgtccaatatccatgaactggctagtggaaacactgcttgaagcatttggttaggaaatagggtcttatattgaagagtctattctcatggcaatggagcagcaaaatgataattttggtgagcttgagtcatgcttattttgagttcatatatatgccgtgaaggtatggaagaagaaattcattgacaagtggtttcacttgcggctatttgatttcaaccactaaatttcttaataagttgggttccacctgtttttataaatgtgcaacatgtttcttcctaagccatagcactttgtaacagattgatctacatgttttcggatagtaaattgtagcaaataccctaaacttggatacttttctcatatcttttgagccttagttgaattattgttttgcaagcccacccgtttctcctatgttacaaccgtcgttaggaaaaccaccgttggctctaaaggtttgtttgattatacttcaaaggtgaccttatttgaacaagatgagatgcatatttcagcttactttagctaagtcatactcaaattctgaccagtgggcaccattttctcctagtacacctatgctgacctgatatttgagcactcataagcgtttaactaatatatttgtccagccatacataaccatgcgtttctctttctgcagaaaaggaaaacttgtgcctttatgggtttcccaatgagcattgggaagtaaatttgcccgcagaagaggtgccacctgagctcccagagccagcattgggcattaactttgcacgagatgggatgcaggaaaaagattggctgtccatggttgcagtgcacagtgatgcatggttactttctgttgcattttactttggtgctcggttcggatttgataaaaatgacaggtatctcatccttcctatatctatacttctcttacctagttatggtgcttcatgtgccttttttttttttagatcctactttgctcatgcattcaccacacatgcagtatttaagccttaatcagatagactcagttttagtatcatagcatcaaggaaaaaaaagaaggggtaaatattgttgtatactactagtagtaatggtgcttaaataaaatccggaatgggtaggtgtccatcctctgggaatcttttgcctcactaatagagtgactcagcatgagcgtggagtaaaattttctattacagactgaagaatagtcttgctaacattttaacatgctataatggtacttgtatgtatggattgcttaatttcattctgtaattctacggtttgtttcacaaagatctagagttacctaaaagagccagctctcagctgttctgcttggtacatattcatgtttgaagtttaatatatgttttctagttggtaatcttctggttttatctgtgatgttagtgtcttgggagtgtttcggtattaatggaaatgatgcacatggttaagtggttaatgtttatcgcatgccttaatgactttaattgagaaatgatgttcttgaatatttgccgctttgtacctatgtttgacctgtcatgtgttactgacactctgctgttgttgtgcaggaagcgcctgtttggtatgattaatgatcttcccacgatttttgaagttgttagtgggaagagtaaagccaagccaccgagtgctaataaccacagcaatagtaaatcaaaatccagcaataaaacggtacggcccattctcctgaattgtactcataccatgcatgactcttgcttgtgtgaccaatctcagacaccaatacaccatgcaaatccttcataatgctcagcgctttgtcatttccttattgttgatctgttcagtgtgtttcgttgtttttctttcaccaaatcaatccttttaacatttttttaaaaatcttaatcatatgccgttctgaaagcagaagtcttctgagcctcgggcgaagcagccaaagccgcagccccagcccccagtgaagaacgaaggccgcgaggaggaaggcggcccggacgacgaggaaggcggcggtggcggcggaggaggcggtagggaggaggagcacggggagacgctgtgcggcgcgtgcggggagagctacggcgccgacgagttctggatctgctgcgacatctgcgagaagtggttccacggcaagtgcgtcaagatcaccccggccaaggcggagcacatcaagcagtacaagtgcccctcctgcagcggcggcaacggcggtggcggcggcgtcagcggcaacggcaagcgtgcgcgcccgtcctaaggtgtggcacggcgagcccatccagagttaagatttgggctcgccgtgtggtaggagcagtctgcatagtgcagtgcagcggctattcttatttgcaatggctgtaactcgtgaggatgatttttaactttgttaagttattgtatggcagtggctgtaacttgtaagggtgtttttaacttgttaggcatgcagttgtgctgccccttagggggctaagactgcttatccattgtactcctaatctaatcttaatttggtttttttttaattaagtagatggctgtatttagctggtctaccagcttactactgcgtcctgtgttaagagtttgctttcttgctccatttaggtaccgagccgtttgcagtgcagagatgtcgaacgaaataccgcataaatgcataatgatgttctccagtatacggcactgtatccaaagattcagaacatagctatgccggtagattttatcagtaacttttggttttctagtgttttttatcttcgtttttcgatcacttagaatacaagggcaatggttttacattagattttgttatcaacttgaattttctagtgctttgatcttcgtttttggatcaaaaagaatacaagggtaatggttttacattcatcaatttttattgtttagattacgtacctacctataataacattagtcagtagctacgaattggcaatcactgatattcgagttcgaccaaggacacgtcccctaaatgctgatgctaacactcgtattcaacaatcaatatcaaactcaagtgcgaaatcaggcgtgctagccagggtattataattgcaaaggctcacattcatatttgaatccatctttacattggatattgaaaatgaaacgacacatggtaccaatcactcatctgcaacgacagaactaaaaatttgtagtactaaacgagaagccattataagccagtacctcgtgagagatgagagaagcaaaaacacaagcacgcatgcccggagtccactgataagtgacaacccctatgaagtgattagtgatattcgcatcatgttagctgaacagtacactactaatgcacgggaagacgactttgatgcaaaacctaatgacaaggacaaccagggcgaaggaaacgtggcctggggtggtataaacaaagaattgtacagcttacaagttacaatccagaattaaacagctcggtagcaaagcacatattgaatcatgctgccgatacaaaaatcctgctgtttagaagatacaagctaggaatagaaaagcaagcgaagactcaacatcaacattgataacatgtgggaaaaatgattgttgaggaaaccatagataaattggccgaactcaactgcccatttttcccaaaactggtttagcaggaaagtttaagcagcatgtacaatgaaattgtatgtgcagctccatttatactagtcctgcatgcaatgagttctagacaaccgaagttgataaaagtttcatgacactgccatacaaacaacaaacaaatctgtttcaggtctaatgagaggaaaatgattgttggagaaaacagaataagcttaacccaactgcccactttcctctaattgatatagcaggaaacactttcggcaaaaaatgcatagcataaggcattaggccgatacacactatcctgcagggtaacatgacaacggaaaaaacaaatgtaaaatccatgaaaaagtaaaacatttctttggtactgctatctagagagaaaactaaaagctacagaagcacaataaggaataaataaagcaagaatgcaatttacagatcaccaaaacagacataatgtcataatataaaaatatgtagagataaatgagaggaaaatgattgttgaaaaaagcacaaaagcttgagt

SEQ ID NO: 67363 - DNA, 5201 bp, Oryza sativa
agatttgaacctgtgattaagatatctgcagttttcccttctgatgagatggaagaaaccatcaatttctgctgcgggtactgcaagaaccacatcatcacgtgtaatctaaacaagcctttgaagagttggttgcaatgtttttataagttccatgtttattatctggttcttttaatctctttttgggaaatctgggtgttataatctaggagattaaccaaccacagcactaaaattcaaacttctcagaaggataatacgttgattgctgattaatgaaggatggcgaaaaaccatgtcatagagcgggtggacctgttgcttcatgtggtttctgcacggcagtgcccggcaagaaatgggcctgttcggttgtcgtactgctgcagctgttgtcgatgctgtagagattggtagcggctggctgtattgccgccacatttaggcctatcgggcaggcccaatatatactagccgtttaatagcaagatggttctggcatcaaagtttgtaaacggacgatgtaatgggttaccactaaataaagcaaggttgaagcatgaacataaaacaaatattgaagcttagtattcttagtttactacctttcatttttgttttgttgtattcctcaattacgaggcttcaagtttaggtaatatttggctgtatgtatagaggccagatttctatatattatgatcgcaaacaatgttaagagaattgttttagttggggtgcaccacgcttaggctgtagcgcaatgcttaaatgacactagaggacgctccctctcaaaaaaaaaaaaccgaagtaagcatatgctctctccgtcttaaaaaaaacctaacctattataggttaggtttttttagacggagggagtagctcacatgtaccgataagaacatatgctccctctttctaaaagtctaaatcctatttatttttcaccaaaaccaagtgtagttaactcattcatcatgtgataaaaccaatgaacatgcaaacaataaatactaaaatgacttcttggtttccgataaaaaatttaatatagcacagtgactacagataggacttagacttttggaaaaaccaacaaatgaaataggtcttagacttttaattaaaaggaggagtactacatttgatcttagtgaaaaggccgaaaaagatatgagtggtaccgtgtaaccacacggcctcttgtagtgtgcccctccctgcttgaatcgtcgatgtggtactactcatctccgcattgtccatggatgcgatacgcgatacatatacgacccgtgtgtgacgcgtgacgatgcgatgcacctcctctggtttttcctttttgtttcttccttgggttcctggctacagggaactaggaattttttctgattccaaacgaccggccttgccaggacaggctaggctcttggatccaaacgcaccctaagggaagctcgatggcatatgccactaccttaatttgcatgcagcttttcgcggttcttcgttcgttgacctccatcgatcgaggcgcgacgtgttttagttcggtcgagtaaatatcatcggtcggccactgataatatggatgcatgaatgcagccacccagacgtatccgttgcatttgcatttgcatgcatccatccaagtttggctggcctagctagctctccacatacgcattcgatcattttgcatattgttcgtgcaaccactgcatatgcaccgagcatttcatttgatttgatcgatcgatcgatgtggtgcgctgcccattttgccgtatgcgatcgagtattatatgcttcgtccaccacccaggccgtgatcgagtgatacgaccgctggcgctacctagctagatgcaatcacacaactgcaagctaatactccctccattctagctagttccatcatcatatttcaaaaaaccgaattttcaaatttgaacgttacattcgtagtcggcaagccgttgcatctcgatcgatctcgtccgacgtgctggccgtttcaattcgcacgcgaaatgggagcactccgcgcgcagaagcctgttgcatatgcatgcgaaattaatagcatttatagttgactacaagatagttggttctgccgcgatcgtcatgcatgcatgctggaccgttgacctgggagatgatatatatgtacatttgttatccttggtctttgcatcaagtcaaaatatgatgatcaaacttaaatacactagaagataaaaacgagtgaaaacggcatcatgtctataaaagtagttcttggttgattgggaattttccgtatgtactaatctactagttatttagggacaatatcaatatgacaccgatagatttttttttaaaaaaaaataaagttagcattcctcagtttagaaaaatactacatgacggtataccgttaggacagtataatacctctgagatatcggccaatataccccgttcagacgggataatacgtctgaggtatcgctgatacttgataggtatcggctgatacccaaatattggacaatatttctgaggtatcacgttcaaacgggatatcatcacgtagcattttccgagttacaagcctttgcacaattcgcctctgctctcgataaaacaagtcagaatcaattggcaaggggtcgacgattacgagaattgtttagaatcggagatggtactacttttgcgaaacgacagtcggttggtggagaatttcctccggtgttccattacgtgcaagctaacgttatcgttggctggatgaattgagcactagctagcaccaggctgctatatagcaccggagcagctggtgtttttctgcgctggatcgaggccgtgcagtggtcaaccaactcaaaggcaccggccactgatctatagtacttactttgttgtgctcctttgctactagcatctgccactgctgatgatcgatgcagttatctagctagctagtcctctcttgaatatctcgtcaaattacactgttacagaaggctgaaaatgatatcgatcgacgtcgtcgtcgccatcaaaatggtctgccgtgtactgttcatatatatagtggttgacctgtccatttatttttcttatggtaaaccgcaacccccttaattttcgggggaaaagatatacgtgtacaaagaaaatttgcaaatgttttagatgttgatgtatcacacactgtaagtaaaatcctgattttctttattacactttcaactaactaaatcgaactgtcaagatctttgtttgcaagaaattgttcaagtatatatgtatatcacttctcttaattttctccctggatcaactcaagcatgcttgcttgtagttgtagaaagtctcggatttttcctttgctttgtacttcttctacctctaaatacaaagaattttaattataattacaaatatgcacatgtccagattcaaaaaaaaggtgggcaagcgaaaattgctcttgcaagagcaacatcaagatataggtaggtggtggcagtcaggtaaaggtaggggtgaaaacattatgaaaatttcccgaccgtaccgatacctttcctgtaaataatacaataataatatttttatcgactattacagtttctaaaatttagtttttctaacttctatcaatgttgcgttgaaatcaacactaaatagtaaaattcataaatacatatatttcttgaccgtttcggacttctcgaaaaaaaataatattgtttccgaccgttttcgtccataggtagaagcccttgctcagatctgactcaaaacaagccccagatgctgccagtacaagcaagcaagcactattacatacaggtactgtacctgtcatccaattagaccggggagatctttccctggccaatggaatccagcctcacttgaccctgcccccaaaagcccagtggaagaaacttccacagtacacatatcacacacactagtgctcactcaattcaggcttcatccatccttatcctccctgcctttttgcctggccctttcctgctgcctacttgtctgtgactgatgaaagctaagtgcaactaactacttactactctatacttacttgctgataagctgattcatgccatgctatgacagggaggatatacagcaacaagaaaagcaaagaaaacatactgcatggtgacacctagcttgagaattatatatataagtgcttaattaagcagcattaaacttttatgttagcactgcataaagtatatgtagagggtcaggtggtgactgatcacagatcagcaatttggatgtcatgtcattgcttgcgcattaaggatgtgcatgcaggtagcctctagcctctctggatattttattttatgctctcactagtcactaatactgtatattagcagtagaagatagtactaggtagtaaaatttatttattcattttccaaaggttatctgtgccgacacctgagatcacacagccgacactctgaattccagaggaatccaaaacagcatatatatagcaccaatcaagcattctactaatatcaattataaccaagcaaaaaaacaaaattgggagaaataatgatggagaaaaaaaaagcatccatcgtctgtttggtcaccacagaacatcatggatacctactcatcagtaccatgccaaaataaactgcaccatcaagaaaagtcacccaaattaactaattaagcttgtttaatcatcttagcagcccaaacaaatgaaccatgggatcattattaggagaatttaagaagaagtcaatggaagcgaattagtagagaatttagccatataattgactcattttagcacattgagaaaaggaaagataaaagagagagaaagaaaggtaaaaaaaaagagtgaaaaaacagagattaagattaattaacccgacatgtcctctgattaattaattaccaaaacaccaaccaagaaagcaagctcatagcctgtcttgccggccgtatcccgacgacggggagggcccgccgccgccgccgccgccatggccatacgcacctttccctcccatcaccatctggtggtggtggtggtggggcggctgcggctgcgcgtacccagctgacgacgccggcggcgagccgtacataggctgtcccatcatcatgatcatgcc

SEQ ID NO: 67364 - DNA, 21712 bp, Oryza sativa
ccgtgccacgctggatacgtcgcggccgtccgttagccacgttggatggcctacgtggtggggcgggggtgctgacgtggcctgggtttatataggtaaattaaggtcatggagccgtcttggcccggttttgttttggtgtgaggaaggagatggttgtcgtgttttggtgcctgcactgacacacctttccagtcacatctcaatcaaaattaaggaagggaatttatattggtttaatgtgattattctccatggcatttgtttctttttttttcttgtcagaaaaaaaatcttatatgagatgaccttatgttagttagtactcctaccgtgttcaacatttaaccatcgttttattttaaaaaaattaaaaaatcatgtataaaaatactaatcataaagaaatttcaaataaaataaacagtcaaacgttaaatatagaaatccataaccacacttaaaatgggacgaaggggataatgtattatagttttcaatgaacattttgctaaaggcaatataggtgtacatttgctatttacttctaatcaaaaaagtggtaaacggttcacatatctgtttttcttaattttaagttatagaatgaaaatatcaaaagacttttggacgatttcattctttttctccggttcttctaagtttatcaacttttagataactaccattctcaaactacgatttcttcacaagctttccgcgtcatcattgttttagatttcttgaagttactttaggtctctggcatataatatttgattcatctctacaaacaattatacatgatacgtccaataataacgtgacctaagtccctcctagacaatttcagatgttgaataaatacattatgtcccaaaaaaaccatgtttagtcatcacttatatatttaatagaagtatggaattcttatattaaatctgatcatcgataattttttaaaatatatatgttaaaagcaatggattaagatcctctgcagtcgactgcaccgcgcttttattattgacatgcggtgcagtcgactgcagagcatcctgatccgtaaacagccacatcggtagatataacatcactgggtctagataggagtaaaaaattgtgatgggtgacactaagttaagcacatggacagcgcaatcagccaacaaggttcactatcttcagatattggcgaattcagcatgtctccatccgagcccttcacacgtcagccgggtcgtcttaggccactaattaagcaaaccttagatccaaaaataataaccttggcctttcgccactaactaccaaccactctgaaaagaagccttctcgagtgatgcgaaagcagaaatcacgttgccaaagcacaaggtcaattaggctgtctccaatgggcagctcttagctagctcatagaggtttttaagcgatgaacaggatgcgctagctcttcttcaagcgctaactcgcacgctcaccaaggcggtgccctctcacaggcatgctcgcccaggcagtggccggcactgtgccgagcgcgtatgagctagcagccggctcataccgctggtgaaggccttggctcgcataagtactactgacaagtggcatcgagtcaagttcccaagtgccctctcttttgtaatgccttttttttttaagtagtatctagttttatttttttgagaaaatttttcttatctagttgtagaaaaaaattaagtaatatatactctctgatcttttttaaactcctcttttaaggtgcttgctccactagacctacatgacatggcatttatacctacaacattgtgcaacttcatcagaattttttagataatggacttcatcagacttgaactctgtctggttgttttcttagataaggaaggtgccagatcctcaatagagttttttgttttctttgcatatgaaaaacatggatgcataaattgctgaaatttgtggctttacattaactgaatatgtcatgaagcaaaaggtgacattattgcagtgatgctgatgcccatgatctacctagttaatgagaagaaaagggattaagagatgcctgccttgtgtataggggttacacttaacaatggcctgtccttgatcgatacatataggagctgattgggatgtgaaactgacactgttctattcgttaattgtcgccatctttgctcttaatcttcgagttcaagatctctgacggtgtttctttctctgtagattacagtgccatttcgaagctcatgcacatgttaattgttgttattaagctacagctagcttgatcttattccgatcatacagataacgagtggtcaagatgcgatgctcctgtctgtgcaagaagaacttgtactgcaccaatttgcagttgatctgtcagttcttcagatcttgggaaccattcatgcttagccacatttgagtcaatgggaatgttgcttaagtagaatctgtactctgttgctgcaaaatggattcgagcgagattgatgctatatatgtgggcccacatgacagcagctacgtgtccaaaggtgacagaggtggcatatgcaccaggaatctcctccaacaacggcacccatatctgtcatgaggattacgatcaaaaacagaatattgagtggctaagggttaaggtctagtaaccacataactccttttcaatagttcatttgttgttctacatatcgagggctcctttgattgaaaagatgaaggaataaaaaaagacactgtgttttgataggaaaggatcagaagtgtaaaacagagattacaaaacacacaaaaaaaacatgaatgatcatttaaatcaaccgtagaaaaaacagagtaatcatatgaaagagatagacccaaaaagattttttttctaataggttgaataatttgttaattttcctctaaaacccctatagaattgaccattccatgagaattcaaagaaaagggtaattaaggtgcgctctgttgttttaaaggcattccttcaacatttccttctaggataaaatccttgaagtttcctatatatttcttacaaatgaaaggggacctaaatagtctaaaggtttatccattctatgccctgtagatcattgtgtcatttaatagtgccttgatcagtcaatagttgactgaaaaatcagaatctttttcaccctggaaagagggaaaatatgcatgcacatcctccatccctaatacaactatttctagcatttaaaatttctcataaaatataaatattttagaatattaattctcacccctgctcgagtattgtgttactataacttaaccaccctcctgttgcagtatattatttttttccctttatgatcagaattccttatattttagaactgatgaagattttccccacttgttggatggtagagggtcatggtcaggctagctagtagtgttaccacacatgattgtgaaccttgtggttaattaacacaggttaatttccctatcaaactggctgtttttgctggctgatattttctgagactcaccatggactgactgactgactggctgattgatttttgttttagataataatgggactgactgattgatagtgaattaattaattgtgcttggatgtgtttcatgtgtgaggtgactgtgccaatttgacaacttgagatactacggcgatcgatcgacgtcgtgcgggtgacggtggcggccggctgccggacgaccggtgtgaggccgtgcgtgcgtggccggcgccggcggattaatggcggtgctgtgcgacgacgccggccggccggccggttgaccggtgcaaccggcaactgcagccatgcaatgatgccactgcattctttgcaagaaaacgacttgcattatagttgatgtttggggttgggacgttgggttgacttgcttttcgatggatgtgataatatatttttttttttgggtgacgatgtagcgatagcttcaaccttaaatatcccaaatgaagtcaactttatcgtgcaaaaataaaaacgcaattctcatgagaattgaatttcagtaatgtagtagtacgtattttagctgatctagcccttttcatccatgttcaacaattgacctgatactctgataggtatatacagtgtcctgcttctgtggtcttgtacattttccatccgattgtgatggcccatccgatcaacggctagcgacgagccgacgaccacctcacaaaagatttttccagtatcaggccacacagccacacaggggctatagctcctagacctgatctgtgttaggggaaccaaacattattaaatcgttagtttcttaagtggagtggaagaatttgctctagaaaaatatatacgaaggatgaagctaatttttttcaagctacacaactctagcttgggagtactccctccgtcctataatataaaaaatttaatattttatttacactgtttgaccactcgtattattaaaaaaaattgtgcaaatataaaaaacaaaaaattatgcttaaagtactttggataataaagtaagtaaaaaaataaataataattctaaaatttttttgaataaaacgaatggtcaaacaatacaagtaaaatatcaaaatcccttatattagaggacggatggagtagtagatttggagccctaccaaacatgtctcccttcattctaaaaaaaatacaatcccaatattaagaaaaagacaaattagtacaaaagaaaatgtcctatatacccctcattaactcagagcatgttggaaataggagtgtgtttagggtaagatagggaaattttgaatgaggagagcggttggaggaaaaaaaagaaagagtacttttttgacaaaatttatatgtttggattgcattctttttaggataaataagtattttaagaaataaactttaataaatatcttagaataagttgtgagaaatcatactttcaataagttgtgagcaaataatatgcaacagttatttggtaaaaaaaaagcttaaaaaactagggcagaatgaaaagaactttatacgatttgacaaatgtagtactacagtaggtctatatattcgggctgacttctttcattggtttttccaactcacctccctcttttcccatgcacgtttttcaaactgataaacagtgcatgttttgcaaaaaagtttctatacgaaagttgtttaaaataattatattcatccagttttgaaaaaaaaaagctatcgcttaattaatcccgcgctaatggaccgctccatttccagtgagcaggatatgggttccaaacccaaatcaacgaagacagcctcaaaagtcctgctttctaaagaagcccctatattgccactctctctacctctctgatcagcgtagcatatatttttcctagaaaaacatctactccctcttttttataaaaaacctaatcttagatttgaatatagatatactcttgtccagatttaaattcagaattagatttttttatgggacggaagaagtaccttacaagatgtagtgacggccatctgacgtacgtctctttcacgcccggccgatcgatggaggcgtggtgccctaccaagttggaaggctgaaaaacaaaaggataaaaggataaataaacagagagctttatcgaagacggcttaatgatactaataatcgataagtaatggagcccaacgggcactggaccgaccaaaatagcgatgctcacacgactcgttgccgtcgccaatcatcataacagtgacaagggcacctccttcggcctcatatccttcgctccgccattggaatggtgcagatcagagatattcagagctaattaagctcatcattgccaaaattttgctcacctgccattatacccctattggtgtgataaaaaaaaagaagagagagaagaaagacgttaatttggtcgtgttcgttgtaccaagacgattcacgtgaaaaaagtttaagctggtgagaaaagacgggcgatgactgtcgcgctctgtgaacacatgggtttaggccatgtagaaatcatcatcgtgcatcatggcgtgtgcatcgatcgtttgctagctagctagctagtgcacgaattggcgccctgtcggctaccatgtgtaaagatatgtaggtgatggttgacttgcaaatttgcaatagatcctggcacttgcaagccacccaagcttggttggtggaagaccttttttttttgtttgaaactatatacttagggtgacctatctaaatggtacaattgtgaagaaatcgttttaattagtcaagtgtcggatcatcagtggagaggatgtgggcagtgggccccctttttttcttatcggaatgtagaattagttacttcctcctccgtttcataatgtaagtcattctagtatttctcatattcatattgatgttaatgcatctagatagatatatatgtctagattcattaacaacaatatgaatgtgagaaatgatagaatgacttacattgtgaaacggagggagtagcaaattgagaatgcttcattggtaattcctccgtttcagaatgtaagtcattctaatatttcccacattcatattgatgctaatgaatatatctaaattcattagcataaatatgaacgtgaaaaatgttagaatgacttacattgtgaaacggatgaagtggcactaaatgaacttaggatttagcaagtggtacagtccgatcattagtggaaaattttattagttaataattaagagtgcttcacaaaattaatactccctccggtttcataattcttgatgttttggataatgatatggtattcaaaatatatgtttgaccttatttttatattacaatatatacaataaataaatacatgtttacttttattatagaattttgaaagacaaatccatatgagttgttttctagattttttatatttaaagttattgatagttttgagtgaattatgttttgatgagatagtccaagggaagtactgtacttcagtgtactgttcaccactatcgcagcattatttatcgttcaaaagattagagatctttaaggcatttctacatcatgagagggctataacacaaatatcccccagcaatgggtcaactgaacttaatttgaaccgtccgattgagatccaaaggccagtgagcgttgagccctatcaatccaagccgtcaaatctcgatcgagtggcagtcgtacgggtttctccctctataccaaaattaagatacagtgaataattgagttcaaaaaaaagatacagtgaataatttaatagagagcgagagcaactccgacttcattgacgaaggtgctagagatgatggagaaggtgtaggatttagcagtcgagtttgcgactacaaattaaactttgtttgataatgttttagggagtaactatatttatggcgccatatttttcaccaaaaaatagtcggcatgtatttacattgtaagtccctaaattacatatgtaattttagtgtatttacaatgtaagtcctagaattacatagaattacatatgtaagtcctaaaattacatatgtaaatactaaaattacatactaattacatatgtaagtggtgtgtaagtgtggtgtaacttgtataagagaaggtatcagtgcaacgttcaacgctaatcaataaagaagattagggcttgctgcaatgccgccgtgcgtgaaaacatccaacgaccatcgaaaactcacggagcaatcgtacggctagcgacaccgactaaaatcagcccaaaaaaactggcgacatatttttagcaattccgatgttttattgttgttcctgctctgacagctggtcaactggtagatcggctgttgatcgactgactaattaacgggccatcatcatgcatgaaccggcaaggagcagtcgccagagaagaacaccaagtccgtcttggtcacaatcacctgaactattcgggggaggatggcatgattttttaagttatatcggtcttcttttgattttctaataattataagttgttcgcatcctaaccatacagaagttagaagttaggagtgatattagagtaattattatatcatcttgtaatcgtctgatatcgataaagctttctttatcttaaaaaataggggcagtgtatgagacatctctaatgttgagcaagaaattcagtgtgccaaaagaggtaagattcagagcagcaatgggaaatgggatggagcaaaattgactgaacaaaattgttgaacaaattcgccagaactcttgagggtttgggctagaaaccaatctgatgcaggcgcgaagcccaacaatttgacatggatctattatcctttttctggatcatatttgttccagcctcatttggacaagatgtggcagaagcccaacatatttcatccatgatccaaccagttcccagtgcaaacatcttcacagccttttggcccttattaattcggagcccacttcaggggaaaaaaaaaggaaatatccaccaagaaacctgcaattttctccaaataacaaaacaactagtgatttattaaacgggtttactatagatttctatcgacaaaaaaaagagaattctttttcattttttttgaccatcagatgtgcttgaagattcatgaagggcttgagagagaaaaatcatgtgaaaactcaaataggcttacatagggatggaaccccgatctactccattcgtctctaaatataagatattttggttggatgtgacatatcctaattcgaccaatctggacaggagctatgtcacatccaaccaaatttcttatatttagggacggagggagtattactcacaagtaggtttacatagggatggaagcctgatctcttattaacaagccgcacgcactagccaccagagccatcaaagtggttttagaagtggaaaaggtacaaattacatccttgaatcagaaaaccagacagcgcttaccttgaactttcaatacaggacgaattatcccccttgacataatcccgagcgattttattctatatggcatacgcatgacaatctagtcagtattttttttaaaaaaaatggtggagtccccttgtcatactctctcacctcctcccctccccctctctctccctctctctcacgcgcgtcatcgggcacacgcgtaggtcgagcggcggcgggcggttggcgcaaacggtatcgcacggggatgggtggtgagcggcagcccggacaaggaagcaagagctgtgaactccaagagggagccggagttgtgggaggccaccacgaagtacctgaactgcggcgtccggttagcctagacgacaagcaaccgccccctcggcgcgccaagtgtgattgtataatacaattacaatatgattgtatttggaagattttgaaaaggattttttaatagaaagtttaactttcaggtaatccctcattaaaatttaccatccttaagatggatcagcacatgttgttgtcgcttgaaagctgcaaatctccaaatttccagcgacacacgcacgtcgctgcggttggacgtcgcgggccacgcggtagaccgcgacaaacacttgccaccttctttgtgtcgccttatccctcgccacgccgtgcgcgtggcgcgcccggaaggcgagagacatggcggcgatggcggcggcggcggtgccgagcgacagaccaccgcttccgtggcgcgcgcggctgctcgtgggcgccgtctccgttctgcactcggcgtcgctccgccgcgacggcaccgtcaaccgcttcctcctgtcgctgttcgaccgcgtcgtgccgcccaacccggcccccgacgccgccggcgtggcgtcctcggaccatgccgtgtccgacgacctccgcgtcaggatgttctttccgggggcagctgccagggatggcggcggcgatcatctgccggtggtggtatacttccacggcggcggcttcgtgttccactccgtggcgtccgcgcagttcgacgcgctgtgccgtcgcttcgcctcggccatcccggcggtcgtcgcgtccgtcgacttccgcctcgcgcccgagcacggtttcccggcgccctacgacgacggcaaggcggcactccgctgggtcctcgccggcgccggtggcgccctcccgtcaccgcccgccaccgtcttcgtggcgggcgacagcgcgggcggcaacgtcgcccaccacgtcgtcgcccgcacgccgagcagcgtgtccgggctcatcgcgctgcagccgttcttcgccggcgagacgccgaccgcctccgagcagcggctccgcgacgcgccgttcgggtcgccggagcggatatcctggctgtggcgcgcgttcctcccacccggcgccacgcgggaccacgaggcggccaacgtgcccgccgcgctccggcgcgacgccgagcggcgccgcgcgttcccgccgaccatggtctgcgtcggcgggtgggacgcgcaccaggacaggcagcgcgactacgccgacgccctccgcgccgcgggcggcgccgaggaggtcgtcgtcgccgagttccccgacgccatccacgcgttctacatcttcgacgacctcgccgacagcaagaggctgctcaccgaagtcaccgccttcgtcaaccgccgccgcgccgccgccgccgcctcctagtgctccacattcttgaacttgcagtagccgacattacagtttgcttcactgtatcgctagctcgtctccactcacacaatttctcatttgatttgatttgatttgattcatacgatgaattcaacgagacgagctgttcatgatcgattctgtccgtgaaacgaagataacgagttgaggaggccacgtgaaagcattgatttttagactgattgccattggcaaatggcaagcatcatgtgaacgatttttctctcgtcaaaaccaatgaacgtgtagtggcgacaacgccatgaaaacccaaatgaaccaaaccaatcgtagttatccactctactctagtatttggacggaattggggctggatggtctacactgagtctgtgaatgaccatggttttgcagatggccagcaattcagcatggttctgacttgcaagtgcaatgtataaattgttcctctataatgctctctctacgcaattaaactgtttacacatgtcctttgattgctgttgactgatcagcaaccaaagtaatatcttttgttcaatgaatgtggtctacagaagtgttaattaggacacgtaatctttcttattaattcgatcgtctgtctggcatggcatcaatctcactggccacagtagtagcagcttgaagtctttgcagcatcaagcactactagaaaagaaggcaacatttattcacaacagaaaagcttctttagcttctgaacaatggtaaagaaggggtcccatcccaaaacatggcagcatttcattttcattttcatttccataggataggaatgttctgctttacgcttcccagaagccttctctctgataatcagagcttctagctagtgtagtgttagccgcaggtttttggtttagcttctgctttcttgctgtaccaggctgtgagtctgattaagctaatacaatagctaattgggcatgagttcttgcttccgagaggaggtaggcagcagttgcaaactttgcattctcctttttgtactgattgattggccgtttgattggacacatatgatcgatcgacaaacgaatctggccgaccaaaacacattgcacggacagcctcatccatgcacgtaccagcactgtattttactgtactccacataggcatctcttctcttctcttccaacttccaagttccaacaaatggacagaaatatgggtccccatgtttctatacagtgaaaccaatcaggtacatcactcagaaatcagaacatgctgacagctgatgagcttatctatgtactactaggagtattctgtattaccatgcttttgatttttgaactatactgtacttttcagaacagatggctgatggctctgagctaatgaacaaacccaactgatcatggcttgctcatgctaattaatcattagtcaacttgctccaactgaatgtactgcttactactagtatattatggttctcattgtcatttatcagatagtcataaagggaagaagatccaactagacaccaagaacatcacaactcaactgttcacatgcacaactcaacaccctaaataaacaaaaaaaggcacaggcataataaacaagaagaaggcgacacccaaaaaaaaaagaaatattttcttcttctttttttttaccactggccatgagctagtgatgagtgagtgtgagcgagagtgatcacacgcactgattgctcccgtcgtccatggcgatggcgatggcgagatggccatcacatgacgctgcacccgccggcgttggggtcctcgtagcattgctgctggtggtagtacggctgccggttgccgtagtaccatccctggtggtcgtagggcgccgccggcggcggtgccacgccgtagtacccggcgggcgcctggaacgcgccgccgccgtagccgtagccgccgccgccgtaatatgacgactggtcgtaggctgctgggttgtagctgtagcacgagagggagccggcgggcgccggccagatggacggcacggcgacgccctgcgccgccggcatcatcatcggcggcgcgatcggctcgccgcgcgggggttcggggccggcctgctgctgctgctgctgctgctgcttggcgatcttgagcttctcgaggagcggggcgaggtcggcctgtgtcatgccggccgggaagggctgcaccttgccgggcttcgccgtcgccgcggccggcggcggcgcgtcgtcgacgtcgaacttgaccttcttctccggcttcgcggcagcggcggcggccttgtccgccttcgccgcctccttctccggcttgccaccaccgtccttcttctccgccttgtcaccgccggcggcgtccttcttctccgccttcccgccgccgccgtccttctccgccggcttcgccttgtcgccggcggcgtccttgccgcccttgttctccttgcccttgacctgcatgtccttgatgatcctgccggccttgcagcacagcttcttgcacaccttgtcggcgtcgaacggccccgacaccatcaccgcattgttcttctcgtcgtacgagatcgtcttgatgttcgccttatctgcacaacaccacagatcatccatgaaaaccatcagccattagccatgatgaacacggtcgtcatcaacctcaaatcaccaacatttttatcttttcacactccatatgctacagtgcgcagcagcatcgcacgagctcacagtaactaacacaaccatctgacatgtgggcccacatgtcagttgacgaaacagagacaggtccgtgcctttgcagcttttgcattggtgactgtggcgatgaattgatgatgcgaatgcgatatgaaaccatatgatagtgtactagcttctaccttggatcctgcaaaggactcttctgatcttcttgtagcatcgatcgcattcgaggtcaacgttgagcacaaccgtggagatctgcagcgatgtgatcgagggattaaaagataggtaaatgctgtactaatggagtacttactagctagtggtattattaacagcagatccggaagctgttggtacttccggtgttactgtgtggttcacttggcaattcttaattgagagttaactgcagagttgcagatagcagaataaattagtgacttgcctaattcttcaacctgtgggttcagaaaggatttactagtattctacaattctgctactacctagtttttgttctgtccttaaaaaaaacaaaagattaggagcataaaaatgaatcttggagttttctcttgcagaaccagatgaaatgaagccagtttctgaagaagaaattcagtgggcgaacttgaactaggaaatcgagtgggtgcttctttcgagagcatcaaaagaaatatgaaaaggacactagctgggagcgtgtatcttttgtatctttgttcaaaagattgtttgaaaacgaaaccacgagctgggaaaagaaagaaaaaaagaacgtgtgccttgatcttcgcatgaaagtggcttgcgacaaggaaaggagttttgggtggtcagagatagagatatttttgcttgctctgcacttcatttctgcttaccaccatgcttgttttcttgcgtgcctgacactctgtttagctacacaagtgaacgccatcaggttgtcaacattctccatttctccaataaacctgaagtgcttctctaccaaacttgactcaggttctccaagaaaaatatttctaccccaagggaagaaaaaaaaacgattttctttattttgcttaaacacatcaactttgttctgactacacatgcacacacacacacacacacacacccaactgaagaaatgaaggaaagatgcaaggcaagaatcaatactgaacaacagaatcttcagaccagctcatgaaaggacaccctagaacagcaaagtccggcgaaaagctcttcttaccttgtctgccatgagaatggcggcggtgtggccggcttcgtcgtcgccgccgccgctgcggccgagctggacgccggaggaggaggtcgccggagagggaagaggagaggagggaggcgtgaagagaagagaagaggggagaaggatggtgtatgttcgtactgggttggtggtgggtgcgtggctttaagcctgatctcggccctcactgacgcgcacgcaggtgttgggtatatatcttctcttaattatgtgtgtagtgtatcagtctagtaattagcagtaagcaccaaccacggcccaccgacaggtggggcccaccggtcctcgtcgaccttttgacctctattagctgtgtatcatgtgcaaaaatattgtcagtaggtgggcctctctctgcgttgggcacacacgtttcagagaaaagaaaatagataatcagtctagtagtactagtgctgcagtagtagtagtactgtcctagtacaagtcacttctagaattcagaaaagaattgtggaagcaatgtactgtaatgcttatctcttcatttgcaatgttttgcacattttccccccttaaaccagatgatatatggtgatgaagaagaggagggcgagatataattagcacttgatactaacattgcatggctcagaaaaaaaaaaggtagtaaaaaaggaaaaggaggtgacatacatgacttaacacaggtgatgtaatgttagcagcagtgatgtgtgctttgtgtttttgtgccatggaaagcagggaaatttgtgtccaagcggcaagagcgcatgcatgcatgcatgcgtcccagcctgggaatggcgtccatcgattttgacacctaaatttggcggcgtctccatgaccatgccttggacttttgatgcgtaggcaggcgaaatgccgccaaatttgccaataaattgaggtgaaatgcaccgaactgaactgaaacagacaaccataagaaaattttgggacgccacatactttgggggaattttgtttgttacctttgggcaggtacaatagcagcctattagtcagctataaacatattttaataagataaacgatgagagagaaaaacagcgggctacagatttatagcccgctgtagcacggactctaatatgcaatgtgtatatgacagacgtgaccatatattaatagtatagtaagtaactattgtatgaattggctattagattgactatagatgaattggagttagtagtaggctatactattgaactttctcttacggcgtgatgttttctgtcggcaacgggatgaagattgaaggcgagctacgtacgtacgtcatcaaccatctgtgtatgggcaaccaccagataaaacacaaagatggtcaataaattaatgatggtgtgctaatgcgattgccttttggtgttgggaagttcatagctatctggattcttggactgggggccagggatttaattttgcattccctaaacttccaaagtgctgcacaactcatttgccaattgccattcgtcgtatcgatctcaccagagggaaaaatacttggaaccttcctctgtccctccctccttcccagctactcgctcgccacctttcgcagcttcgccaaggtggtcactcgcaacgccactccagtactccactccccatcacatgaacaagtattcacatgccaatgattgcccccctccccccggatccggatatatgcagtagtagcgtggatttatgcagttgtagctgttgcgttggatctaaatctaacggtaagaattagattgattactgcagtaaaaggactaaaagatcgttcaggggtaccgtagcatgaacactgtagcaattgatttagatcattgatcacaaaaataaatggctgaaaatacatgcagttttaaggtgtagtcgtaattaggaccccaaccaatgcaaccaaaagaaaaaacgtcgtcacaccggacgagacacagtgacaactcatgcagcatgcggcacgtactccctccaggaagtcgcttaggacagcgacacggtctccaaaatacaactttgactttttatttctataaaaatattggttaaaaaatgctatatgtatatttttataaaagtatttttcaagacaaatctatacatataatttttatatttttaaactaaacaacttgaaagctatttataatttatatttctaaggtttgacttaaacattattctaaacgacttcctaggtgcagagggagtacaggcccaacccgcagatcgccccggtgggcggtgaaaaaaatagtaggcgacgtacatacgcgaacgcgaggtcgcgcacggagaattctgccgtttttaccgtgagacgcgcgcgcgagcggcgcgcggcggcgtcgtgtgggcgcgcgtatgtacgaacgaggcgagctgttacggcgcgcgcgcgcgcgcgtacaccaaagtagtaccaaattaacacgttggccgcgggacgttttcttcgcggcttcgcggggttggtggtgtcggtgggattctcatcgggttgggcgcgcggttcgccgctcgcgcacagtggtcgcactagtcgtgcacgttaccccgtcgccgtgcgctcgcgccgttgcacgttcgcgatcgtcaatggagatgctcatcgctgggtttcatttattatttttatttttacgctacctggggtgtgtggtgtgcaaacctggtgtggtggctgccgttgtgctctcgttgtcatgataaatgctactctctgtattttaagtattacaccgttgacttttttttattgatgtttgaccattcatcttaattaaattttttttacaaatataaaaatatttatgatatgcttaaagaacattcgatgataaatcaagtcacaacaagataaataataataatataaattttttgaataagacgattggtcaaaacatcaatggcatcatatattaaaattcggaatgagtacctccttatttcatgatataagacatttcaattttttcctaactcaaactacttcaacataaaaaaaataaactatcaaaatatattcaatacaatattcaataaaactaatttagtgctataaatattgttatatttttttctataaacttacttaaactttcaaaaaatttaactttaaaaaagtcaaagcaatttataatatgaaatggagtgagtatgtactgtaagttttaaaaattaaagtgtagatataatgagtgcacgtaagttttaaaaatttacagcgtagatatatgaaattatagtgtaacaaacatctaactacattttgatgaaaaatatgacatcaaaaataaataaatagttaattcctgtgcaacccgtagctgccgttgcgctttcgttctcatgagcaatacaatccgggttattctgcaattcgtgcggtgtttttgtacatgcccgtcagtttgtcccatccactgactgcacaaggaagaagaataatttatctgctcctacgcaaagaacgtgtgggtttttatttttgtttatttgatcgtatttgggttggcttaatccacaaggtttttagtgctggttgttcgtgatcaacttgtcgtgtttacgggggtttcgtattgtgatgattcatccatgcaagctgcaacaagagatcgagcatcatggcatctcatgcatggctcttggatacctcttcagattgttctattggattggttacaagaccagcaggctgtaggatcgaatcacaagaactaagccaaccaaaggggggtgaatggttggtatacccaaaaaccgaaaacttttagcgaaaataaaagttaccctcaatttcgatgagatcggtctgaccgaagtagattagccggtctgaccgaagcgtagccgccggtctgaccggtgttgatctaccggtttaaccgccgagatcgcctgccgctcgctatcgccgccgtcggtctgaccgccgtgctctcgccggtctgaccgccgtgctcccgccgatctgaccgcccgtagatcgccggttagaccgccgaaacccagtaaacacaaatcgaagaactcataaagtagatgacgactttattgattctctttgtgtttacaaagtgcaccaacagcaatctttacaaaaatttcgactaaactcgaaaccctaactcaaaactcaactctattgctctctaaagcgataccgggaagcctcacgctccccctctatttatacatgaggtaggcagcctaaagccacgaaccaaactcatactaggagtcctaaacaccttagaaaaccctctagtacaagaaagaaactttacataaccaaacgtaccaaatttggactccttccaaattcgactccgcatcctatacgcacacaataactccatcgtatgccatatggaatctccatcaaccacgtgcatcaactctagcctaagtatcccgcatgatctctgaccacaacggacgtcgtcttatccccaagccgactcccggtccatcaccgcaaatactctcccgagacatcgagtcgcctacacatggaacaaacaaagaaaccatattccgagaccaagctatctccaacttaactcattagcagcaaacaatagtattacatacatatagcatccatttagaagtcataatcatgaaaaaaactcggatatccaaataaacaacccgaaaccgaaaccaacacagtgtcggccggtcagaccgcgggctgcgccggtctgaccgcgcattacacgccggtctgaccggcaacccatgcccggtctaaccggacccaaatccagcagtacctgtatattcacctgtgaaatccaataatctccaaaaccacttcgtgaataaattccaaataacaaaaccaataatctccaatacccatttgttcatcacagaataataatcaaaaatacctttgattttacacaggcataattctgggtgatgattggttctacttgattaaactaaggagaaacttccgattggtagcttgcacccactcaagtatcgaaaagagattattgggtgatggagtgagcactgtttccctgtgaaacaacagacaaggaattaacgatttgaagattttatgagaatattgggaagatgaaacttccctttcagataatgaataatgtgttatttgcacactaacatttttgaacttttttgggtacatgtactttattactaaaaaggtaaatagagagaaggagtacaacctaatgccagtacatgtttcactgaatggaaggagtacaacaaaatgcagagagatagctgtatgcaccgtggtatttacacactaacattttttaatacttctctacctatttcgttagggagcgtattctgtgcacataaatttttcgtatacacattatgcacagaacaaaattcaccaaaaaaaaacttagagaaaaggagtacatgtttcaatagcattatatttctgtttaaagtcttaacctcagatttattatattttagcccagaaaaaagatagcttgaaggttataataaaggcaaaatttgctacaggacacgcaaaaaatgtgtaattagctaggagacaccgaaaaaacgtgacactgtccatggacactacaaaagttgtgtaattagctgtaggacaccggaggcaatattttataatttccaacacaaaagaggggagataattttccaaatgaccagattgcccctgacattgcacaatctaaactcgaccgggtctggtcgaaccagtcccagtcagagtccgctaatggggttgggcctacatgtcagcgaggtggtggatgggaggtagggtagcagcgatgtttgcggtgtcgccaacggtgatgaggttgcgtgaccacgacgtgtcgacggctccaagcttctcctcgccctctagctcacccagcaacgtcgcacgacatcactcttcaccccattgccaagaaactgatgcgaggtgttccatctcatcctcctcgccctcatcttctctgccggccgtggtgaagacaaaggccgtcatcgccatcgagtcgcggtcgtctctatcttttgcccgttccatcatctcctttcagtgccatctccattccatctaatcacaccccatttcgtgcagtgacggcgttggaacgcgacctcgccaccagagctcgggagcatgctccgagcaccgccgccatagcgacctcggcgttccgaccaccgtggagcattaccggtcaagctgcctcgccatcattatcacctcgagcacctcttcaaaacgccccaagaaccgccaagatcgatgaagcgagaagggagatcaaccttttcttctccggcgccggtctaccgccatcttcgtcaaatccgtccacaccagtgagccattgcccgattccctatacacgtgctgtccctatgacctcaccacgctcatgcatgccacaagctagcggctcatcgaccctttcgcgccatcatcgtcgtcgtgaagctctgcatcgccgcctggagactttctccatcaccatcgatgtctagaccttgccgaaccctgtgtgcgattcggtgagtactctagagcctctacaaaccacatgcatgcattcccttaggctaaatcgagctctaacacgacatgcaccaccatcccgaacttggccggcgcccgtaccgctgacaccactgattccgttcaccattgcttgcaagaagactatggtagcttcgccttggacccctctacaaattctcttttgactgcaacctcatccaagccgccgttcactgccggcgacgccgcaaacctcgccgttgccctgcctggctgcctcccatccaccacctcgctgacatgtgggcccaacccgattagcggactccaactgcgggttagatggtgcgataccgggggcaatcaggtca

SEQ ID NO: 67365 - DNA, 3685 bp, Oryza sativa
agtgtctatggccagtgtcacatttttccggtgtctcccagccaattacatttttttgcgtgtcctgtaacaaattttgcctataataaatcggttagatttttttgttgcttcatatacatagtgtgtacacgagattacttgtgcggataagatatgtgtccgtttcagaagaggtacaacttaatgcagagagcaggtagctgctacaatagatgtatgcactgtgtagtgtgagtacgatggtacagtcaacgcaaagcaaactctgagtctggacgagctttttgtttctgactgtgactgtgtttagtttctgaaaaaagttggaagttcgaggaaagttggaagtttggaaaaaaaaagtttaaagtttatgtgtgtagaaaatttttgaatatgatatgatgtgatggaaaattagaagttaggggtaaacacggcctctgtacaagtacttgacaatctcaatgcatgtaccacaaaagattagtatggtcttgttcgtttctccaacaacatggagataaactttttatactcgtggcacgcttttcaaactgctaaacggtatgtttcgtgtgaaaactttctatatgaaagttgctctaaaatatcagattaatccatttttttaagtttgtaataattaaaactcaattaaacacacgttattaccacctcgttttgcgtgaaacacttaatctttatctttaggagattcaaacaccacctatgtgtcatctttgacaataagcagatagcaagatcccgggaagaacactataggccctgtttagttctaaagttttttttccaaacttccaactttccatcacatcaaatctttcatacacacataacttttcagtcacatcgttccaatttcaaccaaacttccaaactacagtgtgaactcacagcctatgaatcaacggatagcccgcaaagtggtgggattcagtcatactaatgaacaacaatgccacacccaaatgacagatggacatcctaattatttctcttgtaaaaggcccaactgttttgttgggtcaatgggcattttgttgggccgatgaaattgttgtacacagtatgaataagtccaccttgaatccttcacgtagggtttcaatcgtatttctcaaacgaaaaaccaggtacaatacattgctcatcttctgaaatcagtcaactatagttcaaagacagtattgactaattgagattgttttcgactcatgtgaccccatgttgtgtgttgactcggtcatcgtcctacgtggcactcatatcaaaggaaacaaaaaacagtggagcccgcatggtgcccactcatcacataagaagagacagagagcccaaacaagaggtgagagggaacgaggatggatggctaagggcatcaccaatgtttactgttggaattaatgaatggaccttagcccactcgaagattaattctttggaaaatcacaaaagcccacctcatgggatggcatgcatgtggagtttagtaccaccttacttattctaggagagggggacctccttaaaagggaggatgccctcctagccacttgaagcatgtgtggtggagagaagagggggaacacacgcgcgcgcgtactcgctcgcctggcaggcggcgcacgtgcacgacgtgcacgtggttcgccaaaattggttcctcaccttgcgcagatgcagcctccttttgcaattttgttttgctgcaaattcggattcgtttttgttttggaaacgttccagaaaaatccggtgcatgcaaacggtgtggagtccggataagttacgcgcgacttatccggttcggttacgcgcagtggagatcgtgcgggcgcccttatcaagcgacccttctctatataaaccgagccgccgccttcacgcaacacacgcgaaatcaatctagggtttgcctccgactctgtgctgcgcgtcgctcgtagattactccatcccgctcgccggcgtgcacctgtgatcgggagagcaggtctccggaacctctgccttcgacgttctgcaccgggagaaggcggcaataaggtttttgggaagcgctttgcgcgactgctccctgttcgtccgcgacggctcgtcttcctcttcgcttgcgtgctgcgtgccttcgtagatgcctgcgaaaagtttcgaccgagcagccggtctttccgccacctcggtacgtgttcaatatgttgcgcatatttgatctgtttatgttatactgtgtagtttacatgtgtagatctaatgatgcgttcatgctagttttcatctgtaatgtcatgatttatttatggagtagattaaatcattatatgcctataatctcaacaatccaaaaaccttattataggcattgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttattgctgaacagcagaagcaattcgaggaagccactactctctttgtgggatgcattcttagcattcttggcgatcgtctggtcgaggtgtatatgcatatgaccgacgctaaggagttgtgggatgcactgaatactaaattcggtgctattgatgctagcaatgatctgtatatcatggagcagtttcatgactacaagatggctgacaaccgttctgttatcaaacaggctcatgagatacaaaccatggctaaggaactcaaactccttaagtgtgtcttacccgacaaatttgtggccgggtgcattattgcgaaactacctccatcttggagaagtttcggtactgcactcaaacacaagagacaggaatactccgttgaggggttgatagcgtctcttgatgttgaggagaaagctcaggaaaaagatgccgtgtctaagggcgatggtgggcagtccagtgccaatgttgtgcacaaggcccagaacaagagcaaagggaaatacaaagctcagcagaccaccaacttcaagaagcagaagaagaacgacaacaatcctaatcaggatgagaggacttgctttgtgtgtggccaacttggtcatctggctaggaagtgtccacagcgcaaggggatgaaggcacctgcagggcagacttctaagtctgctaatgtgactattggtaacactggagatggaagcgggtatggtaatttacctattgttttttcagttaatcagtctactaattggtgggttgatactggggccaatgtacatgtttgtgctgacatctcattgttttcttcttatcaggacgcacggggttccaccgtcctaatggggaatgggtcacatgcctctgttcatagtgttggcacggtagatctgaagtttacttcgggaaagatcgtgcagctgaagaatgtgcagcatgtcccttctatcgacaggaatcttgttagtggctcccgtatgactagagacggatttaagttagtttttaagtctaataaagtagtcgtgtctaaacatggatattggggcgcgcgaggcgtgggcgcgtggagtggttggtgaatggtgagagagagctcgccctcgccctcaccacggcgtgcgccttttatagcgaa

SEQ ID NO: 67366 - DNA, 7282 bp, Oryza sativa
gccagctataaacatattttaataagataaacgataagagagaagagcagcggactacagatctgtagccagctgtaacacgcaatgtatgtatgatatgtgggaccatatattaatagtataataaacaactattgtataaattggctattagattgactatagataaattaaagctagcagcgggctatactattaaacttgcacttacattgatgagaacctaaacattgcaaaagcagactaattaaacgtgtgcagagaatcatttaatttaccgaggcctgagatagaaggtaatgcagctctccgacatttaaccagatcagaaacatataattctgtattaatcacaccatgcgagactgtctcattcacagaagtatagtccactacctgtttgacaataaagactgaatttcaggatattcggtgcagtgacggactcagaaagatcacgttgggtgtgcacattcatatctctcttacagcgataaatgcagaaatgaaaatctaagctacgggatattacaggacctgaatatcaaattattatacatacaaatagtatgcttaaatgcagataagattgtcaaaaatagtgcttaaacagttcaatcatcatctcatatatagtgaacaaaaatagaaaattacaaccaagaaatttaattggttggattaaaaattctgcacaacaatataaatattcttgaattgattcccatgatccttatcatttaaatggttccagagctaatcagatgtttggaaagtgatctaagcaattagaaattcaaaagttgacaactaaaggctaaaagggaatctttcaatctaaccttatttattagtgctaaataagctagaaatccttatattttggaactgatggaatatatatggtagcataacgaatatgtggacaagaacgtgtaccttgtatccatcaattcttgtttcccttttaaaattgtctttcaaaatgttcatctccttatcaaacttatgggaaagtgcatccagatcatgggtgattttcttttttaaaagaccattatggagcttatccacggtatcttgaaccaagatatgtgttattgcccctaagcctccaagagcatcaagaaaggatagaatattttccattgtgaccctattatgatataactcgttggcaacctcacaaaagatagttgtgtacgtcctcaccatctgcaattcagaaacgatcagtaagccgaacgaaattttagaagtacaatagaaagaaactttagaacttaattacctgatctgctgtacgttgagaaatttcggttgtaccaagcccgaaggcagcaacatcctagaaatgttacaataaaattgatgaattaactttagaagcaccaactatacatataacaaatggaaagcgtacacatgacatcataatttaccatgacctccgaagctaaatctagagctaatcgtgctttcctgcaaaccgttgacaccatctccttctcgtctgcattctgtcatagtgtcatcgccaaattaaaagagaatgaaatgcatcaacgataagctgcaacacatttattttggtagatctttgttaaacaataagagcatgcttgtcaaaatttcaccataaagtaatgtgttaacaatgaattcggtgcattagcaaaatactagtgaacttgacataaccccaaagattggtcagctagtgcaaatagggaaaagatgtgcgcactaattttttttaaaagaaccattacaaaagcagatgtttcacattgtgactgaatcttgacttttaataaaggcaaattgactcaatcagttaacatttttgttagtaagaagtttgtaaagaaatttttagtacatgtagcattgctcttgcaaatacatatcaatggaaatgttattattgtggattttttaattagaagttttttcccaactgtttcacagacagagtataaacaagactaaccagaatcttagaactggaagaatacatcttctgcatgataaccgcaattttgtacttctccttacggaacatatcagggggcgtacgcttcaaaagatcaaaattagaggcattaggaacaacaaatataaatctaaccgcaggaaagtttgctaataatcactgactcaccttataaagaaaatgatctcggttacctctgtccctagagtaataaaactaacacagtagtagattgctttcaaaattccaattgaagtttaaatttacattgggaccactgtttttagaaaaaaaaaaacttctgaacttaaaagcaattttagaactcatacagctgatggttgacatcataagcttgggactttcatttgtaacactctggtttacaagaagaaatcaaacattggcaaatgccaaaacatctacttcctccgtttcaggttataagactttctagcattacctacatttatatagatgttaatgaatctattttatgtctagattcattaacatttatataaatatgggcaatgctagaaagtcttagaacctgaaacggaggtagtatcattagttatcatattactcctctgttgcttataattcccactgctcatctatatctcgagggactagtaatctagtattacagcatgaaccagattaatctagattaacatctgagatcgagacttaccaggcccaaggctgctctgtaatcatccaggaatttgtctaatctctcctggaagatgattgctggatgctctgatcttgcagctgcatcctgttcgagcaagcaataagcttacatcattattagcacaaaaacatagcgggagatcgaaggctcgccggaagaggagacgatgccgctgcgtcggctagcattacctcgtcgtcggcgccgtcgtcctcgtgctccggctctgactccgttgggctctttgtacagtgggagcggagctgtatcctcctcgccggcgccggcgaggggaggcggcggcgttggctaatcagagggaggaaggccagggcgctcgtcggcgcggcggtcaccgcgagatgaggcggcgaccaggtggggcggagcgccgccatgtgttccggagtttcgcggaggaggaaaagggattagcgatggatttatctgttcgttcgttgcaaccccgcatcgtatcgcgcacaaattagttaccataatactatcgcgcaacattctaaacgataatttcaaatcctagtttagagattcactggtcaaaaactcggattaaatcctccaatttcgttcgaaatttacaccaaacacggctacatttgccaagcaaaaacttgatcacatcatcatcacctgttctagctgaaactgaaaagcatattacacgtgaaaaaggattgggatgttgctgttgttctactactggtcgtaggtgtagatgaagtcggagttcccgaccatggcgttgagcacctgggagacgaggaacccgccgccggcgaggacggcgacgatgagcagcgccgtgacggggttcttgagcagctccacgatgggctgcgccagcgtgtacgcgaacccggtgctcaccgtcaccacgtacagcgcgtaccgccgcatgttgtcccagaactcctccaccagcgggccctccggccccagcgccgccgccggcccggccgccgccgccgacgacagcgccaccgccgccgcgatggccccgatcagcgcccacgtcgggagcccgcacgtcctgtctgccccgccaccgccgctgacttctccctccgctggttcttggagggggtggaggagctgctgctcctccgtcttctcgggctccggtggtgcggtcgtcacggcgaggaggcggtgctggttcgttcgctgaggggaagggaggcgagcttggaagacggtggtgcggccatggaggcggaggtggcgggggtggtggtggagtacgggggagaggcgaggtaggtggaggagcgagaggtggtggttcatcttgcgccgccgcggctggcttggccggcggtgaggtgaggacggcggcgatgagggaggaggagtgtgtggtgacgagttcgcctcgcagtcgccgtgatctgcacccgctctgcatgtggggtggtggggatgcgggtggttgttgggccgagtggaatgttgttgggccgaagcaattgttgctgatggttgggccgtgggcttggttcgtgtccatgggcatggttcgataaatgggccggtttggtgtgcgctttggcttgttagcgcttttctacttttgtgcggcttgtgtaggctaaagtggctaaccaaaagtttgatgacatgttagcgctttctacatcttttaatctgcgcaatgatttagcaaattgttttgcttttctctgctagaaagaggccgtctcgtaattcgttttagctttcgtgaataacgtggcgaaatcgtgtttactaaagcattttatcacggtaatgatacgttgtggctatattttgtttcatattgtatctttatctctaaaaattgaagatgtttttaccggtatttttggtacgttattcgtgtatgagtcagtttttaaattcgttcgcctttaaaaaatacaggatgagtagtataaaaaatctctttaaaaaaactcgcatgctaacatgagatgatcagacttatactacctccatcccaaaatgtttgatgccattgacttttttaaaaatgtttgaccgtttgtcttattcaaaaaatttaagtaattgttaattttttttctatcatttgatttattgttaaatatacttttatgtatacatatagttttacacatatcacaaaagtttttgaataaaacaaacggtcaaacatatttaaaaaagtcaacggtgtcaaacatctaaggaagaagggagtaattgcagctaatgattttctagaaaattatgcagcgaagcaaattttaaaattgaatttctccttactaaaccgtataacaataataaaaattaaaatattcttcacctgttgtaatgtacgggtattttttttctagtttgatctaaattgagaaatatttaggcattttctagctagaactgaactgaattagaaacctcaccccttctttctattttataataatgtaaagcgtagtaaatactaccacagaggctcttggaggttgtctgtactccttcattcttatctttcaccatagattatattcgtcaaatcgatcaatcggtagaaaacactatattttttattaggattcaacgaggtcaatagtattgattgataatatatactcgagataattttatcaatttactgctgattttgactttgtacattccgtttaacagtacatctttacaagtagtaacaaaaaaccgaaggcgtaagccgaagaagactttctttcacgccctcctccaaatccaagggcagcagtagcagcaaaaggaagtcaccaacccttccttcgtcaccctaccaccggtcaccggtaaacccgcccccgccccgcccgccgcaaccccagcgaaccaaaccaaaccaaacgaaacgaaacggagtagattcccccaaggccccaacctcctcctcgccttcccacctgtccacctccccccctccgccgccgccgccgccttcttcccgggggcggggcggggagaggaggcgcgggggtgcgggggtttagtatctcctctcgccggtggccgcgcggggaggtgacggcctgagattctcgccgcgtccgcccgtcgttctggtggtctcctcctccgccgccgccgccgcccgcgtgttgggggagagcggtttggcgtgaatcgggccggggtgagcggacgccgccgccgttggtggctgcttcatggagtgcttcctgctcagcctgaacccgttccggttcaagccgatttggccgccgaggaccgcgcccaaatctccctgaaaccctagggtttcccctcctccctgcccggggatttcgagaaaaaggaagtcccgggcggcgcttccccccaacccctcgtttttttttttgggttcatctcgtgtgttccgtgaaattctcgtcttctcggaggtttctgaggggagggagaggctgggctgaccggctcaaggtgttgtgaaaggacatgagcttgctgcgagaggctccttgtctcgtttagtttgagttcgggctgggcgtcccttcttctataggtgacggtggtggtggtgctgctgctgcgagggatggcgaaggaggaggacggcggcggcggcccggagttcgtgaggtggagggaggacttcgtgtcgcaggagaggggcagccgcgtcgtgcattactacctcgaggacgccgcgggcgcgtcgcacctcgccgtcgtcggcacggagcggagcctgcgccacatgctctatgtggtctcggaggatttccgggaggcgcagggtgccgatggcggcgggccgggggtgtttgcgcgcaagtggcggtcacgccgtgaggtggtggattggctcgcctccttccttccggcgaagtccctcgcctcgagtaagtctcgcctcctttgtttatagtgctcatacacgagttcggctgatactgaatataccaatagctgtttatttaacatgctatatgccatgtagtgactttagaacctaatgaagtaaatagctggtttggagtatgtctgttgttcacagtaggctagccatgaattcagattagaccttactagtaaaattttggatttctagaagatcctgtgcaacttgctgtgtaccctattttcgtagtgcataatcattttttctgcgatggatacaatacggaaaatttagccttaaaggacctttaggactaaaagttctacctgaaagacctatacagattagacattatgtggtagaggcctttggtttatttccacccatcatattagacatggtaacaggcaatatgtgctaactggtaacatatgtaactgtaatcacaacatttgggacttgagagtgcttatgctttgttcaagttcaaagagaagccctttcaaacagggaaattacatgaactttttacaatagcttgttagtgacagttgtccttagtaatcaactttttctttgttccctttcttaccacataatggtctgattaccagtttgttcaccctgttaagcatataacatgtatgatcaacatatgaaccatttgttaacggtttggtcatttcagaactttcaaaatttggat

SEQ ID NO: 67367 - DNA, 16833 bp, Oryza sativa
tttttgaatttttttttctggtcctttcttccaatgaaaaacaacaagttgttttgataaaatagatccttctgcagtccgtatctaattttgaccttccaagctaggggcaattgcaaatttgctgttggattgaatcgttattgcaagactgccactagaaaaatgcaaaaatgacacactgtcattcgagtggtatccctgcaaaattgaaaaaaccattggcaaatttgcaaatgccccagtggtattccttgcaagcgtatggaagctaaaccatgttccttatcatcaaacaacgatttcctatgttctttaatcctctatttcatctgcaacatgttgatatttctattgtttttacaggcgagaacttctttagtgtatgccagctaaagaatttaagaatttcgaaagattgggtcaagagccactgggttgatatagaaatgaaaccagatgtgttatcgaaaataccttcggttggtgttcaaacaaggcaacctgataatctgacatctgttgagaggccggactccagaaattctgcaatgtctgaccaagagcttgcagccatacaaacaaactctagtgaagataaacaaacaggagctgatcagccagcagaagttagtttgactgatatggcctctgcttttgcagaggaccagaaacaaacagttctaggaaagcgacctagggatgatgatgctgaacaacattgcaatggggaagtaggcatagatgttggcaaattgtgaagtttgggaagcgcaacctcattagacgtatgtacatagctatagatatggtaattggaccccagcagaggggttttttactaggttgctgatatcagtgagcatcgacatcttttttcatacacgtgttcccttgttttactgttagcttcccactttcaggctttctgtcaccagatacagaggttgcaaactaaatattacccttaccagtcatattgtatagcagtctgattgatcattgcttctcttatgttttcctccggagtctggactatagtttcagtttattctcaattgttaatatagtttaagttcatatgaataacattcttgtcctagcttgcttgtgctacaagagtatatctgcatttaagctgttgtgaagattcaacgactaacaatcacacattgtgattgggtatggtgtgcaattgcacatccatcaagtatgaactgcacttgcgcatgttgatctgaagaagttgcaaaatgagtggttttttctcctcctcaagttctgtatcatctatttgtggcatcctgggatctgaagtcaattctacctgatgccaatgccatcccatgatatcattatcttctgttatgttaggcctgatgtccctggcacgagcatgtcacattcatatgatgcattacctagttcctttacacatgcaaactctcatctgctatgattggctggtctaacaaatctccggtcccattatatcgcaaactttgaattctataaaactcaatctttgaagttgattttatggtttcatcgtggtttattttacaacattttgcttttgtatcattaaattttacctataaattactttttgtttgctaataataggcgatacgaataagcataaagataagtgaaatgatggggctgctcatctcactacatatggatgtatgtcaaagtttgttacatggtacatcgttacatgtcagctattatatctactaggtacatgttctatctgcagactgcagtggagaaggaaccagcagcagtctgaactttctgaacttgtgaagaatcggcgatgatctacagccggagccactgctcgccgttgatgaagctccggccgatgaacggccgcgcctcgtcgtaggtgagcgtccgcgaccacggcaccctctgcttcgtgctcgcccctggccctttgcagttgtactccccgaacagcaccgtcctgtcagaagattcagacacattctctgtcattttctgacggatatgatatggcagtatcgtctctaggatttcagaaaagaaaaggaactcatttggtaacagccttgtcacatgtggtaactgaattcccctatcaagactgtttggtgagcctgcaatgcaactcccaaccacttcctatgccatttgatcatcgaggatggtaagttggtaactagtaaaattcagctaaaatataatctcttcgatcaataatattaatatgccatgtgaacctgacagagtagctgcaattataattgtaactgtaattttaatcaagagcagcaaattgagtgtgtgattaaatggcaggaaagttgatcactttgttcttgattgatcaccccagtcgctccatccctgggggacgatgatgccactgaggtcacagtaggagtacaccactctggagtacttgccccatgctcttcccaggtagagcatgccggagccggtgagccggcagccgacgaagctgaacccggactcctccgacggcgagctccgctgcgacgccgcgatcgcgccgtagctcgtcgccacggcgtgcagcgtgcaaccctgacaaaaagaaaaaacaaagttacaaaaattcagactgccaagaagctaattgtccattttaatcatggcatattactgcctccacgtgttacagttgtatattgatctaataataatatattgacgtgtaaggtttttgcatgttcgtgaaaaaaataaattgatcatggcaccacattgccatgtaatgtcactctcattaacactcactccggcatttttcattcagtgacagttgtgccgaaggtagaaagagaatgtgaccactaattctgaacaccgatttgtgtaagagcattggtggcattggtgcagggctaagtgcctaaccaccttatcccacttagctatatagctaggttaagcaaggtgctaatctaggtgcctcaccagagtgagaagttcttttgctgtaaggtataaaatggaagagttggtgaatgcctgaattgtgagtttgtgacagctctgatcggaccaacaggagacacagcataaaaggtatagtactactagtctagaggacaactagagcaaagtgtgggggacagagtgtccaaagattttatcatgctatacataaacatattcttaaaaaatataaaatacttcctccatttttatttacgtgacattggttagttcaattttgatttgaccaatgtcaaatagaaaaaacatatgttgtattaaacatccaataagaacttagtgagattagggatttgcaactgctctctatctctttaaacgagtattcagcggtcatacttgttgtgtgtagtggcgtatgtgcgcgtcccttctaaatagaaatagaagtcggtttttcttataggattatttctcatggtaacagtacactactgatccttaccaagaattaccacaaaaatacctgtggttaatttgggcaacatcctgacttaattagacagtagtaaaaggcagcaacagtagtagtaacagcagctgtggtttaattttatttatttattagttacctggtacaaggaccttgcgttgccaaagatgaaatcgatggagccctggatgtcgcagttgtagaggtagtgcctcccgatgttgtcgaacagcgtgtcctgcgtccccagtatcctgcacttgtacagcaccgtcttgtcgccggacagcctcagcgccaccgcctgctgccccaccgcccccggcgccgccgccgccgccgagttctgcaccaccaccacgcttgttacatccaggaacacgtttcgccgccgccggcgagccggccggcgacgacgacgacgacgacgtgcggtgtgtgtatacctcgaaggtgatgtggctggcgcagaagtagtcggcctcgacggcgacggaggcggagtagaaggtgcccacctggtggcccgacgcgccgacgtcggacgcgcgcgagtgccacgtgatcaccgtgtggccggtgcccatgccgatcagcgacacgaacggcttcgtgatcggcaccgtcaccttctccctgcacggcacgccgtcgccggcgaggtcagcgccattgcagcttcaattccagtcttaaaaagcttcgcgagataggacgacattaactcgtccatggcggttacgagagggacaggtagtggggaggcgatcgatcggtcgaacacccacgtacctgtagacgcccggcctgacgacgatcttgaccctcctcgtgttgccggcggggaccatgtcgacggcgccctgcacggtgcgcgagtgccccgtcccgtccggcgacaccacgatcgtcgtccgctgctcgccgccgccgccgccgccgctcctcttgccgccgccaccgccggccgtgtcgtcccacgtgctgctccgcgccgccccggccggcatgctcaggtcctcccacgtgatgaacccgccatcacctcctactccggcgccgccgccgccagccaccgtcacggcgaacacgagcgccacaacgacgacgagcacgcccgtggcggccatgtccaactagtcgagagctaccgatctctagctagagctaattaaccacgcggattaatttggaacacacgagagatcaaccagcttagcttaatggagtatatatcgagctcgctgatttcacattacacacgccatggatgatgacgacgacgatgtgaagaagaagaagaagaagaagaagagaagaaaggatggaatgcaagaagacgttggaggcgtgaggaagtgatgatgccattaaatatggggagcgccacacacaaagccatgggtgttttggtgtgcccattggagatatatcaaagatttttaacattttagggcacaaaagtgggtgtttttgcttatggagttgtgtacacggtttcgtcgaccgcgaaaaaccatttttttttcatgagactaatttcgtccacgaaaaactttagcggtttgtcgctcgaaaagccgctttcatccaggttgcgtgatagtggggacctatttgtcagtgactgtttcgtgatggttctttaagagtggattgttggtagagctagcacgatggtgttgcattgcatggacttgttttgtgggaagggaactcataagggtgtgatagttattgcatagtattttttttgtgattaattaattaattaattagtatgtcatggcataatggttggtgctttgttttattgattacaagaattggaaaggttgttcatgagttgtgcacgagagagaccaagatttgtttggggaattttcgtggtggaatttggacaaggtaggctgatcaaacggggtagttagtaggttgttagtgcagaacggttgagtctagcatgcacgtcccactttctcaaccctttttacctagctcttgtgaattgtgatggtccatagttaactgcttttcttgacctaaatggagaaaaattagattggcaaaaatgttttctaaaacaaagcgctaatgcttcagatgagaagaatggcaagagatcaatggtcaatgccattttgtttcctattgctagttataatggattaggcgaagaagcattatgtaagtgcgagcctaacactgctgaaatctgtcaaaaggtcaatgcactagagctatttttgacgattaggtaatcttctgcagaaacctgcagttcaagtaaagccgtttactgtgcaatcaaatgaacatgggttgtgtaggatctatgcccaaattactcaaaaattcagcaaatcgacacgcttattcgtgacaactttcatcaaaatttcgtttacaaatgagcacggtgaaagcaatttttcagaccgcactttgtcgttcaactcaaaatcaaagtcagcctataaagtcagacaactttgtacaagtgtgaacttaaaacgagttcatgtccttggtcgtgccaaataaaaatggactgaaatagtccgtatttgtatgagggattgatgaattcaatataggctctagtactttcaggctcagccttgcaacaatgaaatggtcctgtggtttcagcccatggactggttactggttagagatttcgtaattgtcatgctgttctgtggaaatttccagaagcttctagaatcaccatatgcacaaacagatatggcatatatgtatgcatacaaaaacagtttttgttcatgggtgattaaaacatgggtacaagtgattcccgaattccaaatttattgtgattgatcttttcacaaatcacaatatgttcaggagattaccgaaatttggtatattctcatttgggttactctggatcccaaaaaactttacaaggaagtgggattttgctgtgtcatcagcatatgcttaagctttgcatactgcagagaagtggaatttttgcattggctaacaaaccaagtaaactgtgatcatatttagcaagtgatcttcaagtgggatattaaatttttacataatcctaatacttattcaggttccaactaccatctccacttcaccaaatgttacacatttatttctgcaaaatagaaaagcatatattaggaacaaacaaattcagcatagacagcacaaccagattgctacagattggcagttttttggcaggggatgcacaaatgcaaggcagtatttatatactgaggcaagtaagcgattgagtaccatgatattatatcccactagcctaagcgattgagtgatatactgaggcaagtaaggtttggaaaccggagcggaatgtccctagcccactacaccagtacaacatggtactctagctaaagtctgcaatgatgaccatgtgcttcatccttcatgcgttaagtcgttatgccatagcccataatattgtttgttaacatctacgttgagacatccacagatagaaatagtacaaaattggaaatgctaacaaccaaaagatgccttggatgatgttatagtttattaaattgaaattaacatgtggcatcttgttttacatccctttccctcctaaataaacacaggcacgtcattagtcataggaactttctatacttgaaccaatagtcagtggagaaaatacagtaccaaccaagaagcatacaaatgggaactaggtatagtgaaaggcacacccttaacggcttaacagtaatgggatccatgttcgataagagaggcctcacagccctgattttgttgcatccacgcttgaaaaaattctcaaacttcagacttaggtattagaattccagaaatttagaaaatattgcgtaagctagcaactctagtctctaagtaacccttttttcattaagttacaaaagttggtaaccatttcatatctgataatcacacttatgaccagcataatcctcacagcgaagcaaacatagatatttgattatataaataatttaaaagaaggaaaatctatctccatgcagcatcaagatcagggataggatcaatttgttcatacctaatacttgttcgacgattgttcaagttcaggcctgtggactgacatgcgagcaatctcagatactgccgtctcactagcctgcgtatcatcaccagcaagctcctcatatgcagcctcgaatgcttcttgccagaaccgtggaagccgtacccgatcaacaccggtgcgtgtgtacacatcccacatccggcgcactagcttctctctgtcctccatctcctactcattatttaaaaattaggcaaaacttcagtacaagatttcattcacaactaaaaaatgcatatagttttgctcgtctatgttttagcttaggattctgctggtcatattgactagacaattatgcagatgaagcttgggaaattaaaccgttaacacaaatagcatatgttccagacaccaaaatcaagaaataaaggtgactgctttctcgtccatgtaatggaacaacttaaaataccatcagaccaaaaaaaaaaatcatcatgtttccagcagagcgtgtacccttccttagcatttttttgataatgagcattttcttagcacagaactaaacctttcagaagagaaaatatgcaatgtatgtccaaatgaaactctataaacagagaaaattactagattgcagaatgcttagtctactatgtgaatttctaataaaataagctgtttgtgactttgctgaaacaagtacccatttcatccccactatgaaatctgaaatcaaccaataatgcatctcctttttcgcaatgtcagaccgttgggacttgggaaaaatgcatgtacacatcggacagttgaggaacaatggaagagattaggcaccgaccaccgagtggcggcaagatctggaaggaaggaagggaatgttggggtaggggagacatacgagggggtcgaggtcgtcgataagcgggtcggggaggtccccgaactcggcggcgaggtcgccggaggaccagcggatggtgacggaggcggcgaacatggaccagagcgcgaggagcgcgatggcggcgagcgcccacgccttgtaccgccccttcccgagcagcgccgcctccgccccgccggcggcggccgagatggggatggagatcttggtcgccggcggcggcgtggaggagtggtggtggtggtggtggtcggcgggagccttcatggccagcctcgagtatggcggtggcagtgggagctcagcagctgggtctgggactgggcgatgtgggcaattactctaccttttgatgagatgatttgagcaacgtgtttatttttctttgatagttgtagtgtactccctacgtccaataaaaaattaaaccagtattaaatataatatattctaatacaataaatttagaaatacatatgtctatatttttaggatgtgtcacacatcccgtactagattcctttttttttttacggagagagtatatggataagaggaccaagattttaatttttgatgttgctgccaatctatttttgttaatgatggctatgattattcactcaaggaaaagaaagagaagtgctaggagagaatgtgttaaatatggcccaatagttaaaagagataggatgagaattgagtatctagacacaaaaatttggaggaacgataccacttgtatcaacatacttagacttacgttattaccaccttttagaaaagactctttgttttggctatgtaagttctttagaaatcgtggtttgcttaacgataccatccacatatctattaagaaacaagtaactatgtttctaaatacagtaggggacagccttagaaatagattagttatcactaagtttgataggtctggagaaacagttagacgttatttcaacaaagtgtttcttgctgttggtgagctacaagatgaactaattaggcctcctttattggacaccccaactaaatttgccgggaatcctaggtggaatccttacttcaaggcgtgagattcatctatgtctcattttcaattttatatttaaataaactagtatgaatggtgaacagttaacagtgatggatagtatatcatcactaactgttgacaccaagaccctttactagaagtttttagcaactgctccctccgtcctaaaatataaagatttttatggttagacaccggtattaaaaaattatgtggaattaaatgagataagattatgattggttgagaagtaaaggtagatgagaagattgaattgtggagggttgtgattggtttagaagagaatgttgatgaaaaagttattgtattttgggacaaaccttaagcgctaaaagctgttatattttaagacgggaggagtacaattccttttaacatatgtagctctatagattctcagtaaaaaatatatgtatagttatataatccacgaaataaacaaaataaacaagaagtcaaaaactgaaaaatccaacctttgtaaattcttataagccaagcaattgttaataagaattttaagctaccgagagctttaagccttttaactcgaagttgccaaacaactgtaaatcttggctaaaccgctaacgcatgtgaaagtaggcctggtgatggtgggccttgggcttagcatgatctgtattaaactaattaaaactgctaaatcgcaaaaaaaaaatagaagttgctctaaaatatcaaataaatctatttttcgattttataataattaaaactcaactaatcatatgttaataccacattattttaaaacacttaattttcatctttatttacatgagtttcaaacaccacctacctatatacttaaataaacatctcaaacaaaattggtttaattaggagttaggtggccgtgagagcctgtataggtgtccaaacgggcggcacggcccggcccggcacgggcacgggtccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcctgcggcccacgggccgttcggggcacggcggcccgtgaaggcaggccggcagctgaggcctgaggcccagtgcacagtgttttttaaaaaaaaaagcaaaggaaatgtataaggaaaaaaaattaaaaatggaaataaaatgtttaaaaaaaagtaatgatttactaatgttaaaaaatgaaaaaatggtatttaaaaaatggaaataaaagtttttaaaaaaagtaatgatttgctaatgttaaaaaaaagaaaaaatggtattttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaaatttgtcatgtaaaaactcataggggaaaatgagaaaaccatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgatgtggtcgctgcgcagagtcgtcctccggtcttcgatgattcgggcgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaaaagcatacaacataggtatatttttccaatatttcaaatatttttgtttcatgtgaaagacaggttcagttagaacgtcatcattttcgtattctttaaataaattagcaatttcaagaaggttgtgcaaaattatattagcagttggataataaacttgtgataaagttagagtacaatcataaaaagtttctagaaattggtgaaatttttggacaattgcccaaacatgctcgttcagtactgaagacccgtcactgtttcttgggccaccacgtgactgaacaaaatcagaaagtaaactactataaggtaaaacaacttttaacattaaatatgttgcattccaccgatgctctgcactgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagtgctctgcatcggtggcaaacttacgagctttcacaccggccgcattgcaaaacctcttccatgcagcaatctgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttacaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagttttgccacacaccggaggttctcgatctcttcgagccggtgtgtgtcgaaacacttccgctcgcggttccggaaaatccttccgaagctgtcgccgcctgaaccggtacctcctcaacgacagccgtatgaaccggtacctcctccacagatggtggagttggagccgatccggaggtatcgtcaaaccccgacatgtagttggggtcgaaatcacccaaggtgaacgacggcgactggtatggaaagttcggatccattctgaaaatttaaaccgacataaataaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtcagtgcgccgctggcgctttcggcctgacgggccgctggcgaaacgggccgtgccgtgccgtgccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccgtttggccacctctaagagcctgcaatgagatgggctctgtgcaaaagctgagttaggtggcccgatcccctttcttccccgcaatcaattgctcaccggcggagaggccgccgccgccgccgcgttcttcctcctcctgagccctaaaagggaatccagctcgaggtcgaaccaaccaaaagcttggcggcgtcgcggagacgcggccaacctgctccacatacaccgcccgtttcgccagtgtcttttctctttttactggcgcgcgcgcgggcgcgggcgcgggagaggcgagggagtggtggtggcgcgctgcagggggggctgcttggctgcggagtgcggacgacggctataaagagggcggaaagagagcgcccgatcccgctactcatcagctgccgtctcctctgtgtgtgtgctcgcgcgcgcgctccggttgctcctccttgggttcttgatttgctacacgcgtttgcttgctcaccacgtgtttgatggaatacctgtgaggtgaggtgaggtgaggtgctgtggctgtggtttggttgatgctaatccagctgttatttgtgctggattgattgcttatttgtgcttgttattactagtcgttgttagaaagcttctggctaaaaagtcgtcatttttttgcgaaagcttctttagcctacaacggcatagggatttcgatagctaaaaggtgtgcttatcttgttaatgaaagagaagtgcagatgctttatttgttgtcttgttgttccaaactctagaaaagtatgctctttttgcctttatcccacgagtagtagtatatcatcataaaacttaagggtccctttgaaacgcagaataggaaaaacacaggaataggaaaaacgtaggaattgaagtagcatgttttcctaatcctacaggaatggaaaacacaggaaatatgaagagggtccctttgatagcaccataggaaacaaacaaagcaaaggatagtttccaagaggttgaacctcttgcttattttcctatgaaattgagctataggaatgcaatcctaaggaaaatttcctatactttcctatgaatcaaagggtttcataggaaaaaatccttaggaaattaaatcctctaaaattcctatgacaatcctccaattcaaaggggccctaagtagatgggagaatggagatattcccgatatacacacgtggattggagcccaaccgtgcatagctagccatcatctttgtctcactttgttaggaaatttaagtgaaatcaattaaaatctaggtaaatccaaaggttacgcctttcagtttaactatcaaatactccttgataaaactttactaaatataaagagtttgatgttgtttccagagaacttatatcaaatatcaataatttttggtatccattcttctgaaattagtatttcccttccggaaaacatacttaaaatagcagatatttcctctatttcacaatgtaagtcattct

SEQ ID NO: 67368 - DNA, 3596 bp, Oryza sativa
atgctagaatgacttacattgtgaaacggatggagtagcaatctatagcttctttgtgtatcctgttccaatggcaaacgcttgctcctttttcttgatcagagcaagcaagtctgaaaattttatgtcttttccagtttgcaggcctgatactgcctgttggtccctccccatcaaaatgcttggttcacttatctcttactcaccttcagtggtaagttttagattcatatgcagtgatatatagattaatctcttatgctgaacaagtacccaggtggaaacattattagtcatgtaaagataatcaaagatctgtgactttttttttgtgcttattgctgacattcgctgatattcgtatacttctgttttgcttttttcatttagaatccaaagacggagaaccctgatgagttaattgcgactggtgtccttgcgagtctgcaaaactttatccgcaaatgcatcgtagctgtcctctcatatggcccaatgcctaaacatattgcatttattatggacggtaaccgtagatatgctaaattcaggagtatccaggaaggctctggtcacaggatgggcttctctgctctcattgccagcctactctactgctatgaaatgggcgtgaagtatatcacagtgtatgcatttagcatcgataattttaagcgagatctgactgaggtgaaatccttgatggagttaatggaggaaaagatcaatgaactgctagaaaacagaaatgtcatcaacaaggttaactgtaagatcaacttctgggggaagttggacatgttgagcgaaccggtgagggtagcagctgagaaactgatggttagcactgctgaaaacaagggactggtcttctctgtttgcatgccatacaactccacttctgagattgtcattgcggtcaataaggtctgtgcagaaaggagggatatactgcagagggaggatgttgacagtgttgcgaataatggtgtgcattcagatatttcagtggcagatctggaccaccatatgtacagcgctggttgccccgatcctgatattgtgatccggacctcaggcgagactcgcctgagcaatttccttctgtggcagacgacgttcagtcatttgcagaatccagaccctctttggccggagttctctttcaagcaccttgtctgggccatactacagtaccaaagagttcacccttatattgagcaaagcagaaatctggctaagaagcagctgtaatcacatcctccctgggaggagatagaaaccatcatacaagatatctgtagttacacaataatctgtattctcctttgatatctcctagaatgtgaaatatacaaaaaaaagatagctattccattgtaggcaggccaaacatgtgtatgcttgagttggtccaaatgtgtgaaatgtaataacatttggtctaagcaaagtgccttattttccctgaagcaattttgttcgctgtgcagatgtgctactatatccttcttgttacagtatgcatgcaaacaaactgagaacattataaagcttaaagcatccgtaaattaccaagtgcttcttcacacctttgatttatgctttactcaatcaaacaaattggcacaaaaactgttcacattttatccgggaaacttttgtgcttctctgaatcaaaagaatttttgctccattgattcggaagattttgaactagcatatttcattctaaaaactccttatggaattgctgactttgctgtgttaaggatttatatgattctttaaagcaattttcttacatatatattttttttagaaaaaatcatgcttagcaattcgaaaagcgtgtgagcggaaaacgaaggagtagaagttagaaacatgcactctcttcataaaaaaaaaccctggctatgtatacagacatgcgtatcctaactatgtatctggacatatgtatgtatgtccatatacacagccatgtttttttttggacgaagggtagtacttcctccgtttcacaatgtgttattctaccatttcccacattcatattgatgttaatgaatctatatagttatatatgtctaaattcattaacatcaatataaatgtgggaaatgatagaatgacttacattgtgaaatggaggaagtagtatagaatatgcccttgttgtctatacaatatttttttgaactattttcatactaaaagaaacccatttggaatcaatgtgttcaaagggtggcaattccaaatggattttaaaaccatggatatacatattttgcaacttttgtccccattgatcggcataaggcataagccaataatacaccatataacatattgcgataataataatttgttgataaaactgttatatatgtgttcttatcaagttaaaaggtcatggtgaagaataaactttgatgaaaattttaaatcaagttttaaaattcaaattttagccatggttgatttcatttgggcaaacgatggagcctctttgcttgttaagcttcaacatggagtcaaatactccattcgtttcacaatgtaagactttctagcattactcacatacatatagatgttaatgaaactaaacacatacatacgtctagattcattaacatctaaatgaatgtaggcaatgctagaaagtcttacattgtgaaacagaggaagtatgagataatattttgcatttatattggtgttgtttattgaaatttcatttgtattggacgttatgggtgaaatagccagtgcctgttgaaaagctctcatctagtctcatcgtttcacctacaactaattataagttgtgatgcttatcagcgactcaaaaaataatttatgagtaaaatttttatatatagttgaaaaataaactagataaaacattaaaatcaaatctcattaagatctaaaaattaaatttgggctatgactgataagtttaaatgtcaatgctgaaaaaaaatacaatgagaaaacactaaaatcaactcaaattaaaaattaaaatttaatttttggttgtagcagataagttgaagtggagctgatcgtctgcttgtcttatcagttgtagcaaaaatttgaatctaaaaacttaatttcaaagttgattttaaggttttctttgttgtagtttatttttcagcattagcttttaaattgataagaacacacatataatgttttgaatataaattttttgggttgcttagtttattttctactgtttattagtggtagatcaacaatcagagcaacaagaaactcacatgcaaaagcacggtttgcaatactattttccttcgatgacaatatcagaaattctgaatttgggatgaattcaccacctaacataaaattaggctctatatttttcctcctcctcccctccaattcggctgcacaacttgtttccatgacaaattagaatcaaatccagcacatataggcctttttctcttttcctgatgaaacaaatagaataactcaggtctattctgaaaaatggtggcgatccaaataggggggtttgtgctaaataacgacatgaaaaaaaaagg

SEQ ID NO: 67369 - DNA, 8587 bp, Oryza sativa
ttaacatactccctccgtccaaaaaaaaaagacaaaccttagtttttcgtgttcaacatttgattgttcctcttatatgaattttttataattagtattttcattgttgttagatgataaaacatgattaatatttaatgcgtgacttgtctttttaatttttttcataattttatcaaataagacggatggttaaacgttgaacacgaaaactcagatttgtttttttgggacggagggagtacaaatatacacgtgctaagagaacaaagtcagattttgccagccaggtgatggtgatatcggacatgtcactgtacatcagaaagctaaacagtggattggtgctggttgactcgcagcaggagcataattaaagcagtacggttattttgtgctttgtggcgacgaagaggcgtacgtggaatctcgcttgttggtgcttggtggcaccggtagaggagggcgaccgccgccgccgagatgttgggctcgtgggatttgagcccgagctggatgggccgttcaatctgccggagtgatgggctactgggctagtgcatcactgtttaaaactgatgaagataaaaatgaattcaacgtacgtaaaacgagaaagctactaggacataattaattaagttttaattattattaaacttaataaattaatatattcaatattttaaagcaatttctatataaaaagtagtcgtacggtttaaaaaacgtgctaacgaaaatcgagaaaaaaatatgtatctttatgagaaaaaaacatgtggtggacgctcacatgttcttttgatgtgaccaaatggcacatcactcacgtacaagagaaagtgtagaaaagagggtatgttgaaaatcaaatgtctaaacggagaaatctacaagtatataataatccttccattttatattataacattctttgaccttttctaattcaaacttttttatatttaatcaattataggaaaataacaatatttacaacattacattagtttcattgaatctaacattgattatatttgagttaattttactttgggccaccttttattaccgatgtttcgctttggaccaccttaggactaatgttttcactttggaccggatatttttacctttatttcactttggaccaaccttactcttttattcatctacatccaacttgtaatatgttgaagaaatagtcttacatatagctgtggcagctcattgacgagtatgagacgatgtaatggagatcgtttatatgcttgagaagagagtcgggtggtccaaagtgaaacaaaaggcaggtttacccagtccaaagtgaaaatattgcttaaagggtggtccaaagtgaaacatcggtaacaaaaggtagcccgaagagaagtttactcattatattttaatagtattttcgttttgggttgaaaaggttgctaagtttctctataaatttggtaaaaatttaaataatattaaattttaaaaataaaatgtttcataatatgaaatgaagggaatatagaaaaagaggggacagtttatctgttagagtgctctctcctcattggttgtcatgagcgctaatcatccttgttagcactaacacacagcaaaataagcatggcatttagctgtccccgggtccattttccatttttaagaaaaaaaaagggaaattccatgggtcctgactagagagactatagagtcctgcgtgcatcgatctagggagtaaacgaacaacaatgtttcaaacgattctgtcgataaaattttgtcacatctacctaacacaagatatataaaaaaaatcacatacaaaatggtttgcaatggagcaattaataatgattttgttgtaaatgtatatgttatcaacatgtatgttatatcgtttgttaattaacatgcggtacccttctactccctctgttccacagtgtaagttattttagcatttcccacatttattttgatgttaatgaatctaaatagatatatatgtctagattcattagcatcaatatgaatgtaggaaatgatagaatgacttacattatcaaacggaggaagtagctcttttatcttttgtttccccctccacattacaaatatcctacgtgttgatctcccagacgatgacatcgtatcattattcttgtccctctgatgttattttcttattaacgatatccatggaacatatttttttccaactaacttaaaaatgttcatcattacgatagtccttaatttattcgaagataaacgtattagagtaaccggattacataatatgattatgaaccattgtaccacaatccgtgcatagcattgtagtggctattatataaggcagtgtacatagcagaagatgtattcataacatatccctaattgttgtggccgtttattttgcctactaatagtcatacattttgacgtgatcatgttttaccaacaataaactatgcccattatatagttttcaataaggagttcctattggaaaatttgtgtctcaccatggacagtacatataactacacgctgcccataccttctaactccactcgttagctcatcgattggactgaagtaacaagtacaccagtcataggagtgtagctagggttgaggaggaagagggagagggagagcacattgatgcctatataaaagatggcataacaattagactatgaatggatgacaaggtaatgtaatagtgtcactgtatgttagacaaaacttaatggattatgggtagacttgatggtgaagctaatatatcttagcaatcagactagagtagcgggtcgattatcgatcacacatcaatggtgactacatgaaggctctatgtgttataaccgtataagcacaatacccacaacgaggttggatacgtgggtggaggcgtaactatatgaagacaacactacgtaactcgtggcagatcagctcaaaaaggaggagaagccattggccaatgcgctagttatacattagccatatatctatatcgctaacactgttacaaattgtcttgaatctatatttattcatgtccaaattgctgcatgatagccaaactaaattgcatctttcagagccatcgtttcacttattcgcggaataagcgaaacaacatagcgatctaaaatcaaagattgaaaaataaacttcaataaaaaaccgtcaaaattagctccaaatttagggttgaaaactcaaattttggttgataattataaatataagtaaaaagatgaggcgctttttctctcaaagaacctttgccatgtctctctcatgcatattgagcccctgcacatcaacgtagtcatagcacaaattgctactactactacacaactttttcaagacatagcaagtgctcaataatatcctacatagaagcgctgaaatacttttgtatgtgtgttttaccttgctatacaacctatttatgtttcttgaatatttttacataaaacaattactactaacacacttgtaatatggacatgttactatgtagtgaagccacacgtaaacatgatgatggcataattttaattgataattaaacgtctaggtctttcaactagccgatctgggtttgaagtattacccattctaattatttgatattaagtcatttcctaatatttgtcttttaattaccaatcaatcaaacatgaagcagtagcgcagcgttaaacgtgatttgagcaatattgcaaaccaaacaagagtagtgcacgactccaacgcgaggccccgggtccaaatcaaacccgtgccagccgcctccggccccactgccagtctgcaccccaactgggtcgcgcctatctcctcacagatcatccgacggtcctcctctccccaccccaaaacggacggccacgaatccacaacaaccacaaaatcgacccacacccctccatcagcctccacgtgggtcccaccgcattccgtccccacattgtcagtcacccacccgctcgaacccacacgtgagaaagcgattccatccattaactaataatatctttgccccttaaaagaaaacgatacgaaaaaaaacccagagaaacaaaagaggaaaaaaaaagaagcgagaaaaaaaagagatgcttttggcatcatccagcccaccacgcctccacgccgcgctccccccctcctctcaaaagaaacacacgcctctcggatcccgccacgtcatcgatccgcacctcccgatccgagccctcccattggctgcgtatacaacccgcgatccccccacctctcccctgcaccgagtccacggtgcgccccgtgaaccgcctccaatggggaggtaaacacccttgccccgtatatatctctccgtttcaaatcctctcgaaaccaaacaccccggaaaaaaataatttattttttataggagaaaaaaagaggagaaaaaaaagggaagaaagagatggacgaggcgtgggagagggcggtggaggcggcgctgcaggccgccggagaggggagctcgtcgccggcgaggagcctgacgctggacggcgccgtgaagtgcctgcacggacggctgcccgcggcggagattctggagcggtaccagagcctggagcacctgtcgatcgccggcgtcggggtcgcgtcgcttgccgggttccctcggctgcggaacctgacgcgcctgacgctctccgacaaccgcatcgccggcggcctcgaccacctcgtcgccgccgggctggcctcgctccgcgacctcgacctcagcaacaatcgaatccagacgtcggcgacctctcgccgctcgccaacctccgcctcgtctcgctcgacctctacgagtgccccgtcacgcgggtcaaggattacagatccaaggtgttcggcatgatccggactctcaagtacctcgacaagatggacgccgcgagaacgagaggccggagtcggatgacgacgacgacgacggggatggcgacggcgacggcgaggaggaggaggacgacgacgatgacgaggatgaggatcctggcagcggcgaggtggccaacggaggcgtctcccacccgcgcggtggcgtggcgtcgcacccggtggaggtgaacggtgtgatcgatgtggacgaggacgagagcgacgccgacgaggtcgtcccgaacgggggagacgaacaccacgctaatgggtttcgggtcgcggccgttggggacgaggatgaatatgtggaggaggaagacgatgatgatgaggaagactatgaggaggaggatgatttgggggaggagatcgatgaggatggtgatgacgaagacgctgttgttgaggtgcatgatgtaccaagtagcagtgatgaggaggaagacggcatcgaggaagaggatgaggaggaggacgaggatgaagaggaggttgaggatgatggtgaggaggctgagccagagagcagcgggagggtcgctttggcggtgggggacgttggagaagagattgatgggcatgagcacggagagggggaagatgaggatgagaacggtgagattggagaggaagatgaggagagattggaggatgatagggtttatgaggaggggaatgatgacgacgaggaggatgtggatgatgaggtataacacattttgcattaatttctcgcaagcgtatcaagatctttgctattcgttgcaatgtttcgtagtaacggtagcatcggtagtcgtttatattcatgttctagtaaaattgatattaaccattctcagttgcaggttcttttttttttcaggggatttactagttcgtgcgttagttatgtgggtgtttgtttagtctacttattataagtgcaacattttttttgtcatgctgaagtagataacttcaattgttaggtttcctttccacaatcacctttttggtgatgtctttgctattcgttgcaatgtttcgtagtaacggtagcatcggtagtcgtttatattcatgttctagtaaaattgatattaaccattctcagttgcaggttcttttttttttcaggggatttactagttcgtgcgttagttatgtgggtgtttgtttagtctacttattataagtgcaacattttttttgtcatgctgaagtagataacttcaattgttaggtttcctttccacaatcacctttttggtgatgttttacactctgaaatagtgtcagggataatcttctttacctcagttacttagcagcagggataaaatcatttttacctcatttactgagtgtgatacataggagcagttcagagacttatgtgtgcgctctatcattattggctaatgtatccgtgtgatgattttatgagttgtgcattagtactttgtttgatatgctgcagctatgtgcacaatctttttgaaaattccagttagacccaaaaatgacaggaaatgtgagaaattagtgtttcagatatgattagatagatactgtatgacagcagagtttagtttcttcatgtagaagaaagagaaggttttagttatctcttttatgccctattttcggatataacaaaagattttgcatctgaagtttttaaatttggcaattgcttaaaagaaaaaaactgatacatctatgaaacctgggattttatatgttctttttaccttatttgatatccatatctatgtatgcttagtaaatcactagtgtttctactctaatttttattgatatatttctgttttagtagtgccagatgttttgtcatgcatttatttcttttggggctatcttaataatgcattatttcattatatatccctgactgtgtaagtgtgtacagacctgtagttcttctatccatgagaacatgctttagtttttgcctatgttatctggccagtagaagctcttctctcatttgtgaactgtgcaatttattcgctgctaaatatccttgtagatagattttctcctgtcatgcttgttatggcccattgttttgttcattgtgtaacgagaaggccttcctttctgaatttcatcttcttaaatccttcgagaggtggttgatactgcttttttactttcactattgttttagtgtgctattcttgcttataggacatttaatttattgttaagttgatcttttgatgtaaatattgctgatgtttactatggttttgaaaccatacatattttctttcagtggtagagacgcttattgtatttcagcaattgcatggttactttgcctatgtttttcattgctaatttattgctgcatgtatgttaaaactataaatcatggagtaatttgtttgactctttgggcatttcacttagtgagctgtttatgatacacatgacttttatgtttgaggtttttctaaaccctgttccagaatgtccttcctgttaatgactatctctaaaagcagaattgtggaaacacaggtctaatgagaattcatccaattttgcatttcctcaggatgaagacacagaatatcttgttcaaccaattgctcaacctcaggccatggcggttggaaacgactttgatgcagctgaggctgatgatgctgatgaagatagagatgaggttgatgacgatgatgatggtggtacggacctgccctcgtcctcgcagggcgctaagcggaagagagatgatgatccatcaggcagtggagatgacgacgaggacgatgatggtgtcgaggacctgaggcccttcaagcaccactgaccaagcagcaatgtacatggatcccttcctccccctcttctcagctagaaagaaccaagcaagcagcagcaggagcatcagcaaacagaaatggtgggtttccccctgttttttcttagcgtttttcttgtaaagactttggattgagagagagcttcttcatccagccttcctcttcaaacatcagattttaggagggaaaatggagatacctgtgtagcaacttagcaagtagccatggcagctcagtttcagtttcagtttcattgtctccctagcctgcaccatctcttttgattttcttttttccctccagaatttcaaatggtagttacaagccccaggtttccctccaccctttcaaatttctgttacattggcagtgtagccgatgtattgccaactctcaaaactgtagtttccctccaaaggaaaagcccgggaaatgccccccctttcaaatgccccctcaccctcagtagccgttgctccccctccaatttgaatttttatacttttgccctagttggttgaactgtgttgctgtgtgtggtaagagtttctcactggggagtgtggacgacggtgccaccaccccggggggggcttctgtacgcgggcgctgcgtgctttgagataggtgaaacggctgtggttgcagcgatgcggaggcgtccgcggccaaccaacgaaccagccacctctgtgggcgagagggcgggcaactgggctcccggtgctcgcagcagtaagagccatttctttaccaatttttggaccgagcagatgcagcagcacagcccg

SEQ ID NO: 67370 - DNA, 4721 bp, Oryza sativa
gtgcgcgttgtcggtgagcggctcgaggcgaaggggaggagaggagattcggccggatttggatggatgccttcttttcttccttggatgcttctccctcttgaaatgacggtattgccctccccctcctcgtcgttggtgggggcccaccggcttgaattaggcgcacacccccagctggctccccaactttgacacgtctctctgccgcgggatccgaattaaagaatgggcgacgcgcctagagacgacgcatactttgggtgtgggtcccaccacggtgatcgtcgggccccacaagtcagtgatacgatagctctgcttcgagcggtgaatcacgtgcaccgggtccatgtcacgtacggcgactgggaggtggggccccggttggggtggctacgctcgtctgaccatgtggtccgtgtctacagatagctctggcctctggccccgcgcaggcacgctatgcccgtgatgccctgtatggacggcgcggatcgtggagagcggagatcggacggcgggtgtgagagcagtgacgtgggagatcatccgcctagtgtagaggagacggtgccgggtcgtcgtgccgtgttgctcgcgcgtacagcgtggaccgggcccagagggtggacgtggttggtggggccatgggggtggtgtgggtggagaggtggggtccacctgggcccacttgtcagtttcatgggtggaaggggatggatgggaaacgacgcgcgggcgggcggggtggtgttcggctacgcggcgcctccgccgtgtccgacggggccgttgcatctccgcccctcccccgcaaaccgcttcaattttcaccaagtcaagtacaaagcacaaactgggaagtattttcggcagtaaaaatagggtttgttgtgagatacggagtttgtttgtaaattagatgttttggaaaatctaaatactatcccatctcaacccatctcaaaatatagtatttttattataatcttaacatgcatttgtttagatttatagttataaaacttattatattctagaacaaagttatgactccctctgttttagcttataagacttttttactttggtcaaagtcaaactaatctaagtttgactaactatctaggaaaaaaatagtaatatttttctacagaattagttaaatttagagagagtcaaaaagtcttatatttgaaacggatggagtattttctttccaagtcgatttggaacaaataaattagtatttttcccctaagtgaatcattagttcattaacaaaaaaactggccacatatttttagcaaatcccaaaaaagttctctttctattgtttctccagctgtagcgactaatccgaaccgttggttgtgatcggacggcaaagagataatgaaacgaatggctggctctcaggcaatcgtgctgctcgcgcctcgccactgagctccagtttccgagcagatagagcgagttgtggcgggaaaccaatgccatccaactgaatcagtggaaggcaaccaccaccacggccacggcgagccactgcctgccaagaacgaaagctttagacggtcacctcatcggcgtcgccgcccgattttcccatggcgtcccagccactacgcctcgtgaggccgagcccgctcgccggccggcacgcggcggcgtgcaagtgctccgccgccatcccgctcgtcttcgggcggcagcggctgccgctcctcgtcgccttccctcgcggctccggctccggctccggttccggcgcctcctgctccgccgtgcaggagtcgtcgtccgccgccgccgccacgactggtccgcccccaattgcttagctactgtaaatcctttataagattaggaaagaaacgcatcagtgttgattagatcagtcaaatgtttgccatagtagcaccatgccaatgttttgcgttttgccattgaaaagttgcacttattttgttgatcttttggttactatggatttgtggtgtggtgtgcagtcagtgagaagaaggatgcggccgatgccaagaaggaagccaccgcggaggcgaagcccgcagcgaagccggccgcgaagccgaagaagcctccggtgaagccgctgccggagatgatgcaggaggagatcatccccccgctgaaggcagctctggaggctgaggacgacgtgtcccaagtggagctctccttcgaagataatagggtgagtgtgccgactagtgccggagatgataatagggaagtgatcacactgcatattagcatccctaactgtttcataagtactgttgtctgaagcttgttgattttgtgattactgattagtactgaaacgtgtaaattagcaacttggtataagttacagagttacagatggtataaagcaattcagcatagcatagctaattgttcgatgaatgttaaacaagtcaaatttaattacatggaataggtttctcattgctttttttaaatttgattcagcctagttctgaacaatagcattgctgatgatgtaggaatttctgaaggaaattaaaaacatttgcttaggctgtgatagttttgtacaataaggctacagcctacaaggaatgataatgaccaaatatttctgctttttctagataattgataattcataccaacatttctgctatgctgcgttattacatatatatcgacattattaacccttgctttgatgaatgcagttggagggttccttcataaaggatgaagtgccttattacttctgggccttctttccaaatggagacctcacaggtacaagctacctcctgcacctttctcatttcttcatacaaaaattgctgctttcttgctgagaataccgttgggaggcataagcaggacaatacctcaatgcattcacataacctatatatttcataccttttgaatttttaactgtaaactactatcacttgatattccgtgttctgaaggctgctatgtagcgtattatttaggtataaatccgcattctgaagactacaatatagtgcatctaggtgtaaaagaccagttatgcagagtacagagtacttaagtaggattgcagaagcatattttgcaagttgcaacactgcatcatcatcaaagatatgggcgcatagcttattgaatagcttgaaatgtttacaccagtatcattcatctcgacgattaacgcaggaccgaagggcttcgcgctgtcatcgtatagcacagaagtgagcaccatcgagccgttcctgatcgacgagaagagagcaaacgccaagtatgtggtgttctgggtttacaagaggctggctggccaagggatcctccctgtctggaaggaagaggagggtgagggtgagggggagggggagtcttcagcgtagccactcaaaaacacacacacatgggcacaggctgctctgaatatagtacattgtgcaattcctaattgtgaatgttgtaaagatgtaaagttcatctgctaatatatcacagataatcttgatgttcttttttggagcgaagatgatcatgacgtctgaaccttgcatctatctctttggtgccgtgtcaagtatcagtctatcagcagctgaaaaatggtctcttgctgagtctgcagggtagccactgaaaaaacacacacatgggcagtacaggttgctttgaatatagtacattgttcaaagcctaattggacagaattttataaagatgtaaagttcatctgctaatgtatcacagaaaatcttgatgttctttcaggagtggagataatcttgatgtctgaaccttgcaccattctcttctggtgccatgtcaaatatcattccatcaaaagctgtatatatatatatatatatatatatatatatatatatatatatatatatatatatatatatatatatatatattcaacaatagaacttattggatcggagatgtaaaccattccattattaaaaaacagcagctggaaaatggtctcttgctgatgttcagtgccagtgtgctgtgtttggttggggcgatctttctgggctgggccgcaagttcaggttctcttgaaatgcttgtcacaatcatagagtgaatagtacaagatcgagctatggccatgtgtcatctgaaaggtatggtatgtggagtttatcatcccttagtcctagctgtcgccctccgtctcattcagtcctcgccattatctgatgctgagatgaccatatgcatggctcctccacagagaaggacaaaacggaaattgaaatgtagatattatattcgtccttcgcaacctaaggttcataaagtgcaaatatataatatatataaagcaactttggcattttaagagcacttggatggtcttatacggtgcataaccaacctcgacagcctcctatcgcgtttcctataatattttctcccttaatattaacaatattattgtcctttttatgaccatcctagcttatttttaagatcttactcaagtatcttttttctttacaaaacacttcttacatgtagataattttgtgaaattcgtctcatcttcaacatgtgtgtcttttttttcctttacacctactccatccgttccgaaaaaacgaacctagacacggatgtaacattttctagtacaatgaatctagacatgagcctgtccagattcattatattaggaaatg

SEQ ID NO: 67371 - DNA, 3057 bp, Oryza sativa
ccactgcaaccgtgcaacgctgacactcacttttaaatcgcctcaaaactaactgaatcactgaacacccgcacgcaccgcagtttagccatatcgccgccgccgccgccgccatgctcgcctacctcctccacgcccccgccgccgccgccgccgtggtgcccagcccgctctccctccgctcgccgccgaagacgcccttcctcccgacgtcccccatccgcgtgcccacgccgaggcggcgccccgccgcgttctcctccgccgccgccgcggtggtgcccatcgcggcgtcgctgctcgagggccccgtgctggtctgggccgggaggctctgcctctactacgcgctcctccacatcggcctcgccggctccccgcgcaaccccttcctcgcccacggtaatctgcattagccgcggctggtttcgattcgggggaaaaaaggctgggggttcttgatgcgcctcgtgtcgtgttcgtgcagagattggcgatgatggcgccggggacagcgacctagggttctcgaagtgggcggacaagctgcgcggcggcgcgccaggtttcgtgcagtttcaattcaaaaatcgatttatctctccttctcagttaattttatccatgatttattagaacgcgaaaggtgtgtgggattctgtaatcgttaggagaatgtggatcttggataagatattcctctttgggcatctggatagcgagctttctgctagctaggagagagtgcatgcaattgcatctttggatgggtttagatttgggaccaaaaaggtggagatgcttatgatatgatattgtgtgaaaaagcaagttttccgtcgtcgtttatagtggactataatttttagatgtagaaaaagtaaaagttgatgacttggtggatcgataccattatggaatagaaatgtattgaagatttgtttgctacggatatgggaatcagattctcttggatgtttacagactaatcacagaacatagtgcagtgcaggctttaaatgtgtatagaggtttccctagacttagttattgtattatgcaagaaactcatttctcaaactagaacagtttagcatggatgtgtgcccaaaggtgttatcaagcatttctcaaacttatttagtctgacactttgttacctattatttggtggggttaatccaagttttctacttctggtgtgtatcacctttggtttattaacgaagaatccattgtgtcaattctcactatgccaggatcaaccatttttttatcagataacatgcttatgcagttatgctcaccagctgaatttaacatttcaagtgtcaaattctgtaagattgtgtctaggaggaaagaaacataacattacccaagtggtaggcttaagcagttcacaaggggaaccttcatcattttggtaaatagaacgattttggatccaatattgtagatgttatcattgatatcctgatgaggacatcacccatggacatattgttggctaaacattggatggtggttctagatttctgttccattgcttcgttatgtattggactatggttttgatcaaaagtacttccattttcacacacaagatggataaatgatgtgcgtgttcatctcattcaggagaaaacgaagcccaggataagaggaagctagttagcaaatggaaaccaacaactaaaggcacgctgaagaggacttaccgagttcgttcagtagaagaaggtcggcggattcttaaagaaattgctttggttctctccgaagatgaccactttgtggacgcctccagtcacaaggtgatttttttcatgatccactgcaaatacactttctagccattatgtttagtgtttaataatttaacaacaaggtgcttcagaaaaaatactgagatatttgccatgtttcttgctcttattgtaaagttgatgctcttctaactgaatgttgttgcttacaatcagggttgtcaaataaggagggaaagtgcgcacggcgagagtgtgtgctgctataatgtgagagctctgttcgatgagcttcctacccctcacctagttctggagattacagctttccctgctggacctctcactgataatgactaccgcaaggccgagaggctcgaaatggtgctgaggatgagtgcttccatttaatttcagaacacccattttccatttcagcttacttttgcccaagctgtaaattttctaccgatggggctcgaaatggtgctgaggatgagtgcttccatttaatttcagaacacccattttccatttcagcttacttttgcccaagctgtaaattttctaccgatgggcctgtaaattgattcagtcttgctaagaagttaagaactacttgtaaaacctgagttctgctcaatctttctagaattctaatatttgtgctcagtctttctagaactctaatatcaagaagtctttgtcatagaccttacatttttatggcaccgcacttattttttttaactttgcaactaactgttggacagtggctaattcatgtgctatatctgtttctgttatgtcccaaaatataactaattttagcgttcaaattttgttaattccacatataatttctttacctattttcttatctcaacccaccgcaaccatccctcatttaatttacatttctgcttaatccccattaaaaattttagaagtgttttatattttgggaaggagggagacacattaaccagcagaacgtgttctatgactcaaatttgggaccattctaacttgttaggtcgtcacatcgaatgcaaaagctgataggaactaaaaatcagataaaatgcaagctacaatattcacggggaccatcagtttcagggtttcaacttagagttcagtattagatacagcaagtacagatataagcatccacaaacagaaccaacagtcagttgatcattgcagtgcttttagttacaggaaaacttaaaatggagccacacatgtttggtccatttgaggatgaaactacttttttttttcc

SEQ ID NO: 67372 - DNA, 2127 bp, Oryza sativa
gctatagttgagctttggaggcaaagctcctggattccccaacgatgatactgactttgttttgtcctgatctggcatctgatgaccatcatcattgtctgagggggaaaaaaggacaaacgagatgttaggttgggcaccggaatgattaacagagataatcgatgtaaattgagcactagaaggaataacaggaaaactcactaatgaaatgacagactcatcaaaactgtcacttcagaatatgcaaaagattactcgaaggtttggtgagaagcatagtaataacaacaataaaggaaaatttgaaacgtgagcattacatacaaaacagatgacatggttttgagttttgacgcatatgaactattatcatgtggaaacacatgataatactcttcgttccaatatgggtttcatgtggaaactcaaatgaaaagttcacataatccagaaaaaaggttgcctaagaccacagcagctcgtcacaatttacagctaccataaagtcacttgcactatagcatagatgagcttgcaaataatcattgaacgtattggtatcatgaatacattcaacttggcactacatccatagacaaacgattgccaaccaagaagcagcatctacaaatgtgttttaaagagacatgattgaagcgaagaatatgttgcgacaataagatctgaaactatactaagaccggattaccattatgacaatacttttaaatatcatgcattaccagattgtgttgaggtatgtcgctcatttggactgctatcattcatggcagattcttcttggtgtgactgtccagaatcgcttgacggggaatcttgatcatacatcttatgacctaactgcttcatctgataatctccagagaaaaaatcctacacatgcagagtctagctggtaaatgtgttactcatgggagtagcaaagccagcaattcccaggttgcaccatcaataactactacttacatagttgggcgtagtatgggctcgatgatcttccatttgtcgcaaaagcattagcattatgagatggtctcactttggtccaggcaccatttttcttcgtgtacttctataattagccttcaagacaagttgataacattaacttaagcaaattgaactgatagggcttttaacctgacctcttcagattggtggggattttgttgcccatcaaaggattagctctaatcctttctatcaaaagatgcctattaaaggtttctactcattaactggaatatgattatgcatagttactttcaggtgttgaattatctaaaaaaaacgacaatagatgttgtaatactgaatagagacagtaggaaataactgaatcatgagattctgaaccataaaagcaaataaattatgatattaccttaatatcataataaggtaatacttaatagtggtactgttcagtaggaacagagtaggcagagtaggttgttaagtgcttgttgcaagagtaggaaataactgaataaaaaaacaaataaatcaacctaaaaagagtaccactacaaataacacacagcatcctaccctaagtagacagacagaaaattcttatatagaaacaacctgatcaagaggaataagcacaaaatgcacattaggtagcttacatcagcctctttttctttttctcgaataagaggtagcctacatcagtctcaggtttacatttattacatgcagatcataaagagataacctacacaacttttagtggattgttctcgagtccaaattgccaatccatatgcacagaagaagtcccttgtcttaatcagaataacgattgaaaagctaaaccactagtaaatcagaacatatcgcagcaagttcacacattcagaatcttatcagagacacaatcgcttgataccgtcacaaattcacacggaatttagcttcaagttaccaaatcctgcaatggggaagtcaaatttccacccactccacggcctaaaacacaactcacagtgcattcgatatacagtggtcagctaacaacaggggatgcattgacttcctcgaaaggatgcatcttgcgatgtctaactacaactccgaagcaagcctaacaaagaa

SEQ ID NO: 67373 - DNA, 1011 bp, Oryza sativa
gtggcaagcagctttaccactataaagctttttgtcgtaatggtaccacaatatctgtaagtattttgtcatggtcatggtcatgtgtgtatacccaattgcccatattgttttctgagcttcatgtgccatcttctttgcagacccactcttttgtgcttgtcatgtctgaggaggaaagtcgctatcttgcatacttggaagatatgtacgaagataagaaggggcagaagaaggttaaagtgcgatggtttcatcaaaaccaggaatttgcttgcgctatacctcctccccctcctcatccttgcgaagttttcatcactccttattctcaagtaatcagtgtggagtgtgtcgatgatattgcaactgtgttaactcctgagcactatgaaaaatgcgtcaatacattgccaaattcttctatggtgggaatccgtttctgctttcgccaatacagtaaaaataagtttaaacgttttgacctgagatcattgcgtggatattttagtcaagctgttgttttgtccttaaaacttcccccagagcaagaaaaggatgatggttctgatatcataaaaacttttgagcaatggacacctgggaagacaaagtttcctaagcagtttgagaggctttactcaaaatgtttgggaactaaaatctgccgaggcccacaagaagactccatagcatcttatcagaaaccaagcagtaagcaatctcccagaaaacatctctcagtcaagttcatagggccccagaatcagcgtatgccaacctacaatgttggtgacagaatagaggtcttgtctcaggacagtgggattgtaggctgctggttcaggtgtacagttctcaagtcatgtactaatcataacaaattgaaggttcagtatgatgatctccagaatgctgatgatagtgggagattggaggtatgactactggtcttagtttgaaatttaagtggtatatgtatttttgaaaggcaaaatatgccataatatt

SEQ ID NO: 67374 - DNA, 1050 bp, Oryza sativa
catcatcgtgttaatcatgaatttttatgataatcgcgcatcgataattaagttgagatcaaagttttttatttgcataactatgctggttattcatagagcgagatgcacgtttgattaattggttggactacttacgaatcttagcagtttagaaaccacgtctgaataactggttatacacactaaagaaacacctagattatttaaaattaattattatttttttctgacgagcgggcaatagagcacgtagagtatgagaagtgctatacgtactactaacgtatgtctcacctcatcaaactaatcacattgcttagattaattacctctgtgggttcaggttatgatcgtacggactacagagtcgtattgaccagtcgtatgcgtagtcattccggtaaagtactctctccatccatgtaactttacattattcatgtccaatatttaaccgctcgttttatttaaaaaaaatatgattagtatttttattattattagatgataagacatgaatagtactctctccatccacaaaagttacatatattacttttgacaccaagaccaaggaaaaattaaatcatcttggatgttacaaaatcaagtagtaaatgcaagcatgcaaccaataagtatttagatgattccttgagttctaataaaacatttaatttatctcttcattcaagtcttgaatgcataaagactacaaataggaacaacttatttagaaaaactcaaatgtgaaataggtgtaacttttgtggatggaaggagtactttatgtgtgactattttttattgtttgcataaatcttttaaataagaggatggttaaatgttgaagatggatatctatgtctacgtttattttaggacggaggtactgtatatacattattgcatgatcatcgttgggattgccaaagaaagttactactaagtgctagtctttttattttttatattttattttagaacaaagaaacgttctgagaggtcccaaactaaagcaagctcgtttgaattgaatataggatt

SEQ ID NO: 67375 - DNA, 783 bp, Oryza sativa
tttaagggggaggaggagaaagagagagagagagacagagagagagagagagaggcggcggcggtggtggtggggggtttggtttgctagggttttgggcccgatggacctcaactcacatatgggccctgttgggcttttgtctcggccgctggagtgagatgctgctgtgtcagagtgcgctcacaatctttgcttgtagaatgtttaactatgtactccctccgtcccataatataaggaattttgaggtttttgtttacactctttaatcacttgtcttattcaaaaaaaattagaattattatttatttttttgtgacttgttttattatccaaagtactttaagcacaacttttcgttttttatatttgcacaaattttttgaataagacgagtggtcaaagagtgcgagcaaaaactcaaaatcccttatattatgggacggagggagtagtaatgtagcagataggggtgaaaatggagcggattcggatggatagttgtcataccatattctaaattatattttttaagcagatttggagcgggtgcggataatgtacgggtgcggatgagaagcgaattgtttcggatgtcggaaatggtacggataaaaggaacattaatacaataatcaataaatgactcatcgtaataattagatgattaagtgctaaacaacatgaatagatgatgtccataatataaaaatttagctatgcgagtgtgatataagatgataaaagccttagactaaaaaaatctatgttaattgatga

SEQ ID NO: 67376 - DNA, 12192 bp, Oryza sativa
  unsure (1)..(12192): unsure at all n locations
cggagcacatgcgacacggtagttcaactacacacattaaaactaatacaaaatggcccaaaaaaattatataccgtagttgtagccctaccaacatcaacatgaactatccatgccaatccctaaatattcacaatgcatcccacctaccaatttcacccatgccaaaatattacaaaagttgcaaaatcaacgtgaatcgcccctaccaacatagagatggaagtataattcacagcgcatcccgagccacatttgacaaatgacaaaccacggttttaataaagaaaatagtcagcatacatgggcaaatatttggaaaattaggcttttcggaggatgtttaccttggatcaatctccaatgcaatgcccacgaaatccccttcgattttggggtgaatttgaggagatttgtgaaggggaggagagagtgccctaggctcgactatccctagccggagaaaggggtgggaaggaagaaaatagcggtttggcaagcacggccgtgctcagcctaggtgtcctagctcagtgctaacgggcatggtgctgaggttggggactcgccgtcaagacggttggcgatgaagtcctgccacgtcagcaagaggatcaacttcgatgaaatctgggcagcgggtcagcgtcaacggacctacgctgtcacgcccagaaattcactagtaatttccgaactaatttgtgcataaaatcctcgtccaggaatcagccgaggtacacaaattgacaatttaatatacaaattcatcgtaataatgacgttacatacttacaaaagaaaagagaaaacaacggcggaattacggtctagcgaagctccggctccactcccacaggcagctcaactggggtataagccaaacgtcttctcctgtgcgacttttcttcaaaagaggtttgattgattattgcaaggtgagtacatggaatactccgcaagccacacagcaaatatgcaagtgcacaaggataccaaagaatggcataatttagggctcatttgcaaaagcagcatttaacaaatatttgaaaattgtaaaacagtagagtaactaatcatcaatattaatcaacactgaacaacacacccatgctgcacaggcccaactatcctgaataaccatatctggctgtacagatctatctccaaaccaggaatgtaccattccaaactaggagctaaattaattactatcaattaccacattattattaatgagtagtgtgggactaatcacaaaagtcattgttagatcctcctataaccgcgggcacggctattcgaatagttttactctggccagatgtgtaccactgtacccacaagacacaactccacaatatgtcaccatatcatcatgtgcccatactgaacatgtcaccatttgtgtagttgtgacaagacccctcacatagctcaactcaaagcagcgcacctttcctggatcataatcaccccccccccccgtgggcttatctccgccacttctcagtatggcacaccataatgagccttgctatacaaagtgtccagccgttgcccattttggcttgtggttggcacggttaatgtttcacaaccgaagctcgtgaaccggtccttaattgtcatgagcacgaccatcaaaactatgtgctcacaacccaccattatcaagttttagttggcaaattaattaattaaccaatcacgattagccatcatgagctatgattaaatatccatcattaagtaatagtgaaacattagttatcccaattgtgtgctaatgtttctaagcatggctaagcaattatatctaatatatctagttgaaccaatatataaatccaactagtcaaattataacccgaggtaatcaagaaatagagtgatcaatgcaaattggccataacaaaggaacaggttcacaccacccggtgacattcaaaaataaatgcacagttgaaataaatagagaatttaaatataggatcaacatgctcaaaggaattgtgtttgggatatgtgtgacttgccttgcaataaagggtcttcaattaatcttcttgaatacttccggcgcactcgcgaacctttgaaacgacggaaacgacaagctaacacacaaaacgaggaaaaagactaataaaaaccaaataaacagtacacataaagtaaaaaaaaacatgtagatcatgattttagatgaattatgagacttgaacggcctcattccgacttcatatgaattgattaccaattttacaagattaaatctaattaaagcctatttaaaaaggattaaacaaatttaacacaatttatggataattttaatatatagatctttattttataaaacttttgcaacttgaaccacattaaaccgagttacaatgaattagttatgaatttctaaagattaaaccgcattaaagcatttatatgggttttaattgaattatgacgcaataaagaattattttgaaaataaaaagggatttattgcgtcatcaaagacggtccacagtaaaccgggttcacagaagcggcccacggaaccaacggccaagatctaattgacctaaacttgaccgaatcggacggccgagaacgatccggtctaccacgggtctacggctaacatcagcaatgacatcagcgatgatgtcatcgccggcggcggctcggcaaacaatgctcgtcggcaaacgacggtgcaaacggaggacaccaacgcgtagagctcggctcggcgaactcaccagcgatttggacgatgacagacggcgacgatcgacgacggcaaagaggtcgaggcggcggtggtcttcgggtcgtcgatggcggcggcgctccggcagtcttcggcagaaacggaggacaggacgaggacggcggcgacctagcgaacctggcgatggccttcctgagcgacggcggcgactggagcagcggcgacacttggctggactcgcggcggcgacggcggcgcacgggctgacgcggaggcggcgctacaagcgacggcgggctagggcgaaggtggcggcgaaaagaggaggtcccgggggtcctcttataggggctaagaggcggcaatggaggcccatggccggcggcaaggagatggaaggtctagggttagggaatccgaatcaaaatcgaatccgagctttttccaaacaaaattagccgaagtttccaaaagagaaaaggaagaggagatcccgaggatcatttcccttctatcaatttgatcggagatggaaagcggcggctggatttggaaggggcatcggcggctgcgtgacatggctggggcggctggaggttgaagacaaccctgacaggtgggtcccacctgccagcggctgagagagaggcgggaggagaggtgcggcggactgggccggcttgggccgaaaggagggagagagagagacttgggccgactttcggcccaaagccaaaagagatatttaaaacctttttctatttaaattattcatgaaatgatattccgtttattaaaaatacttcctttgctcaaataaatcctagaaaaatctagtaactatagaaacaagagaagtatttaagaaaattttatctatctcacttttatattgagatttattaaattaaaattagatcttctcttttaggcttttaagatcatttctaataatttcttttaaacaacaatttataatttaaggattttttaaataagaaagtcatttaacataattatgattagatcattaatgattaattattaattaactaattgctgaaatattctttgtattactaaacttaggaattgagctttgaaaaatccgagaagattccaaagagtataattaatcctggagaatttaataaaaattaaatccagccatgctttatatttaggaaattttatttcccacatttaaattcacttgtaaattaatgaacatttaatataaattctattaataatttattaaataatttataaatcctaaaacggaaaatcaggctgtgacatacgctgaccgtaggacctcagcgtgaggtagttaacgttgaggtcgcgaatcattttttgttaaagttttctttatatggtttagtttctaaataagtattcgaaaagtaccaatttatcaattttttggtgcaacgtacctcagcctcatagtttggcgacaaaagtgtgtgcctagtgacactgacacacctggggtatgcatacaaggacaattagcatataataaaccactatcaagtcgtagttaaacacgatgacgattcatcatgcatgcacctgtgttattactagtactttactttaaataattagtcgctctcttatctctaatcctctcttccactttaaaataattgtcgctttagtttttgttttgtttgctgctatgcaacctagatggcggcaacagtgctgctatgctgctattttctaacaccctttacagctgcttcgcgccccagcaaacgacacgaattcatcccaaaaactaaactaagattaatttcgagtcaaacgtacgttagctcgatcccaactcgaaatatatattgttgtgctgcgattgcaatcgatcacgttcatgtctcctgttaattgacaaatgcaacatatatcgatccacgttgcaaaagaggcttcgttttaaaacttaaatagcgtttattcgtacatgtcatacgatattaattacgggcttacgtcgtgagatctatgagagcctagctgtacatatatattagctggcgcgggagagatctccaagatcttttgatcgtatcttgcacggttttaaatatgttatcgcaacatatattcgcgatgtcactgatgttcgatttttattttttattttttgtttaaaagaaaacaagagttgcaatctctccagtctctcctatgattagctgatgataatcattacagtacagatctgcttcgagatcgaggttctcccaagatttggctaattaaatcgtgaaagtttgcgctttagacctacctcggataagttatggcaaattttgtgcacgcacgcaatcgtgatccctttctgcctggcacttttgattagtttaatttaccagcgatcgcatggtaataaggctacttttcaaagataattaagctctgttcaacatgtttttgtccacactactccaaataaagtgcgcacattacaaaattaacagtcgacacgtttactggctaaaagatgaaaaccaacgtattggccgggttaatatctagcttctagaactagctagcaatactgaagttagttagtatttttgtgtaaaatgagttggtaaactattttgttcttcatctcgcacaagagcgacacatgttaatatattttaaaaaaaataaaaaagaaaagaatataccacacgtgcggatcaaacttgatactgtataaatgatctttcagaaattaaactgtctcaattgcacgcaatttacgcagaagccagggttgggacaactagggcttaagctctggatttaagctctataactaatcctatcagaatcttgataaatttatatagagattttggagacgaggaaggacatattatacgacctatttggaggagttttcggtagctacagctcctcctgaaaccaaaaggtcctcaaacggtccagctttttatgcaaattgtacgaacgaagttatatttatagaataaaaactgagttagaaaccaaaagtctcaaggttataactggctaggttcccaccagctaaataagacaactcaaccctacacgcgcgtaccttaattaacttgctagagaggaggaaggaggggggatacataagcttaaaatttagggttaattgaatccatgcaactgtaaatatgccaattcggaaaaataccattactatttagcatatcggctacgtgttactgaaaattggagaaattgtaaccgtaccactccatcacatttttcatcaaaaatctccgttagcccccaactgcacgtgggccccacctcccttccatctcttctcttttgatgaggacatcttccactattacctgctggcaaagacgcaaaagtcgggcggcgaccgtgtgagcctctgaataatcccacattgcttagcttgggaggagaaagccaccttaaaagggagagccacccttcccctattggactagtcttttagagagattgggcctttccccgagtgggtgtgcctaagaactgttgggatccaggcaaccttaagttattgggtctcggccaaccccacctgggctggattgttatcatctttccccttcctctctctccaccaccgtagatgcggcaagaggtgtcgtctccatcgtcgtctcaaagagggaggtcaggccgggctactcctgcgttgttgtcgtcgttgagcgcctcgtctcggagccggcaagccacgcggtatcccttaccgtacaaggaaagaggaggtggtggtggtgaaggcatcggcgacgacaagtacccatccttgccaccgtcgccgaggacctccatgatgcccggcagccggaggggtgcgccaccggcgccagcagcaaggaccccctcctcaataaatccattgctagtatgtcgctctaatggctcgcttcgccgtcgtcgctgccatcgtcaccctcctcgccgtcacggctgctgtgcaggccccgggagcggccctcatcccggcgctcaagatggccctgctgcctgctcccccaacgaggtccctggccaccgcccccatgccggtcgccacctcacccaccgccacgtcaccttcccccatggtgcctcctccgactccgcccactgacgccccagatgccaatgctccctccaccctcgccccgtccgtggtcacctccaccgcctctgcaccgaccggtgcccccgtgagctcctccgcgttcaccaccaccgacgctcccatcgtggggatggaggaagagatggggaagaaaaaagagggacaatgtaggaagatagaactgacatgtgggtcccacgtccaggaggctgacaaaaaacgtgatggagtggcacggttcgaattttctaaatttccagtggcacgtagccgatatgctaaatagtagtggtattttttcgaattggtatatttgcagtggcgtagatccaattaactataaaatttatctccaataagtcttatctaatgaggaaatgaaaaaaaatcttcagaattgacatttagggcatgtttagagagcttaaaattttaagcagcagctggttggtagccaatttttaagaatcattagaccaaaagtagaactgttttagggagcttgtgattttgggagaaactgcagcggttaaaaactctcccaaacaggtccttagtatgattttcatgctaacctaccccagtactacaattccgtggggtactacaattccttgtaacgcgctccctccgtttcaggttataaggttataagacgttttgacttgtgtcaaagtcaaactatttcaaatttaactaagtttatcgataaatatgataatatttataatactaaaatagtttcatcaaatcaataattgaatatatttttataataaatttatcttaagttaaaaatattactatatttttctacaaacttggtcaaacttaaagcagtttgacttttaccgaagtcaaaacgtcttataacctgaaattgagggagtagatgtgaatggtacacgggcttctatatatatatatgttacatctatctctctctatatatagtgtaggctaggtatatactccaatatgcgagtaattttacaatctttaaaaaggtaccatgaagtaattttagtgtaaaattttgtatctcatagtttttaggtataaagagatatcaaatttacaatataaaaaattgataagctcatattatcttcttagggaccgtaaaattacttccaatatatatatatatagcacaggaataaaatattgtactagacacaacgctgaacggggctcgtgccgtgccgtacgcacacgctgcggtgtcgcactggtagtgtacccccggcgcgtgaagcgttgacgtgcaccatggccatgcatcttttgacgcccttgatgtttttaaaacatatttgatcgttcgttttattaaaaaatttaaataattatgagttcttattctatcatttgatttattgttaaatatactactactattcaagtttttaaataatatttataaaaatttttaaataagatgaacggtcaaatatgtttaaaaatatcaacggcgttaaatattttgtaacggagggagtataatctagctagcacaagttaaagtgcataatattgttgcatgcaggggcacggccgagctcaatgcaaagtctgaaattaaccccccagcagcagcatggagtactgtatatgatatacgtaggctgcctgctaacgtgttgcccggacagcggggcgacccgtcgctgtccctccctccgatcccctcgcctcgtctcgtgtgctactacacaaaagcaacatacattaattgatacggaatacgtatatccttcctacttatcatttaattcattgttaaatatatttttatatatacttatagttttaaatattttataaaattttttaataagacgaaaggtcaaacatgttaaaaaaagttaacgacgccaaatatttaagtacgaagaaagtttatagcataaaaaactgaaactttttacattttaaaccttttcaaaaacttatttcgcaaaagacaaaaaaaaaacttatcttgaaaaaacttatctgtctacgcaagcctttttcgagcggtacttccgctagcaccgcagccgtacgtgcccacgcagttaattgctgcaagtgcgccactcatcctggcgccgtgtagagagaaggtggcgccagcggtgccggcgccttcccaatgtcacgtcagctggagggggccacgtgatgccatggtggtaggacggtgccagcgactatgatgtctcaaaaatgactatttttgaaataagtttttttaagtctatttacgaaataagttttttaaaagaaccaaattgtgaaaaaaactccgctacgtggtggggctggcttacgcacgtccaaacggccggccggccggccaggtggatcgagttacgtacgctacgtcaccaacgtacgtacgccacaagtggaaacggggtcacggggccggaaggaccgggtgaacactagtgctgccctaattccactgtctaatctaaaacggccaggaaacggaaatttaatgcatggagatcgtgttggattaattgaccacctatgcatatgtgtgtactacccgtttttccggagataaaaaaagcctgcactagtactactataggagtagctcgttaacgggacacgtacgtactcaaaggtaactcaacgagcgatcgacatgatacaaatcaagaaaggttgttatgaatgttttacagcggaaatgtgctgaaacacgcttatttggatgctagtttttctttaccacgtgtctgtccgcagcttaattggctcgttgaaaatacaaatcagttcgttgtagcttttgctatattaaaattcgagtttacccattatccagtaaatatgtactattaaacataaatacagctcaccatttagttatctcaaataaacggtactaggctatctattacaccatttcaacaaaacatcgatattctctctccgctttcttgttcctagctccatgtcaaaacaaattatacctaacaacctaagattatctttggacaataaatctaaacacataggtacgttggttgctacatattgaaacggagatagtaccatattcttataaatgctattgttatactaatatttgtgtcttagctaaaccaaaaaacacgatagcctttagtccaacaagagaaaagtggggactagagggtccaaggaaggagaactaccggtatgaaatggaggacatggttacacatatactccctccgtttcaaaatgtttgacaccgttgactttttcgtacgtgtttgaccattcgtcttattcaaaaaatttaagtaattatttattattttcgtatcatttgattcattgttaaatatactttcatgtacacatatagttttatatatttcacaaatttttttaataagacgaacggtcaaacatgtgcttaaaaagtcaacggtgtcaaacattctgaaacggagggagtatattgtatccaagatggaggtggattgagatcatctgtagtcgtaactatatatggctgcaacgtaaaactatgtatgtatgtttagccgttcattttaatgaccagtggtccatatttacagatactgtaatcaaactaaataattaccataacaatatttgttatagtgttttgtctaatctgtgatgtttgattcacattaaacggtagctgctacgactggataagttgcaatcagtactcagtactacgacttatccgaatccgatcgaggttcctggctagtttgcactaccgcgagagtaggatcatctagtaggtgtcatggggacccggaaggaatagtgttgttgacttgtagagattgaaagcgttggcatgataagatgggaaacactatatatatgtatcatggttgaagaaggttaactggagatagttgaaggagacgtacgtgagaatatacggagagtctgtattttagataaaggaagtttgtatggttcttaattaaacgaacaattacagaaaggtgatacagtaattattataagatcacttccaatttctatgtaactagatgtacagaacatataatatattatcattcataaagaacagacaggattaaaatatcatgtcctgggtacgggagctacaatcatgcaaactatctttcattctcgtacactaccaagccaacatttggactgcaatgaataccctaaaaacaattaatgtctccaatgaaggaccnnnnnnnnnnnnnnnnnnnnnnnnnntggtctaagcaataaaggtcgttagagcataggtttccaccccaaagagcaaattcttcgaactctagccatatcttcaataaggaagcaaaaccactatattgctatgaacaaccagctaagctctgagtggagattaatcaaaactcgatgtctagaaaccggtactcgataagcactacctaatcgggaatttgattagttttatgtgtacccctacaatagttacatgcttctagctacatatattcaatttaattacatattgcaaaagtgagtgtaactaaacttagtattcttgtggtgaatctagctagtacgcgcgtccacctgaattcaaatcctaatcttgatataggtgctcgatttacgggctaatattattttaatggtaggccggtgatgcatccgtcgacagcgagatatccataatgactttgttaatctcaaaatatgtcggtccgatctttcaaaggtggttatatgggtatggtgtacacgtatgtttataaacacgagtatatgttatgagtagttgtgtttgtactgtgttttatcagaaaagaaaattaattaattgcgtactgtgtggacacatacgggcgccagaggggggtagttactgtacctgacggccgtgcgtattgccgtaagcagcaggacgcgtacccaacgcatgcgtgccgcttgtatatcctatcctagttaattagctatagcatatacagacactggccggcctacgcatgaaggccacaggttggccggtgaagcaaatcgatccagcgcgcgcggtcacggcccgggctggtaggacgaaagcgaaagtgccgtacgcccgcgccacgtatatatatacccatgcaacatccattatggcgaatgcatgagtaattaggttaattataacactcataatgagtcttaattagtgcctagtgttacttaagtactacttaaacataactaaggacttgtttggatccttcgggctattaaataactctccggaatcttgctatttaggattattaaacgtagattatcgacaaaaccgattccataacccctaggctat

SEQ ID NO: 67377 - DNA, 3362 bp, Oryza sativa
agcagcgggctacagatctgtagccagctacagcatggactccaagacataatgtgtgtatgaaaggtgggaccagatattaatagtataataagcaactattgtatgaattggctattgatgttttggagctactccctccgtttcacaatgtaagttattctagcattttccatattcatgttgatgctaatgaatctagatataatatctatctagattcattagcatcaatatgaatgtgggaaatgctaaaacgatttacattgtgagacggagaaagtagcagttagctatactattaaacttgctctgaagagaatagaaggagctaggcaggcacggtggatgaaatgcaattaatgcgccagcatatatcacatgtaatccgtggaacgtgtgttcacgatacaaatatttgcattggtcccggtcggaaacgaagcaaattgagtaaattttacaaaactacaggtattttgaccaagttatcacaaaactacagatttaaggagttgtatcacaaaactacacatttagcaccaaatttatcacaaaactgcggattttaggttaagtatcacaaaaatgcatatttaatattgaacttatcacaaaactacaacttttggagtttaaatccctagcaccattgttatggtggagctataaacattattactttgtgattaaattggttctaaacctatagttttatgataatttagttactaaatatgtagttttgtgacacttcatcttaaatatatagttttgtgataaatttggtattaaatatgtagttttgtgatacaccaagttaaatctgtagttttatgatagtttggtcatagtatccgtatttttgtgaaatttactcaagcaaatttaaacgtacaggtccagattacgtacgccgccagccaatccatcgagacgacacggtggcatgcagctcggcgcgcgttttgttgcgcgcgcgcacgtccgcgtgtgcactaaccatacgaccacctgttttgcccgaaagaagatcgagttatcaatgattgcccaaaagggaaacccgtgtgcttcatctttttcttttttggggctctcgaattatttctagaacagtataacctacctaaattggtcaaagaccaacaccggcgtgcaacagttctcgatcagacgtctctcctgcttttctcaaccctttaggagaccatgcatggctaatccatatctgctgctgccaagatcgatcatatatatcttcttatttgggttaacttgctaattaaatatccgtacttttgctacagataaaataaaaatatattaatgtcttatatacccatttttttatagggaatatttatcttagtttaattttgtatacggatatccatttagattttttaaaaaatattaagagctcaaggagtaacgtaaaatttataatgggaatagatgccaccatgcgcaacactaccagagagtggaagactaccgtgtacctcagttggttaccgagagtgttatatggaacacggtaacatttaaagtatatcgtgtgtgaacaaggaaaaactcgggaagtggctaaaaatgccgtgtgacgaatcgagaaacacggtaaagcgtgggacccacggtttctgccgttacgcgtgcggaataattggtctggcgcgcgggatcgccgttggcgcaggcggatggcgcgccaagatttccgttggcgcggccggctggcgcgcctgattttcgttgccgcgcgagtaacaggagaatcccgcgcgagttacagccgaaggcccacatgtcagcccaaaatagagaccaacaaaaccctagcccttttaatcgatcccctcacttccccaccccctgccgcctcattctcctcgccacttttcccctttctgatttttcccctctcttcttcgcacatggcaggatagctgtgcaccccagcgtcagtccgccgcacggccgccgagcaacgctgtgcattcttggccgtacgaactccctgcatgtccacgtccatctgctaggctccccttcgttgtccagcttgagcacacctcatcttccatccagctggtggtatgtatatgttgagttttttcttgaatcgtatgtaaagttgggtcttggttctagaaaacccatccattttctcccaggatctagaaatagttcggtgtatgatttctaggaactgtatctcattttaatttcttgtaataccacaagtaccatatgaataagttgttgtgctttgtaaataaaaacaatattagactacaaaatgatgtgggtgagagtccttgcacagtcagaataatgtgttttcatatttgtgtacttgttgatggatacatattggttaggaaaaacttgccctcttttcagaagacataatggtgagtgtgagtgtttgccacagccctacttgtttagatcgttgttgaatggttgaatcgggttggaatgacagcaccatgttgtgtgatgatctgcaatgctatggtgtactacatctttgtatcgacattttataataggcattattataccatgttgctactatgtagtttttgacctgtttaatataatactgcatatcttaattttgtagcaatatgcggcgattgagcttgggctgcagggaggattccaatccttcagatcaggctgtgagcgctgctaccttgccgagatgtagaacaaggtcctcaggttcccaacaacttgataattcttctgatttggatgagatattggctgacgaagaaacagacgaggaaatgttttttcgtggtcccacacggatgccaccgcgacctacccgagatgaggacaaacctgtgctgactccaaaaggagataggtaaatagggtaattttggtatgtttcattagtcgaaatatgaaggcttgatctgtttgttcattgatttgcacatgcaatggcaagctgacggagctcgtggctcctcaccgggagaccgcgcaggcccccctttgccagttcggccgggggcttagggtgaaatctcaagctctctcggtatgtggaaagatcgcgagctaggaagaaacgcgagacacgggcgatgtatacaggttcgggccgctgagaagcgtaataccctactcctgtgttttggtggatctgtgtatgagggagctacaaagtgtgagccaacctctcacttgttctaagttccgaatctggaaaagatcatccccctttccctatgggcaaggtcctccttttatacttcaaggggataccacatgcaccccttctctttccaaactggacttttcttctcttcataaatggacagatatttgcacgg

SEQ ID NO: 67378 - DNA, 4478 bp, Oryza sativa
attcccccccggagttcaccacgccccggggcacggatcggttctgggccccttttggcgattttagccgacccgagcccccgagagtaggattgagcacgggtgacctatttcaagtcaagattcttcaaaaggaaacaaaagcatagacacagcctttaggaaatcgaaaatgcttttattgaaatacggaagagaaaaaaaaagaaaagcccccggccaaccctgcacgcccgaggggggtgcggggttggcccgagccaaaacctgacactcgacccccccctcaggggtagaagcgacgaaggtgttcgatattccacgggttaggcagctccgtgccgtcgcccgtggccagccgaacggagcccggccgggggacgccgatcactcgatacggatcctcccacattggtgagagcttgctcaatccagcacgcgtttggacgcggcgtaggacgaggtcgtcgacgtagagtgatcgggcccggacgtggcgctgatggtagcgccgcaggctctgctggtagcgcgcggctcgaagggccgcgcgccgccttcgctcttccaagtagccgaggtcagggggcgtcggcttccttctttttgtcgctcgcaggcctcccctttcgggtggcccgcggagcgccctcgacggcgaggacatgaccctcgtcgtcggtatgggctgacctcttcttcctcctcctgtcacgccgccctgtctgagcggcggatccgggggcggccgaagctgccactccggaaccggaggagttccaggtccaggcctcctccttgcgagccactcggtccgcgagctgaaaaagctctgcggtagtctggggctctttggaggcgatcttttcgagcatgcggttgtgccgcacaccccccctgaacgcgtagatcaccgcgtgtgcagggatgcatggtatggtattgcggacttggcaaaaccgctgaatgtacgagcgaagtgactcatcatcccctcgctgtaccgcgtgcaagtccgcttcttcgcctgggcgcggataagtgccttgaaagttcatagtgaactgtggcataaatcctcccaagagtggaccgacgcaggtggcaggttcactagccaaccccgcgcctgtcccttcagggccatgggaaagaaattcgccatgaccctgtcatcacccccagcggcctcaatcccagtcgtatagacctggagaaactcggtggggttgacgctcccgtcatacttctcagtgatggtgggccggaaccttgggggccaacggacattccgaagactcgccacaaaggctctacagctgacaccaccagccgggggcacggagggctggtcctcacgtccatgtcgaggtgacactctggacgaagaggcgccctccgttgcgcggggagtacgccggctattacgccggcgctcgatgtcgaggcgagcatccggctctccatgctgatcctcccgagtcggaggtgccgacgagggagtggcagccgaatggcgtgcaacagccgccgctcgccgcgccctccgccttgacgacacggagccggtagtggcggcgccggaggtcttggtggtggcggaccgtccaccagcacccaggcgctgctgtgccgtcatgaccaagttggccacgtcgtctagccatcgctgggctggagactccgggtcagggacgacgggcgggtgacgtaggagcgcgccaacagcctgaagcgcgccctgaggcgtgctgccgtcgccgtagacgaggaggcgacgctccccatctcgccgttctcctgcatcacccgcgactggcgatgctgcggatttttcgaccctctcgagcgcctccccctgcttaggattttggtgtggaggaggtgggggagtacgagctcgacggcgtgggtttggctccccgtcgtcgccgctcacactcggagagaggtcgtgcacctttgcttgctcggccattaggctgaacaagaaaaacttggcgcacacggaggagtacgagagctcagaaaacacacgctgagccccctacctggcgcgccagatgacggagctcgtggctcctcaccgggagaccgcgcaggcccccctttgccagttcggccgggggcttagggtgaaatctcaagctctctcggtatgtggaaagatcgcgagctaggaagaaacgcgagacacgggcgatgtatacaggttcgggccgctgagaagcgtaataccctactcctgtgttttggtggatctgtgtatgagggagctacaaagtgtgagccaacctctcacttgttctaagttccgaatctggaaaagatcatccccctttccctatgggcaaggtcctccttttatacttcaaggggataccacatgcacccctctctttccaaactggacttttcttctcttcataaatggacggagatttgcacggttgtcctccgaacatccttctgacgggacggcacacacctacctccacttctgccgaaggcaggcgcgtcgtgggaacgtggctgtctgccgacgacatgaccagtgtcagaccggtcattcttgtcctccacgcgtcagttcaacaatctgcatgttcgcccttcttcatacaacatataggctgtaatggttgggatggagcctggtataaatctaaccagggctaacgtgccatctctaagagattacacgctagctctggcttgagacgagtgcctagaggctttcgtcttgacgggatggggcaaggcgtgcgtcagaccgccagtcgccacctaacccgtgatctgaccggtctgtgaccggtcacagaccggataaaggaacgcgctgcactgcgctgcatgcagcgtgacacgcttgaccagacttacaataaatgcggttaggtgagcactgccgtgttcacctatcccatatatgtggcgcaaacttcctcgaggggtcggggtgcctcggccctcggggccggggcaggagtaacccgaccccccctcgggggaaatcaggaggagggcggacacctcaccctcgggcccgacgtccccgaaggtgccaggccgcatgggcgattgtgtctgcctcaagcctctggtcacgatactcccggtcccatatcaccgacagtagcccccggcgttatgccagggcgatcgcccttctcaagggaagcggtcgggcgtgacgccactcctaaggcctggtgacaggtggggccggtctctacagttgccgtcgaactacatcacccagtgggcggtgtgaggcagctgcgatgggcccaagctggcctcgggggttgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaatcacagtgacccgatgcgcctggaaataatggcgcagtttcctcgaggccatcagaatagcgtaaagcatcctctgggcctgagggtatcgggtcttggcgtcccggagggcctcactaacaaagtagacaggccgctgcacctttcggcggggccgatcctcttcgccaggggccgcatccccggggcgttcttcgtccaagtggcctctcggggcgcactcgtcttctgtgccgatgacctcggggtcggaggatggcaggagcggccttcccacagtggcctcggggccgtcctgggggtcgggggctcctggcgtcgtcggacaagcgggcaaagggccaactccggtcgtcaggggccttaggccaccgttcggctcgggggcctcttctccctgctctctcccggacagaatcccagcggtcgcacattacgcgcatcggcaagagaaaaccaaccgaaaataatgagcggccgctgggctcgtgtttgccttcaactccgacgaggaatgcggtgacgatggtacggacgaccgcgacggctaggccggctacccgggcgcgtcagagtgagcccccaggcccccttcttgtatagactgatttaatctgcaatcaaaagaggaaatttctatgtcaaatctatttgttgtgtgtatgagacgaggatggtctgtgccgcggtccttctgtgtcttagcttgaagtagggctcgtgcccaggtcccagcctcagatggcgcgggtcgaggctagtgcctggggagatccacatgtcgagactggccaggccgggagcgtggtgaccgagggttatgggtgacccgattgtgggtttttgccgattcccccccggagttcaccacgccccggggcacggctcggttctgggccccttttggcgattttagccgacccgagcccccgagagtaggattgagcacgggtgacctatttcaagtcaagattcttcaaaaggaaacaa

SEQ ID NO: 67379 - DNA, 9426 bp, Oryza sativa
  unsure (1)..(9426): unsure at all n locations
gaccccccctcgggggaaatcaggaggagggcggacacctcaccctcgggcccgacgtccccgaaggtgccaggccgcatgggcgattgtgtctgcctcaagcctctggtcacgatactcccggtcccatatcaccgacacaagctaatgattttgggggcaacattcgggtccccactggcatcctgaccgtgcttattaagcattttttccctggcattgtcaagtttaaaggaagagatgagccagcatggagttggaaacattacaggattgcaccagacgatccagaaagcgctgtactgaatcgcttgccaagccgtctccatcgtgttgaggaagatttctgggtttgttttagagcattaccttctccaatatgaagtacactatgcattttattgtgtcttcagttttcatagtttacggccaatttgtactgtacaatagtaaagtatcttaataccacacttttcaatgtcaagcaggctaactttttgtagttgcagctttactttaggtgggcagagggaatggaacaagctgctagaaaggttgtccgcaattgtatcaagcgccttttttcggacctgatttatgaaactcgtatcatggccgtgctcaattaccaaaggaagatcttaaaggtagaaacttctcgggatattgcttgcaggacatatctaatagaggaagagtacctacaggtgctatggttgttcattgataatttgttgtcatctactgatcatattagtaattaataaatctgtgcttctcctataggtagaaccatggtggttcctaaaggcaaaaaatgcgtggcgggagttgatacgattgaagtggtgtaatcctgaatggtaggctagctcacatgctcatangatacggagggagaaaatgacatggccatctcaccgccaaggcagtgctaacttgagtcgtttccaaaaaaatttggtatgtgcatctatgttgaaacatgtagcagatcatgcacagcagatcatggtataatatatatggtacccatgttctgttttaggagaagagaaaaggcaggtagtgtctcaaatggaggcctacacagaaggaaggggggaatatggagaggatggacgattcagatgtaacacacatgtaactgggaagcttgtaattgctgaatatttagtggtagtttatcatttgtgcatgagtactaatacactatttgatctgactgtaggaggcctataatgaagcttatgttcagctgcatggagcaggaagtgattggcgcaattctcccattgatccaatggctgtgcacatggctggtggtggaaagaaacatggtcgattcatgatcggtgatgggctcattgactcatcagcaatctttggtgacagttcacttgatgatccacgtcctcgcagaagactgcgaacaaatcttgacaacacaaaccaaattgaagaccttgagcggcaactacaagaggagcgcgaggcaagggaacgagagcgtgaagaaagggagcgtgagaaggagagggagcggcaggagcgggagcaggagaaagagcgtgagtgtgaagagagggcacgggagaaggagcaggatagaaaggagagggagctggagcgcaaggaaagggagttggaaaagatagcgtttgaacagaaatcatcgttctttgaagttgctttaagagtaagtggttatgggatccatctagtagtgttttcattatttgagggcttgaattctgtgatggtcgcactaactagtgtacatgtgaaatggattgcaggctatacaacttaagctgaacattgacttaccttcagcctcaggtcctcctcccttgcctgtcatgttgactaacccagtaagtatttgatacatggtagtgtaggtgtgcatgaagtaattgttccccatataacttatgaggactaatattaaccattttgtttgtaacataaaacaggctttgtccgtatcttcggctctgaatggaaactcattttgtgctgaccatggaggggctgctattgtttctggtgcaattttgatggttcagcttgacgcagcgagcgcaatctgaagataattatgactttgctactgctggaaagaatggactagttctacatgcctggaacatgtggatgtgttttgtaattaaactgacctagatggtcatggccatgaacctgagtagctgttggttgtggctgttgcctttagtcttttgttcttagttatatacgtttactttcctaaggggttgcatgaacctgagtccatattcggactctagtagctatttcggtgtgcatgttgccttaggtacttttggtcatagatgttactgtgctctggagtttgtgaactggaagtttggtacttttggttggaaatgttggcattcagtggaacttatcaacttggaacttatgtggtgtggcagtggccactgtccagatataactcacgcgttcagcaaaactgatgactgatattatttcatattttggagtgaatgtctggcaacttatggaagggtcgcacaaattagtaacaaactaattgtgtttgttcattgtcaaccaaattatcactcaacgatgtttatatattatgaatgctttcaaattaatgccatatgaaaattttttaaataggagtcccaatctcaacagcatgacaacaagctgatatcttttttagttgaaagttagaaatgttcattgtttaaaaacattttaagacataaagctgaacatttcctaagaaaaacaggtttgaatatttggatagcttttagaaaaattaaagataaacgaaagttttctcttgaaatgtacgcaaataaattctgagatagacctctgaacaacacttttaatcaaaattataaatttgaataaatttgattaaattaattgaagaaataaattcttattatatacaacaaaccaaagtttaattcttaacgaagttaaaaaggaaatagtttttgtttagcaaaggcacttaatgcaaggatcaatcaaaatttagttcaaaagttctacaaatcataacagaatcaaaggaattgttaactaattttaataacacgcactccctccgattcatattatatctcgctttgactattttgtagtcaattttttaggtgttgaataagtttgtagaaaaatttagctacatctacaaaaacaaatttgtttgataatatgttggttttatgtaaaaaaatgttgctatgttttttataatcttattcaaaacttaactactttttttaatcacctcatatttttctcattgtcacacgggtcgtcctgcgtgacgcggtccttacggtgcgccgggtggtgaaggcgaggacgggacgggcgtcagacaggtggacgaggtgccgcggcgagggagatgggttgcgcggcgagggcagagcttgcgtccacggcgtccacggcgaggaaccggatggtgttcaccgactgctccaccgccgccggctgctgcgcgtggagggcagtcggccgtcggcggccgacggcaaggcatttttgacatgaaacaatggcgacgttcgcattcccgactacgtccgttcctcttcttcttccttggttaaggccaagtaggcagaggacgagcgggcacgcggcatcaatctttagaatatgagtggaagcgaaaatcatggaatttagatgaaagcatgttcattttgctagtttaaaaaaattgaccaacaaaaagtcaagacgagtaatataaaacatagtgagtattttttttagctatttcacattgtattgggaccaaacgaaatttagtacaaaatttcagtttgcaatccacatgtaaatagttcagttcgaaatttagttcaaaattttggtttatcaaaggcaaatatatttagtttagaattccacaccaaatacagatttgtagagaaaaaaggacgaacagggtagtttgcattcctaatcttatcgtgtgttttggttagaaaacaatacagtaacgctcgtggtccacatgtcagaaatacatcgcggcaaaattctcgcaagcgcgcggcaaggtcgccaaaaatctggtgggtgtggctaggtcaccaaaatccccaatctctctatccacctctcatcccaatcaacccaccacatcgcgccgccgtccaaggccgccgccgccgcgccgcgtcccatccaaggccgccgccgccgcgccacgtcccgtcaaggcgaaaccgccgtgccgcagccagtccaggccgccgccaccgcgcaccctatccaagcccacgacgtcgccccgcgcccatccatttgctgtcggtcgagtacgagaccccagcccgcatgcgcaccaccgtgccggcgccaccagtcgccacgcacggcagaggattggctgctcttccagcaaccctccctaggactgattcgtctcaggtgctgttgtcttgctcccggaatcctcattcggccttcaagtttcatcatctttttgattagtgaccagttctagaatttactagtcaggttgcggttgtactaagggattgcagaactaggttgttatgccatgtgaaagtttgtgtgattgatgatctgaactaatgtttgatattttatttctcagtcatacaaactaaactaggcctttcttattcttgaacctttcatgaatagaaggacatttcctaacataaatttattctgtcactttgtcataactaagtacaatggaaactgatcgcagttggatgtacaagggccgttgaaagcgtggcgaggttaccgctgagtggatatcaaagactacataatttcttgacaaggcattcagcagggagacaggacgtgctggtgtgttgtgtccatgtaactactgcaacaacacacgtcctcaaacaagagatatgatgatgaaacacctttgcaaatttggtttcaggccagcatatactgtgtgggtgtatcatggtgagacatatcctgcacgtgaaagcgatatatgccaaagcactgaagatgaagatagggtggcagagattgatcggatggatgagatgatagatgatgtccatgatgattatgtctcagttgaggaggaagatccagagcctacagcgcaagctttttttcaaatgctgtctgcagcaactcaacctctccacgaacacacacaggtatcacaacttgatgctatcacacgactactagctgtcaagtctcaatatgctatatcaattgctggatttgatgcacttttaaatgtgatatgtgctctcctcccacaagggcacaaactaccagcaaacttgtatgaggcaaagaaagttcttagtgcattgaacatgccatatgagaagatagatgcatgccctaaaaattgcatgctctttaggaaagagaatacgcagaagacacactgtgataattgtggagagagtaggtatgtggaggttgaagacagtaatggtcacaagaaacaattaactgttgccaagaaggtacttcgttatcttccattcatcccaagaattcagcggctgtacatgtctgaatcgcaggccaagcaaatgacatggcacaagaatggtcatcggtaccatactgacaagattgtacacccagctgatggtgaagcctggaagaaatttgatagggacttcacaggcttttcaatggaagcccgcaatgttagaatagcaatagcaacagacgggttctgtccatttggtatgggttcttcttcgtacacttgctggcctatgtttgtcattcctttaaaccttccacctggtgtttgcatgcgccagcacatcatgttccttaccttgataattcctgggccaaattatcctagcaaacacattagtgtattcatggaatccttagttgatgaacttatacatgcttggcagcaaggtgtgttgacatatgatcgtgccaccaagacgaatttcatcatgcgagtctcatttctttattctatccatgaccttccagcatatggtatattttccggttggtgtgtgcatggaaagatgccatgcccaacatgtatggaggcactccaaggaaaaaggttgaagtttggtggaaagtactcattctttgattgtcatcgccagttcctcccaattgatcatagctttagaagtgattcaaattcttttctatcaaacactacagttagcaatgaaccacctcttcgtctctcaggtcaagagatccgtgcccggttagataaccttgtccctgctgctaatggagataagtttgtaggctatggcaaggatcaccattggacacatatatttagtttgtagagactcccgtactttcacaaactagtacttcctcataacatcgatgtcatgcacaatgaaaagaatgtcgctgaggcaattttcaatacttgctttgacattccagaccaaacgaaggacaatgtcaaggctcgccttgatcaagcagcactttgtaacagacctgaattgaacctcggccacatgcatgcgtgtagtgagtgggttaagccgagagctgactctcgcttgaatagagctcataagaaggaattatttcaatggcatcacatattgacattccctgctggctatggattgaacctagagagacgtgtgaattcgtacaccatgcggatcaatgggttaaaaggccatgattaccacattatgatggaacgtttctttccagtgctgttccgtggatacttgccaactcatgtgtgggaagtgttggcagaggtaagcttcttttatcgcaaactttgcgcaaaacagtttgatcctatatagatggcaaacatgcagtctcaagtaattgttttggtttgcaaattagaaaagatctttccacttggattttttaatccaatgcaacacttaatgatccacttaccatatgaagctagcatgggtggacctgtgcaatttagatggaattaccccattgaaagaggccaaaagtatcttaagagcaaggttagaaaccgagcacgtgttgaagcatccatagcagaggcttacatactagatgaaatctcaaacttcacatccatatactttgctaatcaagtgcagacaattcacaatcctgttcctcgatacaatgttgctactcagtctattgattgttccctaaatctattctttattaggggggattctactagccgtggagtccctcgacacctaactcgtgaagagtggaatgctgccatgttgtatgtgcttacaaaccttactgaagtggatgactacattgggtatgaactatgaaattgatatgagttacttctagttcatagctgcatataattttactttaaatcattgtgtgcatttttatcttgcaggaaattcatagatgaggaatggactagacgaggtatcccaacaaggcaacaacaagagaatatcttacggaatggtgctgggagagatcgtcctaatttcgtatcttggttctatcaacaagtaatttctttagcccagactttacttatattatacacttagctatgcatatcctttcagatcagattaggaaatctatctagcttagttcgatgtaatatcttgcatgtgtatacatactttcctaactgttgaacattaagttctttcatgaatgttcctgcaacctaggtaatccccatcaaaccaataaagtattactgctaaaactctaaatttggtgacttcttatatcagtgctataaatttggtcctacaacagtaaagcacatttggattagtgcaagttcctagtatgcatctgcctttttcatagtacaatccgagttaatttttttacaagcattatgaaaatagtactgaacatgtatgtacatgtcattaatatggagacacttctcaattgatcatctgttaggtcggaaatctggaaagaataaaatcattgccaatttctactaacaaaaagaacctagccaattaataacttgataacttcagttttgaaattcgatacctcaataatcaatagtgccttcttccattttctttttgttttcattagtttgcagtttaacacctgttaattgcatttgtgtcaataacctaataatacttgtgtttttctataacataaccttcaatattgccataatagaacattatgccacaatttattgacacattatttcctttcatttcactgctagagtatgtttagacgaaactatgagtgatgatttgagacaagtaactaaaggatgccacactcgagtcttgcaatataatatgtatgatgtgaatgggtatcgattccgaacacacaaatatgaacatgagaggccaaatgcaactacaataaatagtggtttggtgactataggatagggagaaaatagtgacacaactgagtattatggtacatcaaagaaatagtagaaatcagctttgatggcagaaaacctctcacacttgtgctcttcaattgccattggtttgacccaagcaaagtgaggatacaccaagatatggtctggttgaggttgctcatgcgtcaatccttccaaaattcgaaccatttgttttgtctcatcaagcgacacaggtgtattacatgccgacccatgtaaatttgtgcaagacctcactaattggtgggttgtgtataaggtgcagccaattggtagactacaagtacccaatgatcaagattacaattctgttcctaatagcaatgttgtccactatttccaagaagatggtctgtttggcagttttgtaatcgatcttggtcaagaactcaacaatgatcctgagcaagttgccatcagcagggatactgaagatatttgcaatgacaaggacttgaagcttctcaatggatcatctattcaagatgaagatgatgatgacgaggatgatgaatcttattgcacttcctcatctgctgaagatgatgaagttcccactagtagggatatcttatttgacgaatatttctaaggtacattattcttttttttatggagactataatgccaattttttatatcctgtgcctccccaaatgaatatttcctttgtcaactatgcacaagaattaatctttcataaactggttgcgtgctgtaataatatttggcagtcatcttactttcgtaaaatttcaggcatacaattggatcattgcaaaggattgcagttgattggtgctgtcaatacacaaatttggagttggttactcactagcctctaacatttctctattgcctccctaggagaggttgcaagaactgagactcaccttgttactattgcattatagccacttcagacaaccattgatattgggtttttgtatcattggattcaaaaattaatactgggataatat

SEQ ID NO: 67380 - DNA, 9506 bp, Oryza sativa
attcctgcagccctccgttccgtgcatgacgtgccgttaactggaaagttaccggcagggtgttttcacacggtaagctttcagcacatcctgagttcgcaagcagtttctcacgggtagagtgacacggtaaaggtgaaaggctgccgagtacaccttcccgagagtttgctcacaagaacgacgttaccgtgagttttagccctgttaccgagttgtttaggcacacggtagacttccgttccctggtagtgcaactaccttcttttaaatagatatataaaactctcgaataactcaatgcccatgtaatcgatcatgtatacgttgcttttttttgtggaaagaagatagtaccttatttagggagaagcgaattataccaactctaacgtcccaaattaatttatcttcttaaatatttcgcagataatttcagtgttaaatgaaaaatggctgcttccattgtgagaatcattaaagtgagtcgtatgctgtatgcatgggatgagccaaaatccctttcatgtgtccagccgactatgaatattatagagacccttcaattcaaattgcatgcctccttggtaacaagccgcaccacatgcatcgatatatcgtttttgcgtagttggccggggtgggaattgtagcatgccgactttttggggcattaatacaagatatatctagcttagttttaacaaaaaaaaacaatagcaaaattatcctagaaagtaatgtgcaaacaataatattcaagggacaatgagctgttgttgactttgttagggatcgatcattctggcgagtatattccagggatagttaattttgtcaaaaagattccatttaaatcttatgagaaattttacggactaaaaatattggtgcctcaaggtatacagtatctggataattttactttataaaatatcatatgttatttcacaacgttatcaaaatctttgtgatggtagccatgaaaataaacaagttaaattggatagagtgtttatttaccagcctcaggttcatgcgcaattttagtttacgtgcttttgcttatacgaacgttgcacccaccgtagtagttctgttcggcacgaccgagtttgcgaaaaatgctggaatgtacaattcaaccgtggtgttgttttgtggagttcctttttttttctaatcaatagtgcaatttttgttttaaaagaaatcagcactttatttaatactttctccgtcataaaatataaaggattttgattttgggttttggttttggtttacgctagtcttgtgtaactagttgctggaaaaatgctgatagccggtgcaacattttcgcaagggaaactggaaactttttgagttacggctgacacataagagtagtggagtgtcgttgactaactcgatggtcaccaagcagatggcatatgtcggagcaaggtctagcaaatctatccatagttgaagaacttcaccatctccttcgatctgcaaaaaaaggagaaaggaaagacatacaaggctacaacggaattcactcgactatgagacaaacccgtccagcctccagaccgcccttcccttgtctgtgaccaacggccatcgcagacaaagaggagatgggatttggcaagggaaaaaagaacacttggagttatctttcatagaagcactcacaaagagatagaaagaaagttgtcatgaatatagctaattaagaccggttaattttgggctacaatgactatacgatacgatagtggataagttgaagatctaaattgatattcatgtactccctctgttttaaattaaaaaacctaaagttttatctcagatatctaaattagtagtactagattaagttcaatccgaacatatattaatttattttagaatgaaaagattatagaaggacaatattgtaaagtaagatatttatactgtccttccatacttgtgacgtgagaaggaaccaaatttatactctgcaatccccaatactgagactgagcacacacccacacctgccacgtgtccctggttgggtgatcgaacactagcccaaactgccagaaatacacaaagtttctccccaaaaatagctgaaaagaaaaatcctggggccacatgtcgcggcgtcgcgcctcccacggcatcctcccgcgcactctacgtctctactggtgttcctatatataccgccacgtctcgtcttcccccgcctccaattccaacctagcaagcgatgcgacctgccttctcctccctttcggcctcgccttccttccttgcgactcaggtcattcttccgaacaccatccccgccttgaaaagctctcgaccaggatcgatcgatcgccatgggcagcggccacaggaagctcatccacttgctccgcgccgagcaggcggcggcggcggcctcggcggcgtcggcgtcgttctcgcccaagtctttctcgtcgtcctccgcctccgacgacgacgggtgtagctcgtcgtcgtggcagacgaacgacggcgccggtgggtacgggtccgcggcctcgtcgccgtcgcggtgcagcgcgtcgacgccgcccaagtcgccgtgggcggcgcacctgccggggcttggcggcggcggggtggggacgggcgccggcgccaccgggctcgtcgcgtcgctggtgaaggaggacgggcacgtgtactcgctggcggcggcgggggacgtgctctacaccggcacggactccgagaacgtgcgggtgtggcgcgaccgccgcgagctcgccgggtttaggaccgggagcgggctggtcaaggccatcgtcgtcgccgacgacgggcgcatcttcacggggcaccaggacggcaaggtccgggtgtggcgcgccgacgcgggggaccccgccgtgcaccgccgcgtcggctcgctcccgaggctcgccgactacgtccggagctccgtcaacccgtccagctacgtcgagacgccgcggcgccgccgcgggcggcgccgggaggtgtggctccggcactccgacgccgtgtcgtgcctcagcctcgacgagggcgccgggctgctctactccgcctcctgggacgggtccttcaaggtgtggcgcgtatcggactcgaggtgcctcgagtcggtgtgcgcccacgacgacgccatcaacaccgtcgccgccgccgggttcgacggcgtcgtgttcaccggctccgccgacggcaccgtcaaggtgtggcggcgggaggaggagccggcggcgagtggcggcgaggcgaagacgaggcacgtcctggagacggtgctgcgggaggacgagagcgcagtcaccgccatcgccgtctcggccgagggccgcgtcgtgtacgtcggttcgtcggacggggacgtgacctactggcactggatcgacggcgaggcgaggtacggcggcgcgctcagggcgcacgggacggcggtgatgtgcctcgccgtcgccgggaacgtcgtcgtgagcggctcggccgaccggacgctctgcgcgtggcggcgcggcggcggcgagcactcccggctcgccgtgctcgccggccacaccggccccgtcaagtgcgtggccgtggacgaggaggagacatcatcgtgcagctccgacggcgagcggcggttcgtggtgtacagcggcagcctcgacgggtcagtcaaggtgtggcgaatctccgacatcgaacctaccaatcctccgccgcggctgccgtcgccgcatgtatggaagagagaggatcagccggcggcggcgacggcggcggcggcgagggcgtggtcgccgtaccagacgtcggagatgaacagcgtggcagcggcgtgacggcgaggctagagctgatcactaacttgacacaaacgtgcgtgcatgcaagaacagtgtggggctcacacgtgtactgtagcagaagagtgtaaatatacgtagaatatacggtgcctgtacgtagattacgtatttgtcaaatgtatggatgcgaatgggtggcttggtcggagataccattttggtaggaggaatgggcggttagttgacagcgagaggtctaccagccacgtcaaaaaccaataatggaagggaaaaaaataaaagggagaaggttttgggaatggctttgttttgttgattttggtagtgatttaattaacgctctgtgtaagatgtacagatgtatataataatataaaagccaccatattaattttgatgtatgaatatattattaacagttcggttttggtggcaatcctcacctttaatctgttactacttctcttcagtcatctgtagtagcatcaaaggacagcagcatgcatgtattcttccctaaattaatcaggaatatatatggcggttcatcgtaattaaaagtcctaaaattacatttcccacaccaatggcgacatgagattgtgatttgtgtattctagtaggaatttgaccacacagaacaaaaattaccatgaacaggtctagtatccagatcattcctgatggacaacgtcaacaaatcaaggcatcaagtgtgaaggacatatatttccctccgcccaatcttacaagtcgcgaattgacttgacagttgacactaagtcgtagtactaattaattgtgcatataaaagaaaatttgccttattcttcaaatacttattttttttaatattcaaaatttctcacaaaatacttgacactctcaagtattacttgtctcatccattatctccgattcaaatttctctctattctacctctacttcactcgcaaagtctcaaccatatatcatttaatgggataatatggttttttttaaaaaaaactatacttaaactatctaaaataataagtattttaagaggtactctatccatttcaaagaaaaacaaacttagaactagatataacaaacatattctaatataaccaaatctggtcatagatctgtagggagtagggagtaagcaattaattaattttaacttaattgtgtaggactggacgactcggcaggtaaagagtgtaataagaccaaattgcggtacagaggtcgccatctttccctttccaatagctcgccgggggttcccctgaaacaggagttcccgtggccgccgaggattccctccccacgccgcaacgcaaccggagatggaatgtatagtatctggtgttcgcagcaccgctgttgcgctgctgcgccggccaacgcctcgttcgccgccgggcatcgtctcgcgaccacacccatccctttcccggccggcccaaccacggcgactcgatcggatattgcctgcctgccatgcatgcatggacgacaactcgcaaaggtttttgggctgatttcgagctgccgatgcaagcagattcggtgatgaccgttcgatgaagggtgtgattaggatgcaacaagccaaagctgtttattctaaatattaaggtctcgctgttcttttataattaagatataaattaatcttagtttttgttagctgttagcacgatttttaaactgtcatgaactttttatattgaagttgctataacatttgaccgaaatccattttttgaagtttgaaataattaaagctcaattaattatacgctaaagatttcatctgacccatgttcaaacgagacataagaaatgtacttaactattaactttcctctattccttcaggatgtgtttggcaagtgggatataggagatgggattgagaaaaggaaatagatgaatggctaggattaaatgaggtgtgaaatattgcccttttgagggtgggatattatttcccaattccatttgccaaacaagcctcatggtatgatcgtttcgaatttgttcaaagttattttttaaattttgattaaatttataaaaaaatttactctatttttgtatcaaaatatatttgattttacatttaaaaaaattaatttattgttgtggtagttactaagatttttttttatacatatggtcgaatttaaggaaatccattaagaaaaaaattaaaatgtcttataatataaaatattataatagagtgaaaaaaattgtatctttaatccaatattaatgtataaaaaatctaaccgctcaatttcatggagaaacactactagtacatatactaattagggacaattgcttatttgaccttgttttagagcctaactactaatatgaccctactttttcaactttgcttacttaaccatacttttcaaaatcagaactgccgtcttagcctattttactgtaccattagggtttaatctagggtgcaaaaaaaatattttatactcggaactggctaaaatgcctctgactaccaaatcaatcgtgtccctaaattgctcaccccacggtctactcatcccacgcggataggccttctaggcggcatgacgttagggggaggcggcgctcagtgcacgctgaggcggcggcgcgtggagaggtcatcagcgacggtggcggcagtaggagctgcggaggttgcgcacggagaagggatcggcggcgatggcacgcggaggctgcggcggctgcacgcgggtactgagtagtggatgaaactagcttatgacttagggattttagggatgaaatttgtgagattttaggtttatatatgttgatttttatatatgtggcttagtgaaatttatatgtttatgacttggtgatttgcccattagtgaattactacgataagtttagggtattttagggttttagtgcaaatgtatgaaatttgtgatgtggatctaagtggatttatttatttgtgacttccctttcttttctcaacaagagttggataaagattaagattttcgtggcacacttttcaaactttctatatgaaagttgctctaaaatatcatattaatctatttttcaagtttgtaataattaaaactcgatcaatcatatgttaataccaccttgttatgcgtaaaaaaacttaatcttcatcttcaggagaaaagaacaccaagagttattttagagatgcatgatggatgatggattttagtgtagatactacctaggttatcaaatcaacatagaatatgaggtgctgtccggagttggtttgatcgagttagtgcattcatataactgattaagataccttctgaccctaagcccctcgtattctgtcatttttagatattttagggtatttatgatatgtttgtggtaatttagagtattttaatgaatttttagggtaatttagatatacatgtgactagtgatatataatttagggtattttgtatacttttactgagatagtaatctttgtttttactttttatcgtacacaggttatttagaaaatgtctcagaaagacaaacccacgttagcgactaggagaaaaacggagtggattcagactgatagtggtcatactatatcctaaaccatatttattaagctaattcagagcgggtgcggatagtgtacggatgtcaaaaatggagcataattggttcgaaaacggattaaatttatcggatgttacgtgtgtatgcaatcaatacaacatcgagttggcaatgcaaggaacaataatacaatagtcaataaacgatccattgtaataattatgtgcttaagtgctaaacaatatgaatacatgatgtctataatataaaaatacaactacataagtatgacatgagacggtgaaagtctcagactaagaaatctagggtaattgatgaattagtacattggatggaccaacttatgttatatgcaataggtagagtcgttacatgtgttgatgatttcggattatccggcaaacggcctatcggataatccgacagaaatgtcggataatccgcagccgccggattttggagataccgtatcctcatccgcatctgcattatactatccacatccgcatccatatccgtcggatttctaaaagcccatactatatactcgtttcgaacggatttgaatcggattggatcggatcggatattattatccgatccgttttcaccactattggcgacaactagtgggaccacatcgacccggaaccataggacccgaaataggattcctaaggatcagaaataataagagcatcgctaaaagccaaacgagggctacctcaatttcttcaagacctaaaaatgtctgcccctatctacaaaaatttaaattcacaggtaatgacatatcctgcaagtgaaatatttaagatgccaaataatacatctacaagacatcactgcacaccattgtaaaattcacagggaaattcagttcccacaaccaaacacatatccaagtcatgaacattttatagaagttgataaacagttttgtcacaacatgtaacaaaaaaaaagaaaaagatgagtaaatttcacattgggccatatattttgaacatagttttataatggactaggggtaagccagagtgttcacttaacactacatatctttacactgatttgcgctttgggctagggatgagcaagaagtggagcagcgggggtctcaccagatctggacggccgcggtggcagtggcggatgtcgttggagatgctgcgggcgaggtcagggagggtggcagcagcggggatatcacgcacgacgtcggggagggcggcgctagaccagcgtggtagcgaggtcgggatgggcagtggacaatgtcggggagggtggcgatcagagcttctgccgccggccgtgaaggcggcggcctcagacgagacaacgcccggtcgcgtgctccaagaagaaatgaggccgcctctgggtcggtggggaattggccaattggggaaagagtaaatttcctatatccttgcaaactcactcaatccctttcgtaccccgtgaaatttacccgatctcctttataccccccaaaattttaacttgatcccttccatgcccctaccgttacattttccttcatttcactattacgtttggttgcaaatatttatgcccttaatgctttaggtttgaatataaacttgaaaaacgattaaaaaattttatttcgctgcacaatatgtgcattttatgaaactaattagactaaataattagtgcagaaaattttgacataaatttttaaaataaaacaaatgtaataaattaaattttttatttaaagttttaataggacaacgggtattttgatcgggagcattcataaaaaatattgtgagcgctggtagtcctatgcatactccttttttttatgactttcttttaaaaaatagatacatatttttttatttatttatctaaaaataaattttgtgataaataatgcattgcacaacaaactcataactataatagccttatgcgataaacttttacatttttaatactgtaattcatgaatttctatgttcatccaaagggtaaaatggtcaatttttatagaaattagacagtca

SEQ ID NO: 67381 - DNA, 1820 bp, Oryza sativa
cagctcactttctaccttagaaagacgggaaataatttcatctgaaggcacaacgggtatcttcagttctacggatgagggaaccctttcaatgatatactttctgatagcaacataagaacagtaagcctcccagtctgactttggataaaattctctcctaaaaaaatgtagaattctctctttgacaccaaaattattccaccattcttgataatcacgggttccagtgtcttgtgtgatgcacgccaccaagtccttcccaaaaccacgaattcggttgtccagtgtaaggcactgaagcgaagttgcgttctcaaggatataaaatatcagctccactagttcctgcttgtggcaaaaaccggttactgtcacatgcttgatgctctggtggctatgttctggtgacaaatgtatttttaggtatttaggattaaaaaccaatggatagggttctttagcagactcctccacctgcacagtaaaaaggaaaggaaaacgatatcattcattcttaatgataaaatgacaagggaaacaacttaaggatgaaagaagacaaaattttgctttgagagataaaatgtcatacgtgcaagataaaagtttccagcacaggagaagctctgaggaaagtaaccagataagcgtactgatagccaaagccataatcccttggtccaacaatcgcaagctccagatacttgaggtgcaggaatcttccatgcggttgaactatgagtggatagaaataaccaacctcattcgcagacatcaggaacagagtttcaacgtttggggcaactgttgggagctccttgcgagcatattcaaacaaattaaaccaagggtagattgatatgtttacatgcttcagttgcagtgaatctccaagtgacaactgtattaggggcccttcatagtaaaaggtggagagatttggagcatcactcattattaactgcagcaagttgcatcgtctgacccgcaagaaattaagcagctgcagtgtgcaaggtattttaaacaatctatctcatggcaaaacccaagttccagatgctctagactaagagaattataaagaaaggtccatagttcttctgtggtgatatgcaccaagctaaaataagctctcttcaagtttctgaaggaacaagctcctagatcagggcgaaaagcgcaggagtagagacacagagactgaattgagcatcccttttcaaacaagagtttacatgggaatctatatttcattttatcatcccggggcagctctagggtgagttcctcgatcccagggatagctgcatcaagccaatggttgatatgatgggcagacaactcatgaaaaaattgtagttcaaacctaaacctcttcacccaaccaccagtgtggttttgcagagcaatatcaatcctcttgatatatgaatccatttgaccttgtatacaattgtgttgtccatccatggataatgttttggcactgaatttgagctcaggataatgtctccaggaccgtaaaagttctcgtgaggcacaggcaggagagcaattatctgatgcaacacatcctgagcaagagatacataaaagacaacttcaacaacaggatggcaagaggacgaagttgagttggacaaagtgataatgcttataagagaaaaacaacagatagaaaggcatgtcataaagttgatagtgctataacattcctattctattattccagtagcattatttgtttacttatttgctgaagtagctatgccctgattcagaagagctgaaacaatgcctgaatgtatgcatat

SEQ ID NO: 67382 - DNA, 5503 bp, Oryza sativa
  unsure (1)..(5503): unsure at all n locations
agaaaaccagtgttacttggacagtgtccgaattgtttggccaaaccggacacctgtgtccgtgtccaggtaacaccggggaaaacactagactggctatataatataaggaagcaaaatcacacagaagtacagaaccatttgatttaactgttcaggttggtttgcgttttcatataatatatatgcaccaaccccaacagcaccagccgcagctcactctagcctacctgcctcctctgccaccacacatcctctcttcccctttcacaggcttctatattcgcacctgctgccaccccacccagctcagctttggcaacgcttcatgccaccacacatgactgccgcttgagctaactttttcgaagccgaaccctccattgcctgccccactctatggctgtgaaaaaagctcaaggctcgcaagctattcatactcgactcattataagctcggccccaggctacaacgaatcaagctcgagcttcaactaaggctcatatccattaacgaacagagctcaagtagctcaacaaaggctcgaggcttgagtgcgtgtttttgtctccgtggctactgctgtactactgcaggagtactagtactgctactatgctggccagccgcagcgtccatctttatttaaacaattaatattccaacgttcaaatctagaggctaatacctccgtcccatcctaggttgctatattatgggacggagggagtagctagttgcagtacttgtgcagccttttgtcagtgttagtgtttattctcttgatggtgaacgcatgtgcttgcatttgttgttcctcctgggcaagctcgagtagactcgaggctcgttcgagccaagcccgagcttaactgcaaactcgaggctgttcgagctcggctctgagttcataacgagctcgagcctaatcatataaactcgctcgagctcggctcgttgacagacctaccccactcaaccatccatcctcatcgcatggagggagcctccctgtcccgatcaccaattccaccactggcccatcaacctcccgaccatcaattcctccccaaatccagaaccctaaccctactggctcaattgctaatcgccgctgccacaaccgacccattgatctccctgaccactaatttatccctaattcctcccaaatcaagaagcctaatcctactggcttaactgcgagcgacagcaccggagtggaaccagagctgaaggggacgaggccggtgcacaggggtaagattcgcatgattttgtccccgagaatatcttttcttacactgtaaacagattacaagttgacggagaagagggcgataaaagtttgagctttctgtgcacagatcgatgacgatgccctttaacttgatgatttagctatataggtcagtggatctggttatagtagattaaagcagagaacaagctgaaaatttaaaagaggcataccggcctggattcgccgccgccgccgccggcggcggcgtttcatggacatgatcctcgccagacccagcatccccatcttgtaatagacgacacgacacgacacggagaagtttccaagtgttgtatagtactactctactctagtcctgacgccgactcgtaaagttgtactatctccgttttgaaatgtttgacgccgttgactttttagcacatatttaactgttcgtcttattaaaaaaaataagtaattattaattcttttcctatcatttgattcattgttaaatatatttttatgtaggcatataattttacatatttcacaaaagtttttaaataagacgaacggttaaatatgtgctaaaaagttaacggtgtcacgtattttgaaacggagggagtactgatcggaagcagcagcgactcctgtcctccccatcgtctcttggtgcaaggagctacggcggcggctggagcctggaggggaacggggcaagtaaatcgtgttcaggcacggccagggagacgagggatgtatagcccgcccggcccagcaagccacgggccctctggtggcacggcaactgtagcgggccgtgccaaggccttagcccaagcacggccaaaagagatgctgggccgtgccgggccagcacggctactgttgcgaatttttttcatttttaatttattttgttttaatatttacagaaatattataccgacgaaaatatttacagaaatagagggcgacagggtgacgtgtgtgattgaaggccgctgagcgggcatgcaaattttccatgcgacgaaaattgcatttaccgggcggcaagggacctaagcgcaaaatacacgcacggcgtcatcttgcatgtcattttgccgccctccacttgggcggtagggtctatttttgtaaatattttcgccggtataatatttctgtaaatattaaaaaaataaaaatgaaaaaaaaaaatcctactgttgcggcacgtgggccggcaccagcacacgtgacccataaaaatttgaaacttgaggggaaaaaaagaaagaaagggaaaaaataataatacgaaggaaaaaaggatgcatataggattaatgtgaggaaaatttagggaaaattggaaatataaccgaaaatatacagtaaaaatatgataaaatgtgaaaaaataaaaaatatgagaaatataaggggaaaataaaaaattgtagggaaaataattgggccggaccatcgataggcatgccgtgccgtgtcggccctaagatgctggcccaagcacgggacgggcaaacggatcgtgcccgcacggcccataggctggcatgtcgtgccatgcctgggccggctacaataaggccgtgcccgggccaacccagcatggctcagcctatttggatagctataatcggatgggaatgggatcatgaggagagagaccgcagtgggtcctattccctcctcacattcttggcatgttggtttttggaattgggtaaatttgatttaagccattagaaatttactatattggaaaacatcatcactattcatgtatttgaaaaattgttattacagttttatagttattcaatatatggcactacttacctcatcaatgcattttgttaaaaaaaaaagttagaccaaaataccattttttgggggaaatttaactatttgtcactattatgattgccaattatccaaatactcatcttagatttgccttttttttttttgcccctctaaggtgatgacttctttaactattttctacttttacccatgtggcatgccaacgtgaccacctagtgtaaaaatcgatgtgagacccacttgttaatctcacaaacacttcccttcctctctccctctgttccggctagccccgctggctgccagtgctgctccggctagccccgctgtcgtccctttcatagatcctcggtggttgatggctgcggtgttgctggaccatgggacgataactccggtgcttggtgggtcccactccacaccacgctccacgtgatcgtcgcccgcttcccgaccgtctccaagctcgccctcaagtgcgactatcgcgctgagggcgtcaccaaccccacgttcgtgctcctcgtcgaccgcctcgacccgacccttcaacgactcaagctccgctccctccgcctcgtcaccgattacggcgtcgtcgtgctcgctgtcgccgccactagcctccgcaagctctccatcgcctcatgcacctttggtgccaaggggatcgaggtcgtcctccgctcctacctccaactcaaggagctcttcgtcaatgctgcctcccacctccaggacaacggggctgattggagcagcgctgacagcaagtgaggctagccggaccggaggaagagaggaaggggagagttgtgagactgacaggtgggtcccacattgaatttttacactggggtgccacgttggtataccacataggcgaaagcggcaaatagttaagaagccaccaccttataggggaaaaaataaaagcaaatctaagcgtggtgtttggataagtggcaaatataatagtagcaaatagnaaaatttccctcctctttcatcccctcctctctcatgttcttctctaaacctcgcccgcccgtccttagcaagtcaggcatgttcatctggttctcgtcgtgggcgccgtcagccttcagtgcctctgtggctacggagatgccgactgcaactttgtctccagtagccatggggggtgtgtgtatagctgacgtagtgacgtggcgccggtgttgacagccgccgcgcctgtggttgaggggttgtcagttcgctgcgtttgtgatcgcggatatataattttatcacgtgtgtattattactgatttagggaatggcattataaacaaatagggtttctggtgtataaaactggggggccaacacatagctagaagttgctatatattggctgatagatagatgagggatattaaaggaataaatttttttttatctatggacagatgatatgtgagaaagtaagagtggatttattttgaaataaagttaaactaaccgcagaactcgatttgttttgggcagagagagtactaagcaattttgtttgcttggttatgccttgccgggcagaatgaaatgaaccacgtgattaggggcaaaagtgtaaatacaaagggaaactattatttccaaccctagattccttccttgtgctgctataaagcttttccagtgtgtgacaatatgcaactgcctctaccgccgccagctctgcgttagtctgcttcaatttctgtttctcccaggtttcttgattcttgctttgagttttcctctcttcttttggattatttttcttttgttctttatttggagagattttcctaatgatgatgcgaatatctattcaccgaaatcgaggcatttttctcagctctatcctcccccatatttcgtgtttttctttctttttctttttgtcttcacaactatggtttcttgatatgagtaattggagattggtgatacgtttacatgttgtaagagtttcttctctgatgaatgatgaagggtttcttagtttgttttcatggaggctgtgttatgggttctgatggtgcagtgatatggtcctttgttcaatttcgcaaccttttgaatcattttttgtttgtttatcaacagttacatagacatgcagcagtgatgataagcaaaaaggactcataacgtcatgaggtttggacaaaacatgattgctttcaagcactgttgagctgcatctgtctcgcattgcaaaatctattgttcaagaaatttttttccctcgtgttcgtaatttaagtccctcgtattcataatttaaggagccagtcatctggaatcaagggccagagtgactgaacgttcaagtcaaaagttgttgattgacagacaaaaggcgatctcaccgttatccactacactttagacaaccc

SEQ ID NO: 67383 - DNA, 2649 bp, Oryza sativa
aacagactcatgccaatgcaatgaatgacttaacataacgatagaaggtagatagacactacacatacacatagaagtatgtatacatttgcaaagtttgtaaattcattaaggcatgtaaattacataaataaaagtagcagttcagtactacagaaatgtttctaggcaataacctgtcatcaatgttgcgcattgtccattgtggaggggcaacactctgacttctaaggttatcaaacccctgcaatccagcccataacaacaagttagaagaggataagccattagcttttattaactattacagaaagacaatgcaaatgagggatcaaagtaagtaccaatacaaacgtgcaaccactaggatcattcgaaataacctcaacctttgtgagatgtttcaacttgtaaagcttggctggctgaaacaaaaggaagatattatgtttctaaagggagactaaagagaactgcagaaagtggtaagaagaaaaatacaaagtgtgatttgtttattgaagtagttgataatgaaggcaagttacaatagtaaacataagctagatgcagatgctcacatatagtaaagaaaacaaacctcaagtactgcgccggatgaatacttcaatactcggagaaaagctttggctgcctcaccttttgtcgattgtttaactgcgtgaagttgttactgtttagcagttgttacaagcatatgctttacatagaaacgaatactgtcttaaatctagcatgacaataattaagtcctatttatacgtcaaccaaaccagcttgcaaacagacatactagcaaatctccactgttaagtactaacaagtttaaaatatgtttataacatattggcaaacaacacttctaaagtataactatcatgtttatttgagataaccaaagattaactcttcacttcatttagaccatgccaaaacaatcagagtaatcaatatcaaaatgtcaaggtttccttgttctaataatcaagtatttatagagtgttgcccaccagatagagcagataactaaatccaacattccaactgcaaagaagtaggaagtcagtgcaatcgattcagcacagcaatgttcatcaatccacgctaactttgagaattccacaatccacactaacgtgcatcattacattgagagacatcaattccggtttcataagttttaaacatcttgattatcttatctgcctcccaaaaataaaagcaagcttcaagttaaaagtctgaagtggctatactggccaaggcttctgattcccttagccaatgaagcctttcaaaagaaaccagggataaagttttggtcttggacatgcaaggatttgacaactacttggcccaggtccatccatatgggagaaaaaataattagctcgtcggtcctagccccttttatgacaagtaatggcagatccttctgacaatgatgaacatttcatcctacaagttgtagtgttaatgagcatctctaacaactgtcatcaactccaggctccatctaatcacagttcacaaggacttgtccaatcagctccaacacctagtcgattccaacgattactggtctggtgagatgcttagacgttcctatcaatccatgcattaactcttgtgtaccggtattcgaaatttcggtctcaacaccgcatgatgaaagctctaaaagaaatgttccttgtacaagatgcttcaagtataggatcgaattgtagtgtaggctacttccagtataggatcagctccagcttccaaaactctgatgattctgtgtccttgcacagtatggcagattctcatttggagctccagtggcgcatgcacgaaaatttactaattttagcaatttacagctaaccgcatagaataagtaaaaaaaaaaaggatctctgcccaaaacaacaccttgtatagtcccctagtggtctaggctgtcaaccgaagtccaaccacaggccatcgctcgatccaagctccccagatcacgaaactcgaatcccaaatccgagcaaggatctcggcagcgaagatcagacaggattagggcagcgtgacattttctccctaaacatggtagcttttccccgagcaaccaaatcagctactactactacttctcgagtctcaccagagcgatccctctccgagcaaccaaatcagctaccgtggaccgaatcgaagcaggggaacaaaccagcaaagctgcagcagagcgagaagagaggaaagaaggaaggagggaggggggggaggcagtgaccggtgagcgcgaggacgcggggcttggcgaggcggccgagcttctcgaagatgcccctccccttggcgacgcggatggagaaggacacctcctcgccgcgcgcccccgaagccgccacggcctgcgcgcacgcgcgccgcagctcggcgtcgtccgcgctcgacttcgccatcgcccgtgcgccgccgccgccgctcgccgccgatctgaggagaggaggaggacgacgaggtgggccgcggttggggaagagggatgagttggtgtcgcctcagactcctcaaagagtcgagattaatcaatcaaaaaccaaatcattttcttttttaccgtttttactgcctgtttttctt

SEQ ID NO: 67384 - DNA, 3734 bp, Oryza sativa
gaaataccagcccttaattccccggtccttttcccccaaataacagtaattaagcggggacacacacacacctgacacgcggcgatcaaaaaaacccaacccctcctctcctcgccgccgccgcccatggccagcgaccgccgctactactacttcgaagaagacgatggcgatggcgaggaggaggtggagtggctggcgatggaggccgacgaggacgacgtcggcctgctcgaggaggacgaccttcacctgcggcttcccgacgaccgccccgcggattgctgggtgagcatgcgctactactacaccccccatcatcacttcatcaccacaccacaccacaccacgggagggggatagatagggggcgaactcaactcgctcgatggatgcgtgctaggccgcctcctgatcgtgcgcggcgcggtgctcgaatccatctagtaggaaaaaaaaagagtcgtcctctgatttttttttttaattttgtgccgtttgggttatcctgcctgcgtcatgggtggagtatagtaatgccgctgattgcacacaacaagatattatggagaagacgccgtctggtcgcttaccggatcgggatggggattggcttcttatcttgtactactagtagtaatgccgattgtttttggaattccggtgtgtgatttgagagaaaaaacaaagtattttaaattaattgctcttgtttgcaccctcataataactacattagttccaatctggttttacctctaagtattaggatttaggagtacaaaatcaattcaatccctcttttccctgcaagggtttgatcatctgcatcaaaaatcatccaattctcacaaactagttgtccttgtagctttgtattataattaatttgcctttattgcattctgttgattttttttttgcaattatcgtatcttagaacatgtaaatttggtttacaaatagaatggttgacatgcgcagctttgtttcttaaacttgtacattattactacatttattattgtgtacaacttcaagcagcgcatgagccatgtatgctgcattggatgcattcatttctttgtgctgattagcttaatatttacaaatcaccatttttttaatttagctgctaattagggtatcacgaatagatatctttcgcacaatttacctatgtttggttaagttcccgtctgtcaccaccaatgcattgatctttactgtaaaaactgtgctccaaataatttatcttgttgttctcacagaaaaaatattatcatctccacattgcctgggatttgtcatttatgcattcaaatcaagtgaatggaactgaagccttaatttgtttttttttctcctgagaagatctatttagttattttgacatgtataactgttgttgtaggccatcacacaagagtcacttcctgctgcccaggtaatgttgctctagtcattcttgccatttcgagattcagattatgttggtcctacctatacttgagatcaattgactgttttgtgtatctactctacccacagcaacaagacctgtctatggtaatgaacttgctcaacataaagcagcaccttgcacgcacactccttatccaccaccggtggaagatgcattgcatttatgatcaccttgacagaaaggggcgggaccgcatgctcagtgaggcatgcattattttgccgaagaatagcatgtcagcagctagctcaacaagtgttacctgcaatgtgtgttttgaggacttctcaatgactgatgtctcgaccatggactgtgggcattgcttctgcaatgactgtgagtccctacgaacccttcagtaacttccttctgatgtcctgatccttacagctattacattactataaacctttttattcggtggcattcgattttccttaagaatattcatcaacctaatgtatcaaatagtttctaggttttcataaaaatgaaaaacagtaggacatatttgttagcaaaacactgcacattttcttacctatctttttttttcttcaggttggacagagcacttctttgcatccattaatactggcaacaagcagattcggtgcatggaggttaagtgcaaggccatttgtgatgaggacattgtgcgccgcctcctcagtctgaagtaccctgctgcatctaagcgcttcgatctcctcctacttgagtcttaccttgaggacaatgactcagtgaagtggtgccccagtgccccacactgtggccgcgcaatccaggtaggcaccggcgagaggtactgcgaggtcgcttgcccctgtggtgtcagcttctgcttcaactgtgcagggcaggtgcactcgccttgcccatgtgccatatgggagaagtggaaagctaagggccatggagactcggatagcgtcaagtggattcttgccaacaccaagagctgccccaagtgctccaagcccatcgagaagaacggtggctgcaaccttgtccattgcaagtgcggccagtgtctatggtaagctgttgtcagttgttacacacatatccacgcagggtttagcggtgggagcttttcatcatttggtgagtgagcttgctctctatggtgatcggcaacctgggaataggcgatggtgtatctagcttaaaatcagtttttcatctccttgattactactctctctgtcccaaaataatttaacctagtactccctccgtactcgtaaaggaagtcgtttaggacagcgacacggtctccaaaacacaacttgaacttcttatttctataaaaatatttattgaaaagtgataaatgtatacttttatgaaagtattttttaagacaaatatattcatataatttttacattttcaaactcaacaacttgagagttattcatgatttatattcccaaggtttgacttaaacattgtcctaaacgacttcctttgtgagtatggagggagtacgagatatgacacatactaggactgtctagattcgtaaaattaagatgtgtcacattccgtactagattggtttatttttggacagaggggtactctagtatcttgaattgctgaccctactgaatgcatgcagctggctctgtggtgggcctaccgggagggagcacacttgggatagcatctccggccacagctgcaaccgctacaaggaggaaaacggcgacaaggtggacaccagcagacagcagatgcagcggtacacgcactactgggaccgttacaacatccacgccggctcgtacaaggtggagcagaaggatcttgggcctgccgtcgaggagcaggtgaagaagctggagtcgaacctaacaggtccgaagatgaactgggacggtagctggctcgccatggcgtaccaatccctgctcgcatcgcggcaggtgctgtcgcggtcgtacgccttcgcctactacatgtttggcggcggcgaggtgaagacgcacccgtcggagcgggcgagcctcgccgtggcgcagaacctcttcgaggaccggcaggagcagctggagcgccacgttgagcatctctccaaggagctcgccacggacttgctggggctgccggaggaggagatcgtcctgaagaaggtggagattgccaacctcgccaagatcgtccaggcaatctgcgggcagttgtacaggtgcatccaggacgaactcctgccactgctcgtccagcccatgaa

SEQ ID NO: 67385 - DNA, 2828 bp, Oryza sativa
gtatttaaacattgttcagaagattctcctaatctgccgcaaaacatcttgtgttatataatattgttgagaagattctcttaatctgcagcataacatctagtgttatataatatgagacatcaaaagttcgttttcctactgaaaattaaccaataagaccaagttgcaaaaggcaaattaaatttgtttcaaagggtcatcacaaagagcatcacaatgagcgatttagattttctcttgggtacatcatgatggatccctatgagcaattgacgccctctgtttatagcactaagcaagacaagttgcattgttgtgtcaggattctaagtttaatgtcttttatatctttctgtccttttctgccggataactaaatatctgaatggttttcataattatccgagatacaaatgaatgaattaattataataaaatttgacaaaggatttaaaacaacattctaagaaaaatatatagaaaattttctataaaaatcataaaagctcaaaaagcgtttatttggctatgctgaaatatagataggttgaaggtaaagaacaccgacagtgtctagcctctcgagaaccaaaggatctttcagttttcgtagtctgcgtatgtttcggtgaaaagaatcttgccactatagacgatccaaaacacgttccagtactatcagatttgggccacacgcaagccaggtcaacaacgaacagttttgagtacagtaattaactagccaaaaaaatggatttacagttgcatagttttaagggattagatcaataaagtattggtacatagttcagggcctcaaaatcctcccgtgtgcaattctctatctgatataaaccactccaattgtagagaacaattgatcaaggcatttttgaatcaaaggccaattttcaaaaccgccttatcctacttgtttgatacataaaaaaaatctgtctttaaacttaaggaagcaatgctacaaaattgcctgacgggacttcctctacagaatacatctcaattcttcagctcaaatggtctgtaacaccccctccaaattcccattgcttgtgaaggtaacccgttcagcctcttgtatcgaatttcatcggtgggaatggttgcaaaaaaatgcaaggtggaagggatttgtcctttgtgtgacttaacaacatttaaggggtttttcggcatcaaccatctactactaccctacaagtcctcgctctcttcttttagtcggattggatggattacaactccattttgagctgatcggacacggccccatcttccaagacgaggctcctggtaataaaagatatatcagtataaaatttaggattttgaaacgaaactaaaaagagtactgtgttgcaacagtatagaagactatggaatggattaacataaatggtatctggtccacttgtagtgctaggattacaaggcagtagtattcctattcatcggctaatgaacaagagaatgcgatgatgaatctgcaattctgcaatctgcattcacttttgaggctgtcatggagtttcaaaacgtagcaggatagggtgctctacttctattaataaaatgttgtaagttgtgtacagtgggaattttagttcaatcagttaagtgtttagccagaaagataagttcaatatagttgctgcttcccagtctttatttgctgaatagtatctcgtaataagctttttagtcaaggcgatattttccattgtaatcaatgaaaatggatagggtttccatgctctaaaaaagtttcaagaacttaatgtcaatgattaaaccggaaaattaagtttttccatccctgttgcattctcaagataatcttgggaacatactgatatcaaaggttaaaaaaaactgaacttttctgtaacaattaacaaaggggatttaatatactgacctggcccacaccagcaacaataaagcgtccagatttcgggatggcgagagaattaacaaatccatcctgataatggtagaacaaaatgtatcaattatttgcaaccaacagtaaaaatatgtagactcagttttttctagcattggcagtacaataaccttgtcatctgaaacgattgccccttttcttggaaagtgccattttcactgtttatttattgggggaaagcaagatgcatgatttgcaatgttttcattttctacccaattcaattaattgcataaaagaagctgagcagctgtactattgtagtatggcatttagtaggtgcacagttatttcatattaattcttagatctggtgtcttgatctaagacccatggtggtcctgataaatgctgtaaaaccgagggagtataattatcaggccaaagtatacgctcctatgaagtacaacaatcagaaaatgttagtgaacgtaactaatatgattatacaatcaactaaaaatcccaaaggacctagaactgagacaataaattccagtaatgccaagtcaaaacagtcagaggtgtcttgggaccttggtagcttatctatggtgcattttattttcataataacatccaaaggggtatcatggagtagctagtgtagcttaccagtctcaaactaaataatggccgaatgcccttagaatcaggttcaatagcccaaagacgaactgaaccatttgctgctcctgatgcagcaagatcagaacctcttcttgcagcaatagcactaacccatgattgggctgatgagacactttcaggtttatgtatgccattttctgcatttgaggtgcaaagcaatagataagaaacacatatacacacagaa

SEQ ID NO: 67386 - DNA, 2216 bp, Oryza sativa
ttgtcggtgcttcacgagcatcttaaagccatcctcaagatctggttgtaatatcctgcaatagttttgcaaattttagtcatatctatttcaacctcaccatttatgtgatcagtatttcaagaacacttatattatcttattgcaccttttagttagagatttttttaaaaaaaagatggattcaattaaaaggttatcatatttatatagcttttaacagctgtagacagttaccacacccagataactgatgtcatatacaagtgacttgtggatagcaccttcagtaatcatgatgacaaatgcattcccgagccatctaaatgtgtatagttcttccgctcacgtttcattccgtttcagcatgctagttttggaacattatccaaatagatcacgcatgaattgagaatacaacctaagtaaaaagtaaatggatggggatggcaaatgagaaattattggaagaagctccacatgcaaacacatctaattttgtagataaaataaatgccatatggttcaggtgttgagggcatatataatcatgtagcaagcaatatttcctaatattttaaccgccccagtttgtgaactactgtctataagcagagtagcagattctgcgtaaattaacattatgccaaagtgtacaggttgcaaaaaaaaccaatagcaagcggaagaggaggggtagatgtgaactccaactttcttcttccattatggcacatcccactacttgtgactataaacgattttcctctcatgtttggttctaacagaaacatttgaatatacagttgtttggatgtcccaattcagtaccaccaatgcacttgctggagccataaaaggacaactgcttgaatcccaagaggccaagagtgcatcattcacaacaagaacttcacatgtatttcgaaactaactcctatgttgcaagtaagatcagtgtaatacaaatatatgacaaaaagttgaaagcagaaaattacaagataacaagaatcaagaataaatacgaggttttagaaagtttagaggatccaggacagttttaggcaaccaggctgttttaatggttggtttcaggacatctctagtttgttgttaactctatattttcccctcgatgcattttgttcggttggtcttatataagcaataagccaataacataagatcttggcgaagttaacatgaaaataaatactctttccacatagtataacctactggttcaagccagtgtattcctttatttctctccatgattatagccctttatttccctccatgaggatatatcattgtaccaccacactcagataaccatatattagcaggaatgttgtccatattccacccctaaaagcacccacctatgtacctaagcaaaaccccaaacgcatacatgtaacctgacccgtgtgcttgtcagctcgcaaaacgcaaagggctattaatttggaactaatcaattagtacagacaatggaacctcactctgatccaaattgctaccctaaaacatcagagatacatgtcctcttcatttcaggttatgaactgtgaccattgacgaaattgtcgtgtaaatttcgttgactctgaccactgacgaaattgtcgtgtaaaattcgttgcaattgagggcgcaaacattcagagctactgtccacatttagggggctgcaagttggaatttgcaaacaattcccaccgacatttagggggggggggaagaagatctcacctgtcggcgagctccatccgcttcctgccactctcctcgaattgcctcttgaggaggatatcggcgacccgcctccggccggcttcctcgccctcgtcctcgtcctcgtcatcctccctcctcctcctcgccgcgtccgtcaccttcttgagaagctccttcgcgatccgcatcttcttctcccccgccgtctcctgctcctcctcctcctcctcctcctcctccccatcgtcgccgacgccaccagcagcagccgctgccacgccctccaggtcgctgtcctcgctctcgatgtcctcgtcgcggccgcccccgcggcgccgcttgggctcggactcgaagaaggggtcctcatccccgccgccgcggccgcgggaggtggcgcgtggcttgggccgcgagacccgcttccgcggacgaggcgccatggccgggggagggatggggggagggga

SEQ ID NO: 67387 - DNA, 12473 bp, Oryza sativa
tccgcatccgcctcatactatccgcatccgcatccatatccgccgaattttaaaaggccataccatatcctcatttcggacggattcagagcagagtggatcggatattatccgatccgttttcacccctagtagtagacatttattcacattttctgcttgtactccctctcctgatgaatatattaccttagtccgaaaatataaggaagcacccaacgtcctagagaaaatggaacgctcatatctggtagcttaaggctgcattcagcctcactccctcgcacagaaaatgaagcaatgattagggggtgattaattaagtatttgctaattttttaagaaaaaaaggattaatatgattttttaagcaacttttatatatattttgttttgcaaaaaaacgtaccatttagcagtttgaaaaacgtacgcgctgaaaacaaggaagaaaagttgggaacaggaggttacgaacgcagcagcctaatagaggcaacgtactgtgtatagaagctgagcgatgggacctaaggtgagaagaaccaaacatgcatactcgaagagaagagagagctagctgcatgggcctctgtctttttttctaatgtatgtaacagtttcattagaaatattcaaatagtatttctttttcatgaactatttatctactttataaaccagatgtatctttatatttgttacaattaaatcttcatgagactatacatgattatatttttgatgaaaatatatatttagcacttttttgttataattaaatatttaataataagatatcacattatcatattttttttagtttttttcaacaaatatttctgaatgttgcacacgatgttatttggatgtttaaataagtattttcttatggtttatgaggtcatttgtaaatgttgcacatggtgtctttttcatgtttcattaagtattttgtgaagacttgatagttgcaactcgatgtttcacgcgtaaaaacgtttcaataaagtcaagtttttgcaaatatgttgatgtttcactaatgaggaccttaatgtataagatggtggttgtcggtgttgcagtcaatatttttgaatgcttcatatgtttgaagtattttatgaagtgagttggaacgtttgataaagtgatgaaacaatttcctatgacaggtgaaactatgtttcagctcaccctccacctttactcgtgttctgagttaaggatgcaacttgccaaatggaaaacccgacgagatgaagcctccttgcgatagccgtccatgaccttttattgaggaagaagtggctcataaacaaagagaagtaaggacatatttgtctttttgaagataacttaacagctcattcacgatattgatggcagtggcatacatgataaataaattcagtccagtggcatatacaagaataacatgtttttatgacatataaggaacgcaaaaatggttccatgccatctaaatttccccaatgtagttttaagccttgtttgattatgtttattgggcgtgtagccaactggcttaccggacaagacactcaattagcgcattatttagtggtttgagaagtgtgccgatgaatcaaagtagatagtacttctctagtacttaaaaaacgaaatctgcttgatttgtccgtccgtcggttttcctactatgtttgtatgtatgcgtgtccgtgcgaaccgtggacgcgcggcagggagagcgagtgttactgtgtggggagacgtgagagagtggtgaagagaagatggatggagaggagacacaggtaatgttgggatgagagggagaaggcacggggaggaagagtgccagaggaagaagtccagggtgggggtgggggggagaagcgttggtggcggcaagctgtagagggaggtggcagtggatcgaagatggcacggggaaggaagagatgagccgcccgggtggaggggggcggagggagaagccggtgatgacgcgttggaggggaagggggcagcgggtcgaagatggtgcaggggagtaattgtggttgatggtgctcatgttagggggatcgagagagagagagataggtggagtagcatgggaaggatataggatatcaaccgctagatctaaagtgaaacaaagaatcccgggaagaatctcagcccttgcagggaaaatcaccatccccactatgttctttttatataagaaaaaaaagtaaaaataaagataaagataaaaaaaattaacagggccacgaagtgtcaaataatttggtccatgtcccagtcaaagcaacagcctctgtgatgtcacccgtgtctcacttgagttctgtaactcggaggaggacgacctctcataaaccctaataagcaccttccgtaataatagtaggcttcttaattcctcgcgatcggccggtcgatcgatcgttcctctcgcctgccgccgccatacccacgccccgccccggccggcgccatgtcgagcgacgacgaggagtgcttctacgactacgaggaggaggaggaggaggaggaggagccgggctgggacgacggcggcggcggcgacaccatgctggtcgaggaggaagcggcgttgccggagcgccccgtcgattgctgggtgagtaaagccatcccgacgtacgtacgtatagcgatcgcatatcgattgagcaaaggggattgattaattatgtttgttaaatcttgatctgatccatccatgatgcatatcaagcataataaaggaaggaattagaaacgacattagatcagatttaatttgcgcgttcttttagttattctggggaaaaaatgagttacggttttacattacttctaatgcacatgcataatatgttagtatttctttatgctttgcatttgtgaaaccatcggtgaactttaaaaattcttgccaaatatgttttcaatggatttctccctctgatttcaaatatgtaccgttttaggcttttagcatatgttctcagataccccctccccccctaaaaaaattgtgtcctttaactggagttgtttatatgcaccttttcttttcttgctagttcgtctttacgaaataaatgctaattttgtgacaaataagtgaatcatccttttcaatgtactataaatgaagcgcaacaaagtgatttgaccaatttttcaaaatcttctgggcaagcttagaacatgtactcttggattcagatggagtatgctttagtgcacggcttaatgttgttcgagtttggaatacaactgggatacatatttttctgaaaggtatatgtgagttaatttgcagccataattagcatgttttttgtatgataaatggatagcatactcacaagcctaaaaaatcccatccacgctgatgttatgcataaaaacattcacaggtaaaccgagcaatttgaaatgtagccactatgtatgttgggttaaatttaacctactggccggattggtcgactcattctaacaaatctcacgtaaaaccaaggaagtgtggcaagattatattgttaccttcatcgaagtacatccaaattgtttttctatcactaagtataccccaattattttttcaaagcaatcattaacactgattatttgagatgggccaataaaaattgtggctgtattgatatgtgactgccatagggtagagggggaatgtcacctctagaaaatgctttcaaatgagagaacaagaagcattttgataaagaaaaaagttgaatactacaacgacaagtaatatgaaacgtataaagtctatagaaaaaaattggtgtgcagtagatgtatttatacaatgtgcgattgatagttaataaagtatgggaaacaataaaaagtatgtgtcgccaaatttcgcgaagcgagagccaggtggcctccttaatataggaaaaatgtaagccaaattaatttgtccaaaggctagctgctagtttctaagttgttcaagccccctcggccactttccagctgtaatctgacattttattccttctaatatattcggcaaatcttttgccacttttcgtttaaaaaaagtgtgagtgtttggagggggggttgaatgacttgattatgcagttttttttaaataacgtgctcacttttttatgtcaacagcttaaaattgggtcgacctttctctcattgtgagtggtgttgttgtctctttctatcttttttcttgtatattttgctatctttcaaacgtccaaacgaactcaccttagggagcttttatggattctccccccttttagatcgactagaatcttaattttagcactaagcattagcatacaactcaacataatattagcgttacaatatacttcctccgtcccataaaaaataaaatcctgtggatgaatccagatgtactgtactgattaacttttgatgtctgttgttgttgcaggccattacagaagagtctcttccggctgcacaggtaatgtgattcactccacctgacctgacattgttctctgcagcttgcagcttgtgctacagcaattagtactagtaacaaattacattgtgtttcttgacatgctcgatctacctgcgctgtatgtatgtacacagcaacaagacctgtccatggtgatgaacctgctctacataaagcagcaccaagctcgcgccctcctcatccaccaccgctggaagatggaatccatcctggaccacttcgacaggaagggccgagaccgcatgctcagggagaccggcgtcgtgatccagcagcaggcggaggagaagaacggtggcggcatggccatggcggcgtcgccgtcgccgccgccgcgccccagaagcagcgtgacctgctacgtgtgcttcgaggatgtctcatcggacgctgtctccaccatggattgcggacactgcttctgcaatgactgtaagttgcatgtttttctccattttattgtttctttgttttctttttgttctgtaaaactacatcagaagaactttataaattgtatttgtgaagaacttataactgtcttcatgaaaaagaagaattatagaatttggtttcttcctcacttgcattgccctgttcttttttcatgatcgggtgtatttgaatggttgagtaaataaatgattttatgctaattgttcaaggttaaacaaatgaattaaatattataaagttgaaaaagtaattcttccgctttaaattataagtcgttttcacttagtgaaaatcaaaccactccaagtttaattaaatttatagaaaaaagtagtaacatattcaacacaagacaaatatactataaaaagtattactatgttacagaaaatatctataaacttgatcaaacttaaagttgatgttgtcaaagtcaaaacaacttataatctaaaatggaggtagtatttttgaatcaatattataagaaattcatacatataaaggttttgcgaaaatcacatacccgttaatccattcctccataaagtagacaagtagaaaatctatccaaagtattgttttgatatcaattatcaaaatttaaaaatagatttttttaacataatttaaaattagatgctttgttggtactctctctgtccgaaaatatatacctttatctaatcttcctatattttaagacagagagttaattttccccggggaaatttcatcatcaattatatacttcacggttcacgcacaagttggaaaggttttttttgtgtttgcaaaaggtgtgtgattgtgatgtgttgaaatggttcaggttggacggagcacttcttcgcgtgcgtgaacggcgggcagaagcagatccggtgcatggcggtcgggtgcgcggccgtctgcgacgaggacgtggcgcagcgcctcctcggcggcaggtaccccggcgcggcgcggcggctgcgcggcgccctcctcgcgtcgtacgtggaggacaacgcggcggcgcggtggtgccccagcgcgccgcactgcgggcgcgccgtccgcgtggacggcggcggcgggcggtggtgctgcgaggtgtcgtgcccgtgcggcgccagcttctgcttcggctgcgccgcgccggcgcactcgccgtgcccgtgcgccatgtgggagcgctgggaggccaagtgccgcggcgaatccatgaacgtggactggatcctcgccaacaccaagagctgccccaagtgctccaagcccatcgagaagaacggcggctgcaaccatgtccgctgcaagtgcggccagtgtctctggtaataaacaataagatttaaaactcaattcatcctttaggggatatcacctcattttttatgtcacttaaaaattcatcaaaatatttaaaaaaattaggtgagatagattaatatgtgatatatcacttcacaaacatgcaaattcaaactcaacttatataagtagaaacaaaaataacaaatttaactatgaatagaacatgtaattcacagttaaatttgttatttttatttcgaattgtataagtcaaattttaactctcatgtttacaaaaagatatactctctccgtttcacaacgtaagactttctagcattgctcacatacatatagatgttaatgaatctaaacacatacatatgtctagattcattaatatctaattgaatgtgggcaatactgaaagtcttacattgttaaacggagaaagtatcatatattgatctatcttgacaatttttttaaatttttttaattaccttataaacgccatgtacaaaacgagatgatgccccctctgagggacaaaaatccacttccaagattcttaattcaccttggcaattcgatcgccattgatgcgacgaccatgcatgaatgttgtttgcagctggctgtgcggcgcggccaccgggctggcgcacaactggaccagcatcgacgggcacagctgcaaccgctacgacgacgcggcggagaagaggaaggtggacggcgcgaggcgcaaggtgctccggtacgcgcactactacgagcggtacaaggcccacggcgactcgcgcagggcggaggcggagaagctgggcccggccatcgaggcgcgggctcggcggctgcgcgaggaccccgacccggccacggcgccggccagcggcgacgccgccgaggcgctcgccgccgcgcaccgcgcgctgctcgcctcccgcgacgtcctctcgcggtcctacgccttcgcctaccacatgttcggcggcgaggagcggacgttgaaagcggcggcgccggagtcggaggtggcgacggcgcaggcgctgttcgaggaccaccaggagatggcggagaggcacgtggagaagctgtcggggctgctggcggcggacgcgcctccggcgccggccacggcgggggacgcggccctgcggcgggcgaagcaggacgccgtggcgctcaccgccgtggtggagaagcactgcggcgagatgcacaagtgcatccaggacgagctgctgcccatgctcgtggagcccatgtccatcgccgcctaccgccgcgacggccctatcaaggccaaggactttccaacctgtggtggcgcgtcgtgaattgaaaagtttcagggtgtttggtttatagccacactttatcacatcatacttgtggctgtcacagtttgttaggtatgtgtctggtgtactactacagttgtgacttgccacactttttcagtagcatgtcccacactttttcagtagcatgtcccaaatgtcatagacttaattttcttgctaactttgctatactttgtgactagcaatttgtccatcacttttttttggctgccataatttacctaatgttagttgtggtaaagtgtggccgacaaccaaacacacccgttcccaactatgttatgcttactaataatgattttttaatttggagcacatagatttctttttcccgatttctatacaagtttctgaaatgaggtctgaagtttgttgctcttatagcccatagaggtgtgcccacctgaatcatttgtttcctattttagatgaagcaaaattttaaaccactttaattaaacttgcatactctaaatcaaatgtggatctgggatcaaggactgccaaagaaaaggattattttctctaacctgactccgtgggagaggggggggttaacaaattttaaaaatcaaaaaggaaaaaaaaactaaagtgaagatattttcgcggtccgttatttgtgtttgagtcggttataaaattgaagatgttttcgcggtacgtcatccgtgtttgagtcggttataaaaattgaaaatgtttccacggttcgtcatccgtgtttgagtcggttttaattttattttggttttaatctatatttcttctctactattataaaaattgaatttgttttgccggtattttggtacgtcatccgtatatgagtcaatttttaatttcgtttgcttttagaaatacatatccgtatttgagtcggtttttacgatcgttcacttttgataatacataaggaatcacataagaaatctatttaaaaaactcgcatgctaacttgagacgatcggactcctaactgtagctcaagattttctatatatgtatatatatatatatatatatatatatatatatatatatatatatatatatatatatatatatatatatatagacacacacacactagaaaaaatactcgtgcgttgcaacaggtaaagacaattttcaatgatatattaagagccgagtaataaaatgaaatattgaaatcgctatacattataattaaaaaaagttaatgaaaatcctaatattggatcgctatattagattataattaaaaaagttaatgaaaatccttcctggtattaggccgaaagccttccttcctttttcagccataagccagtccgctacctctctccgtttggtttgcttccttcgacccaaccacgagtgaagtcgttttcagccctacccatttcgctaccttcctccgtttggcatgcctccttcgacctatcaaatccacccaaaattggttgagggtttttgatccactcaatcttctctttccgttttcccaaaaatcaaactcgaggtaaaaaagattggggaagatagtcgtcatcgtcggcaactattaggttaaatccagcgaaataaagccaggaaaatcatggagaaaataacgagaaaggagtgggaatcgatttttttaatcaaattggaatagaagacgcactatcgatatggcgcgttatcatcggcaactgttatattaaatccgatgaaataaagctgggaaaatcatggagaaatgatgagagaggagtgggaatagatttttttcaatcaaattgtagtagaaaacgtacaatcaatatggcgctgagattcaactcgggagacatgcgggaagcgtagtgaacggattcaaaaaaccagacgaaaaaaaccaatgcgcacaaaaaaaaattcatttgcgtgcaaaaacaagtcacaaaaataccggtgaaaaaaaccaaacagatttttattttttggttttttgttggcgagattttttttcctttttttttctagagtcggatgattttttttcactgacgtcacagaagctatttttatttttattgcttgttgagtcggactttttttccacctttttagttggacttttttttaccgcctatggaaatttcttgttctttttaagtagagaagattttgataagatattaaaaccgaaacataaaattaaaaccgatttaaatacggatgacgtaccaaaagtaccgacaaaaacatcttcaatttttataatagtagagatatatctaagtgaactctcacagtgaatttcatcttaactaaaccatataacaataataagattaaaataggctttacctgttgaaatgcacaattattttttccagtaatacataattacatatttgtatatataaatattgaatttatagatagaaatatatacatggaaaatttttacatagcagtattttgtaaaaattaaattcgaattgaaatcaaaatctggcccataaatttgcatacaaactttcggtgtataaatttttgaggtatagacttgtaggtgcaatgcaatatttcatatgaaaaaattgaattcgaactggaatgcaaatcatgcatataaaattctgatgtacaatttttcaatgtataatttttaggtgtgcaaaaaaattttcggtgcataaactttagatgggtagacttacctaaaagtgaaaaaaaaagaggtgagaaaaaaggaaacataggacgtgaggggagctaacgcgcaatagcattttcgctaacccactttccgttcccttccgttccaacattttaccgctacggccacatcttattgatgatctctctactttttatacaaacaaaggctaagttagaaacacctatttagaatcaaacgctagattagaaacacctttatcgctatcattttggctgttgctcttttttgggcaacgatgacttgtattatgagctgcagttgtgctgccacatttttagacccggttttgtctcaaaactaagataaatcttttcttcttacatgaaaatagatagatgctccctatcctctttttcagttttaccttttctaaaaaaagaaacatctaccgcgacctcttgtttttagagataacaatgccaaattataaacacaaatcgcggtttggataggtctactactaatacaactttgtcactccggatcttaaaccttatctgtggtcatgtggtggggtcgagccgaaccgaaccgagccgagcaagctccatcgatcggccgcctcgtcgcatcaaattccaaaaaccctccgcgagctccgacgacgcggccgccatggacggcagcgacgacgagtgctgctactactacgacgccgtcgacagcgatggggacgaggaggaggaggaggagataataatgctggacgaggacgacgtaggcttgctcgacggcgccgcgctgccgccgccggaggaggaggtggagcaccgcgcgatttgctgggtgagttctatctataataccctagcctatatatctcccgttctctctcgggtgggaattaaaaccctgcagttcttgtgattgaacttggcactatgatcgatcgagttccgatattgggggagggatcgcctactgggtttagttaattcctttggaattccaaccaatgtgaccaagttaattttcatcatatattaattattgataacagcagttgattgtatcgatttggttgagagaatttgcagccctttgctgggtctctttcaatctttgatttcagtagtaagaattatttgatacacttctgaaagaaaaatgttctaaacaaaatagttgattcacttctgaaagaaaaatgttctaaacaaaatagttgattgaatcaaattcgcatcttccactgcaagccatggtcttttgtgaaagtaaatggtccgtttatacaagaatattgcattgtttcaataattgttacttatgagagttagttttagctatattttatcctgttccaaaataattgttactggatatatcatatttaaactctgattacttgtattcttcaaaaataaatataaatgcttaaaaaatgtcgtattatcaaagtgtgttgtaccacaaacataagctttaagctttcgtccactgtagtctaatcatttaaaagttgttaatggtcaaaatttaataataagtactatttgggcatgaagtattatcttttctttttattaaagaaaatattcacctcgagaagaaggctgcactaatcaagtaccctgtttttgcaggccattacaaaagaatcccttgcagctgcgcaggtaatgatgaggttgagcaataatcagtcatttcaatatattcatagtttcagattctgtccaaaatctcaacacactgttcttaaattttgctgctatatcaatacatctacaggagcaagacctgtccatggtgatgaacctggtgaacgttgagcggcacaacgcgcgcgccctcctcgcccaccaccggtggaagatggagcgcatctacgaccgcctcgacatgatgggccgggacgccttgctcagggacgccggcgtcgttgtgctgccggagaagagcagcagcagcggcagcagcatggccatggcgaagacgaaccccccgggaagcgtggctgtcacctgcaacgtctgctttgaggagtacccactcggctctgtctccgccatggattgtggccactgcttctgcaatgactgtgagttgtgcccaatgttcatctcttgaatgatgcttcctccgtttcacaatgtaagtcattctagcattg

SEQ ID NO: 67388 - DNA, 2669 bp, Oryza sativa
caatgacctacattgtgaaacggagagagtactatgttattttaaaaatgtatgacacgttagaattttccgcacaacgtttgatcatttgttttattcaataatttagtataaacatataaaactaatcgatgacaaaagaagtcagaacaaaataaatgatatttatataatttttaaataagatagatagtcaaatattatgtgaaaaattaaatccgtcgtatatatatttttgaacgaagcatttcatttttcgcataatgttttaccatctatcttatttgatttttcggatatatatttttgaaatgggggagtatttgttggtagtaaatgagaaagatttgatgatctttttttttttgcaattttgttcgatcaggttggacggagtacttcgctgcggcggtgagcgacggcagcaagcagatgaggtgcatggaggtgaagtgcacggcgatctgcgacgaggcggtggtgcggctgctgctgcacgggaagcaccccggcgcggcggcgcggctggaccgccgcctcctggaggcgtgcgtggaggccagcgacgcggtgcggtggtgccccagcgcgccgcactgcgggcgcgccatccgggtggacggcgggggcggcggcgaggagcggtacgccgaggtgtcgtgcccctgcggcgccgtcttctgcttccgctgcggcggcggcgcgcactcgccgtgcccgtgccccatgtgggacaagtggggcgccatgcgcggcggcggcgaggtcgacaacctcaagtggatcgtcgccaacaccaagagctgccccaagtgctccaagcccatcgagaagaacggcggctgcaaccatgtcacttgcacctgcggccagcatctctggtgagctcgacacgacatctatcgattctccatgagattgatgtcacgccattgttggatggatgcagctacgcgtgcggcgcggcgacggggacgttgtacatgcacatctgcaaccgctacaaggaggagggcggcggcggcggcgtgaaggtggagatgaccgccggtgggcggcagcggctgcggttcatgcactactacgagcggttcgagatccacaccgagtcgtacaaggaggagcaggggaagctgggtccggccatcgacgctctggcgcggcggctggaggcggacgccacgctgccgtggtcgggcaccagggacgcccggtggccgtcggcggcgcaccggcggctgctgcggtgccggcaggtgctcccgcggtcgtacgtgctcgcctactacatgttcggcggcggcgcggcgacgcggcgcgagcgggaggaggcggcggcgcaaaaccggttcgaggatttgcaggggcagctggagcaccacgtggaggtgctgtccaggacgctggcggcggcggcgcggccggccgacgcggcggaggtcgtgaaggcgaagcgcgacgccgacaacctcgcccgcgtcgtcgaggggctgtgcgccgggatgtaccggtgcgtccaggacgagctgctgccgctgctcgtcgagcccatgaacatcgccgcgtaccatccggacggcccggccatggccaaggagttcccgccggcgaccagcgtgaccggcggagcaccgccggcgacacgccactaagccacaacgtgtcgagttcattattactatacgaagcaaggttgtaaacggtcgatgggtgaagggaagcaggtggttttgggaaaaattctattgtccaaacatgtttgtggtttggcatggtggatttttggattaattactagctaagtagtataggaaatatcctatattgatacagaggaaatgatggattattttgtgctgattaattagtctaattgttcgacgttgtgcaacgtttctggataacttttcagtatacgaacacttcaaatgatcagacctctcaataatttgcagccaaccaaacgggtccaacttcatcttaaagaccctatcctatgttgtttgtggtctgtttataggaagtcggagctgctcttgagagcttggtttgtttataggaagtcggagctgctcttggtagcttggcaacgatgacctttgttttatcctccagttgtaccgtcgcaagtttttagttttttctccgtgtgggttttgctcggtttcccccttcaaaccgtgcttaagtgagttttttgggtccggtttcccttaaaaaactgggccaagtctcttattcttaattgaaaacaggctctccctatcctcttttgaggtttttccaaaaaaaaacaattgtcggtgacacataaatttggagatatgaaaacaaagtgcacgaatggtaattaacacacgtagattttgagatatcaatgtaaacttttttttaagaaaaaaagaggaacaactacagatgacacaaatacatttggggatgtgaacgtaaactgaaaaaagaaatagcacaaacatggtgagaaaagttaggaaaattgacaaccacgatgagaaaaatgtaagtaaataggaagaacatggaggtttggagatatgaacataaaccggaaaaaatagcataaacatgatgagaaaaggtaagtaaatagaaataagatgaatctagagatttgatggatgatgacaacaatcaagaactaggccacc

SEQ ID NO: 67389 - DNA, 4898 bp, Oryza sativa
caaacaccacatgtagcaggcccaaggaacaagacaatgtgctaacaagatggggcttgacatcttgataagttggccaattatccaatagttttattttatactgttgaagattttccccctaaaacttttgcatttttagatcgttcgaatgtactttgagattcatacggggagggaaaaaaatctacgctatgagcgaggcgggattggagcagctgatctcatgggcgaaagaggagtgcaactagctaacctagctacatgtgtttcatatctatcttatatgttatatatacgtcgcattgtaaccacactagagttgcattgtaattatactagaattacattaaagttacatttgaaagatttggtagatttttatgttgaaagttgtataagtaatccttatctaaatagcacacgaccaacttatccatataacatcatttttttgcaagggaaaaaaaatcatattttcatccaaattccgtactaattattaacatatgccaaattttaaagaaaacatataccaaatctttatccaatcaaatttacgaatttacaattgaagcaaactaacaacatccgatcagttttcgtccctacttctatattactataatataagatgacaaagtagtagttgtattctcaatttatacatggcataggcttgtaatttcttacaaactcctagggcaaaggctatgaaagatgcagaagcggggcctttgcccaacttaaattgatgggactgggcctagctaactgactaggcctagttgggctttccgaaagcgccccacatatcgggcccatcaagcaacgttggcccatcacatcacgtatttcaattcgtatttcttcagggactcggatgtaaaaaccgacccagccaagcctcctcacccccacctgtcgtcccgtccccaagagagattcgtctcgtcgccgtctagggttttagccgccgccgccgccgccgcgaaaccctcgccgcctcgcctcgcctcgcagcggagtcaggatgttcctcggcgcgatcccgcggcggccgagcaaggaggtggcgtacaagcagctgcgctcccacctcatcgtcatggcctcctgcgttgccgccatccgcgccgccccctacatcctccacttcctcaaccgcgacgcggaccgcctcgagctcaccctggagctctaggccgtaaccatcccccgtcccccgctaggtgagacacccgcttctccctcctctcctcctctttgattggtttaattcgggattggtttagttgggggtgaaactcctctttgattcgggacggaactcgcgatcccgttggagaaaccgtgcggagatcctgtgcatgcttatgctattagatatttacccttgccctaatgatctatttcgaatgagttttgcacggttaggttcatgcttatttattgcacaaacgatttttaactatggttgatgcacctcgtataaatcttgtatggtgggtattcagggttatggtactgtaatgctgggttgcttacttgctttaaacaccactgttttgaagaagctttctaattgttgaatgctgtggagaggatctggtagagttaaatggattggtattgcattggaaataataggatccagtatgctgatctatattcttgtagtattaaatttgtgcaccttgtttagataataattcctgtttagatttggttttttaaagaatatttgggttctgtgagtcattgggctatcgttggtgattcgttttctttcttcatggtactatctgccatctttagatgccaattcttttttcaattggataatttattattttttctgcacataacccttgctggatttgatgcactcgaaaacggatggcctaccagtgtgctgtaaatcagtagcatcttccatctattgacaacttcagagttcatatgcatttgttcatattatcgcgcaaactagactcatgtctcagccaaacactgtattggtcaaaagctgttttcaaatttcttgtcaaaacaaagttcatatatgatgtaacagaagaataactttaaattttgttttcctaaaaaaatcccacccaaaacatattatgtgacaagtcattaacaatccttgcaaaccgacttgactgaaaggattaagctatcttttgataatgttagcgcttctgtttctataggaatttctcttggtatggtcctcaaagttgaactttgacgatagacttacggaaatgcatttctaatactacagaaccgtgatttcacaaaattactttcgattttcgaatggatctaattgttccacttttatatcactagttgtttaatctatatatgtaataagacttaactattggtaaaaatatgcattaattgaatattgagatatgtgcatgcttattagtattttttacctttagttgatttacattcttattgtgccacggattcttatgtttatgatcaattagtgtgcagtttgattgataattatagtagtctttatgtatcggcatcagctttgggtcacatttgtaatgttaatgtaatgcactcctggttttgcagtgttcctgttctatttggtgtgttgtttttcccccaattgatttagaattaatatcgatatattcagtatgttttcaaatttcaccaattatctttgctgaataacgataggctatatcttgtggttttatggatttaatatgttctaaattttaatttttctagctggtcaatgtgtaaacccgtgcaatatgttcgtaatggtacttctactcctgtttggctactatggcagcagattacatacaaaaacatatcagtcttttaagtaggaagaaactagagtatttttaagttggaactggaatacgtgttccaacttccaagcgtgtctagtttgcacccggctactaactaagcctactatatgcctgctgaactttttaaacagtgaggttcattattcagtcacaagtcatcataacctaatgggccttgttgaaactgtttctctgttcactagcaactcaatcaatagttgaaccgttgatgtgctcagtgagtttgttcttgtatctggcattggaatccatcattcgacccagtttttttttataaatgatctgttaaaataaactaccctatattaaatctgcattattttttggttccattgtgggaacttttgtggctaaatgggttgatagcatgttgctattttttcacctaattacaaatgagcctcacactgatttgtttctgattcttgttaggtgctgcagcgatggacgaatcatcttcgccttagtgttccatggatggttgcaaagctatgtttggataggatttttgcagaccttataaaacttaatcctattatttttgcttgagaggcatttagctttctgtacgataactcaatggcagcactcctcgacttatctgttctttaagtttgcagtctttgcaataggcattgtgtttcctattgtgcttatattttaactggctatggagtgatttctgctattttacttgaggatagtttagaaaaacaagactgagccatggttaaacaagcaagttaagatacatggttcggaaaagctttctaagcaatttcataattgttttgagggaagttcactaaacgttttggaaattacggtgagcgtaaaatgcatgtgctggcaatatgtttgtcctctaatctgatctggaccctcggttgattgaaaccatcttgcatgtcgtggatacgaggctttgttaccaacagttaaaatagcaacaagagttcaagatcatgaatgaaccttttcccttctcttcttgtgcttgtttttatcgtccctggcagcacggcttctaccggaaatgcttaccatgcaaggtggtttataagcatgcaatgctgtttcaaaattaaaacatttttttattaaattatttatccaaattctaaactaattatatttttggatttcgttacaactaaatctttataacaatatatcacatgactatattatgacaatttttttttaactttttaaatgttgcatatgtaacgtttcaatttattgatgtttcactaatgcatttgcaatgttgcatgttatctttttatttgtttcagaaaatattttttttatgtctcaataattacagtttgatgtttcaagctaaatgtaaatttgttaacaaaatcaaatattccaaaatgcttatagtcatacatacgacgcaatcacataaatcggacgcctccactccatgctactagtatattaaatagatgctcatagccatagcctcatgtatgatgatgcatatgcttaaaatgatgttttctttaaatgatgttttcttttatgttacatatcaatgatctaattatatcattatattcgttataattaaatctttatcacaaggatcttacttattatattctaattattttttaacataatttttaatgttgcgtatatttttatttagatgtttcaataagcatttttttaatgtttcactattcatttataaatgttgcacacaaacttttttttgtttcgtactgtctacaaaatgttttagcaaaattaattattgttgtgaatatattgtatgtttgacatgccttttttaaaatgctttactagttgggactaaatgtttcatgagtgattattgatgttgcattgtatatctttgaaacacatctgatcaaatgatgaaacaattcttttataagcggtgaaacaacactcaaaaatttcattcaaaatataaccatatgatatcttattgccaagatttaattgtaactaatataacaatgtaat

SEQ ID NO: 67390 - DNA, 9079 bp, Oryza sativa
  unsure (1)..(9079): unsure at all n locations
aggggcggtgccatggggcaatcgcgcgggattgatgtggtctcccggattggtcgcacgacaccggcgcggtgccacggtctgctggcgcagcaccaacactattttagacataatcggttccacgtaacgatgccgtgggaccgtctcggtgctatgtggtctcgctggccaccacgctgccacactcttggtccgtgagaccatggcggttccgctcgtctgctcagcgggaacggctcgagcggcgctcccacgtattcgatctgtgggatgcgtatatttgtgccatttcttcctatgaagatatataaactcaaattattaaaaaaatgggtatattctcaattttttttctctatcttttctgattgtatatttgttccttgtacttcacgctgttttaacttggagaatgattagtttatgatgagaaaaatgctaattgtatattaagcaagaacagacagcactctgttgaggaaattctcagcttggagttaattagacttgaggacacctcaatgttgtaaatgtcccacaattacttccaattcctgtacaccacattttttacgaactgttccttgttattcaatttttgcacattagtctaacgtactgctatgtttctctttggccttcttaaaatattaaacgaaaatgcccaggataaattgtaccaacattatgccactccaagctaatcgtataattaaccgtgtgaacaatttaaacttgcaaagtgttctgttataataatgcaaagagctccaacagaagaagaacaatacatttgttttgagcaataacattagaggcttaagtagcggcttaagggtgttttacactttcccaacttttattttctcgttttctatataaaaaatgttttattacctccgttttatattataagtcgtttgatttttttcgaagtcaaacttggttatgtttgaccacgtttatagaaaactttcgtaacatatataaagtatcaaattgtttttattaaatctatcattgaatatattttaacaatacgtttattttgtgttaaaaaaccactatatttttctataaatctggtcaaacttaaaaaaaattcgagtagaaaaaaagtcaaatgatttataatatgaaactgagagatcactaattatttacgcatcaattcgtcatttctttttattggtcggtgaggaaaaactcgagcatgtgagcatatgcaaacaaaatttaagcatcgggtttttccctgtgtgctattaagaaagatggtgtctacctccgtgccactaaaaagttcaagcctccttctctatcatcgttgaactttatcgagccctccacactactctctcttctccctcgattcccctctctccgcaacatccgcgtctgcctcactcctggccagcgcctagctgagcgtggccgagccgctggacgcctgcaccgccatgctggcctccccttccctcgttgccgccgtctccgccgtctctgccgagccaagcggacagcgctgctggccacccctccaaccggcgttcgacctcctcctttgcccggcgctgctttggctcgtgcaccccgacggcttccgtcgccgccgtgccggccttcccctatcctcctcgatgccgcagggccaccttcatgccgcagccgcgcagggccgatcggcgcctggccgccacccagccggggcaccgcgccgccatcgcctcgacccggtcgctggctgcgccgccgcccctagcctcgccgctgcactgggccgcccccgaatggttgccctccgaatggcacacaaggaaacaaacttcattaaatgtcctctcaagcctaagggcaactaagttatttggctgcgccgttacccaccgttacgactaaaaatggacgaaataatgtggagggcgtgataaaatttgatgatagtagagagagaggctcaacttttttttaatggcacaccatctcaccatctgccctttcttaatggcaaacaagggaaaaacctccaactctgtgctgtacaacggctaaatattcgagaaaacccctcatattattatgaactgaaacacaaacttcgtcggcagctgaggcgcgatgcgtggcggcgcgccacaactggagcggccctcccctgagcctgaggggcagaggtgggctagctggagcctggaggtggcagcggccgccgcgcactcgcaactactcacaagccgcctcggccccctaatcttccgcgagaagaacgcggagtagcagcagcagaggcgtgcggggtcggtggactcggtgctaacggagcaacctttctgctgggtaatactaagttcttgccaactctaatatcgcctgcaaccgttcttagctatgggttgccgccgcaacggcctaaatcggttagatcaaaataatccatctttagcgatgaggcagatttattattttaacacattgaaatcacatcacatggtactgtactagtattattgattgatacacttgtgatgtcatgccagtaataatgctgtaatggtaaaacagagggatctaaaagcatttgactgaacaagaacagtaggatcaatctttgtgcatgccttctgggatcagtactgattgatgctgaacctttctgctgtttcttgtgctatgtatgccttgatgcagtgataagagcataagacctcttctcctgtgagcagaagcaaagcaccggggattgattctggcacaggcatataatgcagtaatatgcctcaagacagatcatctcctttcggtgctttgaaattttttcgccaaccagcaggtgcgtgcaaataccgatttgcttctcctgctagtctgcaagcagacagccattaaacaattgcacatgcctaaatcagaagcaagccatttgattgggaactccatcaaaacaatgacaagaagattctggtcctcacatcatgggagcactaagctatgtcactgtcactattctggaaatttctcaaggtatttgatagctatcgcgatttctgtaggccttccagactctgttggaggagttttatcaggacctgtgtcaaatgtggcaacaaggtggtactttggtatttggtagaaatttatattgaaatgatgggggaggatcggcattctaatttgggctgtgtttagttcgtgtgccaaattttttttgaagtatacggacacacatttgaagtattaaacgtagactaataacaaaacaaattacagattccgcctgtaaactgcgagacgaatctattaagcctaattaatccgtcattagcaaatgtttactgtagcaccaccttgtcaaatgaggctaaaaaaatttgtctcgtgatttacatgcaaactgtgcaatcggttttttttttcgtccacatttaatgctccatgcatgtgtccaaacatttgatgtgacggaaaagttggaagtttgaatctaaacaaggcctttggttcaaatgtgaaacttcaggaagaaattgagacccgtgcattccccaaaggtgcttctccattacagcacatggtcaacaacattacttgctgtaggaaatgaccttatcatcatgcacactggtggtcctattcatatatctagtctctttcgcagttcccctaatttttggactgaagttatagccttgtaatgatgtgatgaacaatgagattgcgctgtcacatcaagggaaccccagtccctactaatgtaatccacataggtcaaatggtggttaatttggcactcttcttgtaccttccgagccatgttgaaagttccacagaaatattgggccatccaagtagtttctgaaagcaacatgaagaccagaagcatctatattagaacttgatcacttctcttcagcctgctctgggttgctgaaagaagttcttgtttcttagagaactttgaattttctgaagataacagtaaagaaagggctcctttcgcaatcttcacataaggggagggttcagtaacaagttgagatatgggaaactgcgccagctttactccaaaatggtatacatctgatctcgctaaaggtttcctgtcatactattgcctcgcatcttttgatatgcttacttctgtttatctctgtgtttctcaggggattaagtgatcttcactgtaagggtatggttccaattgatgaggatgaaactcacgaaggcataaagacaattaggattcagaaagcctgtgaattcaccaccagttcagttctttgcgtctgcattatcacctggaacatgaacggcaaggtgcatataatttacttcatttcattcttctagatgatgactgcgccattttctttgatctgatattcattgtttgtgaagatgtctgtggaggatgtaacaaagttagtgagctccaacaggaagtttgatttgctagttttcgggttgcaagaggtaccaaaatgtgatgttgcacaggttctgcaagaaaccatggctgagacacacatgtgaggacctttccgtttcaactcctcaattgaatacttggaaggctttcattgtattttaatatagtttaatggttgtcaaattttagtctattatgccagaaaaccatgcagtctcttcagatgtttctttttggagcaaagagttcagagaaatacatcagaggtgattccatatttgttcagcacttgaacctgtacatacatacatatggccagatgctgttcatgtaaaagtatctttttctttgagtgactaaaatttgtttaatttcctaattttgcatagagttgaaggtggacaaacatgcagttggaggttgtggaggtataattggaagaaagaaaggagctgtagccatgtacatcaatttcagtggatccgtatgtttttgtatcctgccatcttgcaggtttccttttcagctttggataatttcattttctcagtgtcacttatactactaaatatgtgccaatgctgatgtcctttttgttatcgcttaaccattcaactgtgccattgctacacagtatcaaatggaactaaagtagaactgttttacaattccctttgctgaatcacttggatcaaaagatatttgatgatcaaaggatatcttgacaccataaactaccatctgcttatactgatgacaagttgttgctaatttgccatgaatcaaatgccattacaaacaactaacaggatcttgctgaagtgtagctcatgaaaataaggtggagaagaggaactcagaatgccagcacatttcacactcactgttctccaagaatgatatacagtatactaaatctgcagacataacggtgtggcttggtgacttgaattacagactacagggaataagctcaataccagcaaggaagttgattgaagagaatcgtcaaagtgtaagtgtatgctgaaattacatatttttgcaccaggacgcctcatatattatatgtattaattatttcagaagctaagaggcaaagaccagcttctgcaagaagctgaaaagggtgaagtattcaatgggtactgcgaaggaccttgttgtttaagccaacgtacaagtataacatagggagtagcaactacgatacaagttataaggtatctctagttatatcatttgtgaatctaaaatggcaagctgcagatctctttcaattgtggatattttccacaatatctaatggtttgatcttcacttgcacagatcagagttccttcttggacagataggatattattcaaagttgaccacacttctggcttggatgcggtcttaaactcatacgaagcacttgattgcattaagagttctgatcacaagcctgtgagagcccatctttgtctgaaagtacatggtgacagtgcatagatagacatttccagattaaaaaaaaggagaaatataatttaaaatgattaatttgtacaattgtgtataacccggtgatgataataaagtatggtggtgtatctgactatctgctatgctgagcaagaccaactgaccacatgaggcatggttaagcttaagcagtactgactactgaactatttctttcctagttgcaatagccaacatatgcagctcatgtaaaacctgtcgacatgcatgtttctgatactgttctttcctccttccgtacgtctgatgtagaagacttctgcaagttgcaatgcataattgtgctgtaaatatgcagcatagagagtctccataacgtatggaggttactgaagtgtgtttcaagttacagttgtgatggagtatagtgaagtagtatttggagagtggagaatggggttgacttgtggagcaaaataatgcagttccagagttcacttctaggatggtacagagggaaattgtatctgaaaaaagagaagcataaatgtttcagaaacaccatgccttaattcttgcatgatgttaatacatattcttgctaaaatcagtgtttcctttgctgattggttcaaggacagtatggttaataatggtttaacactcaaaaaatggaatcatccctactatagacagtcttggtgttcctttcagcaagtgcttgtcacagttgcgtcggttaggatgcatcttctcaagctagggtgcgtgatccttcaattttggcagcttgtctactactagaaagaggttatacatcttttgtctggcctctggccttatctttcattcactgtttttctgtacttcttttcttgagatgaattgatcttttttttttggtaaaacttgatgaggtgatacttattgatggagatgaagagaaaacatagtagaaaattgtcagatgccaagagcccaagagaatagaacacatggtgatttggctaggattatgtccatatggagcacttcatgataattctagtcatcatcatcatatattgaaaatgatagttttaattgaatattgtgggtgaaaatgtgaaccataggcccatagctaactaacgaaatgcgttgtgtatgtgagcacttgtgattaagctaattaattaggcattgcatctcccgtccatttgacgccttcaaatctactttcgcaaatagcaccttacaacttgtaacatatttgcatcgtcgtagctgttcgtcagttccagtcttgcagaatccaaattcaaagtttgtacagataaacctttttgcaattgtttccctgccatgaggagaacctgctggcatctggtaagagccattttaaatccagctgataaaagtttgtaagttgtttgattaatagatttttaagtctggttataagtatactaatcctttcagcttgtaatatttgacattattaacttttagacatagtttgattattcattttattcaaaaatgtgtgcaattatgtaatagtacaagtcatgcttagattattggtaatgataaaataaatcacatcaaataatagttgtgtagtaatttattaaagcttggccaacccacaacaacaaactgccaacataatccaaatcggtgatgtggcgtttccaactctttgctaatcatcgatgagcctagcagctgccaagtgcaaccaggctcgagcgccggtggtgtttagctaacactatctatttcaaaagggaagactagatagtatcggtagagccaggaacattaaaaaaaatgttaggcgccgatagtattgatattgttttaagaattttctttgttctagtaaatacaacaaaaaatttcaaaccatgggacaggccaagctcatggtcgcctctccttgtctttgccgatgctaggtagcaagtgagttggcttagttacaaacatccattgatggcttgttttgcaaatgagattatgaactaaagggtaaggttcaataatatccatccattatttttattgggcttcccctaatacatgagtgatcgtgcacatcaagatacgtgattaggaaacgacaaaaaacagcccaccctagcctatgtcactggcctaactcatatgctctctctttctcttttcctatcctcttcttctccgccacaaaaggaaggcgagcttacgacgatacaacaaggaggttgatcaaggcaacgcggcgacgaccttccttgccccttcattttccctccagcaaactctagatctaggtnagctccactctcccacctcctccgccgccctaccatccttctccgtctcacttttgcccccgccacaaactctagtctactgcccgctaccaacccagtggctcgcggccgcccacccttgttcgtcacccaccgtcggtctgctgcctcctaggtaatccctcttaagcttgatccccacttccttcctcctcaaatctcacccataaaactctaatcctaatccaacctagctgcttctcgccacacagtcgaaaagtgatcgtgtgcgcgactgatcgcgaggtaacattttaacttttagctcatatataataatccactcattcacattttccaatcccatcccttataagttataacccattgccaaagagggcctaaatagatttctttagccatttaaaaaattctcaaatttccaggactgtgagcccctttctgtaaaatcaccgagaaggcctcgatgaagaagaaaaagggaagaaagagagcgacctctcaccgtcgctccaaaaaaccacatcactattcacaacagccgcgggaaggtattaaaatcgagagcgcccaaccaccgctgctctctccctctctctgctgcatccgcccacgaggtgttcgacggaatgcgtgagagagacgccgcagcgggcgccacccctccccccatgtgggcctcctccctactccctcttccccctggccacgcgcgggaggggacggggggttgacgtcccgcgacagcgacccgggcggtgggcgagggggagtgtggtgtgtggcgtgggagagagagagagatgtcaccttcaaccccagtttttcctctttccttctcttttcttcttgacttggcctactgccggtcgtccctccc

SEQ ID NO: 67391 - DNA, 1463 bp, Oryza sativa
gcgtccatgtcacgctttcccttcgttctgtttctctctcctcctcctcctcctcctcctcttcttcttcttgttcgtcgggttcttgcgtgaggcctgcttggggggatcctcgggcttcttgtcgcaagaaaccaaggaggaggctttagccgaattacagggctacttggtgagtcttttggtgatcctcaggcaaattatggtgatccttagttgttttctgtagaacttggggggataatgatggcgttttgcggtgaattggtgaattgtgtactttgtaccagctggttgctgtgtggggactggcataatgacttttgtttctgttaaaaagtacaggagttcaggcttgaaagtggtggccaggtggggttgccctgatgccttcaatgatctgattgtttctatgcggtccctgtggttctgaactcgaggtatttttttttcctccagtgatatttgcttttccttttttttttccttcgatactgcttgcatctgtgttgttaaaagttccatttttcatactctttattgtccgttttgtcttcgttagtatctgctcattggcatcatctgtgttcaatgattgtttgactcatgactcttttatgtgctttaccatgatttcaagatcctctctagcttttcgaggcctcctcatggaacaaatgtttacattgatcattcaatttatctattgtctttgctaatttgttactactaacaagagcaatattgacgcatcatactgtaatggcatcacaaaaatgtaaaattgctaccagcgggtaccacatagcctgagcaactgtttttttgcaggacccgggtctggattttgtggaatttgctgttgtcagaggttcgtgtgtattgcttgtgttggtccttttcctttattggctcggaggaataccaatcatagggagatatgccaaagagactggacatgtaatgtgattggttgctggtcattttagttcatataagagcattccacattacattttcatttccatctgtatttttctgacttctcacatacctggccttttcaaggcaagaaagcaattttatttttaactggatcctgtcatggataatttattccttaccgccaatgtccaccaatttatagaggtttatatcttcactatgtgcttgcatgccaacaattttacctttttaccagtttggaggcacaccaagccaatatctaatcagataaatgaatatttgatatcctgttctgtatgtagttgatattctgtttcaaaacaaaagagcacatgcttgaagcacccagtaaattatacatgtgatgggcagatggggcagacactgtagggatttttatctacatattgtctcttaccaaatacatgctattgcagtcttcttatttatgagtactatatacatgttattgcacaatttcaatatgtatttacaga

SEQ ID NO: 67392 - DNA, 1970 bp, Oryza sativa
  unsure (1)..(1970): unsure at all n locations
gtcggaggtaagcatgcatcatctcatgagccagaatggagccagttaacagtctgcatgtaatcaaaataatggaaatgaaaatctatgcattcaggacaaataacttctcntaagttggtaggccagttgcataatcaacgccaataacaaggggaaaaacgaaaaataatagtaaatgcagtataatagtactcattagttagatcgataaaacatgaaaataattcaatataccttggaaggccatataggataagaattgcagtcacttcacagcgtctaaccagtttgtatggtcctgtaatcatgtctacaatcttgtttcctggtccaattactggtcttcttagtatctgcatatattatgttatttagccataagccaggtatcaagttcacatattcaatagataactaaagcaaggcattatttttaagaacgtacagttcggacaatttgctcttcagataggcagagacctctggtttcagcaaggtgatgtccctattaaggaggtcaaaggaacaataagttaaataatgtacattactgttagaatattataaaatgatcatttcacttacagttttctcggcctccatggcttcatttaaagcttgtcgctcaaccaacagcaagggaatttgttgttccactttcatgttcaaaccctcatagaattcttgaatatcaatatatagtggttggcattcgtctgtgtccattattgaagtattcaggcattccaaacagagtttccggccatcatctaatgttatgtacttactatcctttggctagcattgagattaaacaaaagaaaagaagggaagtcattagattcaccaattcataattaaaatacgttttcactacgaatggacattgctatgaaatcatcaaatgcatgtgcataggcacatattgaaaacaaacacatttaaattgtaagggtgatttcgaaaaaaaatttgtaagggtggtaacagaagctacatgccaaacttctattttttttgttgagggaacatgccgaagtgttagttacatcctgacacttccatttgaatcactacatgtataacttttttataggatagcacaaacctccattcgttcacaactgcagcacctaggagtacgatcagtttcatgggcaggacaatacttctgcatccagaaaggatgggcccgatattcaatgtggccatctttgtttgttggaatctgatcatcaaatgtcattagcacaactcaacagataaagttaaaaagtagctattactaaattctcatgctcatccaacatgaattcttacaaagttcttgcagacatcacattttggatggaaaagctccttatagcaggatcgatggtatgggttaccttcatgaactgcaaacttcccaaatgaatggataatgtcagttatctcatttacttaaagcatgttatgttgaaatatgctaggtctctttacctcatattctgatattggcctatcacaagcaaaacacctgaagcactgggggtgccaaacagaatccatgcaactaagaaaccgtccttgaccgattggagttttacatccagcacaaaccctacaccgtcaatgtggtacatgagaatcagagaaccctaagggttccaccgcatgcactagaacagggtgagaacccaagtagaacagacatgaagaagataccagttaaaactatgaatgcgtttataattttcatacccataccctacccaatcaagatgattataagatagtacatatattcagtgctaataatttgggttcacaattccacaacgtaatttttgaatttcaggtctactagcaggtcttccagtaggacatttttccggtcgagaatttcgaattttgttgggaatttagaaaaaacaatcgatcatattcagcaagaaattgttcaaaattctagattgctaactcaa

SEQ ID NO: 67393 - DNA, 1151 bp, Oryza sativa
cctaaaattgtaaatatgtgatgcactctggataaatcataccaatttattcatagattttttaggcatatgttaatatagctataaattaaaatggagaagacgataagttttttttattatatgtttatttgggttttatcaaaaaaaataccaagttgatatatctcttagtttactttagccccaccttaattaatttatatcctggattcgccactgggctagtaacatactaacatggttcacataatttagcgcgcacacaagttgtactacatacatagtgccgatcagtcaaatggaagagtttaaacaaaacggaataagaatagcaaaatatataagttcttaggcatgcccatataccaaaccgtcacaagcaactgactaggaatcaccctagaaagaaccttcctcgaaacctccggtacctagtacaaagtactcctcactaaacatctcatttcttgtatcaatgcctaaaaactgattagtagaaactgatttctcacatgtttacatgtttatctcagcagagacccgtgctgataatatgttaggaaattggtctattctaccaatcagcacacaagaaagcaaatatagagctttggaacgcagaagtaggaacgagttcacactttatttcttcttggatctgagtacggaaggagacaggagatatccgagagggttgacctatccctggaccttctgggttctatttataggcagagaaggttgacggcttccgtcttaagcttgcttccgcggcaagcttgcttacaccctaagcttccttccatgctaagttatcttctcgtagtaagctttccactaattcctttaatttgtccacgtaaaacatgtttcgtaacaatcagagccaagtatgtgaattaagccatgtaagtatgcgaaccttgtatataggcaactctaagtagttgtgtgagttgcagagagtataactatatctcgtagattgggattattctgaaacgcgactacccaggctgccaggcacgaccttgacgatgatggtagaattattcatatccgttgtgcactccattgaacacacatataatagatttatactgtaaaaatatattcaatgaactaatatgttactacatatattatat

SEQ ID NO: 67394 - DNA, 2895 bp, Oryza sativa
tgatacccagcgctttgctgcaggattcatcgattagtatatgttaaatattgtcaaaatgataaaagttgaaatgttaagaaaataatgtgaggaagatgatttgacacatacttgttgatatctataatataatattgtagatgatgtgttatgcttatatgagattttaataggctagaatagtaatttctactgagtgaagatgtggcatgcttgcatgagattttaaatggtctaaaatagtaattgctagtgggtgatgatgtggcatacttgtatgttgagctttcgtttttaataattgttagtgggtatcaactatatagaaagtatagattagcacagttatatagaaagtatagattagcacagttttcttttctttaggttccataatccatatattattaatttttccttggccgacaaacaaaacacaaccaaacgcaccgttgctcatagcaatggcccgaatacataattcaattccagcgcagttttcgccatcgattctgtcttgtctgaatatattacaagtcgttttcaattttgccgggggtgtacgtacgtagtaacgtactgtacggtctcattcccaggattcgaccaaatcgcggccaatcgatggaggtaactgcaaaatatatagagcgcacaaaaaaatcaaacctgcacggtcgattggagaatatatatgccaccatagccctttcctgatcgcactgcaacaacccgatttgattaattagctactagcaggatcgtacgattgatctgtccttttcacacgtgcgacccagccttgtttcctcactcagccgacacatccatccatcgatcagaagagaaaaattagtgccagtgcaatttatttgtatagaactagtctaattaatactgtagctagcctacgcgcttgtctgattgtgcattgtcttatccacttcggcagcagtggcagtataactaatgtgatgattagtactccctccctccgtttcaaaatgtttgacaccattaactttttagcacatatttgaccgttcgtcttattaaaaaaatttatgaaatatgtaaaactatatgtgtacatgaaagtatatttaacaatgaatcaaattatatgaaaaaaataaatgattacttaaattttttttcgaataagacgaatggtcaaacacgtactaaaaagtcaacggtgtcaaacattttgaaacggagggagtagtaagtagtataattatattgctgctgttagagaggcagctatagcttagtagctgctgttagagaggcagctatagcttagtagctctcgatggccatggccagtgccgggtcgccgttaatttcactgtgctggtggttgggaagtggttggagttggctggaattgaaacggtcgatcgatctcgacggcccccggccagcagctgacagctgcgttcctatgatcgaatcgatcgatcgaacgtgtggtctgatatgatcatggaagaagaatcgatcccagcaaataccttttcctgtcgtcgctgtcgcctgcgatattccttcccgtatcgtacgtcgctctcacctctctcacatatggccgtggttgttgcgaccctggaaattcatcagaacccccacgaggcaacgtaccttagctctagaaggagatcgatcagatgatgaggaggaagacgacgagcatgcgctgccactgatcgatcatcctatttgtttattgcgactgcctagcttgtcttcacgcacacatgtgcagtgtgcaaccggtatatataaaggtgtagcgggtgcctctgccatggacattagctagctcagctcagctcactgccactgccgctctgcctgccggcgatcgaggagaagaccggccggcggcgagctagcaggagagggctagtgatggaggaggggttgccgccggggttccggttccacccgacggacgaggagctggtgacgtactacctcgcccgcaaggtctccgacttcggcttcgccacccgcgccatcgccgacgtcgacctcaacaagtgcgagccatgggacctccccagtaagtctctagctaactcttcgatttcgatccccagtaagtgtgtttagctttaaaaacgagttttgaagggagaaattgtgagcatattgaggattgaacacggaacattcgcgggttgaaattgaagtgcatctctaaattgtgtttagctttgattcagcgagtaatataatatgcatgaatatgtcgtccattaatcattctttgatctgcaagttgattttaggggaaatgtaggctcttctgtgtccctttcggacttgttcaagaattcccttttgagaagaaatgccaaaggccctgcatgctttcatagaaagcagaagacttgttcaataattctctccttttaactctatacactttcttcgattaagctttttcttattctcagactcgttctttctgattggtgagaattgcattgccctctcgtacctttatagttgcacccgaaaattttaataaaatttctacacgtgcacttacattattatcgaattgtacgggtgtagtttagtggtcactggtgatcatatcactgcatgcatacactacaaatgcacacgtacaaatgaatgaattgatcaatcgttcttacacatgaacgcaatgttgatggatgtgatatgcaggcaaggcaagcatgggggagaaggagtggtacttcttcagcatgcgcgaccgcaagtacccgacggggatccgcaccaaccgcgccacggactccggctactggaagaccaccggcaaggacaaggagatcttccacggcggcgcgctcgccggcatgaagaagacgctggtgttctaccgcg

SEQ ID NO: 67395 - DNA, 3940 bp, Oryza sativa
gagtgggtcgtctgccgcgtcttcaagaagctccagtgccacctcgccaagccccgcccgccgcacgacgacgtcgacggagacggcgcctcgccgccggagatggtggacgcctcgtcgctcggcgagcttggcgagctcgacgtctcctccatcctcctcggcggcttcgcgccgccgtcgggcgagctctgccatggcggcggcggcggagacggtttcggcgcgcacaggcttcatgtcggcgcgtacatgagctggctgcaggcggcggcggcggccaaccagggcatgttccagtggccggcggccacgcaggcggggctggtcggaggcaccgtgttcgcggcggcgcacaaggcggcggggacgatgccgttcggcggcgggtgcagccagcagcaagcgcgggacgtgggcgtttctctggcgaacgtaggaggaggcgatgcgttgttcggcggggcgccgctggcgaaggtggacatggaatgcggcgagcaggcgccgcagctggacatggacgactccacatggagagccttctgaacatggccacgccaccatcaatttggataattattaagcaaaccatgcatacacgtattatatactcagttatatactagatgaagaattaatgtggtcgtcatccaagatatccacagtacagtacactacagtcagttattaattaattaatcaaaaatgaaagtgtagtgttgtcacctagaaaaaatgtgccgaaaatattttggtggagacggggccctcaagtttaatacaaagcagtaagtctattttgcatactcatcttttacccacgattgaatcgcatccttcaaccacaaaaccgggtataacgtctctcctaacttcgaaaaccgatgcaaatcgactcctttgatggttcgggaaacggcttttgctaacgtggcagaatgaccgcggtcaaaaccgtgagtcagcgcatgggcccacatgtcaatgaaatgtagcaatcatatgtggtagagcccacatgtcaattacatccttttatccttccctgtctctcccctttctctcccctgctgcggaagcggcactgatggagtcagcgaggagatctacagcgggcagcgacgaagacaacattgtggccgccggcgaattcacaatatcttggggacgacagcccatggctgattaagatgttgctatgattgcctgtcacctctgcaggttgcagcgagattgaggtggctggcgagggcggcggcgaggatgaggagggagaggagccacaacgaaagatgctgtagggaggtcaccatctccccattgccgggggtgggttcacctctaccaccagatcgaatctagatagggtaggagaggctacaggaacaggggtcctcccatgcccttggcctggctcccactccctcaccggctcgcccgctctgcctccctcgcacggagtcaaacatgcaacccccaccttctaacaccgccgcccatctctagagaggggaacgccaccagctgcccaccatcatccaagcgtttccttgggttcatcaccttgccaaccccatcgctcctatcccaccatggccgacgagttccttggggctcctcttcccgctgcccctgccctcagatcctccaccgttgcctgatgcatccagcaaacagggatgtgtctctggtcaccatgtttgtctcctcaccgcactccacaagggggacaggaggctccctgcagacggtgtcgagggtggcatggccagggcaccggggagctactccgccgcaaggcgatggatcggcagcaacaagatggagtgaacatcgactgttgcctacaaggggagagggggaggtgagggaaggagaaaagaatgtgtctgacatgtaggccctatgctgacttactggatttgaccacggtcaacccgtcacgtcagtgaaaactcctttccaaaatgctaaatgagtcgatttatactggtttttaaagttgggggagacgttatacccggttttacggtcgatggatgcaattcgatcgagggtaagataagagggaggaatgcaaatcgccacctcctcaaccgccttccacatgaggcaaaatgggctttcgcgcgcggctgcatcatgtatcatgggtggcctcgtggactgacagttgagatggcacgtaagtagattccattccttgtagcttgggcctggacctgggcccgttcctgggacggagaggcagcagagcacgcggcacgccccacaatcgacctcttaatccatcctcccctgtctcctcgcccatcgccctcgactcccgtctcctcacctgccgcctgcgcccgtctccatcctactagaagaggcggcggcggcgttctcctgcttccccccgcatcatcgctctcccgtactccatcccatccggcctcgaatcccgtctcctcgccctgccgcctgcgcccatctccgtcatgcgagctgaaggtggcgcccggcgtcctcctgcttcgtcgctcgccgcctcatcaggtattttctgttattcttcaagatacaacgttagatctgcctctgccctgctccaccaggggtgggcccagtagtaattcaagggtattcccaagatttttggacaaaaaaatatgtatatgtactctatactttgcatatgtattcaaacaaataaaaaagatgccttaaactaatcttgggccctattttaccattgggcccaaattttccactcccctccccctctcctctcacggcctgtttggcaagagaagggaagaggaatgggagtttcaaggagggagttgatggtgggattgatcatgggagttatatttttagtccccattctttgtttggtttcacatcgaattctctacaagtctcacgaattaacaggcctcccccaggtaagagattggtgggaattggacctcttaattttccatcccaaaccccatcgaattcctaagtcttccaaccaaactacaaacttaaactcccagatatcatagactcccattccccttcaccaactccctccaaccaaacaggccgtcagcccatactgagtttgggccacaactcagcccattcggctattcccctcccctaaccctaagactagaggcgggctggagcgtggaggcgggaggcgggcgcgtcggcgcgggcgtggctaggcggcagtaggcgacgcgtcggcggctcaggcgtgcgcccgcggcgtgtggtgccagtgcggctgcgagccggcgactgcggcgtgcgacgacgtctgcgagccgggccggcgactggggtgtgcggcgtgcatctgcgagccggcgtgaagcagggtcacgggcggcgcatggacgaccgttgaggcgtcgcccacagccggtcggcccctctcctcccgtcctctcccctcggcccttgcatgcctcctctcccctgtcctgtggccctatgctcccactggtcacgctgctgcggccgctccctcgcgccgtgctccgccgccgttgctaggccgtctcgccgatcatgcctgactcgattcaatcgattgccggaggtgaggtaacccttcaatcctcatcatttcccaattcgatgtaatttgttgcttgctcaactagtccaacaagacaagtatatactggatttgaacccaatttgttgtctaattttgtagactaaacaccaagggcctgttcactttggtgccattttcaaccttaccaaattttggtaaagttgtcaaaaaaagtggctacatttagtttgttgccaaattttggtaactatataataaatcctaccaaaattttgacaagttaccaaaattttggcatagttgccaaaattttggtgccaaaatttggtaaggttttttttggcatcaaagtgaacagcccacaaattt

SEQ ID NO: 67396 - DNA, 2046 bp, Oryza sativa
actcaagcaaagctgtagtttgtttattgtagtgcatggctacctaattttgtgcattaaccaatgaatttatgaaaatatgcttatagccattatatatattatataggttggaactgtacgaaactatacatacatatcatttattaggcttgatgttgtatttttttatcccttcctatttcgaataccccaacccaaaaatcctgggcccgccactctgctccacctacttccaagttgttgattttgatttttgcttttagcagatgtaatttggtgactgaatctcacgtcaataaattgtgaacaggcacattgcatccattcttgtgtactcatccaaacatccttagaatagttgcattagaatgaaaaaagtaagctctctcataattttgtatactcatccaaactcacataaatttcttagcaagagtcagaccacaaactactcatagtcacttaaattatctttttatcaaagaatattcttatttcacttcacaaaattttctagacatactttgtcacaaaattactttgtcatatttttataaattttaagtacaatctataaataaaaatttataaatataattttatatataattgataatataataaaatacaagttaaaattattaataagaaaaatattattaataacaatgatatttatgtatttataaatattttatcgaatatatttatatctattaatattaaaatatatttatctatttaaatacatgggtcatactattagtcgaacataaacatccttctcttcttgacaggtttttggattttggagtagcggtgtgaaaaaggattagatttctcattccctctcatttccttttccgactacacgaactagagattagatttctcccgccatacatatcctgtccctaacccaaatgcgtgatgtggccgccgcttgcagcgctgctccgtcgcctatcctctcacccgtttgactctcccgccatccacgctaaccttgtcaagtcctcctccatctccagccctatccctgccaccgccctcctcaccgcctacgccaatgcgggcctcccagccgcggcgtcccgtctgttcgacgaaatgcccacccgggatgccgtcgcctggaacgcgctcctcgcctgcctggtcttccatgctcggccctgcgccgccgtggccgccttccgtgacatggccaccgcggggttcacacccacggctacaaccctctgcaccatggccaaggcgtgtgccacgtctcgcgcccttcgtcctggccgtcaggtccacgcgcgcagcatcctcgcgtgtcaaggcgatgtcatcatggcaacaacgcttgtagatctctacatgagctgtggccttgttgaggaagcgctgaggctgtttatgtgcacggattgcccgaaggatgttgctctatacaatgctgttatttcaggttgtgtggagaatggcagattcagggaggcttctttattctggggaggattgagcttaatggaattacgctgacatgtgctctcactgcctgctcagcaacagcgaatttgatgtatggtatgcaggtgcattgcaaggctctccgtggtgggtttactttagagacgatcttatgcaatgcacttattgatatgtacgcaaaatgtgggcggacaacggctgctcgtatggtgtttgatcgaatggcttgcaggaatgtggtttcctggtccagtatgattgatgcttatagtcaccatgggcatggggaagcagcattagatttgtttaaaaggatggatgaaactgtaccagtggtcttgccaaacgccattacatttcttgctgttctttctgcttgtggacaatctggtcttgtggatgaaggcagagctatgtttcatttgatgaaaagacaatatgggattaatccgggaccagagcactatgcatgttttattgatttactaggccgtgcaggccagattgatgaggcatgggatctctattgtagtttcagtacaacccgaagtgagctttctggtt

SEQ ID NO: 67397 - DNA, 2493 bp, Oryza sativa
gagagacagacgaatgtacgtgattcggtcatacgaagtatttgttaattggtgtgttacggtatatgtacacgaagcttatgtggaaacagcttttgttaatcatcatagtacgaaacaaccatcccaagctaagaaaaggaacatgcaactatatattattaaccagaagaacagaagcaggttaatccggtcttgagaaatttattatcctaacaaggcacggagaaatcccataattacactgctccacgtcccagtcgtttcccgggtctagcattcggggtattgactacacgctgaatttagtgagcaggtcatcccgtcaagagagccttgcggatgacaaatagcaaaagaacatagattatttcatccataatggtgccccagcagacatcatagctgattcagtgatagagcttgcccagatcatctttgaatttggtctttatctgctccctcttcagtttaagtgcagctgtcaccagcccagactctggagtccatggttcaggcagcaacacaatctttgctggtatttcaaacttctcaagcctcgctgcttttgcagcctgcaccgttaaaacacattgcgttagatatcatggagaatgatggtatgtaattaacatgagtataaaaatcatactagtattatcatttgcaggttaagatcgccttagattacaagtacattaatcagcaatctgaatgacatcaaagacgatggattgcttataggaatcatctgtcatctccatcgcgatgcttttttaagtactttgtcatgcaaacataaactgtattgcactcatgtgatagcaaaatcctctgaaatccacagtaggtcggtctccttacattagtcacaggtcatctaatcgccaggttagtaaagacatacccatttcgtgtcataaatctgtgatgagctttggctataatcaggataacacagcagaaagatcaatgtgctactagttgttttcagttatgaagatactacaggctccaaataatttgaagaatacaatatgttcttcagcataattatatcctagtagttctataaacaagtctactgcatccatcttatctgttgttgtactcactgatgagcttgtaaaatccatcagcttttgcacttcacctatgttctttcataatttatatctttcaaatgtaatccagaaaatggcattgtctaatccatgaaatgaacccatttcaaattaaagatgataaaagaatttttaagtgctcctttggatattgggaaatattcctgcttcttctgggaaatgaactactacaataaaattcctgcattttaaaggagccttgaaattttaaattactttaaaaatagaaatgaaaacagtggggatttattgaatttctatgacatataaaacggacgattgattagagttctagtgcaagagttactgataatttgaatttcattttgatttctgaaataaagatggacactcagtttcaatagatgctcagataatgaaaacaaaagaacgttaaattctagcaatagacagctgatagatcaagcagacaactctccaggagaaatgcaagatcatactgatgtaatggtacatagaagtgatcaactcaagtctaacctttgatagagattgctggacctccttaatggcttgatcattgtggcacagctcatcaaagtttttgtagttaatcccagaattttgagcccactgctctaaggcctggtgcgccggcactaccaacgccacacaataattatgaaatggatcagcataaaccattatgctgtccacataattgctagtagttagagctgattcaacctgtaaaggccagagagaacgagagagagagggggtttaatataattataatacaaaaagaatacccataatggttgaggcactattgtaaccaaaccttgccaagagacacatattctccatgctgaagttttactatatccttttttctatcaatgatctcgaggcacccatcaggatggaactggccaatatctccagtgtaaaaccagcgcattcccctctcatctacctggagtaatcagaaacaaaaattgaagtgaaaaatattgtatttgaccaccaaggatgattggcaaagatcctttaccttgtagacctcatttgtttttgcttcattgttgaaataaccttttgttatgctgtatccaccaactacaacctctcctcggggcattggagaatcagaaattttatagccaccttcttcccatgaaacgagctgaattcatttgatcagaaaaaagagaattagagatacatatacaacatgataagagaacagaaatatctcacaacagaatgaaatgcttgctaataaaccaaccaaaactattgtggtattgtaaaataattttacagacttctgtgtgccactttaagttttagaatggggatgttggtcattcttaaggtaaca

SEQ ID NO: 67398 - DNA, 4589 bp, Oryza sativa
ggggccgtgagacagtaatttctctctaggcatagtataaacagatttttaccattttatgtatcttaacgctattatgttcatttaattataaatttgcatacataaatatcacttatatctgttaattatatgcatatacatcagataagttgactgtccctagtaagtataagcaaataaatcagataagctgactctccctagtaaggcacagaccttgacatagcaacaaggaaggggtggaccaacacggcccacacttgtgtcatcccattcagaaaaggctgctccagcacaagtctctgtcaatccatagccttgacctactggtacactgcagcacaggtaattcaaaactgcataagaaccaaaaacaaatgcagcgacatacaataaaaggaagctcatcacattatagcatagtgcatgtactctagaaaggtcctctgtttaatatttcaactttcagcatttgattcactaaacgtgcaaatacaaatttcactataaagtgatttttgacaaactgtttgaattaaaaaaacatataagtagcacgcccaaattttatgagcttatccaacaaatgttttgttttctgtaaataaataaatccaaaggtttgatgagcgcactacctgcaaacgtacactctaacaatgtctaggacttgagtatggcattgaacttgaattttccatgaggtaagttcattaaaatcagtattttttttagtaacgtcttaaacaaacttaagatgtacaataagacaaaaaaaaaagttgactccttgtatgtttttggaattcatgtaattctagcctcatttttcgaagaaaaaaaagataattcaagtatccgagaaatgacactatgctctacgactggcacacaatcttcaacaaataaactcagtggaaatttttggaagaatacttcttcagttgacatctcactgattgcaaatggttaaatttaagataatccaaataggacaaaagaaattacccaagacatatattcataaatctttgtgtgtcactcgatagaggtgcaccaccacaaagaacaaatctaatgcgcccaccaagcatgaacgtattggtttaaaaatgaggttatcccatatcatcctctctggtgcccaggatccaaaccaacttccttcaatagctccaagatttcgtttataggcaatgtcaaacagctttttggtcagaccacccttctcaccaacctggaaacataatttaaatattaagttttgagatgagaagtatgtttaaaccatattttggtgcatgatcataaaatttgaccgttcaattctgcctgcatgatacatgccatttgatgcaatgcatttaaaatattaagtctacagaaactcattgtttcaaacatgtttccagccttcggtttcatcatctgcttgttggcttatcagccacaaccaatttgaatttgaaacttaattttagagttgaatttggggttttctcatcatagtctattctccagccttgtacctcccatttttaatatatgatgccgttaactttttgataaacgtttgatcattcgtcctattcaaaattttagagcgaatataaaaaaatttaagccatgcttaaagaacatttgacaataaatcaaatcataataaaataaatgataattacatattttttaataagaagaatggtcaaatgtatctcaaaatgtcaacagcgccatatgttaaaaaacggagggagtataacagtttaacccaaaaattattttcggttgcttcattttctatggcttatcagcctcagccgaagctcagacttgtatgctagacaagacatgaagcgtgctacggtatggtaggcattataatggctagggttgggaaataagagatgcagaccagagcagtgcaccaaaactgaaggttgtagtgttgtatgataccaaaaacatgcatgttatactatgctagaaatggctggggcctgcacttgactttgcccattgagctagccagaacatcaatttttttttttaagatatgcctggtgtaaggtacagaaaaatctacaagttgctaggctgctagatgtgcaaacgacaaccaaacagtgcatctatatcctaatcttaattccttaaaaatactgaattgggggtgatagtgtgctcttctataccccaccaagttgtgtggtcaggtataagtggtgacatataaactgtttgcagtatttaggttttagctgatcccatatggcatgtacatccattgaaatacgtgggcacattgctagcagtagcactcctttaaaaataaggttgtggtggttgtgaatccaccactcaccaactctgcactgcaatttttatgaattgctgccttcatttccttacattacaatacctcaatatcccatatgttgtttgttcttatttggccttctaaaaattagaagttgacatgaaaatgtccaagatggaccaatgtatatgtggcatgtgcgaatacagtcaaacattactaaaacgaaaaggaaattaagtacatggccatacagataacgcttaacataaaacaatattaggacctgtatggttcaaaacttttttctttagtttattcacaggcagatatttaaacatataaatgattaatgcatcaaaggcactctaaagacatgttgcagctgaatgcaaatggcatataaaagattgcagaactagtcaaagatggaaagataatggtgtaaactactgagatagatggtatgagaggagaatcttgaacctttttaacacggcatctctgatgcggtctaaaattgcagggactgaaatcataagagtaggcttcagtgcagaaacatctccttttgtccccttctttattttatttgatgtatctgtcatagtcagagctgagccatatccaatggcagcaccagaagctaacatgacagtctggccaaacaaaacaacaatatgtcatagaaatattcacagttcttaataatggcatctctctcaattgcaaaagatgtcacctctgctgctagttcaaagacatgagccagcggaaggtatgccagataaacatcccctgtgccaagttttggtatgattgtcatgacagctgcagttgtggccaccatatttccatgtgtaatcattacaccctatgtcaaaggaaaccataaaactggattaaaagaggacacaagaactgcaaactcaaaagtggttgacattgtgataaatgaaagtacatagctgtggatcccaatggattgtaattcaagtttgcacaaaaaaatatgcattatgctgatcattttgtcaaaaagacgaacgttgtcacactcatgaacagttaattcatatattttatctatacctgtttttcctaatccgaggaattttgagttgtttgccaaaatgatgttctcgttatgaatttcaaatttgagcctttttcgcgtatcaaaatgcatatggtttctgaatttatttttttttttctctgaatactagagtcaacctagagatccagtggttatagagggtcttaattgtacattggaacagtccatggatctctacatgatggtgaggagtggatgaagcagtgatggatcagtttggttcatcctgttcccatccctgctatccttccacaataagcaaagtgggtaattgcacttgcaaaaataccaaggaaaaaccaactttcctttggggaagagaggaaaagagagtatatatcaggaaagtgaatttaatttgtagaaaggatttaatgtcctgctttatttctcatttgtaaattaaatgggcataactgcatattatcataactctcaatgttgcccttaattatggagagcatcagttcaaaaggaagttatgtgagtacgttgagaataggcccaagagattatcataatatctgtcaagctaatgggctaataggatcgtaattctctatatcatacatcacttaagctcttgttcagtgaaagtaacaggatggtaggctcatcatgtgtgtacaccttcagatgaagcaaaaagaaaaggaggaacaagaaagaatgacccctgcttttgtccttatttattttcatgaataaaaatagataacagcatatgacagaaaaaatcagaatatctttgagcacaagtgtaccttgggaagacccgtacttccacttgtatacataataactgcagtatcagtgcttgaaggtaatcttgcatctgtatgtgatgttttacccaattcttcaacttcaccaaaagaaaatgttgtccagtgcttcatttgattgagtacctcagcctcaacaggttcatcctcaatatagataacatgcttaacactctgcaacttggaactgattgcaggtagcttcttaagttgctttgaatcacatatcagagttgaaacctgtgtctgaaatttataacacacaaaaaaaatgagtttcccatctactaatggttgctgtcatttaactcttctaaagtgtaaccatctactaacggcaattcagcatggacatgtgtca

SEQ ID NO: 67399 - DNA, 7818 bp, Oryza sativa
caacagctgacgatctctcagttatcacacaggttcttgatatttttggtcatgcttcaggacttgtgactaacatgcagaaaagctcgataactcccattaggtgcaatgaggatgagttgaaagtgatttctaacatgctgccatgtgaggtcaaggattttccttgttcatatttgggcttgccgctgaacattaagaagccttctaaagccaagttgcaagctcctgttgataaggtagcagattacctcccaatgtggaaggcctccctcatgaacaaggccggtcgactcatcttggtgcgggtggtcctctccgcctgagttgggcactacgtatccgttggttatggctccagaagacagatagtgaccgtgcgtggcaaggcctacccatccaggttcctcgcatgtctcataatctcttcagtgtggctgttgaatcacgagttgggaatgggcagtctactttgttttggactgataggtggttactaggaaggaatatcttaaaaatggcccctaatctgtgtatgttggtcgctaagagggtggttaaacgttgtacagtggctcacgctctcaataacgggaaatggatcacggacataaaagggcccttgactgtgcaagtgattaatgagtatctccagatatgggactcagtttttggtatagggctgcaagaaggcgtcccggatcagcatgtttggaaactaacagactcagggtcctacacttccaagtctgcctacagggccttctttgttgggactgtccgttttgctccttggaaaaggatttggaatagttgggctcctcttaagtgtaagttttttgtgtggttggccatttacaacagatgttggacggcggatcgacttgcaaagcgaggcttgcctcaccgggacgcttgtccgctttatgatcaggccgacgagacgatacagcacatcttggtttcctgtgtgttcagtcgacaagtttggtccttggtcctgcaaaggcttggtttctcctccacacttccgaatcaggatacacgtaagttttcgagttggtggtcaaggacagtgaaaggcttacagaagaatgagaagaaggggctcaattcgctagtcatcttagccatctgggaaatttggaaacatataaatgattgtgttttcaatagagctacgcatagtgtgcctgtggcaatccaagccatagctaatgagggtgcactttggtgttttgtgggagcatcaaaactccaagagctatttgcgaaagcaatagctcctgtaccataggaggtcgaagcgcgtgcttgatgttttgtgtgtttttgtgaggtgttattgttttgtataaccttggtaggtgggtgctgaggtttgctaaatccttcaccgcttgcctctttattcttgcttaatgaaatgatacgcagatcccatgcgtattcggaaaaaaaaaatcttctcatagagttttttaagccttgggaaacaatttgcatggttattgcttgaatgttcatactggtaaagatttctctcaagaacaaccaactaatgaagatagtttaggcaagacaggtaataaactgattaaacaatgtaaaccaaacagacaaaaatagtatcatatcaacaacatgaactaccatacaagcttcggtattacatttcatccaccaaacagttcgcccaaaatcttaaaagttgctgacatataaggatgacccatacttcaataaaatgtgtaaaattacccatatataaagaaaaaaaagaaacggtaggaatgtactagtttcccaagtggataattataagaatgaacataaatactgcacaaaaaagccacatatgggttgtacctcattcagtgaatgcaccagtgcatcctcgccaagagatgcatagatagttacaactgttagattttgtcgaaagcatccctgacaaaataaaacaattattgtcatacaggttcataggttctcacaaatgtatacagaaagccacactatttattataatcacctgagcagcaatgatccactcagttcttgtatcagcaaatattgcagcacgactatctcgttggtgacccaacttgatgagaccagaagaaaaattacatgcacgactaaatgcttctgcgtaggtatcccattcatattcacctaaatgcaatttctcgaacttcctgccatcaggtgactccacaaattctctattgattagcttccttgtgccaagacacctgtgtcgagggtattttttgctagccatctcaaataaagctgccattgtggtggcaccctcccatggaacttcaactaacatggaaaatctactgtttcgcatggcaagtcctgcctcaccacccacatcagcttgtactgctcttttctttccctttttgttgaatatggaagaaagcatgataggaataactacagcaagtagaatggcaccaataattccaggcagaccatactctttcaccagtggaacatcacttgtggcaattctttgaagaattgacatgtttggattatcgccagtattttctcccatgattttaagatttcatcaactgaaagatttcacaaatttcgctacaagaaagtataaagtgttaataaccgtcatgttagtatgttgcaaataagtaataactaatttcttctcaattttataaataattgccttgaacagaagaaatgagtataactagattagtgcagcatggagaatgctttcgcactacagtagcattctatttaacattatgaatcatggaaaaatgaaaaatactagcaatgaacaatatttagaagcactggtactcttcttccaactaacaaaattaaaaatgatcgtatggtataaacagattcagcagctattagacagccttgttatgcagagcaaaaaactgtaaagtgcagtaaaacagtaaatacttggtagttttaatctctttgagtaaataacatatccgcatctccagtgaatgttaaatggtattgctcagagcaccgcacaaattattttatgatgacaacaaaattcccaaaggtcaacttaagttgctaaaaagtacaataatgaaattgcttgtgaatcctgcagttgcctacttctacagtgagaacgactcaacattacaagctgactcgtggaagcaacagcactatcacaacaggttagcagtcaagatgatatgtaagattcagcacgaagcaacgaagttgacagaaatattttgtaagtggagtaagtagattagcaggaatcttatgacaagttgaagacttgtagagaagataattcaataaaatatagcatccatctctggtttgctcaaagggccaatatcttatggcaaggtccttcgaagttgcaagcaattacaaagggacacggatttacatttgaagaaaaaaaaaagataacatgatctcacctaagaaacaaggagtaaagtaaacaaccactttgtgcaaattagcagcggtaggagaggaataattgaggcttgaggaagaaccattgaatagggacattaattaaacggttaaagttataattattccttactctgtacagcagcatagtctgtgcgtgggatcaaaggaaatcaggggcggatcaaacttgggacatgggggctcaaacttttgggggagcaaacaaattaagaaagatctagaatagaagctagggttaacgcgagcaaattccaggcaaaagtactcccggtgggagagagagatgaatcagaaagaggatgtggatgctcaccccgatcccctcccctcccctcccctgctctgctcgccagatggagatcggcgcacctcccctccgttgctctgctcgccagatggagatcggcgtccggcgtcccctcccctgttcacccgcgactcgtcttggcgcaaggagcggagacgacgagacgagagatttctgtttcttttacgccaagggaaggaagtggaagatgctcgagtgctccaccttttgtataaaaagctttcaggccgcgttcggcagttagctttcccatcttataatacgcatttcaaattgctagatggggttgtttttataattttatataaaaatattgttttaaaaaataatattaatatatttcttgagttagttttttaatacttaattaatcatacgctaatgagctgctccgtttttccaaagagaaaggtttccaactcagggcaccgaacgcaggctgcgaacatggaaaacggtattgcccatgagtgtttgattaattaagtattagcttaaaatatttaaataatagattaatatgatttttctaaagcaacttttctataaaaattttttttcaaaaaaacacatcgtttagcagtttcaggagcacaacgcgtgaaaaacgagaggtaaagttggaaaagaacacagcctgttgggcacccacccttgctagcatttggtgcggataagtccactttgactccctcaactatagctctactatgattcatatccctgaatcgtaataccaggtatctcaccccccctcaactataaaaactggtgcaatttaacttcctcgttttagtgggtgttttcgctgacgttgcactttgacttgttccaatccgctgagtcacctagtgggacccgtatgtcagtgccacatactctcttctcttccttccctttccctcctcactttcctctctcatggaaataacaacatacgatggtgattaggggaggtcatcgttgtgtcgccaacccctctttccccttcctctcgtctccgtcggggaggacgaagcacgagcgagaatgacagcggcagtgagaggggaggctgtcgtcgtgccgccgtctctcccgtcaccatctccgcctcccctctgctgccctttccactcgccgtcgtcgaggagcggaaagcacgagcgaggatgacaacgatggtgagaggggaggtcatcattgcatcgttgtccctcctgccaccgcctccgctgctccctttcgttcaccgccatcggggaggaggaagcacgagcgaggatggtggcggtggtgagaggggaggtcatcatcacgtcgccgtccctcccacccataaccttgcatggggaaagccgccgcacttactctgccaacaacgcgtcatcatcgctctgacggccaccacgctctgtctcatctagccgattccgctgagggaagagaagaccggagtggcacgacacgccgtcgtcacctcgatggccaccccggtatgtctcgtcctacaccgctcatcccttccgccaccgcctcttcctcacctttgttgtcgccaacatgtctgatttcgccgagagaagagaagactggagtggtgtggcgcctctgccctgccttcctgccagcaatgatgagagggaaaagataaacgtcattgataggtgggtcccacaaggtgacatagcaggttagaccaaatcaaagtgccacatcagcaaaacagtccttcaaaaccgtctgagggagttaatagtcgagatatccgatattgcagttcatggatatgaattagatttaaccactaaggagtcaaagtggacttattcccattggtgctcgactcactaaggcctgcgtgactgcacaattaagaatgtagcccagttactcctcccccactgctccatccatttcaaattacttaggtcccgttcgtgtccactagaaatagttgataaaattttgaatatttgtggcacgcttttcaaacggctaaacggtatgtttcgtgcggaaactttttctatatgaaagttgctctaaatatcaaattaatctatttttcaagtttgtaataattaaaactcaattaatcatacgttaatatcaccttgttttacgtaaaacacttaatcttaatcttaatcttaatctttatctttaggaaaaaagaattattctaatcaaacattttaatctttaaccgttaatttctatatataaaaattttaacatcataagaattacacttttgacactatgagaaatatttttataattaacaattcatatgtggttaaactgaacataattctaaaaactaatgttaaacatagggatgtttcacttaggacaaagcctataactttaagtaatttgaaattgggaaagtagttattagtagtatcaatagtaaaccaacatgcatattagcgatcaccagacccgttccttttacacccgcaacagtagaggcgtgagaagatataaaacacatgtgtccttccttttacaaaaacatagacaatgtacttcctccgtcccaatatataacaacttaggatgggattagaccaatcctagaactacggatctcactactacaaaagtgatttttctgtacgagagcccatgaattttgcaaacggaccattactagtggcgtctgcaaaaatcgagggtcattgtcccatacggctccttaagtggcccgtatggaaaaatcgattttcccctacgggcctcttaagatggccgtatgcaaaaatgagtttatttttgcatgtggctgtttgacgaccaaatttggtaaattatgaaccacgttcgacattgagatcgaggcggattcaacaaagaggttgattcgaagaacagagtatgcatcggctagaatctgcattggctgagatggatcggacagaggacagccgatacagccgatagaggtgatgcagccgatttcgatgatgacagtttcgaagatgtttctagaatcaatcaaggtgcttcatgaagattgctgtgatggagatagggctcttggataggcaattgtatctattaattaggatattttatgtaatttctttagagatatgtttgggcaaaagtctgctgcaaagacttatggtatcttaaagtttattagaggtaaatgtcgtgtccggcaaggacatatcttgtatctcgggtataaatagaacccgaacccatgtaatcaattaacaattgttcaatataatctcggcgcattgccattgtcagggttacgggttaggtataccctttacccttcgatatacgtcgcatatcggtatggcatacccacgcgcatacagataccctccgcatgcattaaggaaatccttcacggagtttacggatggaaagagtcctactcgaaccagactgggtcgtcaacgtatcgtgtgaggtttgatgtctctgagttctacttggaaaccgcctgacctgcgatataaaagggaccccccggggaggacctaaggcatcgaatctcagagccaacacaacccccacagcctacgaagtcggagcctgcaggagccaaatcgctggggatctagtcgaaccaacttgactacgatctcgccagatccatcgagttccattgttccctttgtaacctgtgttttccatcatataatcccacatcaactggattagggctattacctatcaaggggcctgaaccagtataatcttcgtcttttgtctgcttgatgtcgtactacatagacccttgtaccaacgtaccccaataccttctatatccggtctacgggtatcacccgtcgacagtggcgcgccaggcaggaggacttggtgctcaaggttctactactatgtcatccagcttcgtcgacaacagcgtcaacaccaactcaaccaagtatttcctgcttcaacaatgctggtgtggactcaagtcggcgaaatcgtcttcccggtttacaccacgatgccgatctcagccggtccatcaatga

SEQ ID NO: 67400 - DNA, 11688 bp, Oryza sativa
ttcagcgtatttctccaactcgtgatgtctattgtcctattcacaagacaaagaatcatgacctctcaagctgcaaggtctttctcagcgccatgaaggcgccatctcctaaggtccaacagtcacacgtccccatcagggataaagacaaggaacgaggagcgacgccaacttcagatcaatttgttggggtaatcgacatcgatccccacgaaccgtcagtcttgcacctcctcgaagactatggatcatcgacaacgagcgcgccgcgggaggtattggctatcgatgatgtcggcacgtcagcgcgcaccaatgcagaagcagagaatcaaatcgccactccggcccagcacatcagagccgtcaacgctatactgagggaaaccccctacgatcccgttctgaacgacgatctcacgcattggacagaacgactatgggaataagtgaccaaccatagtaacgcgttcgaagaggccgctgccgcagcgcacccggagcagccaccaactagcgatgccaatggtgaaaaccctgaacagagggaatcgcctcatcgagccacccctccacctcgcggcactggcgatctccgagatcacctcaacggccgccgagaggcacgacgcacacgagacaacgagaaccgttcccggcgtcatgtctcttcacggcgccatgataacgaagatcgaggagaccgttcaaacgaagaccaagaccgtgataaccgccacgatcacaacgatcgcgaacggcgggtgccaagcgatactggtcgaggacgttgccataatgacgacgatgatggagaccggcgccgagacaacagcgggagacgacgacaggattctcgagagccaggccaacatcctcgtaatcatacgccggaaccaagcgacccatcgtcatcgtcatcatcctcgtcttcctcatcatcagatagacatccacgaaggacacacgatcgccgacaacccagcgctgggtgtagagctttcagtcgttccctgcgtgatgtccgatggcctgagagattccgacccggagcaatagaaaagtacgatgggagcaccgacccagaagagttccttcaagtctactccacagtactctacgctgccggagcagacgacaacgcattggcgaattatttgccaactgcgttaaaaggctctgcacgttcatggctgatgcatctcctgccttactcaatctcttcggggccagacctgtggcagcagttcgtcgccaacttccaaggaacctacaagcgccacgcgatcgaagacgacctacacgcgttaacacagaactcgggtgaatccttgagggaatatgttcggcgcttcaacgagtgcagaaatacaatccccgaaatcactgatgcttctgtaattcgcgccttcaagtccggtgtcagagatcgctatactacccaggagttggcaacaagaagcatcacaactactcggagattgttcgagattgttgagcgatgcgcccacgcagatgatgcgctaagacgcaagaatgataagccgaagaccgggggagagaagaaaccagccacggacgcacctgagtcaagcaagaagaaaaatcgcaaaaatgggaaaaggaaagctcaagcggaagtcctcgcaatagaatacgcgaaccctcccaaacgcccagacccacaaagtagcgacacaaagaaagcatggtgcctcatacacaagacggacagacattctttggaagattgccttgttttgaaaaaatcgctcgagaaacacattgcatttgaaaaaggcaagcgagtacgcgtggtcgaaaaggatgtggaggcggctccccaagaatcggattcagcatatccagtctctgacctccacgtttcacacatcttcagaggttccacaacgtactcctcaaagcgagaatacaagaaagtggaacgcgaaatctgttcgacatggcagggggctgcacccaagatgaagtggtctgaacagaagatagaattctcggaagaagaccaccccaagaccgccgtcatcccaggacgatatccgatcgtggtcgaaccctctattcggaacatcaaggtcgcacgggttctcatcgatggtggcagctcaatcaaccttcttttcgccagcactttggacgcaatgggaattccgcaaagcgagttgacaccaaccgatcaaccctttcatggaattactccccaatcctcgtccaggccattggacaagattacgttgcctgtgactttcggccaagctaacaacttccgaacagagcatatcacctttgatgtcgttgaattcgatatagcttacaacgccatcaacgggagaactgcacttgcgaagtttatggctgcatctcactacgcgtatcaagtgctcaagatgctgggaccgaagggaacaattactattcaagggaacgcaaagctggcgatgcaatgcgacaaacggagtttcgacatggtcgagcaaacacccagcccacctgccacgactgagccacccaagaaagtgagcaagacaaacaagaagccgaaaccggacggcgcaatcaagatcgttccactctccagtgccaaccccgacaagaccgtcaagatcggggcgacactaagcgagaaataggaactcgcgctcatcaccttcctccgtgacaatgctgacgtgttcgcttggcagccgtccgacatgccgggggtccccagggaggtgattgagcacaaactcatggtgcgacccgatgccaagccagtaaagcaaagactgcggagatttgcaccagaccgaaaataagtcatacgagaagagcttgacaaacttctcaaagctggcttcatcagagaagtacttcatccagagtggctagccaatccagtcatggtgcggaaggccaacggaaaatggagaatgtgcgtcgacttcaccgacctcaacaacgcgtgtcccaagaatcacttccctcttcctcgaatagatcaactggtggactcaacagccggctgtgagctgttgagctttctcgacgcttactctggctaccaccaaatcagcatggcaaaagaggacgaagagaagacagcattcatcacgccgttcggggtattttgctatgttaagatgccgtcggactgataaccgcagggaatactttccagcgtacggtccagggcgcacttagcgaccagctcggcaacaatgtcgaggcatacgtcgacgacatcgttgtcaggacaaagacaggcgactcattgattgacgatctgcgggaaaccttcgacaacctccgacgatatcgcctcatgctcaatccagagaagtgcacgttcggagtaccgtcgggcaagctgttcggtttccttgtctctagcagaggaatagaagcaaatcccgagaagatcaaggcaatcgagaacatgaagtcgcccacaagactcaaggaagtacaaaagctaaccggatgcatggcaacactgagcaggttcgtcgctaggatgggagaacgagggcaacctttcttcgctctgctgaagaaacaagacaaatttgtatggacacaggaagccgaagaggcattcgttgcactcaagcgctacctatcaaacccccctgtacttgttgctccccaacctaatgaagaattattcctctatattgccgccacgccatattccattagcaccgtcattgttgtcgagagagagaaagtacaacgaccagtctattacgtcagcgaagctctccacgacgcaaagacaagatatccacagatccaaaagctgctttacgcggtcatcatgacatcaaggaagctacgccactactttcaagcccacagagtcacagttgtctcctctttccccctcggtgaagttgtgagaaacaaagacgttgttggccgcattgcaaaatgggtagtcgagctgagccagtttgatgtccactttgtgccacgaacagccatcatgtcccaggtactcgccgacttcgtagccgattggactatgcctgataacaaatcagacaaccaagtcgacaacgaaacatggacaatggcgttcgatggtgcactcaacagccaaggagcaggggcaggatttatcttgacgtctccttccagagatcaattcaagcacgcaatccatctcaacttcagggcgaccaataacacagctgaatacgagggattactcgccgggataagagccacagccgcacttggggtcaagcgactaatcgtgaaaggggactccgagctagtcgcgaaccaggtgcacaaagattataaatgctctaaccccgagttatccaagtatatcgcagaagtcaggaagctagagaaaaggttcgatgggatcgaggtccgacacgtctaccgcaaggacaacatcgagccaaatgacctagcacgacgcgcgtccagacaagaaccgctcgagcccggcacttttctggacatcctgacgaagccattagtaaaagaggttagcggcgaagttagcccggccgcccccgacattagctcggaggccacaaaggcagaacgcgccgttgccgatattgagaccacagatgactggcgcatcccactaatcaaattcatcaacagcgaggatttgcccaaggacgatacagaggccgagaaaataacccgtaaagcaaaaatctactgtatggtcggcagcgatctatacaagaaagcgccaaacggggtacttctcaaatgcgtctcgtccgacgacggcagacacctcctccttgatatacatgaaggcatctgtgggtcacacgccgccggtcggacattggtcgggaaagcttttcgacaagggtttttctggccaaccgccctcaaagacgcatgcgacatggtccagtgatgtgaagcctatcaattccacagtaaacacacaaagctacctgcgcaagcgctccagactatccctcttacttggccgttctcgtgctggggctagatatactcgagccattcccatgaggacagggcggctacaggttcctattcgtggcgatcgacaaattcactaagtggatcgaagcagtacctacgggggaaatcaaggccaacaacgccatcaaattcatcaaggagatattttgcagatacgtactaccgcaccgcatcataaccgacaacggctcccagttcatcagcgccgatttccaggattactgcatcgggctgggagtcaagatatgcttcgcctcggtctctcaccctcaaagcaacggacaagtcgagaaggcaaacggcatagtactacaagggatcaaaacccgcatctacgacaggctcatgtcacatgacaaaaaatgggccgtacacaccacaccgacaacgtctaacaaggaaacacccttcttcctcgtgtacagctccggggccatgctcccagcaagctacgacatcagagtacacgagtacagaagcattccgacgaggaccaggaggagcagcgaaacgtcgacgtgaatctactcaaggaacatcgcgaacgagttgtcgtccgagcaggcagctatcaacaggccctccgccattaccacgagaagcgcatccgagcacgcatactttcgatcggtgactacgtcctccgacgggttcaaagccaagcagggcgaaacaagctctcacccaaatgggaaggaccttacacgatcacacaagtcttgcggccaggcgcattcaaaattgcaaatggtgatggtcgcgagttggcaaattcttggaacattgaccaactacgtaaattctatgtatgagtcaatatcatccataccagtaagacaccttacagtatcaataaagcctattcttaggcccatattataatcaaagtgttcctgcccgatgatcccttatcctgatgacacctagcgttgaaacctatcctcatgtccctttacgccgtcttgacaaggcctccgaggaacctaagggatcttcggctagggacgcctagagccgataaagacgaaagaccatgtaagatctggtcgtgtaagagttctcgtcgtgcgtattaaccaagccgcgaaatcggaaattaactttccaacttcacggctgggggctaggatctgagcttattcaaccaaggcaagtcaaagtccaagagccttatcctccgagaaaattcctccgacgacaaggctaggggctagggagagtgtacgactcaaacgacggactaaagtcgtgaactgagaacacactcttacacacgacatccggagtaagaaagatttgttaagatagatttcttttctatttcacaaaatactccttacaattttttacacaagtctaaaactatattacacttcttcctaagatatctatcacagggtacgaagactaccaagaaggccaacgccagtccatagactggaagaccttctccgccaacggcgccatcgacttcgccaggtggtctatctccgtctgagtcctccgagaacgagaaaaaccttcacggagaaaatcgaggtccaggcgcgggcgatgatctcgtaggcaagccaacacgtgccctccagcatattagctcgatcgacgacactcctgcttcaaggcctcgtcgatgcgtttgccgacgccatcgaactgagcacaggccccgttcagccacgagatgtatccggccgccgactccttgggatccccacggggtactcggagctctctacaaaccttggccatggatgtgcagcaactcttcaagtacgagttgaaccacacctcacgacctcggagcgtttccacagcctgctctttcttcactgcaagcatggttctctcgagttccactacttcaaactttgtcttccaatattggatacgacgatcttgaccagcaagagcaatctcgagatctgttcaatgtgggaacaactaagtcaagctgtactcctctttcgagaacatagctgatctagtcggaggagcaaaagggatgaatggaccactaacctaaggaagtcgtcgccatccccgtccccgtagctaggatctggtctacattgtctggcgacgcatgtggttcaaacgcgagagccagaatgatcgccggtgactcaggttgcccacgctgctggacattctcgtcatcaacatctctacaagggacaaaaagtactcaaaatcaacatgcaagagtaagctaggataataactgcacgcacaaaggcggttgagatccatcaaagttttacacaacatgtctaaggagtacaagagatcctactcttcaaaaagagggagaacagattcccccagatcgccgacttcttccagcacccccttacgcgtgtcgctagccgccccctgatccaagatctcgcgcagatcgagttcaggatgcgccagcctcacacatgcaaggacgtggcacgccccggtgtagatcccgttggacgtctcctccccgatcctagccgcatgcttggaggggatctcctccatcgccgccgccagctccgcaaaagaagatgtcagcgagaactcatcgggattcgccgggatggtggaattaatgccgcactccccggaagctggtgcagaccagtataggtgacccgcaacgagccacggatttccgacagattgttcccgagcttcgacatgcggtgctcgagcccctgtcgttgtcgctcgttgccggccaccaactccctcatcttcttgaggtcttcacgagcctccgccaactcgtgtgccagccggtcagcgcgctcggtcgccgatgccgccgccaaccttgcctcagcaatcttgcaaccaatgccgcgagcaccagcttcgaggagacgccccatctcgacctggagctcctcccaggtgaggacagcagccgatggaccacgaccagccgcgagatcgctggctgggccacttggtgtcgcctcgcggctcccggggcaagcacgacatccgtcgaggtcacagcgggagatgcgccgaaagtccctccggactcatcttgcaccgccttcgcccgcgccgccctatgagatagccatggttcagacaacgctcgaacaaaagcacgaacacttagattcatccacttacttctcgccatgtgtcacaagttgttgtcgtcgtggaggcgggggagacgcgtccgaggcctggagaacggttgatgcgaagtaaggcgaaattgttctggctgtaagatcagacaacaggatagcttactgagggggtagatgccttgcgacgatgtccgcttacagaggagaacttcctcccctttgtcggaacattgccaccacttgtagtagcagcagtagcagcagcagcatcggatgcctccttggcgactttctctttcaatgacgccgccacctgatggtccacgagcggcccgacgatgtcagtcagaggaagagcctacgcttcataaagtcacaaagtgatctcagaagaaaaacgcagaatgtctattgagtacacttacattgatggcagcgtcgtgttcggccgcccccttctcacaaaggggaacggggatgttactcgccgttgtcgggccactgatcatcacctggccgacacgacgtcccacggtttcattgttcagacctgtaaatcgagaaccaaatttcgataaatcaggaggaacgtgcacacgagcatgtcaagataaatgcaagaaagataccccgaggagaaacccgggtcgcgtcctccggtccggaatagtcaaaggctagatggactcgagcctggagcggctggatccgtctaccaacgaagtcagcagcgatttcatacctcgacaaacctcgtactcggagatcgtcgacaatatcgatgaacgattgaagagaaggggtcaaagggggctttgcggtccaagacaaaatcttgtccggttgttccttagaacgatgaagacaggatccaaatcttcgatctgaagatagaaccacctcgtctaccatttgctgcaagaggaagggcactggaaggggatataacgcgacttcaggccatcccgaagtcggaacccgacgcatccagataccctgttggactccatccaacgcagctcatagtagaagcgaaagagatcaagaaagggctctaccccaatgtaggccgtcacaaagatgtgaaaaaatactaaggaaggcgatagaattggggttcagatagagcaaagaaagaccatagaagttcaaaaccaagagaagaaattcggaaggcggagggagaaaaccgcagagaatgtagtcctcgatcgcaaccatgcgacctaagacgggctggggttcagtacctcctgcttccctttccatggttccacgactgggaagggcgccgtcctcctgaagcttctttagcgacgcgttggtggaggatgatttgccaagatccatcgccgatcggagatcgccggagaaagggctaaggtcgacgagctagggtttcttgtgggagcggagaagacgaagaacgcttgcaggcgggatgttttcttcacagtaggcggacttcaaaatggatccccaaaattcctttaaatagacgcactactgacggtgcgaattccaaggaaaggagagagatggccgccggaaatttctgggtccgttacgcgtggtagtttcttggacttcagtttaaattcactcgtgaccgttgggcttcacatggtgttctcgactacgtcctatctctacggtcctcacaccgggaacaacaacaatctcgacacaagaagtcgcaaatggttacacgagttcatttaagcagaagtcgggggctactatcagggttacgagttaggtataccctttaccctttgatatacgtcgcatatcggtatggcatacccacgcgcatacggataccctccgcatgcattaaggaaatccttcacggaatttacggatggaaagagtcctactcggaccagactgggtcgtcaacgtatcatgtgaggtttgatgtctccgagttctacttggaaaccgcctgacctgcgatataaaagggaccccccaaggaggacctaaggcatcgaatctcagagccaacacaacccccacagcctacaaagtcggagcctgcaggagccaaatcgccggggatttagtcgaaccaactcgactacgatctcgccagatccatcgagttccattgttccctttgtaacctgtgttttccatcatataatcccacatcaactggattagggctattacctatcaaggggcctgaaccagtataatcttcgtcttttgtctgcttgatgtcgtactacgtagacccttgtaccaacgtaccccaataccctctatatccggtctacgggtatcacccgtcgacagccacccttttactttcgtttatttctacgagttcttgctttcgggttgagctgcatcgattcgatcttcaactagaagtaaaacttgttatggcggcttgcgttatcgaggttaatgcttccatctctatgatactttaaccctgtttatgtaatccatcgagttatcatatacatgttgcaatctatgctagtggcgctatataacttgttatcggctggttcttatcgttaggaaacaatcggtagagttatgttttattattaatttagattgtatcatatatctaccatctcttgtagattttcatcatcctgcttagatctcatacttgtctttatgtttaatgctgcatcggttgagttcgatctattaagtagaattcataattgtgatatctagcttgttttatgatcatcgagagagatagtatcggggtttcagccgatcttacctgacttagctttatgttttatatgcttaactaatatgctaagtctgccctttatattaagattttatcgcaataaagtatatcagacttctgtttgatatattctatctgttttaatatctgtaacgtagagtagtatcggagtactagccgatacatgctagatctatctgatcggctatgctataagcgtttataatcttcatgttaatgtgtattttgatctaagtgatttatactatctcggcatggcgaccgatctatcccaatcacttgatttaaatatacatcgacagaaagattatgtagcgttaatatctatagccgattgagtagatttagtcttactttgcttatttacaattgccgattgattcacatgtgacacatcggctcgagaataataatatgtcggcggcggctggccaatcagctatcatttatggattcaaccacggtttttcttgtctctctttctggttgattgcaggatcaaatcaactggcacgctcacgatcctaaaggcaagattttggacctgcactgaagttaagcaaatcttctaggccaatgtatgtttttcgcatcaacagcggctcacttaagcgcccgtaggccacttaaggagccgtatgcgaaaaaaaatttgaaaaaattgaaactagtttatctcactcatatgaaatccaaattagatggtttttttcctaaatgtttctaaaatcatgctctatcatgttattgtgttcttacttctattatttgggtcatttttcttgtgactttatttaattatcaattaaaaatttgaatttcaaaacttcaaataatattttgaagcagtaa

SEQ ID NO: 67401 - DNA, 3965 bp, Oryza sativa
aactttgtttttaacacctttttcatatgagttcatctagtgctataaaaatcgatttgaaatttaaaaagccacgtataaaaaatcaatttttacatgcggacgcttaagtagcccgtatgaaaaaatggtccctcttccgcagttcaaaaaatttcacacttaaccctatcttatcctctcctctcactttatcctctttgctccatgtttccaacccctctccctcgtattccgtgggcacgcttttcaaactgctaaacggtgcattttttgtaaaaaaaaattcaaattaatccatttttggaaaaaaaattgttaatacttaattaatcacacgctaatggaccgctccgtttttcgtgcggaggagatgggttccaaaccagggcatgcgaacacagcctcagtcttctctctcactctatctcttctctctctcagaccgagagtggcgcagggcgtggcggcggcactggccaagtgcagagggagcggccgcgggctctggtgccaagggcggcggaggcatggatccggcggtggcggcgcaacctcgcgtcgatccggcgtcggcggcccgtctcggcgtggatccgatggcggcgcgacgacggcgtcgatctggcgtcggcggcccgtccccgcgcggatccgccgcctctacctccctctgttgtcgccgtcgatttccccgccctcctctgcggcgcgacgacggcttcgatccgccggcggcggcgcgacctcgtgtcgatccggcgtctgcggcccgtccctgcgcggatccggcgctgacgacgatggacgacggtgggagcggcggattggccgacgacggcgacgaatccggcggcgcggaggccggctggattgggcagcagtgggctagggttcagcttttttctttttttttatttcgctgaattcattttcgcatgcggctagtataggggaccgcatgcaaaaattggatttttacatgcggttgctctagccgtatgcaaagatgacgatctttgcaggcctagccgtatgcgaaaatcgttgccatccgtatgcaaagacgtattctgtagtagtgtctggacatagatttgtacagattaaaacacacagttgtacatattaattacatccagttagactgaaggacctttcaagaagccatataagtttgtacagattaaaacacacagttgtacatgtacggatgtacccctctcgatcaaaccggggttattaggtaacagcttattgctagattaattacggatcaccgcccatacatggaacatgctagatatgaaggtgacacgcacaacacaatatactatgattattccattgcagatttgatcatgtcactgtaattggatgttaggttgagcaagatctcaggattaggacagtttagcacttttgtgcctttcgtcgtaatgtcgtggttccatgtctctggtgacactatagtaattaacaagtacattcccatgcaatgcaaaaggccaggcaaagataagaactatagctatctagcttggtaaagtgcttacctcgagaaatctcgtgttaggtacttgcatgctaggagttaggcctaggttagttggttttcctacccacccattttttaactggcatatgtgcatcaaaacgtactaaggctgtgtttgttggtggggttaggaaccatctctcacgtacagaaaaccaagcggtccattagcacgtgattaattaagtattacttttttaaaaaaaaataaatcaatatgattttttaagcaacttatgtattgaaactttttaaaaaaacataccgtttagtaatttgaaaagcgtacgcgcgaaaaacgagagggggagttgggaataggctatagatatttatatataaccatcgtacgaataggctatagattgcctataaatgatttgaattagtagttggctatactattaaacttgctctaatggagtagcattaatctctggaagattaattacatgaccaataattaggaagattatgtgattgctacaattaacttcagaatgaggttattcctaacccaatgactagaatgatatccatagcattaaataagctgccatctaagataaaaaaatgatatgacaagtaaataaatgaggaaagagaaggaaaccatgtcttgcatgggatttggtttctacacaacatccaagtcatcatgtgaaataagaaatagtggtatttacattggaagagtagtatatagtactagtttcttgattatgagaagtttatgaaaattatatatagtgttttaggttgggaatggcttgagggaggctgtggtgttgttggtctcggcgtatttttttctcccataataattaaaagagaatggagggatattcgacatagaaatcacaataatggccacctgctgtatagttccacgaaatacggcgaattgtgtattgtacaccactcaaattgaattaactaattaccggaccgcacgggtccagcaacctacagcacggtgcacgtaccattcaatttgcagcacgttcgcgcacacaccgttatctccatgtgatgtgcgacgacgaaccagaggagttgccgtacgtacgtgtcacggcgccacacacccctcgtcctccctgcaacctaaaccgttccacgcacatccgcctcggtcgatgctgcctcctcctgcttgcgttcggccctcgtattccggctcgacgaaccaggaccaatataaaaagctatggcctcaagaaaaagtaaatgtcaattaggataaaaccataatgtgatattctttacctaatatgaagccgagcattgctaatttgctatacgttcgataaaacttcatatgatcagagtacgatatttcgtagcctctggtgtgtgctgcaaatatggggcataacatgtttccacccaatcaaaaatcatggatggtaggatcgtattaaaatcctacaaatatcatcgtacgcaaagcaatttccatatgaagccatagccacattatcttttctttatccatgtcaatcggttacttttgtattaaatcctcactttttttttctattcacacatgcaagtctaataaattaataatccacaccctgaaaatcatatataagaacccatcccttccctttcattctacctttccctcatttctccctgtaactcctctctcatgtcccacggcatcaccacctctcccctctctagtggcgattcttttcccctctctttcatcaacaaggccaccaaggagactagatcggagacagtgagggtggatatcaagacggcagggtgtggattgagggggcaaaggtgtaaatcggggtgccacagcgtggatcagggtggtgacgatggatctgcccaatgtggtggaaggagcggtcgaatagtaggtggcagtgtagatagaggcagcgatggcaggcagagcttcgaggcgacgtcttcccgcaatggagcatctcaccatcgtcctcaatgaaccgtcaggtaggccctttttgacctcatttgtgatggcgacgcgtagaagtttgtttgcagcaacggcacgggccgacggcatggggcgaggccgcttcctaacgcgtttcctcgcatgattctcgcctaccagcagaggcgtggctatgctgaggacacatggacctcctgcatggttcgcacacctctgtagggtgcagtttctttatagttggcgtgaatatttgtctcggatggggtaagacaacatgccagctaggaacgtttggcattgccttaggccatgtacaatgcatggtctccgacttgtggttccatcctccaactaggctaagatgccacagtggaggttcgagagtgtcttcatttgttctagaataacctatagatgtcacagtggtttgaggagaaaagcagtggttctgggagaaaa

SEQ ID NO: 67402 - DNA, 1845 bp, Oryza sativa
cacaaaagaaaatcccaaagatttctcagatctaagcactcccccagtgagtgaactatcactaccaccactagctcaccgctcactctccaagaaccgggtcaaacaagcaaaggcacccggaaaatcccaaacccccaaaacctcaaaaccagagagatccaagaactcctcaaccgaggcaaaagaaaacacgaaaccctccgtcgatctcaggataatccggggggttttaagaggggttttagctttgaggttaagggcgggaaagggagaggagggggatttgttggctgtgggaggagaaaggggtaagacgaggtggaggatatatttatggcacaggtggataccactaccactgtagtaccactgttcttgatcttatcacgcttggggaaattactgttttgcccacctgctaggtccagctggaccgcgctgagagtgaaaccgagtgcaggggacagtgtgggcttcggttcatgtgttcagtggaagtttacttctttgcccctccctgtctggttcatttattgttttttttttatttcccaaaagaaacgtgtgtggttttgaatttgaagttgcttgaattcaacttgatgatgtattgatgttcataaccatgatccttcatggtgtaataataaaatccacttcaatcaaggtgtacttgttagtactcctgtttaaaagacatgatcacggggaagtttcacatgtgctcgagggattttccgtgtgcttcacctcgttttttgatggcttgttcacatacaatggcttgaaacttttgtgttaggtaagtgactggattggcatgattggtgagtttacaataaaataattaagtgacagttgtttctttttttaaatactatcaatatcgtaggctgaaccggtaaatataattaacgaataggtgaaaaagttatatgtgtacagcaagtcaataatttcacgagtaaaatggccattagtgcaaccagaggcacaagaggcacaagacccaaatgtacttctactaagaccctgtttctttcagcttggtattattataatctagattattaagccagattactataagctatattgttataatctgtagtagaataagcgactagttgtttttttttctaaattattatagcctagattattgggtttgcaagtctaaacagtgagtggggtggcatggtgggtaatttttcaccaataatctggaaaaagcttacctaaatgagcttatcagattataataagctgggctccagattataataagctacttcaataagttgtgtgtttctttcagcttactcccaataatctggattataataatcccaagctgaaagaaacagggcctaaataattactccatttttcagttcttgatataacgtttgacttttcgtcttatttaaaaattttctatgattagtatttttattgttattagataattagataataaaatatgaatagtattttatgtgttactaattttttaaaaaaaaattatataagacggatggtgaaacgttggacataaaaaactaaaaatgaagtcagacggagggagtaactatcatcaaatataaattctttaagccccatcgttttgcttatccttatacttatccgcaccacttattagcaaattaaaaaaagagtagttttgtagcaaactgaaacatatgtcgctattgttgtagcaaaccgatagttttgtcactaaaattgtagttttctaaaaattactaaaaaaattgtaagtaaaactttcatacgtctccttagtggtataatagcaaatgttgtaaaataaacatgatg

SEQ ID NO: 67403 - DNA, 5313 bp, Oryza sativa
ggtgaactgtcctcatataaaacttattttattttgttttcaaaacaagtataaacgcagaagctcatctgcacgtgtgcacacactgaaccttatgaaagcacaccctgtaaatttatagctatgaaagaggacataactgagaaaatattattcgcttgatttcaaacaaccaccatcgctgtctaatttttttaactttgaccataattaaattttaaattattatatcattatgtatgaaaattttcaggactggaatgcgacctatttcgttgacatgaaatatttttcagtatttatatattctcttcaataaaaaaaattcgagcagacaatggtcgaagacaaatgggagtcctatctaggagtagcaacaagtatttaaagacggacataccagtgagttaccacagagtatagtgctgccgttctaaacacaacaatatatgtgcactcaaacatgaaaaagaaaattaaaaaaaattgatatgtgcaacataatgccatgtaccatcattaaataaaatcaactcaaaattaaatttacatatatacaaagaaacacagattaatttcaggctcgaagcggtgcacaacacacaccacatattcatcccaaaggaaaaaaaacagcacatattactgttaataaaaacacatttttttttatttttaccagctacgttcaaaaatacttcatctctggttattcacctcacaagtgcttgtccatgtgcatattcatagaaatccttttagaaaaattggtaatatatcaataagttgtaacacgtcatataatggcatagttccaattttccctatccgtttcatgtatactaactttgggacaattatctatttgaccctactttgaagcttaactaccaatttgacatcgtttttcccagtttgcttatttgacctcgtttttcaaaattgaagttaccgtttcaccctgtttccaaaaaccgtcagggttccatttagaacaaattaaaaaaaataaatttacaagcctaaataactaaaatgcccttatttactcatttcttatgctctgtatcctctctcaccagagcacaaatggctggaggtgcgacggtcatcgcggctgcagctgcggcggctacgttggctccacggcggcggcacgatgaggaggaccgccagcggcagcggcggctgcagaggggcgacgagggctggcagaccatcgcagtggttgtgtcagctcggggggcagctgggctcgacggcagcggcgcgacgaggaggaccaccggcagcacgacggctacagaggggcgaggcgacgagggcaggaggaccaccggcggcggcgaccgcggcgacacgcggtgggagcagcggcggaggcgataaaccacggtgggagcgcgacggcagtgcgtagtgggaacagaggcggcctcggcgatggtggggagcgggagagacggcgtgagcggcgaaggggttgacccgcggtgggagcggcggcgacggcgtcggcgtgcggtttgagcagggacggccgtggcgacggcgggagctttggaggcgccgacccgcgatgggagcggcggtgacagcgccggcgcacggtgggagcatgggcggtcgtgtcggcgcacggcagtgaccgcgtggagcatggtgtgggagctcgttggcgcgcggaggccaaatggttgccgacagcggtacatgcgagggcgggcggcggcgcgggagcttgtcggcccgaggaggctgggcggcggcacgagagctcgccagcgtgtggagggcagagcttggcggctcgggagcacgccggcgcgtgaaaaaaaaaatgttgaataaacaattttagaaactagggtcaaatgagcaagggtataaacgtctatttttccctgaagttaacactgttagcttgcccttcacataatacggttagatccgaccttcattttttaaaataagggtcaaatgagcaaacttgaaaaattagggttaaattggtagttacactccaaatcaggggcaaatacgcagcaaatacgcaattaccctaactaactttttatttttcatgtttgagtgcacttgatgtatatcggtgtagtagcacgcgcgtgagattctcaccgtcagacatgacgcacctcgactttggggctgttcaaattgatgacagtttcaaccataccattatttggtaaaattgataattatgtggttatatttagtttgttactaattattggcaatacatatagaattttggcaacactattgaactaatcctaccaaaattttgacaatgttattaatttgccaaaattttggcattactaaattttggtagcgttcattttggcacaaactgaacaaaccctttattttaagagcaagggttttgtcgaatgtttatttaaatcaagattgttcttaaggggtgtttagatcccaccccaaaattgtacgctatgtcacatcgaacgtttgaacacctgcatgaaatattaaatataggctaaaaaataactaattgcacaaattgtgactaatttgcgagacgaatcttttaagcctaatagctccatgatttgataatatggtgctacagtaaatatttgctaatgatggattaattatgcttaataaattcgtctcgcgatttactggcagattctgtaatcagtttttttattagtgcctgaacaccctatgcgacaccctatataataaccgatgtgacacgccaaaactttacacccctggctctaaacaccccctaaatgcaactagtgcatgtgcattcatgcataaatatcacccgtaccacaggcgaagccgacaatgaaactcgccaatatcatagggtgctaatgccaccatctcaaaataagcaaacttttatatattatcagattcatacataaaaactagttaaaatcaatccacaaatcttatcgattttggatcactaaatgtgctttacgatccgtgctctagacccttctcctctatatctgatgacctcatcttcttctccagtgtcagtaacgtcccaaactctcacggaggaacagattaagatcctaagttggaataggggtgaaaggggatgggaggaggaggagttcaccagctttaaaggatgaccatgagagacgctgtacgatggtggacgcgcggcagaacgggccggtagttagacggcgacatcactgttgaagttgtaggggtcgatggtggatgttgggatggtgtttgcgacggggataaagtggggcgaaaaggttaggagacaatgacccatggtggcgaatttggtagcggggagtcatcggagacgaaaacgatgagatgcgggtatatcgcgggcgtcagctcgaggaggatgagaggtggggaatgagaagaaaggagagggaaagggaggccttaccggcacggcttgcacctttccggcgttggcgaggaggagaagggatcacgaaaacggtgttgcatagtcggtggtgttatgcaagggaagtgtgacacacgctacaaatctcaagacaacttcaacagttaaaaattatataatttaaattaggattttctgtcatgtcatataggtactcatagtataaagtgaacatcgtgatgaactggatcgagaaattaggaattctgaaagaacgaaaacattttcggataatcgagatcgttaattcgttatccactagaggggacgtacgtgcatgtaaacgtggaagcgcactaggcccgtcgtacaggagaagcacggaagctacggaagctggagcagtgcattaacacgctccaattacttctcgtgtgggtactaattaaatacggatcagtactccaatattaatagggatcgatcaaagatcacacggcacgtacgcgcgtaccctgcactgcatctgtaccgtctggcttgggatgccctcgatccatgcatccatcgatcgatcgggtccggccggtccggactgcctgcttgtacctgcacaggatatatgagcagtgactgtaactgtattggctacaaatgacctggccggtttcattaaccctcccatcacatgtgaatcagtaagtgcgtattacatgtgcagtagtaaaatcgatggcgccgtgttagaagcccaaaacaaagcttgattttgtctctttgtaaccacattttcggcacatgtcctgaatgcatatatattatattgatatatatcatgttaagatgtactggtacgtgctttcaagcctaattaacaatgatacgataaaaacaggtgtaagacctctttacctactccctccatacctaggaaagcttataattaatattataagaatttgctggttggtaacccgtttttataatctaaagaagtttgattttttagttttctttaagtttattttctgtattctacaactataagtgtttatattaatacttaatttccattccgaattacttacatagaaccattatatcaatttttaagatgaaatatggagttgtgataaattatggagctgcccctattaattacaacattagtacgcctttgagctggaggagtggattacaataaaaaagcagatgcattgataaggcgcagagagagaagatattagccaaatgttttgaaacatgggaatgagaggtattttgaaaaaaaaaaggaatgtaatttgagaccgacggagtagcatttcacaattcctttttactaatttcacatatatgtattcatttgggctaaaaaaaattaataatttgccactagttcacatcaccataattttttgggcaaacacgattaattctcatggtggagttataggcatataactctattcatcaggattgaaatcctaatatctaaaaataaattgcgtgtatttttagttggtgcacgtattgaaagtgatactccatatatatatatatatatatatatatatatatatatatatatatatatatttgcacggtcttcaataatatatttgactataaatttatttcatgttatatccccacaaatatgaaattaccatcacatgaaagtaatttaaaatataaatctaatgatataataagtataatactgttagtatgattattacttaaaagttattgagtttataatttaagacggaaggagtattgtcattattaataaaaaaccgaaaaaaagattgaggacacaaagcactaggatagccagcaggtcagccatgtttgagaggactctcgcggtgcatgttttcatggatcgggggattaga

SEQ ID NO: 67404 - DNA, 1259 bp, Oryza sativa
gcagaggttgtgcaggatgaagagattggtgaaggtgtggagggtgtgcgggatgaggagattggagatatcaattcgaagcccgacaaaccatatgttggcatggagtttcgtgacaaggacgaggcaaagaactattatgatgactacgcgaggaaatggggtttcataacaaagatttcaagctgtagaagaagccagatcacaaagcaatacaatcggtatgagttcgcttgccactccgagcggagctcgagggaatctggtgctagtgctggcagcaggtcaaggaggtccagtagagttctgaagacaggttgtaaggcaagaatggtggttgtgaagagggatgagaagtgggtggtcaccatagtagatctggatcacaaccatccacctttgaacccttctgcacttatgtccttaaagcctcatcgcctcataaaagatgaagatcatgatctcttagagtttctgcgcacaaacaagatacccacgcagaggatcatgtctgttctctgtgatttgtatggaagcatgcaaaacatccctcttgcaaggaaagatgtgagcaacctgagggcgaccatgaggccagaggctgagggcacctgcactgatatcgcagctacaatcaaatacttccaagaatcgcaagcagatgacccatcattcttttacagtatggaattggacagcgaaagcaaaattaccagcgtcttttgggtggatggagtatcaagggaagcatatagagaatttggtgattgcgtgttttttaacacaaaatacatcacaacaaagtactgtcttccatttgcgcccattattggtatgaacaatcatgggcagactgtgcttttcgggtgtgtgttgctgaaggctgaaattgaggagacatttgaatgggtgtttcagacttttcttaaggccatggatgggaaagtgccaaagagtatcatgaccgatcaagatgaagcaatggagaacgcaatcgcaaatgttttgccaaacacatctcataggcgttgctcatggtacatatggagaaatgctaagttcaagcttggtgtgctgccgtctcggttggaagggtttgaagatgacctaagacattgcattgacgagtcatttaatgttgaagagtttgaaagaagatgggctgctgtgcttgaccgatacaatttggcaagcaacaagtatatgcaggacctctacgaaatcagagaaaaatgggttccatgctatttcatggactg

SEQ ID NO: 67405 - DNA, 6393 bp, Oryza sativa
agtatttgtctgctaatcctgtttttcatgccagaaccaaacatattgaaattgattttcactttgttcgagaacaggtatctcgaaaattgctggacatttggtttattaatacaaacaatcagttggctgatgggtttaccgaagccttaccagtgcgtaaactcaatgagtttcggcgcaatctcaacctggttcccgtgttgggattgccggggggtgttaaacagatagatagttcggataggaacatatctgttgacaagataagatagagtttagtttgtttcttatttttctgtttcctttcttctcgatgaagatgtaatctataaactcctatgtacacgccacgccaggggctgtttctggctatataacacgggccgtggaaccgagagaggcaatccacgttaaacccatctttacagacatgatcctgtaggatcaagatgtcgactagagggggggtgaatagacgatttaaaaactaaatgacacataaccaaaactaacctaagttgctaggctcggtgagggtcaagtctaacaaagcaactaagttaagttttgtaaacctagggtgatagtggctcaattatatctctaggaaagtaaatcacactctaagtcaatgtttagcaatcctagggtgatatgatcttaagtatgtctctatgaatgtaaattgaacaaatgtaaatgcgacaaataaatgagacaaggaaacaagagatttttcaccgaggtttagaaactccccggtttcctactccccattgggacgagcccaactccaccgctcaaccacgaagccaccgcacgcccccttcgtcaaggggtgggcaaggcgggagccggcccacggagaggactacccaagcctcgatcactcgaagtagtctccaatctttagcacctgaaggctaattaagtactccctccgtactcgtaaagaaagtcgttttggacagcgacactgtctccaaaatacaactttgacttcttgtttctatataaatatttattgaaaagtgatatatgtatacttttatgaaagtatttttcaagaaaaatttatccatataatttttatattttcaaactcaataacttgagagttattcatgatttatattcccaatgtttaacttaagcattgtcctgaacgactttttttacgagtacggagggactgcaccatattttgttatcatttgttctcgtggaaggtgaagaccaatcctgaacctcattcttgttcaagagtacaagacgtgaaaagatcagagctgcaagtatgtacatggtcattgcatgattaggctctagttagcaaattacggctgtgttcttttggaggaacctctccccttcgcaccgaaaacagagtggtaacacgtgattaattaagtattagctataaaaaaacttgaaaaaattcattaatatgtttttttaagcaacttcctatataaactttttacaaaacgcgtactgtttagcagtttgaaaagcgtgcacgtggaaaacaagggtgataaattgggaacttattggaaagaacacggccgcacatttatctgtttgatgaaaacacgtatgtgatggtagtggatagattagtactaaaatgctatatatagctggttggtacccgttgtttggttgtctagtaactaagaaggctaaatgtgtcattttactctagagtaaacggtcaatgcacggtcaacacacggtagtggtatgaaagggtgtgcaaatttgatccaggggcatataaggaaagagccagtttcaaatggcatataaggaatacaacaagttttcaatggcgtataaggaattctctcgagaagaccaaaattctgaaataatagatatgtgtcatttagactcttaattcacttcctcgcaaaaaaaaatgactcttaattcactagtatattaataacaatcttttcgaagcccacactatatttaatttataattagccagtttgtatactcttattttttcataatctaacagaatacgttcaccttaggaccatcaatttgttattgagtccgaaattcgtccctcaaccgaaataccagatataacgggtccctcaaaatataataccggatcacttgaggttctatatagtgttatgcccgatttcggctaatgtggcaagctgagtcaacgtggaaccgggccccacataatcagtgggtagcactttctcataggttgattcatcttcccatctcgcaaatgatcatattggagagctgaggcaggggccagcagcagcaccaccagtagtagcaacccggtgggtacggatgtggcggcaacggtggctggtatcacaaacggggccgggacaggctgtactcaggagaggatggtcgtggacacagccaggatgggtcgtactcgggtggacatggtgggagttatggttgaggaggaggcacaggtggtggggtgccgtactatggcggaggcggaggcggtggaggaggaggccaagggcatggatgcattgctggctgcattgagagggagtgattgatggcgaggcggaccgatgcggcaccgaagctcagaagaagcgaggtggcggaggtatgctgccttatgctctgcagccatgccccgtgccctcctccacccttttctctctctctctctctctcatcttctctccctcggtgggtgcatcgagagcgagcagttgagggtgagaaggactggtggcgccggagctcgtggaggagaagcgaggcagtggcggaggcctgctaccctatgcgccacagctgcgccccacaccctcctccacctctctctctctccaccttcttctctcttctagcggtggatgcatcgagagggagtagttgagggcgaggagaaccggtgcagtgccggagctcgtggaggagaagcaatatatgcggcggcggaagcctactgccctacgcgccgcagatgccgccctatgcccacgggatccctatcttggacaagaacggcactgatccctttctcaaggcacccattctccattgccgctgggagactggcaacaaggagacggtgtggtacttctgtgggccattacgatgccagcaccaccatctccaatgctatagaaggaggagctctgtggcagcataggaggcaggtgagcttccaagggcaactgaggaggtggaggacggcaaggactatcctcgaagaccgcattctggaacagggaagcccatgtggatggtgaggttggcggcgctgaggaggataacatgggtgagcagacaccgttctctccagcggcggtgaggccatgtggctctccgttgactaggagagggagagaggaggaagggagagacaagtggaaagagaggggctgatgatgtaggtcctactataattttgcttatttttaagtgaacgctaactgacatgtgggtctcatgtaggcactatatcaattgaaaccgacatctaaactgtcttgagatcatatttacactagctttgggacttgaggacacatcatatatattgtggttcggggacgaatttcggattaagcgacaaattgagagactcagtaaacttattcctaataatctaaccgattttgcggttcagagacaccgataaaactcgatcatggacttttccttagcagcccacagctcccacacggccacaccagctgggtccgaaacataggcccaacaaggagcaacaaccctgttctagcccaccactcgacgccgacggccgacaccgctgacacgctgtccgcggtccgcggtccgccgacgcttgcctcccgcagccgccgcccgtcggccctcccccctcccctcgctggcacggcggctcggcggtcgccgagcactgacccgatgctgcgacctagccatcggaggaagagatccttagccgatgccgtgaagaagctggtgaagcaagaggaggagtggagctggggagaaaaggtcaacttcgtgggggtaaggatcagaatatcatatccaccactttctttttacaggcgtatttaactgtacatgatctttggttaggtaagacaaacaacacaattagtcaaagtttttagtatgaagcattgaagttccctaattcttccaataaaatgcaatcggacttgcaatattaacttgaactgcacagtttacctgttttggagaagtatacaatttcttggccctgcccttttcagatgttttccagaaaaaaaaaacaatgccttggccctggatgaccgtccaaaagaatactcaatactgtattcaacaaaatacaaaacacaaaaaataaaaattggaccgatttggaacccgagaaaagttttctgatgttgatctgtggggactcaggtacaatttcttatgtcctggaaaattactatagaactccgaacttccgaataggagatattttctaatgttcatgataacaacatttgtcaatactctatatttccaggagtacaaaatggtgggctcgatgtctttctctattaatgtgtttcagtgtacagacgggtccactagaagtctcagtctccttagcaccacagggaaatgattattaaagatcatatactttgtttaaatttattttgacctgatgagacgactttgactactggctgaagccagctacctgttggaaaattgattggctggtggccatagaaggagaacgaaaatatgggttggtggagttctcatatggctcagacatggtctcatggtgtggagagaagcatgagaaaggagagagtagatcagcaatacgttgtttctattcattgatatcttgacatcttgtttctattcagtgatcataaccagtccaatccagtttatgcagttttctccccttcgcgatggagttttcatgcatctggagtgatcttatcaggtaagttctttccacgttgtctcatcattttgttctccaggtttcctgtaatcatatttgatataaggtagtgctaaccttctctccagatcatggcttcatttttagaaataagctctgccctttatttgatatcttcttttcctgcttcgtagagttgtttgtgatcttacagttttacaggcttcaaaacccagctattttggcttcaattttttcccattacagttatttaattaatttatgatctaccttatgttgcttttgtatgttttcctcttgaagttaaattaggggatgttcggcacctagatttgctttaaaccaattcgactttaattcagaattccaattagagtaaatttaataaaaccccatgttttattaccaaagttaaaaaaatgcgttattgtagcatgtactttgatgctaaagtttcacaaaatctcaaccctatttaaattccagacaatgtagcatgtatttacttaatttttgccattataaaatgtctatagaatttgaattacgaatttcttggttaaaatgtttcattatattgaacccttcattactctgaacaatattgttttaaatatttaaaatttgctaagagttgaataagggcgggactttatgaaaattttaacctatatgctaccagctataactcccagagtttatagcaagtttgacaatgaataacctatagtttactgtgaaatttgttcttgtatttactttgatatttttgaaatttgaatggaaaaccatacaattattttttagatttaatatgaattccttttttcttggttgcttgacatggactctttacttttaaatttgtaatcccaatttgaacacagagtcttattaatgaaactgtttcgaggactggattggaacacagaggagatctgcctaaacaggattggactggttatgatcactgaatagaaaccagagtcttattaatgaaaccatacaatttgaacgcagatctcctgcgtgcaaaaaaagttattgaacataggctttttggggtcgcgggagggggttgctacacataggccattgagctcaattgaggcctgcacacaaacatttgttttagtgcttgagctgaaagaatgtgatggaactgtttcgagaaaatcactaagtggggatgaactgtaaatgttatatagaatttgtagccttttaaacatctaggactatattcttgaaggactctaattaatattctttgacaggagtgcaaaaattgtcttttgatgacctagacatatcgttaatctgcggcaaccacatagacaatgttgcattttctttctttaatcatgtgcctgtagatgctactgtcctgataccatccaatggcttgttctggagtctttgttctgttcttgggctgcaggaat

SEQ ID NO: 67406 - DNA, 1708 bp, Oryza sativa
cacagtattatgatgcaatactaaatggccttgaggtcttcaagctatgggacattgggaaaaaaaaccttgctgggcttaaccctccacttccaccacaaccaaagactgatgtgaaccctaaaggggtgtctggtggagggaaattaaaggtgctgtcccagcagccatatgtgccgtggttgtgctgattacagcttgtttttgtgtgtgcatcatctgtagacgaaagaaagtggcaaagcattctggcaagactgacaaaaagtgcttgacttatcaaactgaattatacaaatcaccatcaaatctttgtcggaacttcaccttccatgaaatgcaaatagcaactagtagctttgatgaaacccttctgcttggtagaggtggatttggtgatgtgtaccgtggagagatagataatggtacaacggtggcgatcaaacggagcaacccattgtccctgcagggtgttcatgagttccagaccgagattgagacgctgtccaaggtcagacatggccatcttgtgtctctaatcggatactgccaggaaaaaaatgagatgattttggtgtatgaatacatggcccgtggaacacttcgggagcacctgtacagcaccaagaggccaccattaccatggaaggagcgcctcaagatctgcattggtgcagcccgagggctgtattacctgcacacgggcccgaaagaaacaatcatccatcgtgacgtgaagactgccaacattctactagatgacaagtgggtggcaaaggtttcagactttgggttgtccaaggttaatccggacattgacgccacccatgttagcactgttgtgaagggtacattcggatatttcgaccctgagtattttcggttgaagcaacttacccaaaggtcagatgtgttctcttttggggttgtgttgtttgagatcctgtgcgctcgccctccagtaaacactgagcttccagaagagcaagtgagcttgcgtgaatgggcattgtcttgcaagaagataggcactcttggtgaaattatagatccctatcttcagggagaaatcgctcctgattgcctcaagaagtttgctgattgtgcagaacaatgtgttgctgatcgaagcatcgacaggccagagatgggtgatgttcttcggaacctagaggttgctctgaagatgcaggagtgtgcagagaacaatagcaaattcagtgaagaaacaacatcgtcgaagacaacaccagacatgatgaccatcatggatactgacaaacaatccacctactcgacaatgagcatcactggacaaaggaccatattctctgatatgatggatccgcaggcccgatgaaacacaacagttaatgtttcaactaatttcagatccatagttcatgtcctggtgatcttttgatcgcaatcactctagtatgttgaataattagttgtttcagatttttcatactagttccaaatctaagcatagttagacttatcaagtaaataattctgcataccatttttaagaagtaatgctactgtttgagtggttattttgttgcttttggatagtatagtttacccaatctatctacatacgaaggtgctgttaatgcagtgtcgatcttaaaaaaaagataattaagaagcaaagtttattatcatgttaatcagttgttaatgctatagttcagctgtc

SEQ ID NO: 67407 - DNA, 6771 bp, Oryza sativa
ccgcggggtccggtaaccgtgccaaaaatgataaggggaacctggttacgtccaacaaggcaacaatttgtgagatttggacaaaaccacttccccatataaaatacatctataaaatacttcagtggtggaattttttcgctcatcaacgggcaaaatggtttacttttaagtaggttattagaatttttatttttaaaagtaagttattcgaaagtttgtttttaaaattaaacaaaaagaggctgaaaaaatcattaaaatttacatcttccaccaagcattaccatatgtatgattttttaattagttttttagataaagttacttttgcttaattagtacgtaatttttcttatagattcaaagaccactagatgaagttcgcccaaagacatattcaagtagataactttacatgggtttaattaagggttaattggatccatgccattgcaaatttgtttattcagaaaaataccattacaattcgtctattcgtaatcgtgccactgaaattttacaaaattaaaaccgtgccaatgccgtcacgttattcattcatcatctgcattttccgtcttcttccatcaccttctatcctcaccggcgcaggaggtaggccagagcacggtggcggcgtcaaggcagtggaggatggcggcagcaatggtgccggccatggggaagaagacgaagccatcaccgtcagggaggccaggggcgcgggaggcagggcagagcgcggagtgcggtggtggtgtcgaggcggcggaggaggatgatcgccgcgatcgccgccgtggaggaagtcgcccctggcgccggatccggcgagccggtggctggatccatgtggtggcagaggaggaggaggagacaaggggatttggggatttcgccgccgcttccgcacgagatctcgcccgcttgggtttcgccaccaaatccggaagagaagggagaggagagcgcggagctaccatgctacgctgcccgccgccgcctgccatggtttggtcgccggcaagctctctctcctcccacgagctcgcctcactgcgggagatggcccacttgacgccactgtccctcttgctgctgccactgctccacgtcagttactccgctgatgtggcaggatggcgtcgagcacgccgatgactgcgcggttatcgtcctccatgaggcgcgcgggaggcgtgacagcagagagatgagagagaagactgaagagagaaggaagaagatggaaaaagaaagagaaagatgggaaaagtaacgacaggggcatggttttaattttgtaaaattttagtgacacaactacaaatagacgaattgtaatgatatttttttaaataggcaaatttgtaatggcatggatccaattaaccctttaattaaagcctcgtactccacctgtgaacacacgattccatagccatttgttacaacgcccttgtactaccgtctctctcctagccattgcatcaaacacctgacgtacgcactgtggcattccatggtacacaaagggcgtcatgacctcttctcacaccattcaaaatgagtgactgccacccaaatatagtgatagtctgatagagattcttgtgttactgaacaattaattatttcatctctcaaatctcacctgggcggcttggtcctcgacttcgccagctgagccaccgccatccatgatcgaccgcttggtcctcgactttccgtaccggctcttgactggagagtcgtcgcagcgacgccgttcggccactgctcgagtactaggttaagacgaaatatgatgtatggtgttggcggattgagagtgacataatcttaaaatttttactcgagcactataggttagaaatttgtggccccaagtgtattcttttctttttttttttaaggaatctctctccaattggcttggaaatatcttttagtaaactgctagttttttagtctcctccaatgataacacgttttgtgatgtctagctgcaaaattgtctatatcccaatggatccgattatatagtactgcaccgggtaatatactaagcattccctctgataaaagagctagagtggtctaaagtgaaacaatgatccaattagcaattaagtcaaaaaaatgtataagatctaataaatttataataccatgcgaatattttttaagaaagacatgtacaatttattatgttttaaccttaaaaataagtatttgagaaattatcgatgattgtaaattttgaagttttattaaatattatcctaaacgtaagataggggaagaaaattcaaatagtaaatttgggaattaaaatatatgacgataccatacatttgcatattatatatcgtattaaaagatgaatgattaaatccaccttagcaatgttttgcttgaataactaaaatacccatgaaaatctatggtaaaatttgagagaactcccattcttgggagaggtatatactctcaccaccacttgagtcaaaactaactaatagatacacaggtgaatttccaatcttattctcacttatgggattacttttgatatctcttttctggaaaagtaagtattgctcatgggatgagaaggtatatagctttgttaggataggagaaaacttctagatttaaaattctactccctccacaccaaaagaacttcatttctagcactaccctttgaccagcaaatcgatgagttatttattcaatactcctacctcactactagaataaacatttttcccgatgtggggtttttttttttttcagacggacatgacccttggagccaaatgaccgcctacaaaaatataaatcggggtgaagttcgctgttcacaggcggaccatttaagcggtgcctgcaaaaatgattttcgcagacggaccacttaagcggcgcctgcaaaaatctattttcgcaggtgaaccttatgtggtccacctgcaaaaatcgtacctacccaaaaaaaatcttaattcttatcttctcctcccacccctccccaccactatttccctctcaactctctctctccctccctcaacacttctctcctctccccaccggcccgtccccatccctccccgctggagggggagcgacggcggctcccggcgcggcggacgcggcggcggcggcggcacggctcccctcccagatctggccggagggaggccgagggagggcggcggtggcgaggcgaggcgcgatttctttttttgttcgtgcagaggattatcgcaggcaagccattgggcagtcgttggtctacaaacggtccttcccactgcctggaaaaaccacttttgaccgcctgcaaaaatacttttttctagtagtgtattttatcttccacacgcgtaaggtaaaaagatgaagttattttggtctaattgagcggtacctcactacatcgctagtacagttgaagggtgcgtgccgtagatatctaattgcttagttgcaaatttacctaaaacaggtcacactttctattttttatgcaatggatagttaaaagaagaaccagtgtgcgcatattgtggttgtccgtgtttgtattgtgtttgtgtttcgtaaaaaaaaaattgggttgtttattgataagttggatggcatattgacaaattggccggcgccatattttttgcccctgctaatatattcattcacttggttataaaatgcccatgcccacgacctcagttggcgcgtgagacgcggcaggccaggcgacgtcaagtagaccgatcgacgcgcaggccgcgcgcgaagatcgtatataccttcgttcgcccccgtactgtgagttctttcatgtcaatcaattagcttcaacacatgcatatgctatgcgctgcctgcaccaaaacacaccagatcaaaataaaaacgataattatatatatgcagcacctgacctgatttgttcttcaattctagctttgacgaacatatatatgtaaacctctcgtcgttcatggcgtcttgtttagcaggcaactccaatatgtacgcctgcagccgaagagctatagcgcgctcggcagtttatgcatgatgagaagaaaaagggtcttagttcatcacggtgaaaaaaaaccttgagaaaattaagttcagtaatggccacaaatggacttttcccaataagcatatatgcgcttctagatgatttttttttgaaatgtttagattaattttactaccactagcaaaatacccatgtactatatattcaactactatgtaggtccttcggttcgtcgcacaaatcgaggccggtcaaattaatgcgcacgctagcaatataattttacaaacaaagttttatacactgggagcaatatgatcaaagggtgattttcctctgtcttcgtctttgaaaccttcaagattctgcatccaaagttattcttgtcgtcgttgacaaagtgcaatagagagaaaaccacacaaaatcccagaaagaaaatactattactgattactaatattgccgttgggtatatctcacttttatataaaaaaaatggacacttaaatagggtcaatcggaattgaggatagtgagaagtgaacttttaaagattaaaacatttttttggattatagaaaattattaaaagaattttggaaaaatgattggctttggattagatgctaacaggttgggtcagccaggaggtgaactagactttatcttcggtaaagggttaatgggttggtgggctggagttcaatgggttgaggtaggaggtagcattcgtggtccatagccgtgagatgccccgagttaccgacttatttataatataagtggattcacgggtcaacccacttgcacccttagcccccgaccctaggctgcaccgacagttgtcggcggtggcaggtggtgccccgtcgaatggcgcgcggctcgctggatgggatggctgtaggagtaggaaacggaggggagggcgaaactattgaatgggttggattggaaggagggactgtgaagatggtcggcgactagcagtgaagaggctcggtggagtgtggtcattatttggttgccggcagcgaccaaatcgacggtggaggaggctcgggatgggtttggtagggtgcagtaatcgcgaactaaaggaaggagggaggaggagaaggctcagtggtgaaacgaggggatttttcgccaacggcggtaatatattgtggatgggagagaggagagggaggaggaaagtacatggtgtggtgcaaaaggaggagagggggtggcttggagctttaaggtgagggattcgtcggccaatttaaagctgagctcagcactagctaacacagaagagaggcaatgatgtgcgattcatgtcgcagctaggagcggcgcgatgacaactataacctgtgcggaggtcagggggaagcgaaggcggtgggctatcgggacgacatcgatgcaatgaaacgatgtggcggagctgcaagggcggttgggcggcattgcagctgtagttgccagcttaaggaaggaggtgtggcgggtgggccctactgtccgctgctggccatggagcgaccgagcgcgctagtctatggctcgagcggtggcgcatttggagggaattgggctattgggcctaattggtcagcgcaggttgcgtgggagaaaggagaaaaagcgatggagagaggaaggaggttgggccggcgggaggaagaggaagatggttggctgaagatgaatagtgattcgtgggatttttcaaatcgatgaatggagatggaactttgattaattcaaattcaggtttgaattcaaatttgatacttgaactcgagaaattaaggaaaggccaaggaataaaatttcaatggaaattttgatagaaattgatatttaggcccgtttggcacagctatagctcctaactccaacttaaatggagacggagttgtgccaaacagtccagatcctccgttttttggagtggaggtagcagagatactcctagaaaatgaactacggggatggagctaggtttttgctgctccataactccaatccaccccaaaagacccactaccctttaactttttagtctatttacacaaaaaattaccactcaactacccttcactcctcctctcctcccgttctctctcctcctccatctcctcccgatcccaacctagctccacagcgtcagcgggcgacggcgacaggccggcggcgcgcggagaccacgcgtctgggaacatcgaacagctagcgggctggcggcgtgcggcactcggcgagacgatgcgcggccgatggccggcggagcgcctggggatggcaaacgaccggcagggcgcgcctggggccggcggctatttttttttcaattttgctagagctgaaacgtacccaaacacttttcaacgagccttcaactccaatagaagctagctcttactggagtaggagtttggagctcggagttggagtttggagccttaccaaacgggccttaaattgatgggaaatttatgaaaggtatcagagggaaattcgaattccggaatttgaaactggatcgggatttttgggttgaagattcactggtggagaaaccatctttgctcggtcggccaaaatccataatagtcccggttgcaataaaaaccgggattaaagattatctttaatcccggttcaaaagtttagagctgccttttaatctttagtcccgg

SEQ ID NO: 67408 - DNA, 2563 bp, Oryza sativa
gcgggtggaggcccgggcggcctcctgccggcgcggcgtcagacggagatacggcacgtcggcacaccggcgaccggcgcgacagtggctggcagcctgtgttatttttcttttttttaagaatttgtgactcagatctgtgtatttgatttgtgtgtgatgtccgtgaatatgtgatgtatttgtgatgaattttgtagaagttgtgatgtaattttgttttaagattttgtgatctatttgaatatggctgatttggggataatttatttgggattttgggatggggatggagcgaaatcaatatattaaaaacacaatgaagaaaagaaaataataataaagcaaccgatctagctaggctagctctatctttagtccggttggtaacaccaaccgggactaaagatagatttttactcctggttttttcacccgggactaaagatagtgatctttagtcccggattggtagtcccggtttgaaaaccgggactaaaggggggttatgaaccgggagtaaagcccctttctccaccagtgatttaggaaggtctcaagcagggatttttttagatcttttggcagttagtccttaaccactgtcagagaacaaaaaattttggaattagggatttactaaaatagtttttgtcagcccaaaaaatcgtgtcgttatagatttactcaacaatgtatttcccagagttcgaaacctcgagattctacgtcttcgtagaggagcttaaaaatatccgtagaggagcttaaaaatatccagatatttttcaaccctatccttgtgatgttctacaaatgcaatcctcctcgacttgttgtacattctccttgcttgaacaagatccagcctttgcaaacttccttggctcaccacaatcaaaatagtgaccgaggtcgacacctagccatatacgagtcctcaacacctccaataataaatccctcacaactacatggaaacaaccatatatagtgctcaaatatcaagagaagcacacacttggtcacagcggcagagccataaaaccttcgtgcgtaagcctgagctagttagagctcaaatattttcacagattatatagcatatttcaagattagattggggattatagagctaggcatagggctcaagcccaacctaccccatgtctgtttgtgcccatgcttggtctgaaactccaaatccacacacccaaagattcgaaccacaacgatagagaaggatttgagagagcaagagaaagagttcaagatccaaagcactataggcaaagctctacccacaagcaagattgaattggatgaatggataaccttacagaagggttgggtggaggtttaaatagccaacataaaattggttgttgtgggggagttgggggggggggtggtaattttagtcccaccttggatattctgacttcatcgatggatatgctccaactgtgacaaacaaatattgtctcgtaaaaatactggtcggatattccaattttgatatcgaaaactccaaaagcaaagaagtaaaccaaactgagactcaagttccaaggaatacaaggcattccaggtgatcttatgttcatactactaggcgatatgtgatggagcatattgtttctacccaagagttgagtcctttgaattttggattgttcggtccgtctggtatttgatgtaagcattgaaaactccagtcaagaatttaatcccaaacacataatcgagttccttagaaaaacgaagattccgacggatcagatattccaaaattgcagcggatatcttgatcacttttaatttagcccaaccctcaactcggctaaaaaaaatttcaatgcattggaattctgtcagtgagtcagatattccaacctaaaaagtaccaagactttgagaaaatgcaacttttagcactaaattataatccaattattacatgtggcttccgtcttaatagtatggtatcttggactcaataaagcaaaatattagaagttcgccaaaagtctccaaactgttttttgcaccttgcatcatgaggtagaaaatttactatttcaaacaattaacaatcccattactaaattcaaattggttctcattaatcaccaaaagaattagtgccatatatgcactttcagttctcgatcgttacagactaaatggtgtcctcaatttttagagggggatttggtgtttgccagaatgatgggtctagatatagaattatgtcgacaatggccataaagtggtgactctggtggagatatggatggaaacgaaggagcaccatatgttctcacatatgaggattccatttttgtggttattcgagagataggacatacgtgacgtgctggagggcatcatcttggcatgtgtttggtttggggattatgtgggatgtgttaaactcatccatgtgttttaggagggatggtcctacttcttatggatacccccacatgtcaatgtgagagaaaaatctattgtattggtccacccatttttgagggataatgtaaacatgaacctttgg

SEQ ID NO: 67409 - DNA, 4560 bp, Oryza sativa
gatgttttcgttcagcggcaccgttttgttggtgggtgtgtagacatgagacgtagtgagatatcccaatgcgctgaaaaaaagaatttaggcattggtactcaccaccccaatctgtttggagtgcaagaatttttctatcaaaacggcgctcaataagatgttgacaatcatgaaaacattgaaaaacttcggattttcgcttaagaagataaatccatgtgaatttactgaaatcatccacaaaactaacataataggaacgactgccaactgaagttggggctggaccccatacatctgaaaaaataagctccaaaggagctttagaccgacttaatgacttagggtagggaagttaatgactcttcccttgttgacaagcatcacatatggtgtctttattggaatcactaacaaaaggtaaattattctgactaaggacttgatgcataatagcagaggagggatggcccagtcgactgtgccaccgggaagaagaaatcttgtggacaccaaaggcatgcttgacaactggatcggtagatggcttcaaagggtagaggcgccctttacatctgccgcgatgtagaagcctcctcgtgtcccgatcctttatagaaaaatgatttggatgaagttcaacaaaggcatcattatcaaaagctaaacgggatgcagagactaaactttttgtggcttcaggaacgtaaagaacatttttaagaacaagattaccactagagattggaacagtagcatgatcaatatgtgagatctccatacctgttccgttcgcggcgtggacttgttcattgccggtgtatttgtcccgtaccgtcagcttgtcaagttcgccagtaatgtggtcggtggcgccggtatcgacgtaccagttggtatcaataccatatgaagttgtggccgtgttcgcagccttctcctcgccagtgaaggaggtgtcgaaacgcttgtagcatttgatcaccgtgtgaccaagttttccacagagctggcacttgggccactcctgattgttggcgccgccgcgaccgccttggggagcgtcgcggccgccgccgccaccgggattgccaccaccgcgaccacgtccgcgctggccactcctccgccacgtccacgcatggcagcgttcgcttgagccatgccttgacgaagttccaaacgctgctcaaagctgatcagttgtgtgatcagctctgagatcgttatcggttccacgcaggctgcaaccgctgaaaccactggataataatcgaagtcaagcccggcgaggatgtaagacacaaggtcctcatcgtcgagcttttttccggccgcggtcatctcgtctccaggccgtgcatcttgttgacgtagttgatcacagaaaggttatccttctatgttgtggcgagagccatccttgtgttgatagcccgagctctggactgggacgtgaacatcccttcgatggtcgtccagacaccggcagcagtgttcatatgaacaacctgagaaagaatttcacgtgagagtgaaagcaaaagatagcttagcacctgctgttcctgagcaacccattcggtgtagtcaggattgggaacaacaatgtccttctcatcctttttcacgatcttggttggagccggcatctccttggtgccgtcaaagaacccagccatctgggcccctcgcagagttgcaaggacctgagctcgccacagggagaagttgccgcgagccagcttctctgtcaccggctgcgagagcgccggggaaggagcgatagtggaagaagatgacgccatgaggaaaagaggaagaaggctctgataccatgtaaagatgggtttaacgtggattgcctctctcggttccacggtccatgttatatagccagaaacagcccctggtgtggcgtgtacataggagtttacagattacatcttcaccgagaagaaaggaaacagaaaaacaagaaacaaactaaactctatcttatcttatcaacagatatgttcctatccgaactatctatctgtttaacaatgtccgcctgcgaaaaaaagaccccacgtcgggaaaatgctttttctagtagtgctggtcgcccgaacctactgttgttgcttcgggcagcgcctgcgacgtgcaggagccaccattgcttgctccgggcgctgcctctaccacaggtgccaccgccgtatcctggtctatgccgcaaccgtcgtcgccttcgaccacgacacattctgcgccgtagcctcgactcaataccagagcctacctgctgtttgggtatgtcgtaccgaagcgggcgattgattttaggaggttgggtttgggtcagttgggccttgttcttaggttgggccaaaggtcattttagtcatttatgtaaaaaactgacagttgaccaatgtccattgttagtcaatgcacggtttagtgatggtagtgacatggaagggtagggaaattttaagtcaatggcatacaagggaagagccaattttgaatggcgtatcaggaatccggtaaatttctagtgacatataggaattctcttgattgaatctcaaatgtaaaactcacattgatgttccaatacaagtacacctttgtatgtatggactctaaatttataatattttcttatctgaaaaaaaattaagaatccacgataacgctccattcaaaacgtttttcttcagcatctaatccactattatattttatcttaaatttgcatgtgtcttgtctaaacttcttcaaacagattggttcaaccttatagcatacacaactcctctgtaaaactacccctgcaatagtagcgactaacgtggatctttgttggttgcccggcaaaaggagcccgagggcttagaacccgttccaaatgaatctaccagtgccatgaggtgtaggaagcgcatgagggctacgaagtgcttcacagagtggatagagcatgagccaagggagaaatgttcattgatgtacgatgcggatggttcacggtaataatgagtgttgcgggactgggagtcatcttctcagatatcatgcatcctaaaggccgatgacatcaaaccacagaggttttattcgtgttgatatgcacggcatatcacacatcggttattgtattagttggttaattttcatggtgatctttcataatggtgtagaagtctcacttgtcatatattcaataaatcaatacataacaattttctcatggtatatttagttttagagatatttgacaggttggctcgtcgggtgataatttaccttaagtagttgctgaagaatcgtacttactgaagaatctccgtagcctcctccaagtcaatcaggaactgaggaggcaagtaatcaatccaatgggagtcccaggcgcattggagatccagagaccaaagcaagcacatctgattcttagcatcttatctagctgtttcattgcaaaatgtactggaataaatgcatgaagattgtacgaccattgcaacattcaaaactaaaatccatttaagctcttaattataagagagagttgtttaagaaaaaactattatattacaatcatctatacaagtgttttttttcagagaaacggattttatttttctacttcccttatagacacaattatttttagagatagtagctaactacttactttgcaggactaccgagagaagtctacccccactagctaacatagatatttattcttggcgtgcatattcgagatttagaatctctttccaattaggctaggctgaatcgggccacccgcccttgggtgttgccttattatcagcatggtgttgatgtagctcttaagatagatatgcctctgtaggcactagttgcttagggtgcaccacctcattatttgaatgtttatatgtagaagcatatgtccttaaaaaaaatgaacagttctatttctacgaaatattatctgcaatgtataaaaatataaaaggctaaaaacttgaacttttttatttacggtgaaccaaatatgaggattttattttttaagacctgcattgcgattctttatcgccaacatcatgtgctattatttatgaatactaaaattataatcatatgctaaatatattgattttttaattttaagttttgaaactaaagtaataaaatagcaacaacacattgatataattctaccaaaatttagtaacgttatcaacctgtacattgccaaatttcggaaatgttgaatttggcagtacatgaacaacctcaaagtaccaggttggtacgccgcggaacaccgtagcctgcccttctaaacgggataagatccaaagcgaaacgctgaatcgtacccatcctgatggcccagatcctgctgacgtcatcctccatcaaccccgcaaattcccccaccaacggaacactaagggctcgtcctccgcctccgccgccgcggctgcctcggcgtcggtggcaggcgccgccgtacgccaccgcgctcctttcctcgccgccgccatcgggctgcaggaa

SEQ ID NO: 67410 - DNA, 925 bp, Oryza sativa
tggtccaaaatgtgtttggtgaccaaagccagaacagaagatatgttgttcattgcaaattggaggatgagaccttcacatgtgtttgcaagcagtatgagagggaaggattactctgtgagcatatcctaaaggtgatgacacataggaatgtcaatctgataccagataaatacttgttccgtaggtggactctgaagggatcagacagtgctgctacatgaagtcatgtacctttgaacatggctgaagcgtccactaggaaaatgaggtattcaacaatttgcaagaaatcagtgtgcatggcaagtgaggcatgtagaacacaggaaggatacaatctagccctccgttcaattgaagaactgactgacaagcttgccgctattaacttgacccgacaagatcaacacctttctcggcccaacatttgtgataagaatgggaaagggatcaccatgggtgagagtaatacgatagctgagaaggtgctttcagaaagctgtctaaaagatccaacaaaaatcaggcctgctgcgtttgacaataatagtgagtcagcaagaaagagaaacaaagtgatgaaagcggtgcaagatctcaggagtccatttcaggtaacaaaactgacggattgaagtacagggtatcagtccatccttgatgtctgattatgtaaatgcaatagtgtccttgtgcccccttctcttaactcgctgacctgtaaggaaagaaggatttgctgcacatgggagaacggtgctagccttgttgacttcttctttttttctttttttttttttagcaatgccctgctggagttaatgtgctataacgtcattttggcactttggtagtgattgcgctcttccgtatctgaaattcttttcttccagtagcatagcatgtctgcaatgcaatgttg

SEQ ID NO: 67411 - DNA, 7937 bp, Oryza sativa
  unsure (1)..(7937): unsure at all n locations
gatcctatgcgcgcgccctgcagtgaacatagagcttcctgaagagcaagcaagcttgcgtgactgggcgctatcttgccagaagaaaggcatgcttggcaaaattattgatccacatctccatggagaaatcagtcctccctgccttaggatgtttgctgattgtgcaaaacaatgtgttgctgatcgcagcatcgacaggccgctgatgagtgatgttctttggagtctggaagctgcactgaagctgcaagagaatgcagagaataacaaaaaattcagtgaagcaacaacatcgtcaaagagaacaccagacttgataactatcatgggtactgacaaaccatcgacctactcaacaatgagcatcaccggacaaaagatcatcttctctgatatgatgcacccacagggccgatgaaggacaacagttgaggatttcaattaatttctgatccagagttcatgtattgatgatcttttgatcgcaattactagaatattgcattattgatcaattgtgtcagtttctgtctaactagaaccaaatgttagtgattctaaattccgaataaaaacccaatgctacaggtttgactagttttttcttgtttctgaatggtaatttaacttatctagctctatgcaaaggcactatatttccgttctgtggttcagctgtcaactgtactgattcctgatgtttccacatatccacattacattaggaacaaatatccagggtatctggagacggaacaaggctttgctgattctttaacattcatcacaatggttctttcatatcaatgtgaatttctgcaatgctatgaattggagcacactcgacacacacagtgttgcttgcactggctgagtgttgcatgggtcatgtgcatggtcaagaacaatgacctactacaggcgcaaatttctcatttagtctttctcgactattataaaaatagaagatctttttgccggtatattttggtacttcatccgtatttgagttggtttttaagttcgttcacttttggaaatacggattcatgtttgagttggatttttaagttcgtttgcttttggaaatacaaaagaagtcgtataagaaatttctttttaaaaaaacttgcatgctaacttgagattaaagtcagacttctaattgcagctcatgattttctaaaataaaatatccaagcaaattttcacagtgaatttcatcctagctaaaccgtataacaataataagattaaaatagcattcatccgttgcaatgcacgggcatattttctagttattaaaaaaaagaaaggtgaaggtatgagaaattgcctaaaattgattgatcgagcttgggagaacaaagctgtataagaatattaaaagccagaaacaataaagattagtttctcgacatcaaaggttctcatacttttgccaggtgcttgagcttcctccttaatcttctacatgaaagtgccatgaattgtgctgtgttgtaagcattcctctcgtgagcctcccagcaaccaagaagcgcaatgctggtcacggattgtctcagaaaatgccgatcacggacataatgtgacaaaaggggtaaatttctaggtactgatcacatttctttcaggtgcgatgtctattgacaaacaaaaatcatatggtatgtgatgttcttcaccccctttgtaatcttccttacctcagaaaatacgaatctatgttcttaggtgttttgtttctgaggtgcaaggtgtaaccgaataataacatatcgataagcttaaactgaatgataactattgaatgcttctttaaaaaaggaaaaaaaacaaggaccatggtgttaggaccacagagtcttgctcattggacaagaacactgcctcaaaggatgcctcttattgtcgcgcccgaaaatcaccctaaaattttatcgtctaaattatttctagaaattgtaaaagccaaaaatagccttcaacaattaaaattcaccaagtttcaactcaaattggcgtgtcggaatttttgtttgttcctcatgttttaaaacacttaaccaatttttactggaattttcagagcattctaaataattttaatgcaacactaacctttctcagttttatctaaaaacaaaaactaaaataaatctctctccctctccttgggccattttcggcccatctcttcccccccccccctctctctttctctacacatgttttctttagaaaaataaatcacaaattcacaaaatgacattcaaagaacacctaaaattcaaatagccatatcttgactatttgaactcggaattgacccgttcaaattgctaatttttccttaaacagtaaagaacccattttaatgctttgctcctgcaccttatatggtttttatttatgttttggccctttttctttgcgtatgtcgtgtagacactgcatatccggaagagccgctctacctagaagttgatcaggagattttggtagcgagcaaggcaagtcatgtcattttgatcatattgctgtcctaatttataaaattatgtttatttaaattattgcatttcgttttattaaaaattcccgcgtttatcactgttttatttagccttaccgattctccttgttatagccttattatttgtattattatgatccttgataactctaggaaaaatgaaactagtgagaactttatatatgtggtgcttactagtaaaattaggaatatgcttagccctggttaaatagaaacaaatagatgttttccaataattagactttgggaataacttttaaataatggttaatatggtttagtggctgtttagccatgacatgatatttccccttcaaaattccccaaacatgttttcagctgggttcggagtgcttgcttttgctagtcgcacctcggccatcataaggaccggtcttcgggccgaccgggcctctgttgcaaagcgtactccatacaaccacctgtctattgggtaagtcttaaccngggnnncccnnnaanatttnnncccggnnnntnnnccnttnaaggnnnttnnaanccccgtcataaacaaggaagacacgaatagggatggatgaagcccttgatggggtcgacgtctttggcttgtatgcccgggtcataaactgtctgctcacccanggcacctggcnnnnnacaagtgggtcnnacctctttgtttagggcagtactaaacaataggttatgtcatggcttctgtccatatgccgtggtggcatgtggcacatggaaacatgtgaggaagacatgtctggtgggtaacgatgtacacctctgatcagagtataatctattcgaatagccgcgccctcgattatgggcaagccgagcaatatacccaagttagagtttaattctattaaaattttaataactagagttatcacctgttggcttgggttaaggtaagatagcgttggagcgcggcttggtaataattttactagagaaaggtttatgttttatttaaatgcctttaaatatttaaatgctttgaaatgctagttttctgcaaaatagccttataaattaattctttgtactcccttgcattatatttacattttcccggcatggcttgcttagtacggtggttgtactcagccttgctcctttttcccacttgcatggcttgcttagtacggtggttgtactcagccttgctcctttttcccacttccagcagaggagtatttcagagatgatggctttgatgtttagctcgtgcctgccgtcaagcgtatgtggtggcccaacgtagcttccggtttttatcgtttatctttcagtgttgggcatttggtcgcccatgtaataaagtactctatttacgcttccgcttatatactttgttatttatcaactttgtaatgtgtaccttgccttctgagataaggaattatgcactcacaaacggaatatagtgttctattttccgggcgtgacagtcatccacatcatgtttccttcactagtcatattcagaaggctgagaataaatgcccaagtgctgccactgttcagaaggcttacttgcttagtactccctccgtttcacaatgtaagtcattctatcatttcccacattcatattgatattaatgaatctagacatatatatctatctagattcattaactaatatatgaatgtgagaaatgctagaatgacttacattgtgaaacggaggaagtatgtttttttttctctttcaaaaaccatttagaccaaggtcacccaacgacagattcaagcagataaccttgtatgggctaaaaggctaactaaaactcacctgtgaacacacgatctcacagtgatctgttgcaacggccttgtactgcaacctccgtctctctcctagacattatatcgaacacctgtcgaacacactgttgcatgccatgtaaacaagcacacgatctcaccacaccattaagaagtgaaaagataaaggcaaaatacacatctgtttgactaatcccaccaaaggatgggggtagtaattttggtattactgcacaattaatctcaccttgttggacctcgccatatccgagccaccggtgtccaactcccagtgtctgcggtgcctttgcctgtcctcgcccggcgtccgctttgccgacgccgcttgccgactgttggccggagccgcggagcgtcgttgcggcgacgtcgtccagcaaccgctcgcaactgggcgtcgccacggttgatcgatccattcaaccttgtgatctttgttggtttggttaatagccaccgagttagaaatttcaggaaacgaattaaccatcactatgctggtcatatatgtctactgaaacccaacaattaatcaaaaacaaaaacccaacaattaagctctcggaattctctttccaacggatccagtttgatctccaaattccatctcagacaatcgtaataacagaaacaaggtgttgattatttaatatgagagagagtatatataccttgcacctatacctttgagatatacaacatagttgcaactcctgatcaaagtttttgtttccttttgtccttcactcgggacgagcaaaggtttaagtttggggggttttgttgacggtcgttatcgatcagcttcgaccgtcaatattaccaaaatagagaagaactagtaatgtttgcaatgcatatatatgttagaataataatattccattagtattaggtttactaaccttttgcagagaataaccatgaaacggaggagaatcgatatcaacacagacgataaatcaatcggacgatgtcgagaatcagacttatgcatgaatgggccaataactcagaattgacacgacaaattgggctaaaattcacaagtctgcggagaagaacaacggaggaggccacctgccgaattagggccaggttgggccggcccctggttcggccgaaccagggggttcgcccgaacccccctggcgccgttggatgcagggttgcggctggacggtgtggattagctcccaatgatggttggagggtatttccgaccattccaaccgtcacaaccgttattgggaggctatataaacccctcaccttctcacttcacttacacacctcaagcaaggctctctcatattaagtttagtagtatcaagctagtagaataggaatagagtagaaatcaggagtccggaagtcttcagaagagttcgggtatggctctagtagctttccttttctcttttgtaagctttgtacttttattagaatactcttctatatacatttatggtattgaaatactttccgagtatataaatgcctactttacattatgttcatgttatactgaatatgctgctagcttatctgggaaatgctttggtgcgggtataatgtttgcttatgcaattgctctatgtcatgacgatgatattagaatagtattgtagtttagacatggtatttagattacgggatatcattatttggggttatatgctgtggatgaaaggtgggccgcagatggtgacagctcagtacgggtattcctccgcgcgtgtatataatcctaagttaaatccttggggagggtactcctccgtatttagccccggttgtatggtcatacaggctgtcgtaaggaactcggcagtcaggggtggcttctcaaagtacgaggagggcatcggatagaggggattagctagtatattggataactataatgtatgtatactatgtatactagaagtataggagtagattatctttctcttttctttccacttagcttatataatatattatgagaatgagtagctactgcttgtgtgtcactcccttggattatcttaacccctgcttaggatttgattattacaagtaatatataaattattagttctctctacatgatcttcccacgggataaaataaatacgatacccttggaatactctcgggtgaaatgctacaatggtatatccgtgcgcttgcggatgaactctgtaaccataatatactagaagtatttctgcgtcattgatgggaattatatttctagtaatgtcgttaagaaataccaacaagcattttcggcgccgttgccggggaagattcataatagagattacctgaactaatactttatatttacctctgtataatcactgccctttgcaggctaaccttggttgttttcactttttactgtgaaaacagggtagtgcatgattggtttcaacttgccagaaaacttcaaagaaaatccagaagctttcttccaaagcgtcaggccgtgagtcgttgctccgcagaaaactctaccggcagagaaaccagccgtactagcgccaccgaccttcaagactatggctgacaagaccctccgcgagctcgctgctccctctgctgacaatgtggccattgggccgcagatcaacatgggagatgtggatttcaacttaaagtccagcctcatcactatggtgcaggctagcccgttctgcggcaagcctaacgaggatgccaacgctcatctgcagcagttcctggagatctatggcacgtacactataaagggtgtcagtccagacaccgtcaggctgaggttgtttccgttttccctcctcgggagagcgaaacactggttttacgccaacagtgctgctgtcaacacctgggacaaatgctctatggtattcctcttgaaattctttccgatgggcaaaaccaatgccctacgtggaaagggacgagtccattcctgaagcatgggaacgacttcaggagtatgtggccgcctgtcctcatcatgggatggacgactggttgatcctacataacttttataatggactcactccaatgtcccgtgactacctggacgcggcagctggaggaacattcttctctaagacggttcgaggagccgttgatctaatagagaagatggtctccaatatgggttgagcgaggtatgcacaccgtcaaggagacggaattacttactgccaagctggacctcctcatgaaacgattggacgaccacgacaaacggccacaaggcaccgtccaggccttggattcacacgttacgtgtgaggtctgcgaccacacgggtcattctgggaatgactgcccagaaacccgtgaggaggcgatgtacatgggcaacaacaacaacggatatcatcgacaaggaggtcaagggtggaaccaaccacgcccgtatcatcaaggaggtaacaacaacggtaacttctctaaccaaccctccttgaaggatctcgtctttgcgcaagctaaaaccactgatacgctaagcaaaaagctcactgccaatgacaagatccttgaaaatattaatgttaagcta

SEQ ID NO: 67412 - DNA, 9362 bp, Oryza sativa
aagcatcatccagtgagtcggctgacaaagaggttcagccagaaaagactgtgccacaggagtactgcaacacacgattgctgccgtttcctcaacggagtaggaaaccgtcagtggacgagcagtttgctcgttttgttgaagtaatccagaagatccacatcaacgtgctattgttggatgctatgcaagtgccaacatatgcccgttatctcaaggatatcctcaacaacaagagaccactcccaacaacggaggtggttaagctgacagagcagtgcagcaacgtcatacttcacaggctcccggaaaagaagaagaatccggggtgtcctacgatcacctgctcgatcggtgtacatcagttcgaccaagccctatgtgatcttggagccagtgttagcgtcatgccaaaggacgtctttgacaagctcaacttcacggtgttggcaccaacaccgatgcgcctacaactggctgactcgtcagtctgttacccggcggggatagtggaggaaaatatatttttataataaatttatcttgggttgaaaatattattttttctataaacttggtcaaacttaaagcaatttgactttgaccaaagtcgaaaaatcttataacctaaacagagggagtacattccgatgacttctagaacacaagaatcaaaatcagtggattggtcaccgcgatcggcctgcagcaacctcatcgcgaggagcgaactgccagccatgacggacacccttgtcggtcatcttcgactgttcgtacggatcatcttcatgatggtcaggttcgaggcttagagctcctggccagcacgccaacgcagaagcaatgttttaggatcttttttagtgtacctttggttcgatgtggaccattgaacggatgagataactccttgctactacatctagtattagagtgtagtagtgtagtagaagggtaattgtgaaaaaattattatagcattattgtaaattcaccattaggattaggtgtaatatgtaattgctaatgggatcagatcgacgctaggtttaggggcatcagccaggaaaatgcttctcttcggatgtcctatcagatacaaaacatcggacgcctaggaccagctcactcctttacttactagtttctcctttctctatgttgacgtcaggaaaatgttgcaaatcggtagcatgtgaattggacgaacccctgtcagtgtaaacatacatgcctagccgtttcttttcattctttcctcatctctttaaatatttttctcctaaattacttatccgatctacgaaccgatcacactgttgtattcgttgcaattaaatatttacaacaagatatcacatgattatattatgtcaaaagaaaaacatgtgtttcaaaccgttaaaacaaaatgtttcatacgtgatagtgatatgtttcaatatgtgccttcggtgtgtttcacaaaattcctgaaactacctgctactactctctccccacctcatgcatgcatgcatgtattttagcaagcttcaaaataatttttctcttaagttacttattcaatctatgatccgatcataccgttgtattcgttgtaattaaatctttacatcaagatatcgcatgattatattttgataaaagaaaaacatatgtttcaaaccgttaatacttgttgtttcatatgttacagcgacatgttctaacgtgtatcttcatcatgtttcataaaatatttaaatgtttcagttgcaatttttttgtttcaccatatataacataatgtttcacttgctggtcaactgcaacatttaactgtccgatttttttttcaatttaaaaaagtttcacatagtgtactcgtaatgtttcactatttatggatcaaatgttgcagtgaattgaaacatcatttcactattcgctgaaacattattttcatataaggtgaaacagcgtccgatgaaatattttcgatctacttagtgaaacaattctgatatacttggcgcaacagcgtgcatcatttaaaaataattcaataataagctattttttttcatcggattatatttatgtgtggtcttgttttaaagatttaattgcaacggatttaatggtgcaatcggatcatgattcggataaatattttaagagaaaaaatagtttaaaccttgcttaatttatgcatgatggatggctggcacacgctgcatgatggggatggttggcgcgtgcgtggatcagacggtcgcgtgaggcgtccgatttttcgtctcgcgccgtacgtccaacacgtagcgctcttccatcagccaggcctttggccgctcgccccccacctctcggcggcgctcccggcgtcgcctgcccacctccctcctcctgtaacaacttccggcggcgcccgtccccctgcgcctacctcccggcgccacccctacccccggcgtctccccctccccccttcccccctctccctctcccggcgtagctctaagcttaactaggtgataccccacgctttgctgcgggaattactaagtaatcttcaatatgatttttgttgtgtgaacaatcgagctattgacaacaaataacgggtttgctgaactttgttataatggagagaaaaattgagtagaatatgtaagaaattgtaaataattatctgcatcgcaagaaggtaggaagaaaattgatgtaaaatcgaggttgttattctgagaacaaaatactccatattacatgactcgtagtaattgttaaacatatatccaagaaaatttgcttatttgttgaaataattagatcattgcagtcttgcagataggatgtccttaattatattcttgattgtatcaaaactggaagacgacttgtataaagatttggtccaattagctaagagaactggatatcgacggacctggctcatgtatttgagccataaagaaggtggagaaatgaaaaatctgttggaaataatgcatacttagccattaattttattccaagcattattatttgaaagcatatacagcaagcataacctacttgcgacatgataggacaagaaaaactcataaattctatcatgctagatatcaaacaaggcataaataaccaagccaagtaggtcattaggctaatcacaatgctaatctagccgcaatattttaatctagatgaacagtaccatgcatataaaaaactcaggtacgaacaaaactagattagaaatgcaccggttcctttcctttgtaaacgaaagaattcactcactgaatggatcgacggagatcagcgagttgaagcagtgcagtcaatcgatgatgtcgagcggccgcgtagaaatacgctgcccagaaacctttacaccgcccccgtgcaggtgcgaatgcggcgaaggctcggagacaccgctcgccggaatgctcgttgcacgacgagcaccacggccggcttggatcgacggcgacgcaacacgacggcagtttaggaatttcagagtagatggctattgtgttctgtgtccttcaaagacgtctccttgactcctatatagagctaacactgaacggcagcccacgctcaatccgttgctcctccgcgtcaaagccggatcggctccgtgagaaacgcagccgccaaacggccacaagcgcacgttctctcttcacgtgagaaccaagtcttcaggtgattgactcgatcagcagaggttgttttatgcaagcatcttgtcatccaacacatgctgatcgtgcggctaagcattaggcatttaaattgatgaaatgatcaatgtttccaagcatgttatttccatcaaaatcaacaaccatttttacacaaagtgatgaaaacagtgatgataaaatggagtcaatgaagaatcattagcaaccattatcgttttgagaatatatatagcaaattaatatgaggatctagtgaatttgattatatatttgatggtctgattcggacaggaaatctgtagtaacaatactctttcaagtttcttcttcatgttgataaactttgacatgtcaagtttagtgattaagtaaacacataaatacttgctacattcaagaatgaaccacatgttacccaagaatatgctgagagcgctcaaaatatggtttatctgcctcaccaaaaaacatatagagatgagagcaatgtaattttgaaaacatgtgcatgatacaaactaatagaaacaggaaaaattacataccgtacatgaaaaatccttgtgtccaactcaagcaaaaaaattctatgcagatcttgtagtgaaaagataattgttctccaaaagtttcatccaagattgtatatccaactactcatgctgaactgttgtagcaattgaaaggccaaagctgcctatagcatgctctaacattaattcacagctcatcggtgaaaaatgtccgagaaaaccatgcgcctgcaatggagaagtgaatacaaaatccaacatatttccttgtgatgcaacatgcaagcagcaacaacggacacctaaaaagaggcaattgaatttaggtattttatcaaataactttgcaaacaatacaaagtgcatataaaacggatgcagggcattttatcaaacacatagtgcacatatgattggttactatgcatacctgtgccaaaccggatgaggctcctgacagacttcctctggatccaaatgatttgggaataggagtctgtccaacaacgcgtacttgatctaacggggactggggaggcaactgatccagagcttttgaggtgactgatggttggtataggatgatttgaaagaggttatgaagaggattagttgggttaattacggcacctcatcttcgcgtaggtggttgcagtttcttgtcactgatttacttcaaagagaaaacagaacatggcgcagttaatagaaggcgatgagtcgtggctgtggcatcgttatgggctgggccaacggaaaaacgtttcacgtaacagaggctgagtaggatgggctggtctggcctggcccaatattgttgaatgtcgatctaacgtccatccggagacctgcaaataatccaatggctcaagagaaaaggatgacgtggcgcaatgtggtgcaagctttatagtctagtgggtaccaactatataggaagaaagaattagctctataggaagaggccttagtttgaagcagattgggcctgttcagtagccccttgactacagttgtacagctactacctccgtcccaaaataagtgcagccgtggatattcgttcccaacgtttgaccgtccgtcttatttgaaaaatttatgaaaaatttgaaaatatttagtcacacataaagtactattcatgttttatcatttaatagtaatgaaaatactaattataaaaaattttcaaataagacgaacggtcaaacgttgaacgtgaatagtgcaaaactgcacttattttgggacggagggagtatatctcttgtaatagactagttgccgtgtttcttatacaatagctgtactgtaggtgtaactgcaaccgctgcaccaataatctaagctgaacatgctcattattgtgtggattgtacacaacatttgcctgattatagcgataaattaaatattttgataataaacttaataaatactagaagaatgtattttaaggaaatatattctttagtcgtgaagcaaataatccggcaaataaactaacaagaattgagaaattttgatttattttttttcccgctgacttgactcatgtattggtatcactggaccagccgcttttcctgcaggagaatgggatccggatcaaacccgccacgcccgcatggacgcaatagtcaactagaagtcagaggatggccctgaccaagagtactacgactatgaataagagtatgatgcgcaaatacgcaatagctttgaccaactcatcttcctggccccttagcgcgtactcatattttagcagcaggttaatcgagtataccctatactactgattaatcagcccaagtgtttggatccaaactttgaatccaaacttctaatttttttcatcacatcaacctgtcgttttcagtcacattgtaacaatttcaacccaaacttccaactttagaagaaactaaacacaaccaaaatttcaacttataatctctccaaagcatcgagtactgacaatttctcatctcgagattcttgtactgacaagtttttattataaaaaaaggaaaaaaaaatcgtaaattagaaggcggcgcctacaaattaagcgagtcaaacattttggtagaatgcaagcaacggacggcagatgtcgcggaccaccttaaaaccatactcctcgatgacaagagcgaggattaccactagttagctttgtaactaggagcctaagccagggaggagcaatggcgagctcgagcttgtcgcgccgtgccctcctcctcttcttcttggaggtagccgtcgccatggcgctgcttcttccgggcggtcacgcgcgagtgtgcccgccgtgcggctcgacggaggtgccgtacccgctgagcacggcggacgggtgcggcgacccggagtacaaggtccggtgcgcggcggcggcggcggggggcacggcgcccacgctcctgttcgacgcgctcaacggcacgtcgtacccgatcacctccatctccccggcgtcgcagcgcctggtggtgtcgccggcgccgttcgtgtcgccgggcgcgtgcgtgtcggtgggcgcggcggcgtcccgcggcgtgcagctggacccatcggggccgttcaacgtcagctcgtccaacaccgtcatgctgctcaactgcacggagctgctgctgcggtcgccgctcaactgctcctccaactcgctctgccacgcctacgcgggcgccgcggggtcgacggcgtcggcgtgcgcgccgctgccgctgtgctgcacgttcgtggcggggggctcgtcgacgtcgtaccgcatccggctgggcccgcagcgtgcagcgcgtaccggagcttcgtggggctcgacccgtcgcagccgccggcgacgtggggcagccgcctcgggctggagctccagtgggcgacgccgagggagccgctgtgccgcacgcaggccgactgcgaggacggcgccgccgccacctgcgccgacgacccgtcggcaaccggaggcgcgggcacggtccggcgctgcctgtgcgtgtccgggctcgtctggaatcccatcgctggcgcgtgccagcagcagagtacgtttaatttttttgcttcgacggctgacagctcggctgtgaggcgcctctaatttttttttatggctgttaattttgatgcagatctcacggatagcggatccaaccatgcgcctctcattgctggtaattatattgcttccttccttcagcgctagctagcgtcttaatttcttattactgtcatcctgggaaattaattaggacctctgttctcgatcgggatgcatgcttgacgcctactatctagttacgacttcaatttgcaaggcgggcgactagccgcttgcttggttttaacggagagagatcgaattgtggagtcgttattcgttgctttggtgaaaactcagtgattaagtaggccgctattacccttttgttagttgttactgcgagtagttactcgctccgtgcacaaatatgaaaatttctcttagcatggagtaaaattaagaaggaaagaatgaggtatggataggggtagaagtgtggtcgttggggataagacgaaaataaatttaaacgagagataaatgattgatgggacacatattattttaaaatctttacatttgtgaataaattttaattgattggaatgtttataatactgaatttttaaaaaaatatttggaatgcttatatttgtagatagagggggtcgtagtattatagttatctgattatgaataagaaataatccaagcatcgaatacatatcaggagcatggtcaaggcacttagtcatttttattcggtatacaataagtaatccgggctgataaaataaaattgaggtcaatgatctggattgaatataaatgagagatcaactgaaagtaggtttacatcagtatcatgctgggtcccatactcccttgcgccaatggtcaacttgcggcggcttacatccggagaaaagcattgaccataccagagcaagtgtaaatctacttaactccatccagagagctagcattgtcagctttacaacacggacgaaccaaggaagttcaacggttggaaatttggaatgagttgctgcacgatttagctcgctttggagtttgtacgaattctccacgcgaaacaatttaactccttcgtggagcccaaccattaaatggatgtaccaagatttttctttgaaaacaatacttaataaataattcatggaggccacatcttggatagtttatatatgaaaattgtctatcctgtctcatggtgccacatcaacttaattaattttttctagatttgggataatcgattgatcaaagttccaaaacatataaaatatatcaaatcaaaccatgttcgctaatcgctacaatgaaaatcaacacaccacacaactcattttaaccattgtgaattcggtagatgtaaccttctatcccacggtaacagcagcaacacacatgtaattttcatctagctggttaaatatagggtgaatagctaatttagtccctcaagtttcaccgaaggtttaatttggtctttcacgttttattttgtccatatagctcctctaaatatttgttttggcttgaaatcatccttgggtccacttaatatgccatatggctatttccagtcaatattcctattagaaaatatcctttttgcccttaatttgtatacaactatacactagaaaagagaaagccaatataaataaacaacattacatatgtacttcccattatttcaatatgtgcacatgaaacttaagcaattgctatcgtatacacttgctagtacataatttatttttattttacataatatactatgtattatctataaaaaattcaagcatgcaatttttctcttttatatatatatatatatgtgtgtgtgtgttatttatgaagaaaattgttggttcaaggataaatttgaactaaaaggaaaacttgaagtacttattatatatagatagattgaaatagaactaaactaagcctctgatgaaactgatgaaacttggaggactactttgactattcacccttaaatatagatatttgatgtttgtt

SEQ ID NO: 67413 - DNA, 12990 bp, Oryza sativa
gccaccgccaacttctcccgcgacaacctgctcggcgccggcggctacggcgaggtgtacaggggcgtcctcgcggacggcaccgtggtggccgtcaagtgcgccaagctcggcaacaccaagtccacggagcaggtcctgaacgaggtgcgcgtgctgtcgcaggtgaaccaccgcagcctcgtccgcctgctcggctgctgcgtcgacctggagcagcctctgatggtgtacgagttcatccccaacggcacgctggccgaccacctgtacggccccctcagccaccccccgctcccgtggcggcggcggctggccatcgcgcaccacacggcgcagggcatcgcgtacctgcacttctccgctgttccgcccatctaccaccgggacatcaagtcgagcaacatactcctcgacgagcggatggatggcaaggtatccgactttgggctgtcccggctggcggagcaggggttgagccacgtctcgacgtgcgcgcaggggacgctgggttacctcgacccggagtactaccggaactaccagctcaccgacaagagtgacgtgtatagcttcggtgtcgtgctgttggagcttctgacgtgcaagcgcgccattgactttggccgtggcgccgacgatgtcaacttggccgtgcacgtgcaacgggcagcagaggaggagcgccttatggatgtcgtggacccggtgttgaaggataacgccacacagctgcaatgcgacaccatcaaggctctcgggtttcttgcgttaggatgcctcgaggaacgccgccaaaaccggccatccatgaaggaggttgcagaggagatcgaatacattatgaatatcgaggccggcaacgctcatctcaaggagctgcacagcttatgatcagtggtcaattatattagttagtcaaacaacccatataatgcacgggttattatagtttttctttccgagttttctgttttgctagtgtctcctcacgtttcaaaagtaacgaatttactctgtggagttttccatttactcttaggcagggttgaaaatttcggatcgaaatttccgaaattttagaaatttcggttctatcggaccccaccatatgatattatttcggccaaaatttttatttttttatgatttagtaatattttgtttaaattagatcaaaatttattaaaaaaattcatataatttcggaccaaaatttccaaaatttcggtatttcggccacccccaagtacaaatgaccaaaccgaaagattaaaccctgctcgcagctttctacatctgcttattcaacagtaacaaatttacttgcatgaatgcgccccacatcagggttggaaattttggtcatttcggacccctccgatatgatattatttcggccgaaatttttcaaattttttaatttttcgtgaattttggtaatatttgttcaaattcaactaaattttgttcaaaatttcggaaattttggaccgaaatttccaaaatttcggtatttcggtgaggtccgatcaaatcggctaaactgaaaagtttaaccctgccccacatcatacgacaccattcctagatggccataaaataattactatcagcttacaacgctagtaattcttttaccagtgttataaatattggttagacttcgtggtctgcgagtaaaataattaccaccttcctctcgatatagcccatgatctcgtagccaccgtatagtaatatgtttattgatgtgttcaatatacagtataagagtaaaagttgatactaagaggattgttaatctgtatcacaaaatggccatatgaatgaaaaaaaattataggctcaatcacacacgagggatacaattactcacaggtgaatcaaactagaaaagaaaaaaaaatgatacagccaaaaattcatcgtgaagctaggatcctggtggctttgttggatcttgctataaggatagagaggctggtctgtgtcttgtgatggtagtggatagtggagagggaaaccgggtggtgagcggtagtcgacgttggaatcatgaaaggacatagtggcgtggtataaagatgagctcgacgttgcgcagtagcatccatccatcatctagcaagcacggaaaaaatgcaaaaacattctcgttcatgtcatagagacgacgagggaaaaaaatagcaaacaacttccatcaccggcgaactccaccctatcctctacggccaaccacatggagcacgatgtgcaaatgtaagacctgtgcagccgatcagatcaattcagataaggtaatattggagattacacgttaatttgatttgcaaacaggggcttcatgcgtgaaagtgaaggagagtatgtagatgtaaattgaagtgtcatttccttacttgcttgttctgtcaatgtcaccgacgtggagcagccgccggttattgctctcggcctaggtgaacacctccttgctggttaaggtactacctagcgtccggctgcgaggctcgaagcagcaccttcgcctcaaccgccaccggccaccaccgtcaaccgccacggtgtcgtcgtcctcctcctcctccatggtgcatcaccgatctgtgggctaggatggtggatcaattcagataacccccccgccccccaagaaaggaaataatgaagtgagggcgagagtggttggttgggtatggggaaaatataatatatactggaagcgaggaaattgcttttatcgaaataaattatttcctccaataatggtgggagcgggatgatgggacgtggggtgggatcggatgcagggaagttgtttttatctaagtaaatcgtttgctccgataacgatgggagcgggatgatgggacgtgggtgaggtgggcctgcgctgatacatgtttgacacttgctatattaggagcgcactgcgctcctagtagtatctctatttgtttggattgtttttaacgttgattatgtttttcttttaattacctttgcagcatataaattctaactaaaaaagttgatgttaaattaaagatataatgttgttctatcataaatgaacgctaattgttctcatttctgttaacaactattaaaaagctttcatattggttcatactattatttcacacgcgttgtgcaaaatgtatatgacaataaaattgatcaaaattgcctcagcattcactaccaaattaaggatggattaaaacttagataccattgcttccgtataatatataggcaaataaatcatccacataatttgtggctagctagcatatatatcatgattggtacggtgagagttagaattcttctcttccatctgttcacttattttcttcgaaaatgaatttaatttgaaatatgactgcaactatatagatcgagcacgttgatgtgctatagactaaagcctaggtttattgtttgaattacttttcctaactaacattcacgtatttagtcattaaaatatttaaatcaaaactatattgtatatgacgaccgggtcctttatgctaaaaggcaaccttttatgcaaattaattcttcaaacatctaattgatatatgaaagaatttgtatcccttttactcataccataattggattatttaaatatttctcgaaagtatcttcgaattatttttgtttcaatcaatttagtgtagatattagttttgtacgacctcgagcttagcattattggcactgcttcaagcatgtcgacagtctgtacacgttcccaatatcaccctcagcttgctcgcccgccaacgctaacctcgagttcgctagcttgccaacgttgcctccttcgaacctgcctatggtatcacttccctcgagtttgggcagtttgcccgatgttgttgacactgctacccatgttgcacactagcagacaccactactgaaaaattgatctttgctcggtcgccccaaaaccacaatagtcccagttataaaaagaaccgggatctttagtttcagtttaaaaccccatagccattctacaatctttagtcccgattggtaacaccaaccggaactaaagataatctttattccgattcatcccctgtcagcccctgtcagtcccttgtcagaggtgcacctcgctcaacctcacatgtgcccatagccatagagctctgctattgctacgatcggtatatatatttttattcacacatggttgtaatcaagatgctagtttgatgtgtctaatccataaatcatcgtcgagctttgcatggttagcaaattgcctgttgccggcccacatgcatgctgttggttgccacttgtgcttcacttggtggattttcatggtgtttgtccgattttgaaaaaaaaaaacttatcttttggtttaatgtctcgagtgatttttttaaaagtcggaacacgatcttaaattgatatatgatgacacaatcttaaatttattgtcatttttttataagttttgatgtccgattggatgacatgcaaattgccaaatacatcaaatatatttttctacttttttaggatatatctttctacaagttaaaattgtacgtgtaaactttgtcttaattttctgtactactttgaaaagagtagtagtggtggcagcgaatcatccaccccacctatttccattgtaatttaacaatttatcccattaacttctctgtattaaaatcaattaaatctaaatggatagccacatataaagttaaattaaggtgaatattccttatagcaaaatgatagataacacgtttcatggagaatatatcttttatttattttgaatattattattatatttcttttaccctagcaaagattcagctagtctattatatttataaatgctagtgaagtggtatatgatgaaataatatatagtatctcaaatgttcgaatgacttgcaaaggttctcaataaaaatttaaagaatatacatttttacaagtgaaacaatagtcaacacgtgtcttaaattcaagttgtgattttaatcataaataacacaaaaggtgcaaatagataaaaaaaattgaatgtataatttaaaaattaaaagttataattatttaattttattgttacaaataatatataatctaaagttattgtatttaaaatttttcgttggaaatatttccgtaatgaagggaaaaatttaagaaaaataaacggagaagacgttcgtaagtgactggatcctctcgtacgggtatggcatgtctcctttgtttttaatctaactagctaggtggcccgcgtaattacgcggctagcatcatacaaaattttttaattttttttacacgtggttttctttaaaatttgttaaatagtcatctcgttggcttaggattttgatagactgaaccttatcatcattgggtttttaattttatagtttttaaaattcatactagccgttacctcttactccttttctatcgctttgtttgcttccacggtccgccacgatttctacttatgcaccatgaactttaaagatcttatagctttaaagttcagtgtcacatcatttttatttttatattttttagaagtactatcaaacgtcgccactgtactcctttacaatccgcccgctgtacccctctttagtgttattttgatttgaaaaatcaaacttgatcaagtttggtttcttttttttttactttctggaagtcccgtcaataactgcgacccaacttctttatggtctacccgccacccctcctcttaattgtcattggtattccaaaaatcaaacctaaccattattcgggtgttattctatagttttaatgtcacatcaaccatcatcaccatactcctttatggctcacccttgtgccccctctctttagtatcatttgtgactattgtattctagatagattgttcttttaatattccttatagtttatttcgaattttttatttctaaattgtattcctacttttaactctttttataatttcaaaatttatttttatttttattccgtattttgattaatgttgtattgtgtttaacctagactgttctttcattattcctaatttttttattcccgcacaattgcacggctagtatccatacaaaattatatatttttataatgattatctttaaaatttgttaaattcttattgtcttaaaaaccttatcatcatcaggtttgccgtccctttgtttacttgcttgacctactatggttctatttatccttcttggaacctcaaaagttttttttttcgaattttagcatttccacgtgtattcttacttggactcttttttctttatctaattttgtattttattttattttttattccgaattttaattgtgttgtaaatggactcttttttcaatattttttatcccaaatttcaattatttcttaaatgtattcctacttgaaattttatatttattttttaattttggaatttattttattttatttcaaaatttaatctgtcgcaactagatttcggcaatactaaaaggggtagcgaacaagcaaggaaagtggatgggttatgagacaaatgctttacactggttcagaccttctcgatgagaagtaataccctactcttttccagggaaatattccggcgagtgtgttattgatctaacgatctgattgtggttattattctcgccctcaacgagtgcccgacccctccttatataggcaaaggaatcaggattacaagatagagacttcatccttacggtataaagctctacatatactttacaattgtaaccgattgggactaggggatattaccttgatacacaagttaacataatacccgcgtccttttatatacatattctatccacatgaactatcccctatagcagttagatagcatagccatgtgggtatatggtacccataatctccacagtagcccctaagaccttcatagttgacaaaataatcttctaccgagtcatctgtactaatataaaaagcaccagttcatcaaatccagatgttttctaacctttagatctaatcatccgacagctcatatcaagagttggatcaaccactgcgattaacgatctcccacgtctaaacagtggttagggatcgatcaaagcgaaaaagaaaacgaaaaaagcttctttgctcgccgcctcctcgtgcagtcgcgcgccctacctcgcacgcaccgggcgccgctgccgactccgggcgcgcgcccgccagagccgctcgcgggttcaccggcagaaaatcacgcacgcaatttgtcaccccgccgccgtcgcatgccatccttcgcacgtcgttgcacccccgtccccctccaccgctgacttcaccccgcggcgcggccgctacaagtcgctgcagccctgtcactccctctccgttccctcgcccatcgtcgcgcccctgtcccctccgccaccaacttcgccccgcagcatggccgctccaatccgccgtacccgtcccgcacatcgaccatatcccgccccgcgtcatttgccgcccacgctgcctccggatcacccatatccgacctccagcctcgtcagattggcgccgccgccgaccctaagcttgtcgtcgagcattcaccgtcgccccatctgccccccatgccgatccatccctagcgccgtcgccgattcaccaccaccaggtcacgtccatcgtcttcttgatttgctccttccgcttcttatttatcctttcttttgttgatttgatcagaaactttatcctttcttttgttgatttgatcagaaacggcaatgaattttattttaacagagagagggggggggcaggggagggggaattgattgaaaaaatgaaaactggagtttgtttgagtcaatcaaattcaaatatgaataaacatgggaattttctgtttctttagctaggccatgtgcatttcacatttgtaatgttgatggaaaagctacagataggggcagagagtaactggagaaaatagaaatagaaatagaaatgagtagcgatgttagtagcgtacatactttacgcaagtcaatgaggatcaagaggaggaggaggcggtatcctagctaactggtcgtctcgtggaggtaaaaaaaatttctttgattccggcgaacctatggctatgtttcgttgataacttctaaagttcttcctgttgttcatcctgctatacatggtgttcttttaagtctttcctccaatcgcctccttatgttctattataccagtggtgccgtaccaatggctatgatgtgcagtccatatatagaatcaatcactgaaaaaaaatgagtttagataagtcacagccattaggactatattaaatgagtaatgaatcattgtatttgcactttttgcagaatcatggcagtaattacatggtcaggttgtgaccaaaaaaaaaatcagagatacatatgctcaggttttgatcaatgaaccacttgtagacattctcagattttggcaaaaatgcacagatacactacaaactcaagacacgttctttgaatttctgagtacagacagcgaacacattcagaatttcagattgcttcatcagtcatcacagaggacacaaattcagaaaagccctgttgtgagaaatgatgattattgacacttcttgtgtcttaaggtaggtctccagcctctagccactcgatggtatccaaaacaataagttttacgggcttatcaagtagcaacaaatcaggaacctgaacaatcaatttaagaatgtaaatgcacacaaaaaacataaaatttcaattcgatcactaggataaattcaaaaatccagacccaattcataaaatgatgcagttagtacgaaaataatatatctttaaacgatatagctagctcttgtcatgattctgatggtcatttaaaatatctatttgtcaagattttataagtgaacaggatcaatggcttaggttgctttcctttgaatgtagatgcgcgtgctggcatgatatttagaaaataggttttcccttgaatgcacattctattagttaatttaaatgaacaaaatctttatgcattttttcattactttcgagagaagaggacactgtaacaaaggccaatatagaggtaactttctgattgttatatacatggtaatcctggcggcggctatcctacccacgacgaggctacccaggtttttgcttgactccctgattgattcaggttcttgttgccaaaccattctccttcggggtatcagggctactccagcgaggagcagcagccaccttactactaccttgccgtcgcacaatttctgttcatctttttactggaagttatgctaattgactaaaactgtgatggtactacacattgacttgacaattgacatatgtattgcctacaatgagggttctgtagtaggtgcttgatggaataccccagtgaggaaatttgtttttgttctgtaccagagaaaaggtagcgaggagatctgtgagtgaaaaaaaaataacagttcaatgtccaggccacccctttatatttaccagttgtaacttcctcttttgattgcattcagttgactctgcaaagtactgcatcactaacgtctgtataaacctaaagttgcattcaagtgtagtgtttttgaacttgttgtggtctatgagatttattctgaaggattatactgatgatgatatattggtgtgctttggatcaggaaggctgtctcatcctactagtcaatcaaggggaatctaattggtagtataaatatcagagaattaggtgatgatcaggttcaacatcacagattcagatattctcattttctgtgttctttaaccagtggcacaatgtgtgctatcagtgtaattaaaatagggatttcttaatatgtattgctctttggatgatttcagtatttcaacgagttcttaatagacctttttttttcatctgtgcatgcaagaggatgcaacctacttgggatggtggcacctctagccataggtttggaggagggcaacaagcagatgcaccaaagggagctcaaatatgaggaattatgtggcaaaaatagcttgctgaagaggaatcttggtaagatatgacataagttcagaaagttaatcactgctgcaaccatctctggtgagtctttttgagaaagaccacataggaaagggacgagatgagcacttctagctacagatgcttaggcaaagttgggattccatacaaaggaaatgtatttaactttgtatgaattgtacatatgcactaaaaaacatataaatctgctctcttatgtgtggcttcccaagtttgataaactagccgtcaacccgtgccttgcacgggttattggtattggtagtataaagatcaaaattttaaccatacgttcactaggttggccatattcgaattgtagcatgttagattgaaataatagttaagtactcctttcgtcccagaatataagcatttttagagttagacaacggttattaagaaagttggtacaattaaataggggagtgttgtggctgaaggagaagtggagatagctggaaaaattgaatggtagatgattgtgattcgttaagaagagaatgttggtggtaaattgttatattttgggacaaattctaaaagctagaagttgttatattttggtacggaatgaatactacttgttaattattaattttgaatcaaacaaatgctaaatttgtgatacatccaacttttttatttgatattgtggaattctggaattaattaagtatttagttgagtctgtggtcgagtttaaatttaagtacaccctgtaatttaataattttgaaattaaaaaaaatagttatactcagtatggatcctagaagatataagatatatgtaattagcttttttgttttatcattcccaaaactcataataataattagtgatctatagtctcttgtctatttgtaccggttaagtacaaattaaagagtccacgatattgccaattgcatgttttattttttcacaaaccctaaataaaacctaatgttgtgattttgtgattttgccacgatatatgctatttaacgtgaatttggtcacgtctatcatatcaagcctagattgtttactctggctgaaagtaatactcatatgaacctacgtagtatatgataatatttgtttacgtgcatgattattcgcttagtaggtttctagctagttcaaatggataaaccgtgtgtatgattaattctgaatttcgttctctttacgtcgcatgatttattatcgagaagaatatttatcccaaagagtcaggattgctaaaattatgggggtcttagtttcagtcacgtcatgtatcctatatgatactctactaagtatgcttctctctatctctctcatttcctcttccaagtagataataattaaattaattttactcctaattcttataaactgtgtactaaaaaacaaaaggtaaatattgaaacttataatgtaattatagtttatgttttgaaatttagcgtgtaattaactacaatgcaagtgtatgcaatatattgtagttacctttcggttttcataaaagaaaatgtatctccaaattaggctgctaaattatacttgtaaatgaagctctatatattaactgaaatacttgttaggaaaaattgatataaggactaacccaaacgaatgaacatgaacactgaacagaaagctgcaaactacatgtacatatgcattgcatacgggatataccgggcatatggaaaattaaatatagttgattgcattcagagaattatagatcaatatatttttatctgcttctactgtcattaaacaacttgtcaaaatcagaattgacaacttagaacttgcaagtttaatggaataaaaaaacacattcaatatgtaaaagatgatcagcaaatagttgatcattccaatcaaaaccataaattgagtgcgtcctaattaaatagactgctaaatatgtattgcaaattgaacatgcaaaccatgcaaattcaaaggaatacatatatatgtatattgtagatgcagcaatagatctgtagcagatgcagtgacggatgtgcaagtaattttttattttgtagcaaacttttttcccccaaaattcatttggttaaatttcgtttcaggttaaaatttattcaatctttatggagtaaaaacagtacgtcaaaccagagacttaatagggatgaacgatacctctggagcgatcactgattcactggaaacttttaacttctcctcgtgattgaggcaaattgtcgctgatcgggaccacagtctgggatcaaggtcgactgcagcctatgcatatctcgtcgccctcgctcacgtccttctcgatcgcgttcgccgtttctttatcgcttcttaatttccaatctgatttctcacgatggaacttggagataaattagatgggttctgtccttccatcgataactggatagataggatttgcaaggagcccactgagtttaagattgattggcccacgatgttaaagtattgcaggatctacggtgtagattaaacgacttatctaattgacgcttagatctttctggttaacgtgagagctccaaaaaagtgcccgattagtataggtatagattgcccaatttgttctgtaaccgcaagatgccatgaactatatatttaagaacttgtttcacaaaactatatatttaagaacttgttttacaaaactataaatttagtgtactcgtttatcacagaactatacatttagtgtcttcatttatcacaaaagtacaaatttagtgtctccattatcataaaattacaaatttaatgtcttcattatcacaaaactactggtt

SEQ ID NO: 67414 - DNA, 1837 bp, Oryza sativa
cagttgtcttttgagctgatagaatttttgctggtgggtctcacgaatctgtcttccatagttattaggatcaaaccggatcggcggtccgaccggggaaaaccaggtcagaccgggctggcttttggtgatgggctgaggcgaggcccgctgagcaaagtccaccaaaaatcgctggaaaaggatggggattcgaccttgggcagtgacctatgcctcccctatcacaaaaacgacacccgtggcggtcagttgtcttttgagctgatagattttttgctggtgggtctcacgaaatcgctggaaaaggatggggattcgaccttgggtcgcacggttgagagctgcacgcgctacccaccacaccatcgcttcgcttctgttggtctaagacattaatcctataatactttaaatcgcggttggaccggccgaaccaccaaaccagtgaaccgagacctcgaccggctcattctccggtccggtatagaaatcttcaagtaaactatgctgtcttcaagtgtatagaaatcttgtgaccgccacagttcatagaatatactttactcccttcgtttcatattatttttttcactcaaccagttttagctattaaatatttttgtttcactgattcaccagttgcacatataatagttcattttcttaaaaaatagctaccatatgtacccacgtgtgaaaaccctgttttcgtgtgcgatttgtgctgcccatatggaaagatactaaaaattattttttatagtgataagcgcccttatagcaaaaaaaatatttagacctagtagcctgcaagaacaggttttagccaaatgcgaaaatcattttttatagtgataagtgcccttgcaacaaaaaataaaatctttataccacaccaataagtaattatatcactacgtgaaacccacatctctatcatatgttccatccacaacgtgcatgagacccacccaggttcatgaaaaaaggcccccaaatatccatcatctaactctccgccaccgtacaccaaaaaaataacatatgtaatttggatttcctatcacaacgcacgagcatgtttgctattcttaaaagaaagaaatgagagagatgaaaggaaatggttcacttgaggtgccttatcttgaagtcgagtttcgaaattgaccctgaattgaaataccagatataacagatccctaatcttgcaaaaccgggtcacattaggtcccaaggcagtattgctccccggttttggtgacgtggtggctgagtcagcgtggggcccatgtgggtcccacatgtcagtccataatcttctcccacctatctcacctttcttcccttctcaacccaaacctccagggcagccgacaacaggtagggagaagagtggcgactgacggctgcgtcatggacctgcacggcgaagagcgcgaaaaagcgaagtaggaagggctcccgacacatcgtccccttgggttacaccacaacattgttgcgtggcagctcgccgcgcatctgcgccgtgtccgcattgtggtcgcatgtcagccacaccgtcgggattggtgagagaatctccaagagttgggagatggagtacgttgcgacgcctgagtatactcgcgagcaccactgactccatgagtgcccgtgcatgcacgcgaagaggacgctagacgctgaattgcgggagaggtgtgtggtggccggtgaccagtagggagaagggaggcggtcattgggcggcggcggtaggtagaagcccgacgacggcgcctggcgattggtgggaataaggttggcagccaacaagaagcttggcggt

SEQ ID NO: 67415 - DNA, 1264 bp, Oryza sativa
aagaagattgctggttggcttgtggggtccacgtgggccctacactgactcagccgccacgtcaacaaaaccggaaagcaatactatcttgaattaaaagtgatccggttttacaagattaggggttgaggaccgtttaaaactcaacgacaagataagggaccttagatgaactattttgggagacgaaaaaactccagcctcatgggcctgtgcataagacccataggcaggcgacaccgcggcagccgagcgctgcacgacctctgcctccctaatccgtcccgtctcctcgcccgtcgccctcgactcccgtctcctcgcctgccgatctccatcctgctagcagaggtggcgccggcgtcctcctgctcccgccgcatttgcatcctaatccatcccatctggcctcggcctcgaatttcgtctcctcgcccaccgcttgcgccgatccccatcctgcgagcagaggtggagcccggcgtcctccttcttccaccgcatcgtcgttcgccggtgagcatccctctctacccatacctcatcaggtattctgcgttatccctcaaaaagtttgggggttagatctgcctctacccagctccacctactttcaagttgttaattttgatttccgtttttagctgatgtaatttggttactgaatctcatccaaacacccttagaacgaaaaatgtaagctcacatactttgtactcatccaaactcacataaatttcttaagaagaatctagaccacaaactactcatagtcacacaatatctttttatcaaggtatactcttataagaaattttcatttctcaaaattttctaaaggacatactgtgacacttggcattaatctaatttaacttttttttctttatcaggttataaattttctaaaagacatttgtgccacttggcatgaatctaatttaacattctttctttatcaggttataaattgacaccattgaacgtactttatctttctgtccacacatggctaccaccgccgcgacgaccatggtggcggcggtgcaccacccccgcccctgcttccgcgtgcgcgccgcctgggacatgaacccgagcgcctcccccaagcccaaggccaagcccccgcctcccccgccgccgccgttgccgaccgcccccgcccccacccacgccgacctcttcgcccgccacagcaacagcgagggccaaggtaatctccatccctcctctccgctttcccaaaccgctggaagcttga

SEQ ID NO: 67416 - DNA, 9771 bp, Oryza sativa
  unsure (1)..(9771): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtatatgctctgccaggagtgacaatcactgagcatttcatgagcacactgaacagcatcttgaaaggccttcttggacatcaaaatggtttctgggagcagtttgggctttgaagccagcaggtacatacagtaccatgataagcaatttgacactgtgtatgccttttgaagctcacctgtaagagctttttcatccaccagaaacgatgataatcttgacattgttgttaagttgattttatggtcattggcaagcttgatctcacataggcttgttgcgatgtgccagaccagaataacacgggagcatgttggtacctctgcaaggcatgccaaccaataacgctctgctctgtcactgacacgagacaaagggaggtctcttgacaaaagatgaccctcgagatccatggagcggagtgcttgaattactgctgccttcacattcttggccatactgtcattcatttttccttctgaccaaaccattcttgcattttgatttctttctaaaatacaagagaatattttccaccccgagatgcttgagctgaacgtttgcaggaaggcatgctggtgtataactatagttctttccccatatctggcaggtgtattcacaatgacatatttcagccatctgtttctgaaattcacaaagttgcacatggctattagttttgcccaccttgataggaagtacccgagcatcctaaaaatctcatcaatcattactatgtacatggctgctgcagtgatacctgaatcgtaaccaaatgagtgcagcgaataactaaaacgggcccgagggcctgtctcgtactgattttgggacatgcaccatattgacatctacaaaaagccatgtagccatgaaaaacttcaccaaagacagcagaagagtgaagaagagcgaaagaagccctctgcagaagaccataggataactggagtggagggaatcccggaggaacctgacatccagctccaggataccgaacagtaccttgtcagcactatctgagaggatcatcttgctgattagctttcgggtcatggaaacagtagcttcatgcaacgttgctccttccagcctacaccggagcaaccgagataatgcaaatgccagggccatgtccttcatgttgttcccctgcatgttgatggaggttagcagcaaggcactatcacatcgccaaatcttgtccaaggtaactagggacttcaagtcttcaacttttagaatgtgtgcactctttcggcttttctgtaactctccataaaccaagtacttgtatccttccatagtctctgggttgcatatttcaggattaaagttgctcttgttaccattggcacccatgtactcctgaagaagttctgaactacgaccattccacaaggacttggatgctatatggcgcaccagaatcttgtagaagcactgaagtaccagaagaccccaaaagaaccaaaatggaaaacgccacaatttggagccacgtgttaaattcatgtatgccacaactaaaagcttcaacacatttctcagctcaaaaaacattccagaactagagcggccatggatgctagagcggagaccaaccagtataagggcccagactgggaacagctggttatttaaaggtgcagcttgcatagcccccataatgtatacaagggtggcgtcagccacaggatccaggaagttcaccatggatctgtatatacgggtgaagaaaaggcttgagaagaagaacatcagatagaggatggtgaggattcccattatgactcggatgcgaagcaagacatagctctccagattccatttgataagaaagtttgcaataagagcaccaggactcatttttagttttcccacagaaaagtgtgtagtcaaaattaaccgcagaccctggcaaattaaacttatagagaaacttcatcagaaatataggttacagaatatataacaagtgcaatgaagggtcatgaacttatgctgacaatgctatactggaccattgtaacaagatttacatgcttcacaggcctgtatgggatgagatgggtggtggtgctaacgaataatcaatatttgaaagtggagaacttattattgcttaatgaaatattctcttcgtcccaaaatatagttacctttatagttcaacttattattgattagtgaaatactctctccgtcccaaaatataactgcttttctaggtagaagataaatacagtgaggttttccatgacctgccctagaaatctgaaaatatattagtggccatatttaaaaatatttatatacagtgaggcttcttgcttgtgcatttcattcactatacggtttgatccttctcttgatcagtagtcagtaacagtaagctacaattctttggatagaatggacaaattagcttatgatgacacaatctacacaaatctatgtagcactttctagccaattagccaatgagtagagcaaacgatgggtgtacctgcttcagcttgtgcttggcaaccttgctgcggtccacagcaatgtttatctatctatttggaccttgttatgatttcctgacaatcttgtgtcagttaaaatggtgttgacaatgtgtgctctgcttttgacctgcaaaaaactgtaactactaagaaaactcttcctaaccagtaaccaagcagctgctatttcgaactctgactgcacaaacagagccagtgaaaagcaagcatgttatatttttcatgcaatctgttgctggcagctacaagaaaaatccaggcagcgggtgattcaagcatgcaatacagatgcatcagaaactgcggtagtatggcgaaaaggagtcaatcttacccattcagaattcagcagcttctcatggcgtattatccacagctcgggcagatggagagaactctaggcaagaccttgagccgagaaggcagcactgggatctggaaactggcaagttgtcataggccaagttcctccattacctccaattcgatatagcgattataaaattgaaccacgcatcccgcggtagaggccttgatgaatgatgagtctttatttttaacacacttcctaaaatatggcgtttgccacggaataaaaaattctggcagagctgtcttgctacactctgcatctatgaccaaagcagttttaatgtaatactgcaatggtgttggaagcaatcacagaaaaaaaaaatcatatgtccagctttcacatgagcagactgaatatggcaggtataggtgtcggatctgtacttgctcatccatctggatataccagaaaactattcgagttacataaaaaagaaaaccattgaatcaaaagtcaaaactgctgttcccttccatgatttgtttgtccattactccattcgataatctaggattactgtccctatcccattatttcatgatttgaggagaaatgcaccggaatatatatttttttgaaaaaaaaaagaggagatcggactgagctgcgaaaattttaccgcgatgaatcagagaaacagagagctccacatcgcaccatggagtcccattgagcgagacgccaaggccatggccgacccagcaagcatgcccccgtggagcgccctcctcgagtgccggccacgctcaccaccgccgccgccgccgccgccgccgcagtactatccccgacttgacccccatcgctaccgctgcgactgccgccatttcacttcctccggacctccctccccgccggcgagcggcggatacagcggagaaaatgggggaaaagcaactgggagaccggaggaagggagccatcagcttccgccgccgccgctcgccggatctgcgccgccggcctcgaccattccggtgcctctgcaaattgcagcccagtactaacaacaccacttggtcggcccacttctgcttttaggcccagatagaaaaagatggctctgggcccagaaatcaaaacttgtcttattacctactaccttcgtcccataaaaagtttatttttcaatttttgatacaatgtttgagtttgactctttgttttattttttaaaaaaatatgattattattattattattattagatgataaaacatgaatagcgctttgtgtgcgactgattgttttattttttttcaaataatatgaacggtcaaacgttggatatagaaatccaaaaataaacttattttgggatggaggtagtctttcctctgtctcaaataaacaaacctttactacagaaaatagtttggaaataaacaaacctataataaaaaaaagtatgggacatcacatatctgctatgaatctggaattctggataggtacgaattggacaggaggcatgcatgtccagattcttagtaatagattgtgccaaaatttgtttattttgctagattaagcatctgcatagttgcatataatgtgtcagagttatagataccacatacctaatagtagttgattaaatctcggtaggacccaccacataccatgtcttatagggacactgacctcggatatagatgaagttccggataaggaaagacaaccagagttctacatggaaacgacaaggactattcggattatatccatattggtttccttatccctagttctacttggacaaagggacacatatgggtataaatacaagaccccctaggaggagaggggacacaatcaacatacacggaacaacagaagccacaacatacaagccaacattcgccaagacaagacgccggatatcgacttcaaagataggcatggctagtcccctacggtgcctacggataccgtcaggagagatatagcgctgtctctgatctcgccggatgcggattcgaagaggaaggctaccctgttgtcgactacgagtcagaccttcagaccgccatgtcgaacacttagataagctaccccaaatattgtactggtgtcattatgatgaataaagagcaacaccggcttcggccaatctatataaaaatcctcgtctctgtctcttttacctcagtctcgcatatatcctagtaccaacgatctccatactttgcaaataccggaatcgcgacatcaaatgaacctcagcaaacctcaatggtggaggtgatatccattttactcatttgagattgtattatgttccttgatgattattgtatcactcggtgcttactagagctagaagatcaacggtgcatataattattgaaattcttgaaatagttggtagtacagatcaaggtggttccatgcgctctgcaaaatgtggtgtttgcatggcatgaactggaattcaataacaaatttctatattgatcaaatatgaagttttgacaagcaatatcatatgaaaataaatttttaaacaggaaaatcaacaacaaaaaagataaacaaataatccaatcaacagttgggacaaaagtaagtcgactacagaaaacatatagggacaatcagactccggcggattaagcataaacaaaataaacagtccaggcttgaggtttcatctgcatagctgcatataattaatgaacctcagctaacatatagggagattttatcgagtacagagttagttccagcacacatttagaatatataaatttgcaaccaaaagaactgatttatctgctatgcttcttagcaattacttgtttcaatggacaccagtcaatcaacttcatcttaccgctagaggcattctgatttattcattgactcaatctcaggccaaacttcagcttccaagtttggacgccgtttcctttcgttatagctgcatcttaggcccagggacagcatccttatagaatcctgtataaacttgtcgtccaacttcaatttatcatccaagatttgaagtttctcaaggatcatcttttgcctgcgtgtgtccattttccccaaattttgcctttccaatttatcaaccatatgctttcttaggccggttgcactttggcctgtgactagctgcagcaatatgatacccaaagcgaatacatctgactgaggagtcagtttgcctgtactcatgaattcaggatccatataggggccgctaccctttggcacttctgtaatatggttaggtattactgtgtcagtgctgtgctgtaacagacgggaaattccaaaatcactgagcttgcatacattttctgcatcgaagaggatgttgcttggtttaagatcaccgtgagctattggattaggcttggtattgtggaggaatacaagagcagagcatatgctggttgccactctgactctcttcccatgagaatgattccttgcgttcttctttactgaggcaatcttcaagggtgccagaaggtaaaaactcatacatgagtgcaaatttctcactgcatgctcccaggagaatgaccaggtttgggtgtctgatccttttgagtatccccacctgcatttccagaatttttgttgttaagaataataatgcatgttagatttattcgttggataaatattaggtttgttaaaaggtaatgcaagaagttaaatggtgctagaatctttgcttggaagggtgaagccagggagaaaaaggtgaactctgcaatctaaactgttggacccgtcttttttgagctattggagacagtgtctatggtctacctcaattggaagtgattcatttcagttattaaagtagactgtgcataagtacctcacaaaagcagtatacgctggtactgcagcagcaggctcaactctaaggatacccttttctgaatgtcacctatttcctaaatagtttgattagttttctaggataagggttaggtgtttgacatcttattgtttagattgatcttacccgtatttggtagaatcctctgtacaatgaggttagtgctattaccatgaagcaagaataaattgatgagtcaaagaagtcccaataatctctgtctgccctttctcctatactccctcccacttccagttcacaaagtagtaatgatagaatactaactcacaaagtatttgaccttttctggggctactcacctcttgcttgaactcccgctctccttgccagctactcttatcaagaatcttcatagcaacagtcttgccccgaggttctgccttgtaaacgatgccataactgcctttcccgagatgatatttttggtcctttgggattgaatcgtctacctctgagtgactgaactcagtgaagccactactggagtttgaagcttcaccctcaatccattgacggaatttctcataaactattgtcaaggttttcatcctattgagttttccgtccttcattttgagttctctgccctgtctttctagttcttcgcgctgtctttccaattctctgctctgcctttcgagttcttcaccatgtctttggacagtcaatgtgtggttttgtctctcttcttcaagttgcttctcctttacttcaagctcagttctcgttttctcatgctcttctttttctttgagctgcaataaatagaagaccttatcatgagtttttactagtttgaatctgcaatttttctttttgacaaagtaacatgtaaatatcttggtaaaattatcaggcgttcaacagaggaggggtaacatttgcattagtttcacgcacactaacttgtcaaaaacaactatttgaagctaaaaacccataatagagttgctttgatgaaccggaagatacgttaactagatgaactgtaataaaaatataaaagtagtgataatttgtccgtaagagcttactgtattctcagattgccggttgaggtctgcctccagtgaaagaatcctttcagcctgcgattaatcatagctaagcattcctaatttgtatcacggtttgaacttttacaaggtcttgactcttgaggaggtagggacttaggaaagcaacctgtgagttgcggttgagccaaaatacaagggtatgcgcaaccgccaccgccgtcgccgctgccgctaccaccatcgctgccgccgccttctccatcagatttcagagaaaagatacagctagcttcttgtttgcagcctcggattgatagagcgaagtagatgatgggattaaaggaacaactgaacagggaatgtcttgttgccttgttggttttgttgtcctgactaactcagagtcaacacgccaacctaccgcttgcaaattgtccttaacatctaaacaatcaaggtgcagtttcatgaaaatggctcttgagaaatgaaatcggtccagtagtagcattgaagtttacgtttttagttttataagactaaaacttttcaactgaagtttttacatttctagcccttctcaaaaacttgttttacaaatagaccacagaaaacatagcatttgattaaccaactgtcaaagggcagaatatgctcggtgcaggacaaggacaagctttgctgctacatggaactgatttgtctttcctttagttagttatcctatgaaatactcttgaagtgtattagttcttatcaggctcaccaactgcgccactacatgctgaccattgggcacaaatggaaagcatctggactcggtgggtgtgaagctcaattgcgaaccaaactatatctacacagactggacacaagcaatcgagaagttcttggttcaggatttccgtcgaacatacaacgtgcaagagacatgacacacagatacgacccccaagacaaaagagtaaaatggaggatcagggtagaagccgcaccagtgatctcattctcagggacgggtagccgcgactccatgcgtccccgccgccgctgattcgtggctaatttacttctcctccgggacaactgggtacacatagacaacatcttgaactctgagggcatgaagctcacctcacctgctcagcaactagtgccacataacacaagcaaagaagtttttggttcaggacttccgtcgaacacccagcgtgcaagagacatgacatgttaatgcacccccacgacaagagagtaaaattgtgggtcagggcaggaggcgtaccggtgatctcagggacggggcagccgcgacgccatggttctccgccgccgacgctcctccgccgcccgacggcccatctcctcctccggggaggccggaggcacacccacagccagaacaacggcggcggtgaatattttcactttggtcctttgtttctgtaaatataagcaactcaagggcttgttatcaaaattttcacttggatagtactactttattttctcctccccgttgtagttgcctctaagattggtggccatcgtctaggacatacttggtctgagcatcaccatgccggcttcaattctctgattctcctggtctcatggcaattgtggaaggaacggaactccaaggtttttgactctagactctgcgttatcttcggtctcggaggtcctacagtctatcctttcagagagccatttatggtcgttagctggcattactaattttggggttttattgggagagtagtgggctctgccccttcccgctgcataagtcggtctag

SEQ ID NO: 67417 - DNA, 1618 bp, Oryza sativa
atgtagataatgcatcaattataaatttactttttatgcttgaatagaaaactacagtttttatttttgctggtttaattaaatccgtagtttttctttttggcaaagtagcatgtaaatatcttggtgaaactaataaaagctcaaaatagagttgcttcgacgaaccggtagatacttaactaaatgaacaataagtaaatttatagagaaaactcattgtttctccataagaagtgtgcttactatatcctcattttgccgggaaaggtaatctacctccggtgaaggaagttttctttctgtatcctcagtttgccggggaaggtactctacatccggtgaaggaattattctttctgaatcctcagtttctcggggaaggtctacctcaggtggaggaattatttcgtcctgcgattaatcatagctaagcattcttactatgtatatcatggtttgaacttttctagctaggctcttgaggaggtacggagagcaacctgaaagttgttgaggttccctctatttctaagagcacgtaccatcgccatccctgccgccaagaatacccctctcatctccatcagattttcttggtaggtgcaaccgatcgggatcgattttgatttaagagaaacaagcccgtcgaaaaaaaagaaattttagagaagctaggcttgtatttttggatagcacgaggtatagatctgtagatggacaaaaaagaagaaggaaaggtattgtttggtcgtcctgactaacacacattcaacacgccaaccgcttgcaaattgcacttaacatttaagcaacaaaatgtaatttaatgcaaatggttttaaaaaataaaatgggctcaatagtattgaaagtttgcgttatcagttttataattctaaagttttcaaatggacttttacattttagccctttcaaaagttattttataaacagaccctaggaaacttatgagaacgtatcatatgcacacattgtgcacaccaattaaaaaatatcataaaaattctaaaaaaatgtacatatacttttaatacaattatgtgtaaagttttatttttaaattcatcatatatagggaacaccaaaaggacaaattctgacagatttatacccacaaaattgtcaaatttttatctattttgttatgcctaaaatataatgaatttgagtttaaaactttacatataggtgtaatactaaagtacttgtgcattttttttctagatatttttggtgaaatttgttagttggtgtgtacgatgtgtacacgagaaaccttgtgtgcgcatgatatttttcatgaaacttttagtataaatttacctgggcatatgcactagagtataacaccgaggttacaatcaactatgcggattaaacataaactagaaaaaacacagaccaggctcgaccgctcgagcttaaatttgcatagctgtatatactgaacctcagctaacatattgcgaagttttacagagtacatgctggttcagaaaatttttaaaaaaagtatacatgatacctaaagaattttatctatttggttcttggcaattacattatttagaaaaaataatttcataccacaata

SEQ ID NO: 67418 - DNA, 6887 bp, Oryza sativa
cgcgacatacgtatttttgtagttataatataaccacgtctcacttatctttatgttacatggaagttacagtataagtacattacaattagactataatcatatttaaaagtttctacacttaaaaggaacttgtaatgtttggttagatggtccctcaaatgggatgccccataattatcaaaatttttagtgttagactgcttaaaatgtcagaagcacttatcacctcctcgccaccaatttttacaaaagaaacctctacgacagaattcagatcgaagcaacggcaaatcagacaaggaaaaataatcctatttgtgaaactaaaatggtttagacccggtataagtgaagtggtttcttcggggttttgaaatgaggtttctacgtcactgtcatgcgtttcttctaccactgaatcccacccatcttaaccgctacacctttcgtcccataaaaacccaacccttctagacatatatgtgtattcagatttataactatgattagattttttttagacggatagagtattgtaataaatttcccttccatcaacattggccttccaccttttcccacagcaaggcatcaccacagccacctcaccgcccccgccgagcatagcttttttttttcgttttgtcccaaaaatccatcgatgcccaggattttcgttttcaaatctccctaaaaaatcgtgtgatattattccttaaagtgttcccgaattgtctctagtaaaattagaattagtagctccctccatatcgccaatttctggtcctgtccagagttcaagtttactcacatagtcatgtttgttttcccggttttctttttcgagaatatgcataaggctttcgtatcttcatattaagaagggggtaaagagtgcatcatgacaattacaaaggtatcaaatgaaaaaaaaacacacaaaaaaaaggacattggggcttttatctcgtgtcattagttatgtgacccgatagtcagtcttgggctagtggagcaacccggcttcctgccagagagctgtctcatcccccttcattgttgccaactcggtctaggaatgtctcgttgttgaatacgctgctgttgcgttcctttcaaatggaccaagctattatttcaagtggcaccaccagctgacaaagggaacttgcgtagtcgggactcgggagcacgtcgggtaagctgtggtaggcaaagtatgtgcaaccatgcgacactctgcttttcccggttttaggggctatttggttctagccacactttaccattactccctccattctaaaatataaggcataactacccttaaccaaaaaaccaagaaaataattattatcatcttatagtaataatttaatggagaagggatcataactaattgcctacatgcatacataccttatattatggaacatctaaaaaagtggttgtaccttatattatggaattgagggagtatttgccaataaaagttaccacttgtctaaggtgagataatcaaattgttagctacaacttactaagcctaagagcaaagtcaataatatagcctgctgtgagctccaaaacataggcatatcatctatagtaaacagtataggtaatgtgtaaaataaaaatactatagcactaatattttattattttagtgggagccatcatcttctctaatctctctctttctccctcccctccccatccttttagtgggcccgttttcttggagcacgtgggtagcccggcgcttattagtcgctctctctctctctcttccgagccgacgtggagtttttatcgccggtgctagagctctattgtacctgcaaatcctgccacacttttttaaatcattgacacgtgggacccaatatgttagaagggaatcttgtcacaactgtggctataaccaaatagctatcaaaatttgcccaactttaaccgtggcaaactgtggtaaattatgactggcaaccaaagaaactcttaatttttgctcttcattcatttatgaattgccaataacccatggcctcgtcggctcccgtgcggtgcacaccaccggcgcttcgtgtgctacgccaccacgcagccgccgccaccgccgcctcggctcgcgcgccgccgcgaccaccgctccaatcactcacgccgccgtggccgtgcatcacaataaatacggaactccaacctctcctgtctcctaacttggttccaagatggcgggctcctccccgtcggctgcggcaagcggcggcggctgcgaagcggtgccgagcacgtcgaccatcgtggccgagatggcgacgggctcgcacgtgctcaccgtcgacggctactccggcaccaaggggctcgccgtcggcgtgcacgtcaagtccggcacgttcgtcgccggcggccacagctggcacatcaagtacttccccaacggcgccaccgacgagacctccgagtgggtctccgtcttcgtctgcctcaccggcaagtactccgacccgcgaagacgaagggcgccgccgcgaccgtcaaggcgcggtgcaagctcaccctgctcctcgacggccgcgacgggagggcggcattgccgccgccgccgccgttcaccaagagctgcgagctccggaccttctcctccggcaagggcggctccgatcagtggggccacaagaagttcgtgcggcggaaggagctcgaggacccgtcgaagcgtctcctccgccatgaccgcttcagcgtccggtgtgacgtcaccgtcgccgtggggatccgcaccgacgacaccaccgcgaagctcccgccaccgtccgacctgcaccgccacctcggccgcctcctcaagacgaatgcgggcgccgacgtcacgttcgacgtcgccggccacaagttcgccgcgcaccggtgcgtcctcgccgcgcggtcgccggtgttcatggcggagctcctcggcccgatgaaggaggaggacaccgagagccacgtcgtggccatccgcgacatggacgcgagggcgttcaaggccatgctccacttcatctacaccgactcgctgcccaatgtcgacgacggcggcgaggcggcggccatggcgcagcatctgctcgcggcggcggacaggtacgacatcgagaggctaaagctgatctgcgaggacaagctaagcggcggcgtcgacgcgaccacggcggcgacgacgctggcgctggcggagcagcacggctgctgccggctgaaggaggcgtgcctcaggttcatggcgtctccggccaacctcaaggcggccatggcgagcgatggcttcgagcatctggctaagctgcccttctctcctcaaagaattagttgctaatctcgctgtttaattatgcagtagaaacttcatttctccctgattatgatcaatgtggcgtagctgttatgatcgaaatttgatggtttttttccgatttgatcataatttaaaaagtttggatgtaattaggaaaaccatcactgacagaatcggattatgccaaatagtgctctaatgtctaatcataatcaaatcggaaatcggttggtataaacactaaacaaaataaatataaattctatcacgatgtgcactacgcttggctttgcaaattcgtcactgatcgagcgctcgacatgtccggatcatccgcgtccgccggcgacgcgccgccgccgacgacgtcggtgaccgcgtcgaccatcgtcgccgaggtcgtgtccggatcgcacgtgctcaagatcgacggcttctcgcagaccatcggcgcaagcgacggcggcagctacgttaaatccggcaggttcgtcgtcggaggccatggctggcgcgtcgggtaccgcgccaacggcgacggagacgacgacggcgccgacgccggctggatctccatcgctcttcacctcgacgaccccaatgtcgatggtgttagaagtataatatgttagttagatataagagttaaatacaaattatagagataagataaatcgtagagatagaatcctaaagataagatagagtcctaaagatagaattctagagataaatctactcttatttgtattatactctaagtctgtatcccttatgtacttctatatataccccataagaggatcgatgtaatagatgagaaaataccaaaatacaacatattaaatttttccacatggtatcagagccgaagaccaacgtcgcttgatccaccttccgctcgcgccgccctggggagatgagataatcgccatattctccctggggcgccgcatctaccagctatcaaaattatttgtagattaattagatccataaactcgcattagatcaatttatcctagctagccacataaaagcctatgcattaattcatgatcctcggagcgtttgccatggctaaccgagcgaagcagcagatcaagatggccacttggccagggatcttcgacacgcccgcatcgacgagagcggacgccagtccgccacggactactgcaggagtacatcgcggcaaggatgcgcgcttcaggcgcgtgcgcacgggtgctacttcggaaacctggcaccgccagcgacggggaccgtacgtgcagcaagaggacactatcgactccaagagtccaagttcgtcaagctgcagcccatcaagccgctcatcaacagcatcaagaaattgtcaccacaaataatgcagccatgcatccacgtgcaacgacttaaatatcaagaagtccgtcgtcactaccgcagccacagcaatgcacgccgccatctgctacctcctttacatcatcaccacgatggtcttctccgacacaacatcaccgatggtcttcatcaacatgggaacacgccgccgccgactcgtccacatagatggacacctcgcgtcctctgacagattaatctgtaagacgcttcttcgacgacatcgaccgtgtcctctatgacggcaacgaccgcatcaccgacgatgacatcgatcacgtcatctacgacgaccaaccaaagtggtggcctcattgccaacgacgtcccctgacatttgcaagacgtccccaatggcatcctctgacatctacaagatgcaagatgctaacaattgcagtttttgtcttcacaccatggcgtaattttttttttcgccttcggctatttgcggctacatcaactaccacgaccacggctacttcatgatcagctacgtcgacgaacgtctacaacaaaaatcattgacggaaactccagtcaaaaacgtccgtgtcatcgctatcgtccatgacactcccgctatgactgcgggagggaatagagaaaagtcaagggacgacacagaaggggacgcaggcaccaggtggaggaccgttcatcagaaatgcaatcgatgatggtgagtcaaatgagatgaagaaatagaaaatttcaaatccagtcgcaatcgttcgcttcgctcccgttacgactgagggggaatgttagaagtataatatgttagttagatataagagttaaatacaaattatagagataagataaatcctagagatagaatcctagagataagatagagtcctaaagatagaatcctagagataaatctactcttatcatattgtactctaagtctctatcccttatgtacttctatatataccccataagagagtcgatgtaatagatgagaaaataccaaaatacaacatattagattacaacatattagattttttcacagatggcgtcagagcgaggttcaagatcagcctcctcgccgccgcccacgacggtagtcatccgccgcccccgcgcagcgaccagagcacagcgaccaggtcgttccctcggttcatcacggcgaaggcgctggaggagtcgggatacctcgtcggcgacagcttcagcctccggtgcgacgtcgccgtcgtgaaggatatccgcacggaggacgacgccaccacggtcaagaagctcgtcggcgtgccgctgccgtccgacatcggcgcgcacctcggccgcctcctcgccgccgggcacggcgcggacgtggcgatccacgttggcggcgagacgttcgcggcgcaccggtgcgtgctcgccgcgcggtcgccggtgttcatggcggagctcttcggcccgatggcgatgagccgtcacaacaacgaggagacaatccgtgtccacgacatggagccgagggtgttcgaggccatgctccacttcatctacaacgactcgttgccggaggtagacgacgacgacgacggcgaggtggcggccatggcgcagcatctgctcgtcgcggcggacaggtacgacatggggaggctgaagctgatctgcgaggacacgctgtgcagccacgtcgacgccagcacggcggcgacggcgttgacgctggccgagcagcatcactgtgagaggctcaaggaggcttgcttcaaattcatggagaatccgagtaatcttaaggctgtcatggcgagtgatgattttctacatctgacaaggagctgctcctctcttcttaagaagctggctaagctggctgcctaaattgggaacaacgtataggaagtggattttaaactctcgaagggatatccttttattatttgcatgtcacttagttacgatacaaataaaaaaatagaatttctaaagttccatcaacagaaaatccaacctcaaatcttgtaaattttggatcactggatgtgcttcacgattcgtgctcttcttctccaactccggtgaccactcttcttctccggcgccggcgaacccaaactccagtagagggccgacgaattagggccccgaggtggggtggggtgggggggaggggggagaggga

SEQ ID NO: 67419 - DNA, 10087 bp, Oryza sativa
atgggtcagtgtaggaggcggagggcaaaacggaatatgtgttaggtggaggcggccggtggtggcgcccgccaccggagacggggaaaacggccgccatcggcttgagggaggaagaggacagggaggggaagggggaaggggagggggccggccggggggacctcaccggcgccgttgactctcttctgccagccggcgaggcgggcggcgtcttgttggggcggtggcgagattggcacgcgaggcgagcggcggcggcggaatgcgcgaggagaggaatgggaggaaaaagttagggttaaggatgtgcacgaatcttaaagcatatctaacggtccaaaatttgaaagattggaggtgagatttccagtccacagatatatacagtccctaaaaattaagatgtatttagatatgacatatcattcaataaatatgcaagttaaattttaacttttacatgtcacaactgagaataaaacgcccgtacgtttacatggacgtgagggtgttcgaggcaatgctccgttacatctacaaagattcgttgtcggagatgaacgataatgaagtggcagccatggcacagcgaacaggtatgacccagagaggctgaagcagatctgggaggacacgctgtgcagccacgtcaacgccagcacagcatcactgtgatggcctcatggaggcttgcttggaattccttgagagctgtcctgttgatctggatttgatgtgagatggctgccaatcttgctgtttgatctggatttgggagcagcatatatgagttcatttttatttttcaagcatttcagatgtgtgcatttgctaatccctgaacagacataacttgtacatagcatggttagtagtcttgtataaggctgacaaggcatgccatgctcagttgctcactagtcactcgcaagtgaaacttagtaaaaaaaagaagttgtggcattcatctgtatatcaactcctttcagcttgatgtcaaaaaaacactcctttcagcttcgatgtttcaatgataagagcttcagagaacacttccagctttatccctgacaaaacaagaattttgtttctacttattaaaccggtaagcgtttaccactgtccgataacaactctgatacatggcgacttcgattaattaatcaacagcgttctacaaattttggtctatctcaataatgttctaaaaatttcgtacaccaaagttacactgttcaatttatacaagagcatggttgagaacttgggattcccttgaggactatggccaaaattctcatgttaaaaaactgagcaataaactttgatgctctcggttttgctgtaaaatgtgccatggcagacaccatgaaccagaatgtagggccttgttgcctgatcataaaaatctcaagatatgcatgccgtcttcgataaattctggagcaaacgggtaaaaaaaggtcggctcggagagataaaggtagagcgagaggcctggattctgaaaataagtgaagaagaaaaataaggctgagttacccctactcagctgacattggatctatcggaccaaaatccttcagtggccaaacctatgaaatagcaatattgtcaatgctctaatgacctgaaggcaaaactcaatagtaaaattagtaatgacattccaggggggaatgaagaatggcccccaatccctgtgttgatgcggttccattgggctgatgcactatataaatagtagcaaaacatggtttctgaatctgaaacctttggttgctataatgaacatcaacaagtagtaatttcaagcaagacttcatggtccacaccaaattagttatatgaactttaagtattaactttatgccttaccaatcaaatgatgatagcatgttgctatgtgaactttgaatgaagaaacaaaatgtcattttcaaggtacacaaatgattaacagacaaaatagcaaggtcactgaaatgaattcttttcccaattaaaactaacacccttcctacttggctttaattacaagtactgtgctaagtcatacagttgaacaaatctacagtactccagaaaccttgtacgtaattatatcagctatttcaaaaaaacctcagcaagtacctttcaagtagaaaacatttggtgtatttaggccaaataccgccaacaaaatgaacgcggccctgatcggggctcgctagttctaattgagcacaaaactgaaatctaactctgtttagaagtgatagaatcagagttgtactcaaaggaatccagagcttttaaagttcagtgggcagcatataggtgctttgcccagagttgtcctagacacggtgtaaaaattcatctgactcatcaccaattattaccatatatgggcacttgccttgaggcatttaaaatgcagagtacttaattcatagcagctcaccagttgaacatataggaacaatattctaaaactataatctaagaaaagatgtacaatgtgtttgctaaagatgacaataaaattttaatttttgtgagtaacccagattgttgtaattgagtatagcaacaagaagcaaatgaagcacttgagactacatgctgtttaccattactacacatattcacatcctagagtaaagcttttattaaccctaaagtttttaacaatcattggttgcttacacaaaatctcatgatataaaaaaattggcatctaattagatgcaaaatcgaatcaaggatgagatttcagtggcatataaaggaaccataatatagaggaaatgagattacccgacaaaagatcttccctgtaattagaccataagggacaggtccaaactgtcttgaatctctagaagcataaatattatcaccctgcacccagacatggccttttggtacctataagtatacatcatccaaattaagagcatcacaagatggtatgtctgaaaaggtagtcaactagtcactataaaaagaattgaaaatcatataaagcatggagcttgccatgttcaaaatcagttatgttattgattgctatttcaaacataagaaatgtatcttctgactgaataatagtctcagcatcctgtcgtacatatgttattcgatcatataagcagtgaactagtggttgtctttcggtgttagtccaatgccaaaaattgcacataaagcgaaacatgaagtcaccggtcataccatggggaccataaaacacagcgttccactcattgtggagacaatcagtgtgcctctcaagtatctattgttcaaatgaagaaaaaaaaatgtctgacagcgagccaggattgtttggtttaaggcataggccacacaccctcaccaccgaattgtgaactcttaatcatgaaacataagttcatccctttattttcacatgtgtactgatgctcgagcaacttaaggctatactcttgaagtacactactactgagcattctcgaaatctacatttattagcattggtaccgaccaaatctggtatcaagtggtaagcaatgacctgaggaagcctttctttttttttctctttttaacaaagggcaggaagcatatcctctagtgttagtttgcattatagcagagaaagataaattctactactaatcttttgcaacacaagagaggatcaaaccaaatctagctaattgaaacagaaactgaagaacctaacaccagattaacccaagctactcaccacgacggtcttggaggcgtcgctgttgccggggtcgacgaggaacgtgacggcgtcgccctccatcccgacgacgcgcttgacgaccgccttgcgcgggttctccggcgagacgaggagcacggcgtcgccgctcgccacccgcccgagccgcgcgctcaccaggtccaccgccaccacgtcccccgccaggttcatcgccggcagcatgctcgggcccatcacctgcgccgacgccaagagccccacagaacgcgggtggggatcaagccagagcagagcagagagagagagagaggaagaggagacgcgggcgaagtacagtaccagcgcgaaggagcagacgtgggcgttgacgacgtggacggcgcagacggcctgcgcgacgaggaagacgcgggagaaggcttccccggcgatctccctccacgggatcccgccgaggcgccgcgcgaacccggacatggcggcggcggcgaggagagctcgggagagttttttttttttttttttgggagaggtagggagagttctgggagaaaagacgagtagtacgtctttggacctgggccatggaagcccacagcaatgggccggctttagacctacttattataggaataagtttacttcaggcctctttattttgaggtcgagtttgaatcacactgtcgaaccatagtaccggatacgacgtatccctcagaagtttcagctgacgtagctgctgcggaaaagaaaaccatagtttgagccctaaggtatggccggtgacttgagatacacttatgttattgattgttacgtaagccgcggaaaagaaaaatcaataacataacggtgaaatcgagttccaatcaggattttgagaggatattgcggcgcaagacgacgagcgagctcgacgaggcagcaccgccaccatcgctcgcgcggctcaggagagaggagtcaaagcgacagctcgagcttagtgacgtcacctcccagcaccttcccgttgaccacacacgcccttctcctagtcggttctcacatgagaaagatggggaagagagagggagaggggagaaagaatgacttatcgctgaaatgtgaggatgcatggattccatactaactcagtcagattaaccacaatcgactcgttatgtcatccaaaaccaggcataacactgacctggggtcttgggtaatatgctattataatttaaggatgtgttatatctgtattgcggttgaaagatatgattcaaactcgatgtcaaaataagggacctaaagtgaccttattgccttattatacggtctgtattgcatatcaggccgtcaagccatctttatcccttctttatggaccgaaatgtagatgggcctaatcataagctgagtcagctagtacttaattggcttgaaacaagaaacaaccgttccggaaacgtttcaaatcaaagttaaaactttttttgatgagttcaagttgctttataaagaccaatcagtatttaaaacatgtctatgagcagagggagagagactggaactcgatttcacttttctcttttaaggaaatgtattatacagtttcggtagagtagacagtttcttggcatgaaaagaaaattatacatacagatatcgttaattgagagcaaggtaaaattaaaaaaaaaatgcgcatagagcaatacaatatgacaccgacatgatacgatgatagtaacagagggaaccatccaaataccaaaggtcgtttccatatctctaaaaatgcagaaaaacattatatatatgttctagatatatatatatagccagcatccagcgaagagaagattactagattggcaaataacaaaggtagaaaaggagaggttcaggtaaggcttcatctactatatgtataagggggtggaggggtcatcatcatcctccttggtcatacagaggcaggcaggcaatggtggtggtctgcttcatggggggtcaggtactcaggtcactctagtagaagacggcgttggcactctggtagccgccgtcgtagatggcctggctggctccggcgcccatccccatggcggcagcctgctttagggcggcgtgctgactcatcagggccgggttcgctgccatcttgctcagcgccagggtgcgctcgtaggctaggaggtcggtcgccgacatgccaggattgaatggtgctggtgctggagggggtaggggcgcggatgctgtccctggtggagttggcttgcttccccaggaacactgcaagtaggaacaagattaaagtttagctgaattgcaagaaccataactagactacatcctctccttacgataaaaactcggtgaaaacataacttgcggaggtaaatgccaatgaaattcagaatgttccaattattgatgttttgcaagtatttctggtatgctctctaataagcatgggcatggcaaaccatccttatgattgatctacccaaaacactcttatattaaatgtatttatggctgaaacattgaagatgaacgtaccttgatctgcctaccgccaataagttgtccattaccagtctgaattgctagagcagcttcttcatgggtgctgtaacgcacaaagccaaaacctttatcacgcgttacacgcacctcctcaattgaaccaaccccaagtgaatggaaaaatctgtgcacatcattgctgttgacctagtaaatataagaggcagaaacgttactggtatggaaaaacaacaaaatacagcacaaaacaaaaagaaatttgtttcagaaatgggagaggttacatcatgaggaagattgccaacataaacagtcgtgtactgtgggttgttttcaggaccatcttcatttgcattatcctttccaccttctgcataaaaaagaacatggaatactttacagttcagtactttctagccatttaacagagctcttgctcagttgattgttacattacatattacaatcatgtattgacttaaaccaaaacaagtgggccaggacaaaaggcatgtatattcacctgatgaaccatttgtcaactctatcatacccttggagtctgtattttgtttctcttcaccagcattagcaccctttgttgcccaattgcaacgaacttgacggttgccgagccacttccctgaagcaatgaaaagtaagcagaaatgatcaggtagctagaactaacctaatgactagtgaggcatggcaacaaacatggaaaaagactcaccattcagttcatttatggcattttgtgcgtcctgtcaatgaataacaaagatgatcaatcagcaccgcaccaaaaaaaagtacaaataaataaaaattaaactgtcacaatgacactacctgctgatttctgaaagaaacaaaaccaaaacctctggatcgtccagttttctgatcccacattaccctagcatctctggaaaaaaaatacatatgggtaagaaagaaaatgcataatcttgaacaactggtaaaatacccttccgataaaatgtcgcagctagcagagtgagaactggaaaaaaaaaatacacacagatacgtgaaacacttacgagcaactggtaaatccagcgaaaaaagcaaacaaagcagcatctgttacttccgggcaaagatcgccaacaaaaatattaaaatggcctgcaagaatgaacagacatcagcaaagctcaattttaataactcagattcacatgtacacagacagtacagaacaataattgcaaaagaacatttaacagtttttcagttcccaacctgatgtatcctctctttgagtacttgcatatgcccaattgacttttattggctggccaaacctggtaatgtaggatcataagaaaatgttggaaaatgttaagaggaaaagcaaaatattagaatttatatatattataatactatagtattgaaatacttacaattgtctaccgttgagtgatacaattgcaattgcagcagatctacggtcataatagtcaacaaaaccaaaggatgactgcgagatttaatacaaaaaaggaaatcatataagcacatgtatataaaaagtgtacggctcagccaaacctaagaagttaattacattaaatctgctgaaaacatttagccacttaaacaaactgatgcatcacattgaagctttctcaagagagatcaatactgtagttagtaacataataattgaatgaatttagctgtctggcctatgtgaataacatagcaaacattttgaaacttccttgttcagaattacggcatttgtgctagcctatccttactatgaaattcaactgaataaaatactccaaaatagtcactccagcatcatcactatagctctagtgttaaccattatgctgaaaaataaactcttgtatacatttgaactatggttcactataacagatttgcataagtcatatcatgtacaagttgtttgatgatatcggtatatcacgcttatggtactgggcagtgtcatactgtcttatagttattatcaagttttaaaaatacagtatgcgaatgaaaaatgaaattcattcaatgacagatttcagtaactatcagtttagttaattaattaagggattaggggcgggtatgcatgtgcttttatatggagatagataaaatactcagaacatcccaaacgatataaatgccttcaagtagcaacatttacaaggatacaaaaggatctagcgaaaacagtatagataatattttttttgttaggtttgtatcaaagagcaaagattccacaccttttccttcatgatgagcttgcatccttctactggaccaatactttggaagacctcatgtagcagtgaatccgtcacttgaagatggatattgccaacatacctattcagaacatcaatggcaaccataagaaagaatgaatgcagaatatctagccaacaatgcaatgctgcaaataacgaagagagctcgatccagatcagtggatcaagggcactctgcccaaaggcatagcattacccaatctaactatttcgtaatgttgcgaaatagaaccaaatcagtgaaacaacagtaacaaagttccttgggcataaacagggcaaaacaggtgacaaatacttacacactccggcatgtacttgaatcaaatccaggaggcaggttgccactaacaatgggctctatctgccagaaaataatattagtgtcaaaaaaaatggtgcacttaaatattttataatgaaaataattcaaggagatagaagaagaaataaaggagcaaaagcatacaagtcactgtaactgcaataatgtatgcaaataacatccaggttataaaaggaattcgagcataattatggtgtgttcaagtatgttccccatttaccacttgccccaaagaagtacaccttgttaaagatcagatgcagcctaaacgtaaacggtaaaccacatcctttaatagcgactgatctagcaatcaccagactagtttccactgaccttcaacggaactcatttatactagttcgcagtacaatctgacaaattcaaagttaataaatatgaaagcttaaacacaagcacagagaactataattcgtgtactataggtacttgttgggtctaataatacataaagatctgaaatttcaaccaaaacaggttcccaaagacgacaaattgaacaataaaccctatccccacaaaccctacgggaaaaaaataattttccccaatacatgcgacaagtcagagagactactacaaaatcaaaagaaaaaaactagagtatctgacaaaatcccaaccgcgaaacagtcaaatcctcactctcaatagtaatcaatcccactggcctcaaacactacaacatgaaatttaccgaatcgtgctaccgaaatccccaaaaacgaaaccctcgaccgcacagtaaaaatccaccaaaccctgaccgctgatcgaaacggaaggagagagagagggagagagattgggccacctgcggcgccgcgaggaggcccgggtgcgggtggtgcggggggaacaagggcgcctgctgctgctgcgccgccgccgccaccgccgcagcctgctgctgctgcatgagcagcgcctgctgcatcatctgctgctgctgcgccgccgccgccgcctgcttcatccgctgctgatgctgcatgtcgatcaatcaaccaatcactcaatcgatcgatcgcgatcgatcgatcccccacctcctcctccgcctccgctctcgtgtcagggatcagattattattagggtttggcctcaggggg

SEQ ID NO: 67420 - DNA, 6706 bp, Oryza sativa
aagttttaaatagaatctaacatgaggtagaaacttatgaaaactttcctttgatattttatctctcctctaattcttatgttttttctgcggttcaattaaacgattattcttgtgttttttctatgtttgtaaatttttattttacgcttatattcctgttaaaatcatttttatatctattcctaggtttttttttcaaacatacaattcaaagaggccttgagcctctagaagcaatgattggactacaggggctttattgtagagtattggtaactacgagaggtgaagtgataaaagtgggttttcgggggagagcacgggtggtacagtggaagggcgcggtgttggtggaccagagctgacgtggcgattcggtgggacgtgattgggccaggatgcaggttggtggcccacttgtcagtgaggggatagggctgggtggcgatggcctcggcgttggtggacgaggtgtatgggccgggggcgtgtggagtggatagggttggagtacggcccacagatctggtgcttgtcagagtccgtgtggcccatgctgtggtcgcttggctggaggcaggcagaggatgggcactgggcatggattctttgcaggctagcagagagagatgctttgctctagggagatagagccagcttttcccaatctcggtgaaaatgcaaagccttgtttaattctaacttttttttctttcaaacttttaattttcccgtcacatcgaacttttccacacatgcaaactttcaacttttccatcacatcgttctaatttattcaaactttcaattttaaggtggaactaaacacagcccaagatgaaatttcatggattttaaacgaaacttttatatacgttggaactaaggctccattgtttcacttattgatggaataagcgatataaaataatttgtgaataaaacttgtatatacgtgttcttattgatctaaaagtaaaggctgaaaaataaactacgatgaaaaaatcccaaaatcaattccaaattttaggttgaaaattcaaattttggcttataagcataagcataagccaaaatataggcatttaatgatacttttcgggatctaacagtaaagttggaggagaaaactgagaggtttgatggaactctctgaattccggtcgatgaaattataggtgcgacgagcacattagaaacggtacgtgtatttgagtcaaattttgagccttgcttagcacccctaggatgttttatactcctcccatccaaaaaaatataagggattttggttaatacttttttctaataacaaatgacactatcggtaatcactcttcattcgctccttccccttgcatcaatttgacccaatgacaacggttattgtgttttccttacagacttcttactaacaagaatcattagtaatctcgacagtatggttgaataactaaaagtcataaaaagtcaaaattcaaccacaatgtgacacctagcgtttgtaggaagtttgtaaaaaaaaagtatgtgtatcatttcgctattgtgttatcatgcctaatcaataaacagatcctatggtttgccatggtttttagctaactatggcatactaatagttgtttttttttttccgatgccctacaaatatgctggtactttccttcagcaagtataagcgccctcgagagttacactgactcatctagtattgatttggtaggttttggttatagtccaaatatttacaatgtactattcaaatggctagaaaattaagtaggataaattttggcttcaacccaaaacgggctaatgagtccaagcagacactcaacgtgcataagagtttgcttactgttcatccattattcctattacaaattgatgtcagtcactggaagttgaacaagataccaggaaggtgcactatgatccaactcgaacacaaatccaacatctgacatgagtcccgttgatgtaagtatccatagcaatattatgacagtggtaggctttcattgtctgcttgttggtttattaccaaatattgaattttgaagcttaattttagagttgatcttgggttatttttctactatagtcattttttcaatattgacttttaaaccatgaattataaatacataaacagctttatcgatagattagcttttttttttcacttcgcttagtttttatacggcttagctctatggatcagagcgttgatagatcaaagaaaacgttggacgtgtttggatggtgctttggcttgagtactcttgcccagacatgtgcatctaaacacatgctactaaaatcggacgcttcttgaggcgtaaaccaaacaggcccgttgtctagatgggcctcaacatcgatccatccatgtagctatggcctagactacatctaaaattccggtccatgcatgtatatagatcaggattgaggccacctaaaccagggcggaattgtacataggttgaccgatatgtgctgaccgcttgatggacaaactgaggccgtgtttagttccaaaataattcttcaaactttcaacttttccatcacatcaaaactttcctacatacacaaacttccaacttttccatcacattgttccaatttcaactaaacttctaattttggtgtgaactaaacacagcctgaaactaactgtgggtgtcaagtctctgccactccacgacggcgcctcacgtcatcgtgaacacatacccgtgtacatgcatgcatggtgttcaacgtatggctcacctgtcacaccactcatcagttcacccgagcaccaacccatgcatggtgacgtcgccgctataaatatcggcaggtgcagtagctataggtacctatcctctgatatagacaaagaaaacatcgatgatgatgatgatgacgacgacgtcgtcaatgtcgttgttggtgtactccgccacgatgcgtcgtcgtggtgatggcggcggtggttggcgtcgacgtggtggaggcggcggtggtggttggcgttggtgtggtagaggcggcggcggtggcatcgccaaggtgcaacccaacgctgctgacaccctgcgcgggggcagcactgttcggggtgccggtaccgctggcatgttgcgcgtagctgagggcgtaggcggcgtgcctgtgcgcgtacgcgcggagccccaactacggcagatacatctgaagccccaagaccaggtgcctctttgttgtctgtggtctccctgtgccgtgctgcccctagacctcaattagcttgcatcggtcatgcccatggccatggctttggaactctagctagatcatggatggatgcacagtttaaattattgtgacatgaataaaatggttgtcatgttcagttcagtgatttatgatagcggtttcacaaaaccgacctgccggttcctactggttagcactagttgtttgcaataatttttatagctaactatgacacactgtttttttttggtcctactaaaatgttgatagcttttcttcaacaatgactcatctatagatttggtatgtgttggctacagtccaaacgttttacaatgtactgttcaggtgccccaaaaatttaggtaggacaaatttttgttttgaccgaagacagcctaatgagtccaagcagccactcaacatgcatacgagttcgcttagtatatatctaatccattatacctgttagtcactattgtcactcgttgaaggttgaataatatatcagcaaatcgcactatgatccaattgtagcatgacatgggtcttcatcgtttgctcgttggcttatcacccataaccaaaaaatgaatttagaaatttaattttgaagttgatttggataattttttttcacctattattttttagcattgacttttaaagcatgaataataaataggagtatataagacgttgtattaaattctttttgacttggcttggttttactacttctcattagccttatctccacgggtcagaacattgatagatcaaggaaaaccttgtctggatggacctcaaccttgatccatccatgtatctgggactacaagacaacagaaatcccagcccatacatgtagataggccggattggcgccatctaaatagagaaaactaccgcccggagattgcatctccgatgcaatgtaaggatgcatgcatttattttccaaactatttatccaattgtcattctaattatatcgttatattcattataattatttttttacaacagtatctcacacgattatattttaattgaaaaattacatatgtttcaaacattaagttttgatgtttcacgtgtgagaggtaaatgttttagctagaattcgaatatgtggcacattttaagttttttatactatgcatattgttttagtgctgcacacgaaatcaataaatatattgtgatgtttcattactttatttgtgaatgttgcgcatagtgttatttagatgtttcagcaagtataatatgtgcaatatttaccaagaactagtgaaacattagaaaaatatttattgaaacatgtgtaacactaagaagagttagaaaaaagtcatcagaatatactcatatagtcacgtgagatcttgttacgaagatttaattgtaatgaatctaacaacataatttgttcatagtttggataaaattataggagagaaaatgaccatttgaattttcaatcaatatgaacaattttactaaatctgactttatatacctaccatacacccacccctactattttctaggctaggaagcgtgcgatcttttcctttcacccggacaactcatgagaagcaattttccatctaaatcgggccgaaatggtacacagtctggccatgcaccgcttaatggaaaagtttgaaacgaattgaatggctcctcgtgtcatcgtggacacgtaccctcgtgcatgcgcgcatggtgttcaacgcctagctcagctcaccgctctgttcgcgtaccactataaataccggcagctaggtagcaagctattgatagagagaaacacaaaggcatcaatgatgatggggaagtcgtcaccatcaacgtcgccggtgtacgccgttgccgccgcgctgctgcttgtgtacttgatggtggccatgggcgccggcgtggtggaggcggcggtggtgccaccgtcgaggtgcaacccgacgctgctgacgccgtgcgcggggccggcgctgtttggggggccggtgccgccggcatgctgtgcacagctgcgggcacaggcggcgtgcctatgcgcgtacgcacggagccccaattatggtagctacattaggagccccaacgctaggcgtctcttcgccgtctgcggccttcccatgccgcagtgctcttagatcttaattagcttgcttcgatcacacccatggctatggctttggagctctagcatcatgtgcacagtgtaaaatgttgtggcatgaataaaatggttgtcatgtttagttcagtgattccatgatatcaatcccaaggtacagtagttaattactttgctaatcaatttgtttgtcatgatgtgatgatcgaacggtggaggattattcttgcatacagtgcgcggggttttctttcgtttgtttgcgtcgttgttctttcatggtttcttctccctctgattttgttgtagaaaggcgagctctttagtacactagagatcatccctaataacggcaaactttcacgtgaaacggtttttcagggaaacaatttttcgtttttgaaaatgaagtcaatgtcacgcaaaccggaataggtgattagcttgcaaagtgcaatcagttaagtagtattaactattttataaacataaaaaagaatatagattttttttccacaaaatacaccgagtagcggtttaggaagcatgctaaaaataaacaagaaaaaagccaaacacaaaatctgataagaagacaccatttaaccgtcatcgcacaaaacaatgtttattatagaggaaaacacaacacagttatttttggatggtaattaattgtctgctttctttttttctttcaaatttcaaaaattaattgtcttctgttttgtcatgtatgaattacaatgatgtgtttgatgtatattttatagaactctagttttttttgtagcatttagtttccttctatgaatataatgttttgcataaccgttttgttttggaaaaaacaactgaaagtgatatgttgattatataattccatattgattttatagttaggcaaattgttgtagtgtgcatcccacatataagcctagttgccagatatgagctcagcaatgctctaaagcagttgttttctcttctttttctttttataaaaaaatggttgtttggatgttacgcagaaaaaaagagagttttggacatatgaagagaaaaccataagataaaagctaatgtttgttttcctccaaaatcctgaaggaatggttcattcaataggattttcaaaggtatctttagggttaattcttttgcatcaaatccttagaatttaaatcctccaaaagtcctaaaaagagccccttagaattcaaatcctccaaagtcctaagaagagcccttgattgagtcaacatcttgttatatattaatatatatattcta

SEQ ID NO: 67421 - DNA, 1331 bp, Oryza sativa
ccaattgatgtagggaagtcatgccacttggacacttggtaggtaggaaggtgtttcatgacaaatagacagaagttgtctggttccaaataggaaaatatctctactattcttgtcttttatcaataaacagtaatatgctgtactttggtattagatttctgcaatgatttgtgcgatgcttgcagcgttggttcacatcgttctgattctaattgtcatcctaggaaataagcttttcctttcttctttataaacaaaagtatttgcagaaaacacaaaagccaagcgcattatggatcatggatcgactttttgcctgtgtgcttgtggttacatagagtcttggagctaaaaaaaatgaccaactaatcatgtgaaaatcatttttaggaaataatagtttcaagaaagaacttaatgtgaatctactacctctagaaaactgaaaagtatccactttcacttattttttacagttgaaccagcaagtgacagacctaatggacatggaaggtgtgaagttcctgtttttgttggcctgcaactgctggggctttgagcaattggagtgataatgttgggtatgactcttttcttgaacctcttcaattagttatatggttatgatttgttcagtactgactgtattttactgaataaatctaaaactagaaagtttgtaagtattttctttatatcacgccatattctgattgtaatacttttattatatatgatctcttttgttctgcctgtagtggtgggatcacatgctttaattatttatgggtagtattgttgaattgtaaaatgaatgttaatacttaatgggtagcattcttgatgctgatgtaaattttactggtatttttaaaattttgtgtgccattattatcacaaagagttttcttaacttattcgcatgacaatcagaatgatccaggctaccagggataaatacgtgagtggtaaccggctagtaccatagctacgagtactgatatgctatgttgtttcttgtacagttacccattcgtatgtgttatttggagttagaagttcagggaacctcatagaagattgagagaagattttacatttgcattgttgaatagtgattttgacttttgagcatagtcaaactgggtagtaattagcgaacaaaattatttgatgactatgtccatacagtagtaaaacttgttaccgctagtaactggccatgaaatgttgactgccagggtactgtattttttcctcaattgattttgaatagttggattggaccactttgtcatgcatgaaggttactgttcattcattattgt

SEQ ID NO: 67422 - DNA, 3055 bp, Oryza sativa
  unsure (1)..(3055): unsure at all n locations
nnnnnnnnnnnnnnnnnnnnnnnnnnnnnnnnnnnnnnnnnnnnnnnnnnnnnnnnnnnnnnnnnnnnnnnnnnagctcggtacaaaggattcttgtacctgatcaagacgaatcaggagaacaaaatgaagctctttcgcgtgccaacctatgatgtggatgtcatctggcacactcaccaactgcatcctgctacctactgccatgatatgctgaagctcattggacgagttctggagcatgatgacaccgatgacgatcgatcagaaggaaagaagctcgatactggattttcagggactaccaaacagtttgagaatgcctttggtgcaagatactggaaggctggtgctatgtaccgtggcaacttgccgtctcctgtgacatcccatcctcagatgtttattagtgaggtggatggtgaatttagtgttggcaaagctgagtcgcaaattaccattcttgaancnacagttatagaggtatgatactctcacaacacatgattatccttgaatcaaagccacagaagtatggtggtttgtcctttttacagactcctgtatggtaatggggatggtgttaagggcctatataaaggagctgtttgacaatatggtttgaagtgtagaatgctatactgacaactgttgtttctgaaagtataactaatgtggaacatcatatccagaacctgaattcagcagttgttttacaaagattcttctactgaaattatttattgacttaaaatcttttggtcttctgcagttattcttgcaaattgtggacatcaagaacttgccacctgcaattccaaaggaaaatgtgtacatatggttcacaaagaatcaaccagacatgttcatcagtgatggtggcaggctggatatctctacaaaaacagggaagtcgattggagccagtatccaatgtgagcctactggtgaactcattctaacagtactggttgatcgggaatcatcatcgaagaaacccaaaaagattgggaagatttctatccctcttcaagagtttacatggtctgattccaagctctcctttgagaggtggtttgaattgaaacctcatgatgggcatgccagttcacctatcgtcagccttcgagttgctgcctcttccactgtcccagtgaaggctcagcaggttcttagcatgatcaggacagaacctttctctcttaagagttttctgtcaccgaattccatcaaggatcaaaagatgagctgctggactcactttgtgtatgattgcaatactgaacttatccgtcttcaaattaggtgattttctgccctccttgatacttcttcagattaattctttcattcaaaataaaagaaatggactaacactttctcactagtaacagcatggaaagcatttatggtatttatgtgtattcatttcaaatgccattgaatacatttacaaaatgttctgtttgcgattggagctgatgttcaacacttcaacttatgtggatacagttaaccatttcataaatcaaatctaaaattgttgaagcacttaagcactagtttttagtttacctttttaggatcttttgattgattaatggtactctttgtatcaaatccttcttgctaatgagtactgactcgccttcatctcagggatcagaaggcaaagaacggcatggttgtcgctcgggagttggtcggagtaacaaagtcatcaaagaaaccatttaagctagcagagttcgtggacaacaagtggtcactgagcaactctaacttatgcatcactaatgacatgaaaccaagcaaggatggctctatacttgagctcaaatgtgacaacaaaacggtaagtgatgctaatacattacctgcacacataaatctactatatatgtgtgtgtgtgtccttgtctcgaaaagaatgatctaagtcttctttgaacaaaccagatcaaactctaccagggaaagaggctagaatttcaacggaagtgctgcaacaatcacgcagaggagaatgcttcagctattactgctgtgaagttctctgctgaacatccatatggcaaagcagttgcattgcttgacaccaaatctgagctgataatggtacacttcaacccttatcttttacattttttttcagtttatgtacacgtcaactttcatttacaaagttttcagtttgcttttgtacattttacaaaattttcagtttgcttatacctgttgcattgttcttgccttctttttttttcccaggtaaatgaggattggtttctgcttccttggatcgtgatgtcgttcctgttccaagacatcaatgtcgaagacggctcgaagctcatcggtggcgccattgctcagaaaggcgcgatctctgagcccgacactgctgccatggcgatgtcagccgagacggtggctgctcctgctaactgcggcacttgcggcacggcgtgcgacagtaacatggcaggcgacaaggtggtggccgccgcgagatgcaaggccgcgcgatgcaaggctgtcgcggcaagcggcggcggcggcggccaggcagagtcggctgggtgcggctcgggatgcggcggcggctgtggcggcggtgttgccaaggtcgttgaggccaccaaggctggcgtcggcggccatggcaagtccggtggatgtggctcgggctgcggtggtggctgtggcggcggcgggtgcggcgccatggccgtcgagagctccaaggatgatgtccatgcgaagtgtgcaggttgtggctcaggctgcggcggcggctgtggcggcggctgtggcggtggcatggtcatggaagcctccaaggctggccatgtcaagtccggcgggtgcggctcaggctgcggcggcggctgtggtggaggctgcggtggcggcgtggccatggaaagctccaaggctggccatgtcaagtccggcggatgcggctcaggctgcggcggcggctgtggtggcggttgtggcggcggcatggtcatggaaagctccaaggctgtccatgtcaagtccggcggct

SEQ ID NO: 67423 - DNA, 2503 bp, Oryza sativa
ttccctccaaatcagaaacatgagatgtgggttaaatttggattataaggtgttggctgttcagaacgtaagtttcatcactgtattcagctgcaaacataagatgaaagctactttttttttttgacgcaaaaggtagagagactctaccttgtttccattgtattaatggtggtcataaaagtgacaaagccagtggctggcaagagattatacaggggggggaacagagaggaaggataaagagaaagaaagataaaaaaagaaggaaaggagaagaaaaggaagaagaaagaacaaaacacaggaataaaaataaaaataaaaatacaggaataaaaaggaaacctagctaagcttgtctgcccaagtgttgaggtgttcgcgaaggctaggctttaagcgatgaacccataattggagactttctctgattcgatgcaggatgtatgcaacgcttgtttccgtgagcttgaagatcagctggttgcgtgctttccagagaccgtgcgaacaagcagcaaagcatgcaggccatcccggtttctggtgttctggcaaggtgtccaggattgattccacaaaatcttgtatgttagagctgcgcacggctgtctcatataggttgagcttcttccagacttcccctgctaatttgcaacgaagaatgatgtgatttgatgtttcaatagctgggcaggtcatacagtgtgggttggaatcccattttttaagaaccctgtttgcattggtgttgagcctgtctcggaacgctaaccacaaaaagatcctgcaagtgttggggatagccttgttccagataagtgttgccggctgccaaaggatgccatgataagtcaacaagttgtagtttgctgatgttgtgatatctgtggaaccaagcagcagtgttcttttgtcggggacattctgttgtatgtgctgttccaacaatatatccatgagggactgtaactcggtttgagcccgggaagagagaaccgggtgtagaacaattgtccaggtaccgttagtgtgttgggaggagactgtacagttgatatttgttgcgtaggaagctagtgtcggatatatgaggttgaatcgtcctgctgctgtccagtggtctcgccaaaactgcactagctggccgttcccaatcgttaccttagtggaggcaataactggctcgataacggaacagactgtcttccaaatcggtgtttctgttggttttgctttaatagggatctcatttgccatgtgttgcgtgcgcaaccattgaaaacatggttctgatgagtctgataacaacttgcctcctatcctcataagtagagccatgttgtgagctctcaagtcacggatctacgctactactcttttcatatcagaatgtagcaatctaggatgtgacttgtcctaacataatgaatctggacatgcctcatattatgtttgacggaggtactagccaatatttgtgtttgaagtcattaaaagtttgattgtactatgtaatcatcagatatcagggatctaaaagtccacttttttttaattggatgtagtagcacctttcatgatgtagggggatcattctatcatctactactagggagtcgattctaatccctcgaggggatatcccctcgtatatctttttcttctaaattcaatgcaaatagttgtgaaaaattatgaaaaaaaattgacaatgtagagtataatgatacctattactccaccaaaagtcaagttcaaattcgatctacacatcaagaaacaaaaaagacaaatttagatataaacattacgctactatttatacgttgaatttgtcttttttatatctcgacgtgtgagttgagtctgaacttaagattttgtagagttgtatatatgtgttgcatgaatattgtcaaaatttttcagaatttttcataaccgtttaaatgatttttaagcaaacgagggaacatccctcaagggattagaatagtttccctctactactatcctctttttccattttccccccttcctttttccctcatttttcatgaatcatgttgcaatcagatggttgtagtactctcctactggtagtagccaggtccccctgacctaaacactgaacagtgaactcatgtggagcagagcctcagactgcttgctcctgtacttaactgtctcttcctttttacaaagcagagtagctcaacagttttgagcagccatgctcgtgaactgtcctgcctatatggaactcggatcagtatgccagttgtgtgtgtcatatgaagttggtccatcagtccatctggtttggcttttcaggtggctcagacatcagagcctgcctgactccaaacagtatgtgaaaattttcaagtgaatagcctgtttttttttcttttcattaatggttttcatgtgaatgatttagtggtaattatccaagggtgcacacaaatgtattgtaactatggggtgcaggaat

SEQ ID NO: 67424 - DNA, 2321 bp, Oryza sativa
aggtcctcatccactagacctcttaaaactactaatcttttttcctcgttttagccattcaagcattaatattccttcgtttctctctgcattaataaagggtatggtagtttttttagcctatatctttataactttctaaaacaacatattttttttggatagagggagtgcggaaatagtactccaccatttagtatcacgggaagtgtgccgatcaatggatttttctattgcttaagcaagtactataagtgtttagagcatgatcaacaatcgctcaatactattccaatcccaaagggtttttaagaaaaaaaaaagatccatcaaaactcctaatcagattaaaaaagtttgggatttcaatcctgtgatttacgttctccataagtggagaagacctctcgctcccaatccaccgatcgtgggcaattttcgcacgctatggagatgtccacactgcaccagtcctcacaagctcgtccgtcgccaatcccgactcgtgccgccgttgggcgtcatgtgttggtcatttgccagccatcgatttcataccattgccaacccgtcatgcaagagaatgagagaaggtgtagaggaggaagaaaagagggattaacatgtgggccccacctgtcgggttattatatatgagaaggggagcggttgcccttttttttttgaccgaagagtggttgcccgttggtagttttgtaggtgatcccatcttatattacatagaatcatgtgttacctaatctgttggagtggaggatattttagaatctcaaatcctagttaaaaatctccaaaaggttatttagggaggtgatttattgggtatctcttagtgatgctcttaaatgctaccaaaaatataacataggattaggtaatgagatggagaagtgagtggagagagaatgagttactcctcacgcaaagggtaacatctcaaaaaaaaaagcaaagagggtaagggcacatttgaatcaaatgatttatataggaatttcataggattcaaatcctataggaaatttcataggattgaagctttccaaatcctatgaaattcctatggaaatccacgttgcatgtggattttggaggaaatttagcaagagctccaacctcttggaaaatttcctctaagtctatctctctcatctaattcctacgtttttcctgcgctccaatcaatcgaccattcctatgtttttcctgtgttttgtaatcctctgttttacacttcaatttctgtcagaatcatgtgtttttcctatccctccattttttcaaccctacgattcaaaggggccctaagatagcgtgagagtgaattatcaaaagaaaactattgtggttgtgtgttagccgcaatatattatatattgtagatgaataggcaacacatttcctattaaacttgctcctatataccccttcgttccaaaatataaacatttataggtagtgagtttttttttaaaaaaaaacaaaatagaacgcagccgagatagccgtttgatccatatcggacggtcggaaataatcggttgaccttgtggccacggaacatgcagctggtctcgatcccggagcagagagagagaccaatcaaagttatcaaaccaaccgccagcgctgatccggctcggctgttgcagctcgcgcgcccccacccctcattcactctccaccgcaccgcaccgcaccgcgccctcgccaccacggcgcgtcgcgcccccgacgcgccaggtcgccgctcccgtgtcgcgccgcgccgcgcccccacggccccggtacgcgcgctcgctcgtgcgacacgccgaggccgaggagaggagacagagcaagcgacaaaacgcgcaggcgatcccagagcgcgccgcgccgcggccgtgtcgatcccatcgaacacctcctcctacaggagtctcgagggctacttgtacacacacccatactagagaaagaaacaacgagaggagatacagagattgggagaggttagcgagagaggttgggcagtagccatcatcatcatcaattcatcttctccaaaaaaaatcagagtagaatctcatcactcacgtacgtgcagcttctctctctttctccttcgcgcgcgtcgatcgctttctcgtccccatcataaagcaaatgattcgttcgcctcgccaccctgctttaattctcttcttctcctcctcctccgccgccgccgccgccgaatcttccggtagctagatcccctcgccggcgacgtgcttgcgtttcttggtgtcgtgacgatcggggcgatccattttgtt

SEQ ID NO: 67425 - DNA, 8930 bp, Oryza sativa
ataaaaaaaaatcttttgtcgtgatatgatcattattcatctatatcttgctcggatcaaattccacaacaaaaaaacaaactgtatcacgttttttcactaactcagaagccatttgcctctccaaataattgagacgctttgtgttggaataaagtgtgcgtgatcaaagatttccagagcttgattactagcagcatcttttcagttgggttcttcttgagtacatgtgggacatgaggaaaaggggttgatatgtttgttggaatagttggttggggcaggaattgtcaagcccttcccttcccccttgtggctcattgattttgactattggggtgtcgcatcctgaaaacgtcactgggacagacaatgcagaggattggctggtccagcctaagccatgtgtccattctaattctaaactctcatgctggtccaagttggcaggtgctagtttcacatcactccaaatggcacattgcaaatttgcaattctcctttttttgccaaagaacaaacaaccttttttacacactgttgtttagtttaaccttttttttttaaaaaaaaaaactcattggtgcatgaaaggagcttcatgggttcaacacccagtcagtatatattaaggtagttaggtggcaatagtttactattgagttaaataaactaattgggtgaagacatcaatggattgattcttctctgtgcccacagctttagcaagaagtcaaaattcacatggatggagcagaagtttaccggttaccactgtttcctctgatcttcctcttggagatcttcctcttctctttttatttaaccctttttgtagataaaagtgttgaggtggggtcagggagaagtgcattcctcctgcaagtgcaatttgtaaatggccaaattgaatctgactctgttttgcatttgattgttgggggggccctgttgtggtctgaatggaattcttgtgtgaccttttcacctccaatcatattgctgttttgttttatcttatccttgcagccattgttgttatcaaaaaggtagttgtgttccccccattgtaagtacagagagtgaccatcaacagtttcagtgcaatggtctagagtaaaggccccatttgcatctcagaatatctgtacaaattgaactgtttcctatgaaatttctgtgtttcaaacatgacattgagaacgagcgcctggttcaaatgcgaattgaactgtttcgtgctaaattcttacatttcaaacatggcattgacaatgtgagacattttgaatgaaagggattcactgcaaattggaacaatttctctagtttcttttttcatgaaattcctatgtactgaaaatttgcaagatttggcatctaggaaaatccgcgcaaattgaactgtttctcgtgaaattcttctgtttcaaatataacactgataaataagggcccgtctcgaatgcaagaaggaacaatttctccaagttttttttatctctaagggttgtattttctcctgctctattcaatgaaaacactctagtgctgtttttcgttcaaaaaaaaattctccaagttttttgtgaaattcctatttctgaaaaatttacagtgtttatctgaaaatttacactgttttggtgaagggtttgcaggtacctgccgttgccggagggggcgctgtgcctggtggcgtcgacggcgttcatggcggagctcctcctcttctacttccactccaccacccaccagggcctcgagggctactaccactacctcctcgtcgtcgtcgtcgcgctctgcgtcgccaccaccgtgctcggcgccctcctccccgcgagcttccccgtcgacatcgccagcggcgccgccatcgcgctccagggcctctggttctaccagacggcgttcacgctctacgggccctcgctgccggcgggctgccgccgcgacgccgacggccacatcgactgccacacccacgccgcccaggagcgcgccgagcagctcgccaacttccagctgttcggcctcgtcttcctcgtctgcgcctacgcgctcgggtgcttcgccgtcgccgcggcgaggcacgggcaccccgacctggccacgatgcacgccaagcacgtcgccgccatggaggcgcagctcgccggcgccggcgccggcgagggggacaggttcgtcggctctgcgctgccgctggaggacaccgcgatctaagtgagcgggctcgccggcgacgtcgctgtccgtcgtcgccgccgtcttcttggatttgggtataggaagaggaagtagagtgcatgtgacacgtggcaggggcagttcagagttcagaattcggaattttcagatcatgaaacgatcgaagagtaggaggctgcagattaattgggattaaccacaataggggatacaaaattcatggaaactttgatttgatcagttgcttgattgatcctttttgttgtgattacgtgagggtttatatttggattacgatttttcctctgatcggtgcagaggttttgtcttgtacatcaaattggttactgggttatgcatacgacagcattatggatgaacagcatataattagaaactgtttttagacatgttttttgtactttgatgtgatcatacggtttgtttggttggagggagttagtgatgaggaatgggagtttatgatatctaggagtttaaatctgtagtttggttgaaagacttgggaattcgagagggtttgggatagggaattaagaggtccaattcccatcaatctcttgcctgggggaggcctgttaattcgtgagacttgtagggaattcgatgtgaaaccaaacaagagatggggactaaaaatgtaactcccatgaccaatcccaccatcaactccctccttaaaactcccattcctcttctcttctcttgccaaacaggccaataggtccattcagattggcaacccgtcttgctcctgtgcaatgtataattgtacattggcttgtttaatttgttgctgaaattaaccttatctgacacactttggagtttccaaactttagcaatgttggatgtgtgtagtttgtagcctaaccaaaatttagtagtgtttgtatgagaagatacttttgaaaataccaaaattttggtaaagtgacaatgacaaaagtttgcttagtttgttaccctaacaattcttggttattacgaaagaattggtaggactgaaagtggtggtaaagtgaaattggtagagttgtggtttatttcgaatttagaactttacattcggaatcaatttagggccaacttttgtcactttgctttgccttttaaactgtccgagtagaagtacaaaaattcgtcttcagatccgtgtaatttcgggacattttattgtcactttcttcacttagctttcccttttagactgttagagaagtataaaaacttgggaaaaaaaggaataagttcccttgaggtcccttaactcgacgagttcaatttgcatcctagaaccataataccagatacaacggatccctcaactgtcaaaaccggtataatataggtcacatgacggtttagacggtggttttgatttcgtgacacctacgtggctaatttgactcggttttcatctgacgcagcatatgaaacaaaatttaacaattttaaaaataaaacaaaatatatggacccacatgtcagtcaaataataagataaaaaatagtggagcccacatatgggcctcatgtcctccccctcatcctctctcttctctatctctcccattctccttttccctcttccccttctccttccccggatgcagccggcacaccaacgagcgagagtggaggcacggcggaggcgtggggatgccaaatcgacggggaagaggtgggcactacctccactgttgagcatgtgggcgtcatggtccaccgacgagtgtgcaaagaggaggacgaggcggggaggccagcgagggaggggggtaggtgggcagggaggtggcggcgaggccggcaagctcctcctaagtccaaatccatcatcgctgacaccacctccaacgcgcgaagagggaggaggcggggaggctggagtgggggcggggatggagcatcatctggcctgcacggcctaccgcaccccggccatggtaggaaaccatgtctgtcgtcgccgccaccatcatcgggatctggatgcgccacccgtcggccaggttgccacgtcacatcttccacccctactccaaccgggtcaccgctggcatcgtcctccacagctttggcccccccaactacgccgctccactaccacgctgtcctctctagatcttggttgctgacgctactccgggggacccacgtcgatatgcttcgcccatcgctctcgccaccccctctacctcgcctcgtcgcccaccgagccactagcctcgtcccctttgccgtacctccgcattctgcatgggtcctcaacgttgctggacccgaccgtcgccaccatcgaccagagggaccaccttcaccgacctcgccgcgttgttcctccaccccttcaccattttcgtcgggcgtcctcaccgtcgaggagaagagataggtgaggggagagagatgaagagatgggagatggggagagaggaggaaagagatgaggggagtgagaatgacaagcggaacccacgtgggtcccaccttttttaattatgtttttgttgcaactgacatgtgggtctatggtttttattattttccaaatcaaattgccatgtaagctctacgtcaataccaagtgggatgaagacctagtcaaattagccacgtagatgtcatgtcagctaaaaccaggaacaatatcgccgagggatctagtttgcgctgcgttttgtaagttgggggaccgttatatatggtttttttgtttcaaatgaccaaaatcggattaggtgtcaagttaagaaacctcaaatgaacttatttcaaagaaaaattgtaccggcctagttaggcccaattcgatagggggtgtggcaggtaacagtgtggctagcagcatagccatgatcactgaccccttgtcgccccgctgattgtcctccgcgccaatcgtctctccgtcggcgcggttgttgcatctcgcgatggcagcccttgtccttgtacaaggtcttttctcctctctcacccagaagtccattttaccttcctccttttaattaattttaaaatattaaaccttcgaatcaaattttaacatactaaatgaacttatgtgaaaacgttgtaaaaaacaattaaagttgtataacttattgagatctaccaatcttatttttgttatttctccatctgagtttgattgatctatacaaaatttgaatttcaaattatgacaacttcaaataacattttaaatactaaatgatttcaattaaaaaagttatcaacaacaaagttgtataacgcatcaatatctataacttttgttttgttcattttgctatatgactttgttataataatttgaatttgaatttcaaattatggcaacttcaaacaatattttcaaatactaaatgatttcaactgaaaaagtcatcaacaacaaagttttggttaatctttgttatctatatagaagtcatcatcaacaaaagattttagaactaatctttgttatctatatacaaattttggttaaactcataaaggaactttactatagtgtaaacactttagtgaccaaaattcttagataactttgttatctacatacacattttggtcaaactcgtaaatgaactctactatagtataaactctttagtgataactcttgttaggtccatatagtgacttttaaaattaatatacgagcaattgtcaattcttatattgcaagtatactggtaactagcattagtaacacatattatgtgctacgacagttcttcctataatactgtactgtttcacattagatgtagtatgtgttacagcctttcgtgtaacgcatgctttgtgctactgtggtattctcatgtaacatatatctttatgtgctacaagtttatgttataatagccctgtcctgtagtagcgaagttggtgaaatagaaattcagaatcaaagttcagacgcaacatgaatacatgatggcctggaaaactacccaacccaacccaaccaatcgaccttgcagtgcacaacattgaaatttggaaactaccgccacatcaaattcaaattgcaattcaaacttactagcatgacacgcaaagcaggcgcagacgacagcatgcaccatcatgcatggttaccattgcaagaatccttcatatacttatctgttgttttccataccagaacatattttatgaaacacataattaacactcaagtttctcagatcaagtccaccgaacttttaacatcaggtcaatatatatgtaaacctcgtaattccgaatgcaacagccagcaaaaaatcaacgagatggatgcacctccataatactagtaataactctaaaagaattgttggccattgttgcttgtctccatcttaacctacacatctggtcagcaatttctgaagcatatgaccaaaccccaaacacatcatcctcagacctgtaacaaactaaaaatagctcagacaaccgttcacgaaactagactgcaactaatacaaggcttataatgcaagattggcatggctgcaacaattacagacatcatgcaaataattaagctcaaagtaatgagctttgtagtaaacacacaagaaaaaccatctgtccctgtacacaaatcaaaggaacatgcaacaggaaaataccttctagttttcaggcagtacctcttaagccaaatcttcacatgaaaaaaaatatgccaacctgaatgaattggagtatattaaaacagtaatgaatacatatgccaaaacctaacaatctatcaaattgatgaatcatgctcaacagggcatcttcataaccgccaaagaaaaacaataaatagaccacacaactggggaggatcaatgatcaacacaatataaaagcaaatatagatacactaatccatgtacatggatcatagtcgtattaaagagtgttacattgaccaagcccaattaacttaattagctgcatacacattgcaccttgcaccttgcattggagatgaagtttcaattttcacataagttagaatcccaattagaatcattattggatgaagtttcaatttgcacatcagttacagttacaatcatagcccacccataggtgaggtcggtccatgtcggccgacacacaggtgagccatgtttaccaggagtaacaagttcttaaagccttaaactacaaaaatgcttcaacccggtcgtccgatcttgagaaaaaaaatcggacgcctcttactgtgattttgctgcatgcagcctttgtcagatcctctctctgttacatatacttcctttgtgggtattaatatgcatgaaagagagatgacacgaggttacttgcatgtacataacacacttttagcaaacttgaaaatgatttttcttctaaattactcatccaatttacaatccgattacaccattgtattcgttacaattaaatctttacaacaagatctcacatgaccatattataataaaaaaatacacatgtttcaaccaattaaacttaatgtttcacatatgaaaattagatgtttcagctgaaattctattatgttgcacaaatttatttagtgtcacgatgtatatatctttctttaatgtatctcatagtgctatttgtatgtttcagtaagtagtttattgtgtttcactggtttatttgtaaatgttgcatatatgttggttgagtgtttcaataagtatccactagtgtactcacaatgttccactaaaaatgttttacctagtatactcacaatgtttatgtatagatctaatattgcagtgaattgaaaaaatcttttgcaacaaataacccacatattatggaaatcatctattaagagaattcattttattttttgttccacaaaaaatatttcactttatataaatcaaatgttgcagtgacttgaaacattctttcgctatttagtgaaacattgtttttatataaggtgaaacaacgtccggtttaaacgattgaaacattttcgatttatctagtgaaacaattccgatatacttggtggaacaacgtgcaacatttaaaaataatttaataataagctaattttttttcaccagaatatatccatgtgtggtcttgttttaaagatttaattgcaatgaaattaatggtgcaatcggatcatgatttggataaataatttaagaaaaaaaagtagtttaaaatatttttgcatgcatgcatgcttgatgatgttggatggctgatggcgtgcgcgtgaatcggacggctcttggatgcgttctcccttaaactagcgtaagtcggagcttgtcttgctccggcctgaggagttgtacaatatgtcaaccttcatgcaaattgagattagtaaagctagcttcatcctgtccaagatgcaattttcacatatacttttggacattaaactaacataaaagaaattctacaccttcagtccttcctaaaaagtactgtagaatcgtaacaaaacaaaaatgcgattttctatatatatatatatatatatatataaaaggatagataccaatggacagtcaactaacataagagaaaatatatgcctctaatcctccctagaactcatagaaccgaaacaaagaaggaaaatattttatcatctcaaacgatatatcatcctttgacagcaactttcatccttctcctcctccttctcatccaca

SEQ ID NO: 67426 - DNA, 2363 bp, Oryza sativa
cttctccgcgatcatggcctggcactccacgaacttgtcctgcgacgcgtcgaacaccgccgccgccgcgagctcggcggcaattaactcctcgcggaactccggcgacacccaccacaatcgctcgccgcccgtggctggcggcatggggaacctcctccgccgcagcgccaggatcttgtcgaccaacgtcttcgtcagcagcatcgtgccctccggtagtagaggccccgtgtagtagtcggcagagccgccgtcgtcacccccctccaggatgtcggcgatcacctcgtcgagatcgtcggagtcggattcggattcggactcgccggcggcggaacccgattcctcgtcttggctggcgacgttggtgcagggcggctccgtcgaatcgggcaacgccgccgcctcctcctccgccgtgatggcgcactgattgaactgggactccaaggcaggcatctcgccgtcgacggccatgggtggatgatttcgcggcggaatcttggattcgttttcaagatttagcagcaaggggtggcgccggttataaaggcggaggcagttcaggtacgagacggagtcgcgttcgcgtctaactgcgcaaccagcgacgagagatcgaattgggcccaactaggccggtacgatttttctttccgataagttcattggaggtcccttaagttgacaccgaatccgattttgatccttcgaatcgaaaaaccaaatagaatggtccccccaacttacagaaccagtgcaaactatgtccctcaacggaattgttcccggttttgaccgacatgacatctacgtggctaatttgactaggtcttcgtcccaacgtggcccttacatggcaatttgattgggaaaataataaaaaccgtagacccatatatcaattacaacaaaaacataattaaaaaaaggtgacccacgtaagtcccacatgtcattctcactcccctccctccttcctcctctctccccatctcccctctcttcatctctctcccctcacctctcttttctcctcgacggtgaggacgcccgacgaaaatggtgaaggggtggaggagcgacgcggcgaggtcggtgagggtggtccctctggtcgatggtggtggcggtcgagttaagcaacatcgaggatccatgcagaatactgaggtagtgaaaagatttattattgtagtactccatttgaccaacataaaaaattgaaagtagatttgtattgcattaatattcaaaggccgaagtaactgatgcatgcggcgttctttgggtcctcgaccacaagtccacaccatctctctgcctgcagtagcctcgagtcctcgacgcggccgcagctgctgtctcacagcgaaggcgccaatgcatgggcctatatgattactccctccggttccatattaattgacgctttgaataaggttgaggtcaaactttaataactttgaccatcaataactttataaatatttagtttaaaggaactagaacaacatatatagatttgtcttttaaagcactataataaaagtaaacatgcatttatttattatatatattataatagaaaaataaggttaaagatatatctcgtagaccgtatcattgtccaaaacgtcaattaaaatgaaaccggagggagtactgcttattgaaccatggaaggaatcaaaaggaagaggggaagaccaaggcaaaaatgtctttgtgatattatttggtactctcaaggtttttttttaattaggtagaattaatctttgttacatatagaaggagttttctctaaaaacaatttggcatgttcatcagcattttgggatgggtttgcaccacaaagccaaccccaactgacgacgattagttttagacggtttgggtcaccggatatgataggttagaccgcttagtctttcaaatcatttgacgggaacacaacaatcagagaaaagaagggagacaactatggatgggtagtttgcgataacccgcgcgataagccactgtaaccagggtcttcgacttcaaaagaaagagaaaattgcagggaatagaaaaccacaattaacctcatatttgacaacaatagaaataattatgatgtccacgacaacacgactacaaagattatacttatagtgtccataatgtaatgttcaagagcaccaaaccatgattttgaagcaacacagcctagtagttatgccaaaatatggagttaacttagcattttcataaatttatatcacgaggtatcattacaactcttgcactacttctagaattctttggggattttttttccttttttttctaaaatttaaatttaaacaagattt

SEQ ID NO: 67427 - DNA, 5778 bp, Oryza sativa
tcgttctggttccctcgctggttctagagacacaatccaaatatgatattgcttgcctttttcaatagccactcccttcctaggggaacaggcgaagggagagtgaaaagaaaaaaaagcacacgaacctacttggagtcgttcacgtgatggctgaagtctgaactctgaagaggatcgatgagccagcgcaccgagcaacatactgtacatatgccatatggtcctcttgtctgacgaatactctgaagagtttaggtaggcagtaggctgccgtgccgcttggaaaagcatgacgtgattatgcatatgatagtatgatactgtatgtcgtttacgcagtgcgacggagcgacctggatttttttcaaattttctttcccttgatgatatatatatatatatatatatatatatatatatataggaaaatgcttctgtactcccgggagtacgtactccctctcccatccaccgttcatcgccccaccaggatgatcatcctcccactcccgctaccgggtctaactatgggagtatcgatcggacccgttttaattcgaaaaaaacaatcccgtgaaatccgaagggagccctattatctctgagtaatcaaattatatatatatatatatatgttcaaacaaactccacagtgaatttcatcttaactagacatatatataacaataataaaattaaaatatacttcacccgttacaacgcacgggcattttttctagtaaatcatcatatttataaatagcaccaatatcaaggcaataaagtatcatttattatgaaatttaacctcattgataaggtgttgtgttagggatgcatgtagacaacgatgccatttaatcttgcacatataaatgaatagacatgtaataatggtatttactcatgcacaaataaatggatagacatgccatgatatcatttacttctgcacaaataaacgaatggccaccagttagataatgatcaatctaggaaaacctcaaaaatcttaggcgatttacttgtgcacaaataaacgaatggccaccagttagataatgatcaatctacgaaaacctcaaaaatcttaggcggtgatcaaattgggatagaggtagtatttatatcgaggaccctaggacagtaagatttatctgaatactaaagttacacgttcacattcttcacatatattgtgaatgagaaattgtattacaatgcattaaatacatatgcaaaatctaaatcaaattataactagctatatatacctactttcagctgattctacccattttaaaggcatatatgtacaagttgataatttatcataagttgttgtttttctttattttatggccccaccaatcacaagtgttgcccatgtttgtcacatttatctaaaaaaaaacatcatagccgtaggtacggtcttgttatcattatcttctgagtgagagcggtttgcatctcatatgtacatgaaatagacaacatattagcatcatagtcatttggattttggactcatattataaatatgtaagcacgttgcttttctccacttctatcattctatggaaagcacattgccagttaagtacgcaagcactatgcaatttagtgtggctgattccctcttccacctgatcaagtaatattcttggaagtttagattcctttgtttttgttatgtactcttcgacaatttagggtatgttcactttgatgctattttcaaccttaccaagttttgataaagttgccaaaaaagtggctacatttagtttgctgccaaattttggtaactatataagaaatcctaccaaaattttagcaagttaccaaaattttggcaactatgccaaaattttggtattgccaaaattttgtaagatttttttggcatcaaagtgaacagacccttagaatccgtcgtggttaacttcatccataagtatctactagaaaaacgatttttcccaacattacgattttatttttctaggcagactataaaatcaccatttacaaaaatagctcaagataccataaacctagtacctgcgaaaccattatttttcaagcggacctcattaaggttacgccagcgaaaaacgattttcacaggcggaaccttaggtcctctgcctgcaaaaatccaccgcccacaccaaccggcctcgtaatatccgtcacccaccccttatctctatccctcaccttttcactccctcactccttcctctcagattcactctcttcccctcacctcccccttcactccctcactcctccggcacggagggcggaggcagcggccacggctggcggcgtgcggcgacaaggaggggagccgtcagcacagaggcagcggtgcggagggtggaggtggcagccacagccggcgcggagggtggtggtgtgcggcgactagaagatccggcggtgtggagggagccggccagcggaggtggcagataaaggaggagagtcggcggcagtggtgacccggtcaccctcggcggtgacggtgaacggaggaggaagggccggatggggagggggaaggggaggagagccggcggccggagggaggggctggcaggggagggcggtagcgggtcggttttttttttaattcaatgaggtggttttcgcaggctggtggatgtagtgtgtgcgaagatcgatgtagaggctcgcctctgaaaatgattttcgtaggcggggctaatgtccgcatataaaaatcatctatttttgcaggccttcaagtacaggcggggtgaagctccgcttagaactttttggtctgtttgcaaaaatcgtttttctagtagtgagtaatattctagcctctttttttgagtgatttttaagttgtgaaatatagtagttgtgaaacatgccaggattgaaaattggcttttatgttgtgaaacatactagttgaaaactgagttaaaatgttgtgaatagttcaaaattgatattaaatgatgtcgaacataacattaactaggagctccataaagtaggagcaattaaaacatggcaggactgaaaaatggcttttatgttgtggaacataatagttgaaaactgagtttaaatgttgtgaatagttgaaaattgattttaaattatgtcgaacataacattaatcaggagttccatataataggagcaattgcactggttttacgtttgtaatataaaaagataactttattataaaatcgacgcctgagagattcgaactctcgcggggaaaccccatgtacttagcaggcacacgccttaaccactcggccaaagcgtcgcttggatgatagatgtgattactgatccaatttattgaactgtatataatctcttctgtaaatttggtcgttgactgctgtactttttttttttttgtatttcttgaaatttatgttcttttttttaagactcgcgacttatctctataagtgaatagtgaatcccaaaaatcaactaggatgagccacataatcaacaaaataatagccattggattcacatgaggacaaaatagcaagaagaaatatgagccattggattcattggattcactttatctagaagcttccttaacctattgagaaaaaatagtaaggttatggatataattttacaatgcacacttttaattaaaaaactattttgcaaacaggccctcttactctatctatgtaacttccctttgggaaaaaaacaaatagatcattgaattatattttaaaagatccaacagtgaattaaagagtaaagtgaggaaaagatagtaatgttgtgtatataattttacaattcgcacagtttaccaataaagctaatcttttaagaaagattaatatgatctaactaagctttatatcatttgaagttatatatattagtgatgagcatatatatatgtgtgatatactaatgtaataatcggctatgcacccgtctgttatgattaatcatcattgcaaatttaagcttattattaataccacaatctatagacacatttagaagagatagagtttatagttgcgcaaatgcgcaacttaatatactagtttcagtgatatggaatattagattaaaattatttacatcagtgataacaattcctctttgagattgagtctaaaaaaggacccatatttgggcagctatgcatgtaattagatatggaatttatgttcttttttaagactcgtgacttcttttaatgatatggaatattagattcaaagtatttaagtacatgagcttaaaaggccccatgtttgggcagctatgcatgtaactagcatgggaagatgagttataacaaatattgaagatggacggttactatctgaggatttcgcatggcttccctgcaaaattgtctcctatttcatttcttttccttgaaagaatgggaagatgagttataacaaatattgaagatggacggttactatctgacgatttctcatggcttccctgcaaaattgtctcctatttcatttcttttccttggaagaatccatttgatgttcagtcttcggctctgcaagagttgttatagcattgaaagcagaggtcttaaaactccaatgacctgcattttgtcccagttcattccgatgcaaagtacacacaattgttatattatcttaaaccccagttttcttctaataaataccagtgttatctaccaaggaaacaaactctatgaatattatcgcaaaatctaaatagagagcactctcgatttagtcataacaagtgaccccatcggcattatctagatatgtgttaacttgaagaatcttactttactttactatgtagtactagtccattaagtaagtatggaaaatattcatatcatctacgcttcaaataaaattctcttaaattactcatccgatttataatccgattacaccgttgtgttcataacaattaaatctttacaacaagatctcacatgattatattttgatgaaaaatcacaaattacttttatgatatgtccaaattacttttagatttcactaagttacttcttaaacatataaaagtaaattcagtaaaacctaaaagtaatttacatatattatagaagtaacttagaacaaaacgaaggtatattataaaagtaatttattatttttcatcaaaatataggtctaatcggattgtagatcggatgagtagtttatgagaaaattgtatttgaagtatagatggatagtgcctctcatagatgcagtggtagctggctaccactaactgtgtagtcacgtccaatatttatacagtagggacagatatttttttctcctcttgaaatttcacacgaaaggtcgctaaattcccttcctccggctagaagaaacctttactcaaaagttcctatgacgttatggaattacatgtttgtcctcaggtctttcctttgttttttttctccattttcttttatctctctctgtcacatattcatttttacaaattcagacccttgaatttacacgcagcccaaccacattccccatcacttccacccacccttcacacgcatgcaacgaccaggattcgtccacgtcatccctcctcagcatcaacggccgggattcgtccacgtttgagctccacatgcatcggcggcgaccgtgcgtcacggatcatcgctcctctccaccattgcaccgtgttcgtccgttcgtccgcgcggtcacgacgcgccgccgccgc

SEQ ID NO: 67428 - DNA, 1360 bp, Oryza sativa
agcacgatgccgaggcagtacacgtcggacctcgccgacagggcggcgcgctgggcagcggcgccggcgccggcggcggcggcggaggcggcctcgggcgaccggaacgcgaacatggcgtgcggcgcctgcgacgtgttgacgagcgggaagaagccgtagtccacgatgcggggctccaggtgggcgtcgagcaggatgttgccggacttgaggttgccgtgcggcggcggcggcggcggcgcgtcgaagtcggcgccagtcatgctcaccagcctcatcgccgggatgcccagcttctcgtggaggtacgacaagccgcgcaccacgccgacggcgatcctcatcctcgccggccaatccagcaccaccctctccgggctctggtcacctgaaccaaacaaacacatcgtaattagcaaactataatcgagattagttgattgagaactacaccctgcgtttttagattataaatcgttttgactttggtaaggtcaaactactttaaatttaactaatttttataaataaatataataatatttataacatcaaattagttcaattaaatctatagttgaatatattttcataataaatttatcatcagttaaaaatattagtcatctctccgttttaggttataagatgttttgactttggtcaaagtcaaactgtttcaaatttgactaagtttatagataaatataataatatttataacactaaactagttttatcaaatcaataattgaatatatttacataataaatttttcttgggttgaaaatttaaacttaaagtagtttgactttaatcaaatcaaaatgttttataacatcaaataaaggaagtattgttttttataaacctagttaaatttagagtagtttgattttgatcaaagtcaaaacgacttgtaacctgaaaaaggaaggagtagtaattgctgtgattagtggggggtgaattggtgattattaatcacattctattattaccgtggaggacgtagaggaggctgccacgtggcatgaactcggagacgatgagcttttcttccttgcggtaatggtagccgacgggggagaggacgttggggtggcggagctcgccgagcatccggatgtgctcctcgaactcggcgcggccgacgcggttcatgtcgcgcatccgcttcaccgccaccgtcacgccgttgcgcatggcggccttgtacgccgaccccagcgtgccgttcccgagcacctcggcgctcgccttcatcagctccggcagcccgaactcgccggcggcgttgctcatcaggacgaactccgccacctgtttccgtgcgccgccgacgccgccgacgcc

SEQ ID NO: 67429 - DNA, 2136 bp, Oryza sativa
gagccagctcatggcggcgaacacgtcgccggggaccgggccggagaacgcgttccgggacaggtacagcgcgcgaagactgcgcacggcggcgaggctcgccggcagcgggccggagaagttgttgcggatgaggttgatggagtgcaaccccggtagccgcgacagcgccgcgaagtcgaagtcgccggagaggttgaggcgggcgaggcggaggccgatgaggacgccattgtagcactgcacccttggccaccggtgtgtttcatcgcacggcggcgacggcgacgacggcgaccacgcctctagcgcgttcgtcgggtcgatcagcgacgccttgagccggaggagcgccgccgcctcggtatcgggcgcggcggcggtatcgggcgcggcggcgccatcgggatcgacggcgatggcgccggcggcgaggaggaggaagagagtggagaggcggaaggcgaggaggagggtgaccatgaccaaattggtggaaggtcacagcctttcctctacctttcttccagcttctctaatgttttcctgcctttctttgggggctttgcctccttgtgccttttgtcaatggcttcttctgctccagtggttaggcaggcagatttgggagctaaaaataggataatgcagctgagacaacaaggtgatcaatggagatgatgcaatgcaatgcaatgcaatgcagctacaggtaatgcaatggcagattcttcacagcagacgtgcaaatggtgcaaatgcaaaatatgcaatggattaggctggattaacaggatttgcttactgcctgtttctctctcactgggaaaaaaaatgagggaggtgatgtggcagttgtcctgtaaatacacactaaaaatagtcagggtagcaaattaggcaaagattaaaattagtaaacggaaacagcttcctgctccttgtttctggagtgcaaaccatgagggcgatcaaaagcagggtgttctgaatatgagatgtgtcacactgcttgagactggaaatagagtcagaaatgtcacaacttcaccagaagtgctgaatcaccatgttacattgaagagtattacttaactacaggtaacctttgtccgtatacagcatcataattttttttgtactgcaaaagaagccatgtatgattttccttttttatgtatctccaaagcacagaaagacaatgaacaaggttaaaattagtaaactgaaacagcttcctgttccttgtttctggtgttgcaaaccatgagggcgatcaaaagcagggtgttctgaacatgagatggtgttctgaatatagatgtgtcacactgcttgagcctggaaatagcatcagaaatgtcacaacttcaccaggagtgctgaatcaccatgttacattgaagagtattactcctacttaactacaggtaatctttgtctgtatacagcatcattactttttttgtactgcaaaagaagccatgtatgattttccttttttatgtatctccaaagcacagaaagacaatgaacaactacaaagtacaaacactatggccaatctcctaactaggacaaaatttgcaacattcaaacctacatttgtctatgtacacggactagcaagcaatcattcaacactcagcctgggtcaccttgaatactgaacatagtgcacatatctgctatagacattcttgtcttgaaaacttgaaaatctcagctatgagctccaagggaagacccttcgtctctggaactcttaagtagacgaacacgagaaccaagcagcacacgaatgcataaatcgcacatgccccactgagcccaatggtacttagcatcaccgggaagcagtaaattgaaagtagtctgccaaaccagaaggcaagtgagcaaaaacttgcacatgttgcacgggcccttgttgggaacatctcggagcagagaatattgggtattggccccagaccgatgacatatgagcagaagcaaatggttaatgagagctggaagaggatttcatgtggcaaagatcccatcttcacgatgttggacaaagatatggcaccaactgataatgttaggaaggggatactgaccaggagaagaaccctgcataaatgtacattg

SEQ ID NO: 67430 - DNA, 6023 bp, Oryza sativa
caccttaaattcgtcgtgattaaatctttacaaagagatctcacatgattatattttattgtaaaaaaaatctttttcaaccgaaacattaagttacaactgctgaaacatcacacaataatagctgaaacattacaaaaatatctactgaaacattcacagagcactgtgtgcaacatttcaaatgatctaatgaaacatcaattaaattatcacaaaatatctgctgaaacattcaaatagcactatgtgcaacattccaaatgacatagtgaaacataattattgcaacatttaaaagagcattatgacaaaaaaacattaaaatattttttatccaaatataatcatatgagatcttattacgaagacttaattacaacgaatacaacggtgtaatcggatcattgattggatgcatagtttaaaagaagaaaaatatttaaagttttgctattaagttagtgcatgaagagtgagattgaggagagaggtaggagggtgtgtcagatctagtgtccccgaggagcggtaagcaactagaaccaatgaattgcttggagaagctagagagatggagacagagaatgtgccagcagccaacacactaaattataggggtggataattagttggctcggctcgtttgagcttgttatcttaacgagccagcttggctcagctagttagcattaacgagctataatgctagcttagctctgcttggctcatgaataggatcgttaagctcgatgacgagctctatctcatttttaccatattaataattttaaatttagcattttgtcatatattaacataataataaaaactaactaataaagaactcaataaatacgaatagtttgtaactaaaagactaagcactaattaagaagcaccgatatcttatactaatgagctaaacaagcggatcgtgagctagttcgttaaactctcgagctagaaggctaactcagctcaactccgagttcgaggtgatccaagtcgaattcgctacataactttattttttttcacccttacatgtatcaatggctgggaaaatattaggtatttttttagcgttgtagtttactccctctgtcctacgtaaaacaaatataagactagatgtaacatattctactacgacgaatctagatagaagtatacggatggagtacataagagcgatagtactctttggtggaacttcgaacaaagatgtcaggacctgcccgaggttccgaaaagcaacaagagccttttcgcaaaagagcggctcgtccgtggcccgaacatacctggggctcaaatccaggggaggaccgggacgggaggcccgcgcgtcaatagcgaaaatcggtgtgtgggactcggaaaacaatggtcggtgattcctcgggtggtgaactggtgatgatactccggccaaggtctctgctgaccttgaccgtttctaattaatggcgtttgaagcggccatggaggagatcgatggtacggtagctatccacgacaccaacggagaaagtgagaaacgatgggcaacctcgttcgttttttaggttattcttcggcctcggccggcgtcagtactgccgctgcctgcagctagcacgtcgtcccacaatggatttgcacgtgtcctcggtgcctgatcccaagccacaagccacatgctcccttcgtcttaaaaaaacttaattctaagcttaaatctatatacattatatttagatttaaatctagaattatattaaggagtatagatatgccatatagtgctcccacatgattagtttatcatcaaaccgtacaaaaatatcctaacagattctcgttctcccttttttttaattgacagttagaatctcacgtttcaacactgacgtatggaacagattttaaagttgtcatactaatccgactattaattgaacgattttgctatatctcactcgaaagattttttcttatctctcactcaattttctcactcaaatttacagtgcattttcttgtaagttacagtgtaatttatgaaacttacactgtaacttttataagttacactgtaatttttgaatcttcacatgtaaattttaaattttgtattggatttggtctttttcttgaggatatggtaatttaatgttcattatggtgtttcttaattgctttttgctttttattatatctatcggattttaatataaagattaaaaatctgtgtgatacgattataaaaatctttcgaaagatgtataggtactcccttaattgaatgaagttgtaaaagagacttaattatctgctgtttatactagtagtatttccgaagtatacgttgccatttgccacagacgttgagcagcgcacattttcttctgcttggttaattaactgattgtggctactctcaagcagggtttacaattttggaaaagaccgaaattttgggttaaaaattttcatattttgagttaacagtttaaaattttaaaatccaagttaaaagtattcaaatttgagttgattttaaaaaaataaaattgagttgaaagctttcaaatctaagttaaaagttttcaaaatcttgacttgaaattttttaatctaagttgaaagtttttaaatttgagttgaatgttttaaatttggggtataaagttttaaatttcggtagatttttttagaatttaatttgaaagctttaattatatttaaagaaacaaccaaacattaattacggcctaattacaaaaaaaaccccgaacactaattacggagaaaaacatcgaattaatcgtgctaatcggcactaaaatacagtgctactcatgtttctttatgttttcgattttatcctaagctagcaaaacgtggacgcccgccggtaactcatcttgtgcaaacgtgctaattagtcttctcggtaatcagctaggcgtaccggtgaactcagagatgtcgtagccgcaaagaataaaattttaaaatatacaatttttacgtttttatgattgctaggaaaaaaaatacccgttgcaaaacatatgtttttagtgatacaacaacttatataggagccgagaaataaataaaaacagtagtatcgctatatattataattgaaaaaaataatgaatatcttttcttgattttggaccaaagcctatttcttccttacgttttcagcttacctctctccgctcagcctatctcttttcggcccagcccacaagtagagccgcaggctgctcacatagccaactcgtgtccttaacctccggaaaacagtcctttacccatatgacgtggaagcctatgttctcaccatatgacgtggaagcctcatcaaatttgatcgaatgtttctcgatctcctaaaattggttgagggttttcaaccactcgatcttctctttccgatcaatgtttctcgatctcccaaaattagttgagggttttcatccactcgatcttctctttccgtttttcataaaatcggacaaaaagtctgagaagctcgacgataggccatcatcaatggagtaacgaattgaagacgaattgaaagagtaaattatggggaaaataaatgagggaggaacgtcagagcctatcttcccatcaaatttggtcgaatgtttctcgatctcccaaaaattggttgagggttttcatacggaaggtagatcgactgagatcagacaaaaaaaagaaccgagaactaaaaaaaaccaaaaggccgaaaaaaaaaggaattccacatgcgtaaaaatactaatcggactagaaaaaccggccaaaaaaaagaagacggacaaaaaaccaggaagctattaggtatagatatagataaattagagataaaaataaatattagaaaaccaactggaacacatatgacatatcaaaattttaacggaaacatattcaatttttataatagtagagatatacataattttaaaagatttgtgaaaatatacacgtacatgagagatgtgcggccggttattttgcgtggcacggaggtagcgagaccaatagccggaataatcctgcgacatcggtgcacagtaccacattggttctgcgggccagtcacgcggcaccgcatatgtgcgtatactgcatgcatatgcgtaacttggctgttcagtcgtgcgccccgcgtcgcggattgttccggacgttggtctcgcactcccgcgccttcatgctgtgtaaaataatctgtcatttttgaactgcggaatgcgtatatttcgataaatcgttcaaaaccttttataatcgtacgtaaaaaataatgtatatttttaaattttattctagccgcaaatgctccgccgccacgccaccgcgcggtcattcgcccgcctctagtcctctctctcctcctctctatagtaagtagtacatgtataattgtatatacgtatgtgtgtactatacgtatgtataaactttttatatgtatatatatattacaattttttatatgtatacacttttactataaaaaaatacatgtatataaaatttatatacgtatttttataaagtttgtatatgcccatataaaaaagaataatacacgtatataaacacatatacaaaatttgtaacgtattaaaaaaccaaaaagtgggaaagaaaccggagaaaatatcaactttgtatttatatttgtatatatacatataagaaaatacacgtatataaagtttgtatatgtgtatacaaactttgtaaacatgtatatacacgtaatcacgtatgtaaactttgtaaagtaacaaaaaaccgagaaagaaaaccggaaaaatggaaagagaaacggagcgaaaaatagggaagcgcgcggcgtccgccgcccctctttgcgcgcgacacgtgttcgcgcgtgggggtgtgtgtggtgggccatatgtggtatgccgtgtgcccctgtcgtttcgaagataacaaattaacggcaaatataggggctcctacgtctttccagccacaatcaccaccgtgtaagatcgatccaacggcgcatggagaagaggccgcgagatcgctaaaattttccccatttcccgtcgccgccgccgccgccgccgccgctcgccggagctgcgccgcctcccgatcttcccggtccctctcctcccttccagaagcggccaagaccaacggcctcgcccccgctacgtgagatcgctggtgccctcgtagctccgatccagcctcgcccccaagccaaggagcgaattcaggtattgcttcttcttttttctccccagattgctgtgcacggatttgccgtaagatgggggaagtaatttttttggagcttccagtaaagggtctgattgcctgacccttcccttgccatatcaagaacgcggcatcagcatgttctagtattcgtacagattctagcctgaagctgacttttgatgatggatgattcctgcaaagttgcttgatgtttttagtgactgagttcacactatcatattgggtaattaacttgggtaaacttcatcgtcggtcataatgtatcatcctctgtttagttacatcactgatggtcttgatttcgcagtgtgttagttgttagttttgagttcaagtatgaagacgtgttgttagtgctttatactagtagtatttggtaagctcatgctcacctaacaacattttgtttcttcagattttctatggagatttagctttcatcaaaacaaaaacaacaatatgcattatgcacgaattaaaatggcgtgtactatagtaatttgtctcagacaattggtaaagattgtggtttttacctatactgtctattgttttctatgtctctccctggatcgccagtggtagctgaaattggggcattcagcatgaggtacaaaaattataatacattgtgatgtaatagtagagggcaatatgtaaggcagtcagagtcacaagcacaattaaaatgtaaaacctgttatttctgatatatg

SEQ ID NO: 67431 - DNA, 1028 bp, Oryza sativa
aattcctgcagcccggaagtttgatgtgaagaaccaaatattgtagaatgatattcagaaataagatgataaggtctggagtctggacaatggaatctggaccacacacaggttctgacgataaggtgtaggactgtatgccagaacttacaagttgttggattatatgcctacaactacaattgcaaggtaaatggcatagcagcaattttatttgccaacctgttagttgggccaggaacaacatttgatatcacactttgacagattctgttcttttaatcaaacttcatatcaataacgtatcgcaaattgtagagcagaaggccatcccttccaaacagctcagcaccacctgcatttgtatgtgataaaacattgattttgtttatgctgcaatgaatcttgaactagaaagctgcacagtagcattcacccttttttactgtaactgatcaatgatcacttagcaattcctacatcttcatttatgtttctgtgaacttactgaatttgattgcagcgaggcagacagaagtcaattacttctgatctcaatataaagatctgggtggttggacttgtcagttttattttaggagccttgtatggaagtagattgatccgatgcaattatgtttacttcacttcttccacagaacatctccttgcttattcaggcctctgtcgttactccaattcatcgagctgctacctcaaacaggctagagaatttgaacattattcatatgtatattcatgtatgaaaatttgcagatttccatatagcacagctggggatttagtctagtggtaagatattcgcttagggagcgaaaggtcccgagttcaattctcggaatccccaatctgaaatcccttttgcaatgcatgtcaaagttttttcttttccagagagagaaatgcatgtgaaggctatctatatgtttgtatgattttcagtggtctggactctggagagatgaggttttggaccacaagtttgatgaggtcctgaggttcaggta

SEQ ID NO: 67432 - DNA, 1128 bp, Oryza sativa
  unsure (1)..(1128): unsure at all n locations
caaatcatttacacatagaaaaacttgtccttgttctgtactgctcatttgctgcccctaactgttagtaaataatataaattgtcgctcgtatagtgaaaactccatccgtcctaaattataaggcttatatttttttacacggtcttcaataaaccattaatttattccatgttatgttcccaacaaatatgaaattagaatcatatgaaagtactttaaaatatgaatctagtgatagatataacatgcaaaatacttagcatatttatggttagtatgattgttagtcaaactcaccgagttcgatttttcttaaaaagagggcaccctataatttggaacggagagagtataaccctatagtgttgttgaagaacatacattaataagtctgttttctacagaattattttcttttacaaaatggtactcattatatgtggtacctatgtaagtatttccagaattttcttttttgctttagtatttacagctcattacataatggggggtacttaaattctgtcatagaccacaatgagctgcaaatactaaagtaaaaaaagcaatataattgatcagctaactatccaagatccaagccctttcacattttcactttatgctgtaggagtaagcacaatgaatccccgcaaaaagtaggaaatcaaattgtgatgattgctgacagcaaaacgaatcatccagctgtccaacataaaatcatttcagtcattggaaatctgccattctttttctttttctgagaaaggcatttgacgttcttaagaatattactctttcttatccactttgcatgttcatgcttctctaaatccatggttggtttgtgtatgtgtttctagactccctttaacctttgagtgtggaactctttcatagaaaagaatgtaggcctcacattttaatacattttnnnnnnnnnnnnnnnnnnnnntctcatcatttgcaagaaaccatgaatgagtgtcactgctctcccgcttctggcctccagtcctgcttgctcttacataggcaaaatagtgcccgccatccaacttttgacctccgtgcacaattaccgctacaaggcaatatttgtactcattgtccagatatctg

SEQ ID NO: 67433 - DNA, 18542 bp, Oryza sativa
aatgccatagtagtgcccagatgtgggttatgaactcccctcctgactcgaggcattttttatgtgctgatgcattccaactaggggcgaggtgtataagtaattctgtccataccccagataggatctcccaacagtcttcatctcctctttcatcagtttatcagccaattttgccccttgtcgcagaacatcttcatttatgttttcttccccaacattttgggtattgttcttttctttaggcatcaatttatcatacctttcctgtagagactcacagcctttaagaatatcatcgtgagcaagtgtcacggcttcttgaaaaatcatattgggcacaaaaaagctgtcagggatcaggtcaggctttgaaaccagtagatatgcacagtatcgcgacaagctattcgcgatgatatatctttcctgcagcttaccgggcaatttcttttcatccataagatacaagctggaactgaagcaatttgtgaagcacgataatagatagcacaaaaatcctggtttgcttaaatcaacaccttcgtttttagcaagcttaatctcacagatgctggtagctatgtgccacacaagaatagtgtgggtgcatgtctgaagctcagagcatgcccatcggtaacttttccttttatcatcaagcagtgagataaccaccttgggcagatggccggccgtaaggtctatagagttgagtttctccaggatggcatgtttgacacattctggaatatcaatggggttgctgagttttgccccattgtccttctttggaaccattcctgtagatatcttgtgaatcagattccaaattctgggtctgtcgtcatatgactccaggaagacatattgatcgatttgtccatgccacctgttagcaataatgttagatttgaagaaggataatattaggttctccatgcagcggtttctggtacgctcatcatcccatcgcgcatacatgcacacaaggagtaatcttgtccaatctgacagtaagtaagtaaccatctcccagatctccttgaacagcatgaacaacatgaatacccatgtgatgatcatgtccacattgacaccctgcttcagatgaaccagctcaccctccgggggcttatagaccttacggatgtcaatggaaagccagcatataacacaaaatgtcaccatggatgcaagcaagctccaggagagcgaagttagaccagaccagaagaccataggatagcgggtgttgaagtaatcattgaggaaggccagctactgctccatgatcccaaaggcatgattggcatccttctcttcaatgattctcctcttgactagatttatatttatgcgaaaggtgcccctttgcagcttcacatcctcaagcctgcaacggagtagcctggacaatgcgaaggcgagggacagatccttttggtccttgccttgaatgatgttccctgaattgttggggctgggaatgttgtcacaggagcatagcaggtgcctgtgacatccccaaatcttatctagtgtgatcaaagatgatcttgtaattgtcttggacccgctagtagcgtggtggttgcctcgctcgctgcttctgcttcttcttctttgttgactggtagcttccaaatcatcttctttttgtaaggaggtagatctattcttgatattcaggacataccgaggtttctgtaacttgaccctttctccatagactaagtacttgaagccttccattgtctttgggttgcattcctcaggtttccagttgttagcttcacgcatgtactctgaaacgagctctgaactcctgccatgccagttggaattgatggccagagtacgtgaatggaatctgtaccagctcctcagcatctggagagcccaaagacaccagagtggtagcccaaatttggagccacgcgacaaattcaagaatgctgatccaagaagcttcaccacattcctccactctgtgaaccttcgccctcgacggtcaggaacaccataaccagagatgaagtcgacactgtaccgaaaattgacaagcacaagggcccagacgggaaacagttgattcttgaaaggtgcagttttcatagctcccagcaggtatatgactatggagtcagagacagcatcgaggatggtaaagatggctttcatggtcgcattgtggatgtggcgacgaaaaatgtccatgatgaacatcacaaggaacaacaccgtgaccagtaccaccaggaactcaatccgaaacaggatatacttcttctggttcagcatgacaaacagcgatgacagcagatcacggatctcatggaggccaatcatttttctttgctcgcttctttgtatgctggcccttaagtcagaccctgcaaggccacttaattggatgttttaaacataaattttagtaaaaagtaaattggcacagttcttcatactcttaagtgcggttcgttcaaaaaaaatatttttattggatgtttacaattcattggattttattttttatttttcaccaggaagtagcagttcaaagcataaacgaagcagaataaagagattacaatagtggtaaattttcctgagtggccacaaaagagaaggtcgttcacaaaagcgaggggatggatttgggacagaagaaggagataggacaggcatttgggttgcaccctctttgttcatccgacaatcgccaacaccttttggagctcaaggatgtcatggtcattgagacaacaggcgatcgaaatatcctcaagagcttcaggggtggttttggagttgaaatccgggagctttgtgtttggtaattgcttcattgagcttcgtggaacattggcaagctactccttcagtttcttcacctttaaggccttaacttcaatcgagaggaaggaagcagtttccttgttagccaaccgctcactcttgtgtcgtttgttttctctatccaaagttcttttcttctagcgagtgatcttcctcgcggagagctcatgttcagcctccataccgctgcagtcaaaatccggcgagtcatgctaatcctgagagtgctgctccaaactatctgccgatgagacagggacagtctagtcctgaggagcaggcggagacacctgggaaggcacaacaatttcgtccatctcggcaatagacggccaggcttgaactgcaggttagatcgcgagctgaaggccatcaccttctccaccaccgtggttgttgtgttggcgccgatgccatgttcgctgctgggccaggcggccagcaaggggcgagggatcccccggggcttgctgaaactgaaaggatgggaagtgacgcacgcacaacccgtcttcgtcaatattcccagcaaggtcccaagtcgcaatcactctgaccttagcgatgcaaacgcttccatcttggaagcggactaagaggtagggacggaaaacctttccaagttgatgctataaaaccaagcggagggaggattgatcatatctaaagaaacattcatcatcaatttcactcacaaagcccatacgaatcagggttgttccgattctaccagggaacagaagttctggagggaaatctgtgatgtccagctcggtgagttttgtcagatcctgaacaaatctggctttactgtcttcatatcgctccaagacaagaatgtggtccccagagtcaagcatttcctgatgctggatggcaatctcgcggtgagctcagagggtgaaacagagggacatagtactacgggaggaagcatgcatactaaagtgaaggtttggcatgtgctccctcatgagatctctgatagcagcagctagattggggcagacaagcgttagataggtagctgcaaagtgccccaccagcctgttgtcagtgaaggggacaaacatatcctggtagtcatcaggctgtaggtaaacaagctgaactgctggaggttgggggctgttcggagtgtcgtcagtgtcaccagaagcatattcttcaaacatatcactgttgtccgctgtagcatcctgagctggggacctcaggggggggggggggggggagcttcattgggtaggacagcaggctcactctcaggggcagccacaggagggacctggaatgctcatgcgcaggtggcgaagcaaaactagcagagagcaggcgatcttcacaaacaaaagtatccctggctggatctggaacagtgaaaggggccttggaggtggattgaccttccggaagcggccgagcaccgacaatgtaccacaccttgttctttggttggccggaaacgatgtgctataccgatggagcttggggtgaccagatggggagttcacccgggacgagatgtcgagggcggcgaccactgcggccactattgcagccacggccacgctagcagggatggccggagtgggcgcagcagcaactccagaagtggtagagatagcaactgaggcgtccccagcgacatcaacagcagcggcaatctcatcgacagcagcagcagcgacgacaatctcatcgagagggcccacgacggggtcgacatcagcagcaactagactaggaggagataccggcaccgcttcttcggtagcaggcagctcatggctgacgtttaggctatcctccagaagagcaatgacatcactcagtggtagaggcgcaaggttagccggtagagagctagggaagggagcttttggaaggcatgggagggctgttagagtttgcaggcgtttcttgacccagcgggtggtgaaggtgggacgagtagcagcggcaacggttggtggggtgggtagtggagtgttagaggctgcagaggagcgtcaagagttctggcgatggccggagcagtggcaggcggcgtgaacaagggggtcacggcattccctagccacatgatcgcggccaaggcagcggaatgaatcaacgcttgaacatcgtggtgcggcggtggagggaagctagggtttttctttgtggagggttttttgggcgagaaagcagcctctagaatgcatgcgtgtaacaccgagctcagccttcgtgtctagctctgagttgttgcgcggaggagtaagtccctgggccgttaagaaatgttcctaacaagacagagctgtgaatgcatgttgtgcttccactggctgcgaaatgttcattgggcggacctgcgttgaacatgcgtttgagccaatgggcaagcttgctcttggaccagtgggcaaaccttaacattgctttggaggaaaccattcaggaagaactgcacattttttgaaatcacgctggctgcagcagatttatctaggtgcatctgaagcatttaagattgaagaactgacgatccagctaagaacatgagaactgccacattgtaacatgcaacccgagtgcataaaatgccagaacccagcgaggaaatagagagaaaatcaggataggagcagaatcagtaattcaagaggttttggattgacaacaagctaaatattttttgattattagaaaggaaggacgagatccagagagtggaagggttaaattgttcgataggatggatggggcgactgaagagttgaaccaaatgagggcctggtcatggaacagctcaccgggccatacctttgattgttgaggccaccggatttctcgccgccggcaaggggagaagctgagccttcagtggggtgtcccccttgcaccctcccatcccccactaccaagtttgcttcatggatgtgtaattttacatgatgtggtacatgatctaagagtaaagaagcaatagggataattctaaaacttgattttgagaaggcttttgacaaagtaagatgggaatttgtttatgaagtgctcaacaggaaaagttccctttaaatggattcaccggatgaagagttgcataaaaggaggcaaagtctgcattaatatcaatggagagaggtcaagctacttcaaaacttataggggcctgagataggggatcctatctcacctctgcttttcaactttgtagtgatgttttggcacagtgtgttgatttagccaagtcaaatgtgtagagaaagtggaatggatgcctctcacaatgtgtgaaggagaattctcatatatatatatatatatatatatatatatatatatatatatatatagctgagttacacttaatgattcataagaccaagagtcatacttaaagctagtggagagttacactaaaagctataagttacataagaccaaaggtcttgaagataaacagcctaaggataaataaataatcctaatacccgcccgcagtcgcagcgggaggatcacgaacgcaaagactggaccgaaaatcagtgaataactgaaccggtaagcctttggtcatgatgtccgcgaactggtgagatgaagggacgtgaagtacccgtacttgtcctaaagccaccttttcacggacaaaatggatgtcaaccttgatatgcttcgtccgacgatgatgcataggattcgctgtcatataaacagcactgacattgtcacagtagacaatagtagccgaagtaatcgggacatgaagttcctggagcaattgccgcagccaacagcactcggcgacagcatgagctacggcacggtactccgccgcagcactgtaacgggagacagtagtctggcgcttggaggaccaagaaaccagattgtcaccaaggaagacacagtagccggacgtagaacgacgagaatcaggacaacccgcccaatccgcatcggagtatgccgtcagggactgaatcatgctggagccgatgtggaggctggtggagagactgcccttcacgtaccggagaatacgcttgaccaaggcgagatggggctcccgtgggtcatgcatgaagaggcagacctgttgaacggcatatgtcaaatccggtcgaatcaacgtgaggtactgtagagtaccagcgatgctcctatactccgaagggtcggcgacgggcaggccgtcggtggcggagagcttggcacgggtgtccactggtgtcgaggtagagtgacactcggccatgccagcccgctgaagaagatccacaacgtactggcgctgtgaaaggaagaggccggcagaggagcgcgtcacggagatgccgaggaagaagtggaggtcaccaaggtctgtcatggcgaactcggagtggaggcgtgccataagctgctgaagtagtgatgtggtcaaagcagtgaggatgatgtcgtcgacgtacaacagaagataggcaatacgatctccacctttgtaaacaaagagagatgtatcggacgtcgaaggtagaaatcccatctatcgaatatacgtggcgaaccgttggtaccatgcacggggagcttgctttagaccatacagggacttctgcaatagacagacaacatcaggggcagcagggtcaacaaacttggagggttgctgacagtacacggtctcctttaggtgaccatgaagaaagacgttcttcacatccagttgatgaatgggccaagcacgggaggcagcgatgctgagaacaacccatattgtggccgacttgacaaccgggctaaatgtctcgtcgtagtcgatgccgtgctgctgcgagtaaccacggaccacccaacgagccttgtgacgggcaagagagccgtcagagtggaacttgtgcttgaatatccacttgcccatcacaatgttggccctaggggggcgaggaacgagacgccaagtgccgttgtcgaccagcgccttgtactcatcagccatggcagcgcgccagttgggatcagccaacgcactgcgatagttggccggaacatgagaggcagtggcgtggtagccgtgtaggtcagccggtcaactggccgtagggagccagtctaggagtgcatcaccatggaatgcagccgaggagcaacagtcgtggcaacaatactaggtgaagatgatgtcgggaccgtcgtggttgcccaacgggtgtagacatggcggaagggtgacacgatggtaccggctcggatggcaccagccgacggagtagtgccgggtgaggaggcaccgaccaagggcgcaccagccgagcaggcgccgcttgccgccgtgacggtgttgttcggcaaatgtcggccgaagaggggaacatacggttgctcaacctccatggagggagccaccgtgagaggtcgcggtttctcaacctccgaggagggagccaccgtgagaggtcacggttgctcaacctccgaggagggagcgaccgctggaggaagtccctgcagcaaaaagtcaaaagacaaggcaacagggggagtcgccgcgaagggaaatcgggtttcgtcaaacacgacgtggcgcgaaatgatgatgcgacgagtggagagatccaaacatcggtatcccttgtgggaggccagatacccaagaaaaacgcaagctgtcgagcgagggacaagcttatgtggagtcgtggcactcatgtttgggtaacaaagacagcaaaaaacccgacggtgagagtagtctggagtggtgcgatgtaggagctgaaaaggcagtgagtggtgaatggaggaggagggtctccggttgagaaggtaggtggcggtggcgagagcctcagcccagtaggacggaggcatagaggcttgtataagaagggtgcgtatggagttgtggatgatgcggagcattcgttcggctttaccgttttgtggggaggtgtaagggcaggagagtcgtagctgggtgccacgactagcaagaaaggtagtggtggtggtattgacaaactctctgccattatcagcctggagagatttgagcggtaagccaaattgggtggaaacatactcggcgaactccacaatatgacgatgaacatcagatttgcatcggagtggaaaggtccaacagaaatgactgaaatcatcaaccaccactaagtaatatttaaaacccgaagtactcaacaccggagaggtccatacatcgcagtgaacaagctcaaagggaatgaaagtgcgagacgaagacctatcaaaaggtaatcgggtatgtttgcctaaccaacacgcatgacatagagaggtgtctattttattacaggaaatggaggacatagtccgaagactctggatggcggctggaccaatatgaccgagacgacggtgccaaagcatggatgaagtggcgagggagtagtgcgcggcgttggagggagtggcacctggaagggtgtagagttcccctcggctattgcagcgaagaatcacgcgtcaggtccgaaggtccttaacagagaaaccaaattcatcaaactcaatggaacatttattgtcgcgggtaaactggcgaactgaaagtaaattacgaactaaggaaggggcgacaatgatgtttttgagtgcaaatttggtggttcctatggggagaaatgaagtgccacgacaagttacggggatagtttgaccatttcctaccgtaataaaagtatgagagttaggcaagcgagtaacgaggataccatcggtggaggacatatgagatgtcgcgcctgtatccaaaacccagttgtttgggctttgaagagccatcttgttcagggctgcaatgaggctagcttgctcccagttgggctggcttgtagcagcagatgtgggcgacgtaaatggcccagcaaaagtggtgttggcctgggagtagtgggccgtcggagccggcccaagaaggccgaccaaagaggggcgccaggccggttgctgggccggccaggggttaaagcagacccaaggcccgtccggcctccagccagggttcacccagccggggccactcccaccagcagagaaaccaccgccgccaccagaggaaacgccgccgccagaaaaatgtcgagcgccaccaccacttccaccgccgccaccccccactgccgccccctatccagccgccattccctcctccgtttccacctccgcgtccgccgttttaccttgtggttgcggcggttggtgttgctgccggcgcgggcttggccaccagggaagccgccaccaccagcccctccgccagagaaggactggcgtgcgccgccaccactcccactgccgccacccccaccgccagaggagccgaagccgccgggagggcaggagccgaagctgctgccagccatcagcgtcgtggctgcctccaccttggcttcattggcgaggcacaactcctttagcatgagtgtgttgcacgctgaggtgaagctcgggaggacagccgcatttgcgatgttctcgccggtgttggagaagcgctcgttcaggcctcggagaaggttgagcacgagttgggattcggtgacggcgtggccgacgtcgcgcagggcgtcagcagcggtcttcatctcctggcagtaatcgtcgatggaggagtcaccttgaatcatggagtgaaattggtggctgaggaagatcgctcgaggctctttgttggcgtgaaacatgtccgtgatggtgacccagagctcccgagcggtctgatccggctccatggcgaggtcaaggatgttgtcagcgactgatccgaagatccagctgcggatgcagcagtcggcctgttcccaggccgggttattggggcgtggaggagcggagccatcgatgtgagccatcaacccgaacttgccacacaaggaggtaaagaaggccctccatttgttgtagtttgggtgggtgttttctagggtgatgggaacatgggatttgacggcgaccgtggcataggggtggaggaattcgctggtggtgctggaagaagaagaaccactagaggcggaggaggtggaggactgagttgattcagccgacatggccggagtgagggaggacgcagctgcgacagcagcgcgctggagcagcagaaaagaaggtaagagcctaggctctgataccatgtagaggaagtggaatggatgcctctcacaatgtgtggaggagaattctcatatatatatagctgagttacacttaatgattcataagaccaagagtcatacttaaagctagtggagagttacactaaaagctataagttacataagaccaaaggtcttgaagataaacagcctaaggattaataaataatcctaataaaatggtttactatctggggtagttcctcatctgttctcagggggtttgacccacctccaatatgttgatgatacaatcatatttattccctgtgttgacagagagataattgttactaagttcattctttactgctttgaagaaatgttagggttgaacattaactatgacaagagtgaagtgtctgctgtaggtttagaggtggatagagttgctaatatgcttaattgtcatgtaagatctttccccatgaaatatttgggcttacccatctgccctgataaggtgctaatatctgaccttatgttcttaccgcaaaaattagaggagattgggagtttggaagtctaacccctcttctggaggtagggatattctaatcaactcttgcttatctgcaattcattcctacacaatgggcttctatctgttacctaaaggtatccaccttaagatgtataaaattatgagcaggttttactgggctggtgtgggtagaaaaagaaaataccacatgatgagatgggaacatctgtgctctcctaaagagtttgggagattgggcttcacagagacaagaagttttaacattgttttgcttggaaaatggatctggaagttaagagtcaggtgataagggtccttgcatagagctgttgcgaaagaaatatctgggtgagaaaggttttttccaatatgagcagaaggggggttctcaggtttggaaaagcctacactcaattaaagagttgggtgaaacaaaactgtcaattgattgtaggtatgggttctcacattgaattctggtctgatgtctgctctgagtcttgccctctgaaaataaggtttaataacttgtgggagtgaaagagaagacgagttttggcttttgttagttcgaacttggtggttgacacaggtagcagaccaactgtaggagaagcttctgatagaagtgatattgcctagactgcaggagaaggtctactataaatatagttgctaacttccctgcgaattaaggctgtgttcctttggaggggttgggagtctctcccctccgcacggaaaatggagcaattaagattaacacataattaattaagtattatctataaaaaacttgaaaaatgattaatatgatttttaaagcaactttcctatataaattgtttgcaaaacgtgtaccgtttaacagtttgaaaacgtgcacgcgaaaaacgagatagatgagttgggaacttagagcaagtttaatagtatagtcaactaccggctctaattcatttatagccaatctaatagttcatccatacaatagttacatactacactattaatacctggtcccacatgtcatatacacacttcgtcttggagttcgtgctacagctggctacaaatctgtagcccgctgcttctctctcttatttatcttcttaaaatatatttgtaactggcttatagtctgctattgtacctgctcttatgggaaagaattgcatcaggttcccaacctcctctccctcgttttccacacgcatgcttttcaaactgctaaacggtgcgtttttttgctaaaagtttctatacgaaagttgcttaaaaaaatcaaataatctatttttttaaaaaaatagctaatacttaattaatcacgtgctaatggaccgttccgtttcccgtgcagaggagataggttacccaccccaacaatctaacacagcaagttgtgtggagaacgagagaggcggcagggagggagggagagatgtctctgtttgtagagatgacagcaagatcaatcttctctttcatgaaaaggctctttaagatggacacgatcactggtatggcgagcgtggagctgtggatgttgatgatagaccgacctcatttctctcctgatggtgcactagcaggaaaaggattggcaagcagttgcagcgaggcttcgacaccatcgtcacacttgctacctggtcaccttggaaggagaggagcactataggtctataggagtcttcaaccatgagttgtcaaactttgcactaggatcacccaggttagatctagtcgggtggtcctatttggatttgatgtacgacattgtagatgaaagggagagggtttagataccgaccggttgaggagttcgtggaggaagaggcgccggacatcgtcgttgtcatcgcggcttgacgtggacggcagcgacagtgtgcttgatggtggcggttgtcgttgcagcggtggttgtgggcgatcccggcgaggtcgtggcccggcggtggtgtttcccgtcactggctgcgccccctcgatcggattagggttttgtggggtggagttggcggcggcggtgaacttcgtaccttgtgccgtgccggcctccacccctcttttatatggcgcagtgtgacgggggcccaccagccattgggctgggcgccctcgatcagggcgcggtcaaggccccttgagccgttgggctcaaggggagggagatctatctaacattctcccccttgatctcactttttcttttagctttttctattccatcacagatttgtaaatagagcatgcttcatcgtcacggtcaatcaccgatggattcgacagccactatacacatctctattcagaaacagatactttacttttgggccctgtagtccaggattcataaggcttcccttaaacccatgccggctacatgttccttgaacacgttgggtggtaggccttttgtgagcggatccgcgagcatcctttctgttttaatgtgctcgagactgattgtttgatcccggactttgtccttcacaacatagtactttatgtcaatgtgtttggcagcaccacttgactgattgttgtgagcgtacattactgcgggttcgttgtcgcagtataacttcagtggtttctcaatactgtcaatcacctttaaaccgggtatgaacttctttagctagttcacctgccccgttgcctcatagcatgctataaactcagcatacatagtagaccctgcagtgatagtctgttttgagcttttccatgaaatagctcctcctgccagggtaaacacgtatcccgatgttgactttgtattatcttttgcaaagtcagaatctgaataccccactatctggagtgattctgatcttctgtaagacagcatgaggccttttgttccttgcaaataacgcaagactttctttaccaatttccagtgctctaggcctggattactttgaaatctgccaagtaacccggtaacaaatgccaagtcaggtcgtgtgcacacttgcgcatactgtaggcttcctacagctgacgcatatggctttgttttcatttcattgagctcatactgatttctgggacattgcgatgccccatacttttcgcctttcactataggagcaggtgtagcactgcatctgtacatgttgaatttcttcaacaccttttctatatatgtcttttgagaaagtcccaatgcatactttgttctatctcggtgaatctctatgcccaaaacatatgaagcttcaccgaggtctttcatgtcaaagtttgaggacaagaatttctttgtttcctgcagtagactgacatcactactagccagtagaatgtcatccacatacagaattaggaaaataaatctcccattcttaaactttgaataaatacagttgtcctcgacattctcttgaaacccaaatttctttattgtcccatcaaacttcaagtaccactgtctcgaagcttgctttaatccataaatggatctctttaaacggcatcccatattttcgtttcctttcatgacaaaacctttcggttgcaccatgtatactatttcctccaaatctccatttagaaatgccgtttttacatccatctgatgtaattccaaatcataatgtgccactagtgccattaaatcctgaaggaatctttacacaagagactggagaaaatgtctcattgtaatcaatcccttctcgttgcgtgaagccttttgccacaagtcgcgctttaaacttttctatattccctctggagtcatatttggttttgtagacccatttacagcctactgttttggctcttttaggaatttcttctaaatcccaaacattgtttagtttcattgatttcatttcatctttcatggcttccaaccattcagatgagcgagcgcttctcatggcctcttcatatgaggtgggatcatcctccatatgcgactcttctatattataaattttatagtcatcacggatagccgatcttctgactctttcagaccttctaggagcctgcatatttggcacatcctgtacctgaggctcttgttgagtctcctgtactggcacattatctatttgtggctgttgcagctcctcctctggtgtggcaaccatttctgttgaatcctgtataacaggttcctcactctcattgttgccacaggaggggtaacaacagatgctggtacctcaatgacaggcattgcaggcacaacatcagcaggtaaacaaaagaaaggttcctgagtcgatggagcgggtacagacaccgcctctcctcaagatcaatttctcaaactaccgagctccccctaatcatttcgtcttccaagaagacggcatgtctcatttctacaaactttgtataactgtttggacagtagaaacgatagccttttgatctttcaggatagccaataaaatggcagccgactgtcttgggatccaacttcccaatatttgggttaaatactttggcctctgcagaactcccccacacacggaggtgagctagcgagggtactcttcctgtccatagctcatacggtgttttgggcaccgatttgcttggaattctgttgagaatatgaatggtggtttttaacgcctccatccataaacccagtggtagtgtggagtagctcatcatgctgcgcaccatatccataagggtacggttacgccttttagctaccccattctgttgaggttcgcccggtgttgaatactgggctactattccattctctaacaagaaccttgcaaaaggtccagggacttgcccataaggtgtatgtcgaccatagtactcccccccacggtcagatcttactactttaatctttatatcatgctgattttcaacttcagctttgaatatcttaaatttatccaatgcttctgatcgctctttaattggataaatataacaatagcgggagtaatcatctgtgaatgttatgaacgagtcatagccatccacacttttcacaggaaatggaccacaaatatctgtatgaatgatctctaaaattcttgcgcttcgttttgcaccctttttgatgctctttacaaattttcctttaatgcattctatgcattgttctaagtctgagaactccaatggaggaagaatttcattcttaactagtctctcaattctccccctcgaaatatggcccaaacgacggtgccataatttcgatgagacatcgggagttcgctttcttttcttgttttcttttgtcaacgaggacacaacattcacattctcagaaagagataacaaataaaactcgtctcgcaacacagcaagaccaatacatgcattattatgccatagttcacatttgccacttccaaagcggcaatcatatccatcaaaatccaactttgatacacttattaagtttctttgcaaagaaggaacataaaagacatctcgaagtaaaagcatgaagccattcgcgagctctagaggaagatctccaacagcttcaactttttcttcaactccattggcgactctaatggagctttctcttctttgcgtagtcctcgtcgaacggaatgcctttaaacaattacaagcatgaatagttgctccagaatcaatccaccatgtggatctagagtaaccaacataataagattcatttacaaatgtaataatgttctcacctttccttgccatgatcattttcaaaaaatcaggacaatctttcttgtagtgtcctgtcttcttgcaatggagacactgatctttctcaacagcgaactgttgttgctgaggcagatgctgagattgtttagcttttgaggcgggagacttgtggttctttttcttatctttaacatagtttattgaaccaccatttgatcctttgattctctcctcctcttgcacacaattagcaatgagcttctcaaagttctatttctctggacttatgttgtagttgacaataaaattgtcaaactgctttggcaatgaggccataactagatggaccagaaagtcatctgttatgcctaaatccattggcttcaacttggaagccatgttgctcattctaagtatgtgatctctaacaccacctccatggtacctttctgtcacaagctgcttgatcagctgtgtagcatacgtctttgaagagccagtaaactgactctttattttttcaaggtactctgagacagcgtcacactctgggattgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgacaagttcagcaggttctataggacatggggtagtcaacacacaatccacctctcccaagataaaagcaaggtcaagttttcttttccattatgcgtagttatctccttttagcgtcggaatatctttaatacaaaccatcaaggagtagccacttgaaataatcatgtgcggtgagaacaaaattaacattaaaatattatgcattaagcctacatcaccgttgggcagaattagacataacacatataaccataactataatattgcattaacaacgttggttagaaaattacaacatcatagcacataattaatgttcctaaaattaaattctcccgttggttcgaaatttaattttagaaacactaattttcatcaattacatctatttgcagcggaaaactatgtaaaaatcatatgaacagtagcaaaatctatgtaattctctctctgtgaaaattctcccattggttcaaatttaaacagaggtaaaacatgcaaaatcaatttaaaattctaatgtaatttgcatgaaaattatacaaaataaaatggaaaaattgctactgttctcttttctttattttcggcccccgagggacctcttctgaact

SEQ ID NO: 67434 - DNA, 2000 bp, Oryza sativa
aggtaagattagggttcgtttgatccgtgcggatcttgtgcttttctttctttggatttctttccccgaaacgatctaaacactagggttgctctgataccattgttaaactttgcgctagaatcacccaggttagatctagtcgggtggttctatttggatttgatgtatgacattgtagatgaaagggagagggtttagataccgaccggttgaggagttcgtggaggaagaggcgtgtcacgccccgaactagtcccgaccggaactagcccgtgacgctccaaattaacctgttaatcgataccagtcccaggaaacagtgctggtatcacagggagacagagtatcacagcaacagaggtctctttattatagagtagaagtacagtcatgttgggctgcggacagatcccgagctcacaactgcattacaaaaggaaagcggaagcgaggacttggaccaatcatcacaggcgcgacttgggaactagggcgaaaccctaaaactcatcgtagccgacttgctcctggaagaactcctcgtcagcaggatccacttcatcttcttcagcaactgggggggttatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgcatcaatctttagaattgaaacaagattggcacccggccaacagcttttcaaacggccacccgggccaacaacttttcaaacggccacccgggcctagctgatcccgtcagctgctgatttttcaaacatcgaatccccttttcacaacagcaatttcacaagcagtagtcaaacaaaactacgctaggaatcacctcacatccgcccatgaccgtgggcacggctgttcgagcagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccagggatcctccccgacaccaccccggcgaatccacatgtctctcggcatcaaggctcccctgataagctagttactcagccaggggtgtcccattccacccatgtggtcgtacttgtcttatgtttggatgaaattccaagggaatcggtccttaagtgcgagagcgggaaaccgtacacctggtacgttccccggtccgcggttttggaaattcatttagttcgcaagcaccgacccaggtgtcgggttttccaagtcttttgtaaaactccagttttacccaagttgttactcagattttaagtttgaaggcgaccgtcgatactcgcacagagcgcacgaatatcgaggcgcaactggtccttgctcgtgccggctcctccgacacgcgcaacgacgatcggcgacggcgaaacagagggcggcaatggcgcggaggcgaaaatgagggagtttggagggggagggcttgggcttaaatggacggcaatgtcggtttgggagaggggaaccgacattggacggttaaggcgcgagctggcgctcggcgcttgcagccaaagcggcggcaggaggatgacgccggcgggggaaaaaggggaaaaaaaggagggggagaaaggggcttgcccttttgccgattcgggaaaaaggaggaggggagcgggggcgacgcggcagagggaggaggggcgctgcctccgtcccttggcggcttgcgcgcggaggggcgggggccgggcgatgacgacggcgatgacggcggggcgg

SEQ ID NO: 67435 - DNA, 9379 bp, Oryza sativa
cgagggaggcaaaatagacttttgcggagaaatttgattggaaggatttggattcggaattgaactcgacgatagatcagggattgagatcttgagatggcacggacactagacaacaagcaaagaaacaaatttcgcaattagggtttttaagagataattttcccgctaggcgccacgacggaacgggcgctacagaccaacccccctaacaagaatctcgaccccgagattcagcacctaagggagcaggtccgggaactcggcgcggagaagatcttctcgctcccaggttgcctcgtcttcggaatgattgctccattggactttgtagaacttgatggtcttccttcgagtctgacgttctgcctcttcaagaaccttgatcggtctttccttgtaggtcagattcttttccagctcgatattacccaggggaacttgctcttctggaactcaaagacatttctttaactgggatacgtggaacacgttgtgcacgtctgcgagaccttcaggtagctcaagctgataagccacttcgccacgtctggcggttatgaggtaggggccgatgtagcggggtgctaacttgccggacatcccaaaccttctcataccacggaggggtgatacccgcaggtacacatgatctccttcttcgaactcaaggtcacgcctccgattgtcagcgtaattcttctgacggttctgtgctgtcttcaaacgttctcgtatcagcttaacttgttcttctgctgacttgagtatgtcaggaccgaataccagtgctttgcccacctcattccagcacaagggggtgcggcactttcttccgaacattgcctcattcggcgacatctgaatgctggcctgataactgttgttgtatgagaactcggcatacggcaaacaacgatcccaagtgccttcgaaatccaaggcacacgcacgtagcatgtcttctaggatttggtttaccctttcggtctgaccatcggtctgcggatggtaggctgtactaaaattcagatcagttccgagggcttcatgcaactgcttccagaaccttgaggtgaactgagtgcctcggtctgacacaattttcttgggacagccaaatctacatacgacatgggtcatgtagagttctgctagtttctttccatcataggaggttttcactggcacgaaatgagctgatttcgtgagtcggtccacgattacccaaatggagtcgtacccgttgggggttcttggcaaaccggtgatgaaatccattccgatctcttcccatttccactcgggaatcggtaggggttgcagcagaccagctagcctctgatgttccgccttgactctttggcaaatgtcacacagggctacgtattctgcgacgtctcgcttcattctagcccaccagaagtatgccttgatatcttggtacatcttcgtacttcctgggtgaatggagtaggcggactcatgagcttcctttaggatgagatctcttaactccttcttggccggtacacagatgtgtggtccgcaccaaactgtgccttgatcgtctatggagaaatttgtgtctttcttctcctgtattctttttattaattcttttatcccttcgtcgtctttttgagcctcccggatttgcgactctagggtaggctgtactgtcaagctggcagggacacctgactgtaccacggtcagtcttaacttctccaattctctgcacaggtgatcttggtcaggccgtatttgagctacattgcaataggccttgcgacttagcgcatcagcgaccacgttggctttaccaggatgatagtggattccaagatcgtaatccttgattagttccaaccatcttctctgtctcatatttaactcggtctgggtgaagatatacttaagacttttgtgatcggtgtatacttcacatctgttcccgattaaatagtgcctccagatcttaagagcatgaaccacggctgccaactcgagatcatgggtgggataattggcttcatgaggcctgagctgcctggatgcataggccacaaccttttgttcttgcattaggacacatcctaagccttgtcttgatgcgtcacagaagatctcaaaatcttttcggatatctggcaaggtgagaactggggcagtggtcaaccttttcttcaattcttggaagctgtcttcacaggctgcagaccattgaaatttcttttccttctttaacagctcggtcataggtctggctagcttagagaatccttcaatgaatcttcgataatatccagctaagccaaggaagctgcggatctctgacacgttcttgggcgggttccaagcaagtacagcttcaaccttgctgggatctacttcgacaccgttggaggaaatcacgtgtccaagaaatgctactcggtccaaccagaattcgcatttcgagaatttagcgaatagttgatgatctctaagcttttccattatcagcctcaggtgttcagcatgttcttcctcgttcttggagtataccaggatgtcatcgatgaacaccacgacaaactggtctaggtattccatgaagattttgttcattaagttcatgaagaatgctggagcattggtgagtccgaaggacataactgtgaactcatatagaccataacgcgttgagaaagcggtcttcgggatatcttcagatctgattttcagttggtggtaacctgacctcaagtcaatttttgagaaaactcttgctcctttaagttgatcgaataaatcgtcaatccgtggcaacgggtacttgttctttatagttacttcattcagggctctatagtcgattaccattctctccgagccatcctttttcttaaccagaagcactggggctccccaaggggatgagctaggtcgcacataacctttactttccagttcttcgatttgtcttttaacttctgctaactcattagcggccattcggtagggtctttttgcaattggagctgtgcctggtgccagttctatggcgaactcgatctctcggtctggtggcattcttgttaattcttccggaaatacgtcgggatattcacagactatgggcaccgactccaaggaggtgacttgtaaacaggttaggatagaccgacttgcggtaggggtgttaggggtaaagcggacttgctttcctccaggtccttgcaaggtgatggacctttcggcacaatctatctgtcctttgtgcttagccaaccaatccatccctagaatgatgtccaagctttgcgagtctaggactatcggtttggctaggaagtcaacttcctcaattctaaggttaacttccaggcatatttgagttgcccttatattccttccaggggaatgtactatcattggtacacgcaaattttgggttttccaaccatttcttttcacaaaagcttgcgatatgaaagaatgggaagctcccgaatcgaacagaactattgcgggtacggagttgacagagaacatacccatcacaacgtctggagcatcctgagcggtttctgcttgaatgtgattcacacggcctcgaccaaagttgttggaagcacgtgaaccttgtccacttgcctgagagctaggacgagactgagctgccgctggagtaggagttctggcagtgctaccattagcatgccctgagttggtgttggtaggattctgaggacactgtctagcatagtgacccatctggttgcaccggaaacactgaactgctgacggtccctgcggtgacttgaaagaggtaacactgttaggcgcagtatcgctactaggggcacgctgctgtggctgaggtgccggacggtttatctgaggacgaggggcgtagcctggctggcggttagcctgggtgaccgactggtggtattgcatgggttgaccgtagcgagggcgaggtgcgcctcgggaagaatttccctgatggttagacttgcgtttcttgtattcttcggtagcctcttttctggcatcctcaagtagaagtgccttgttgatcatatgttgaaaagtggggaagtcatgagcaagcaactggagtctcattccaactgcgattcctgatcttcttcttatctgtgtctacttcctcaggggcgtaccgagccaacttgttgaactgacttaggtactcattgacactgctgttgccttgcttaagtctgttgaattcttctttcttcatgtcaatagtgctttcaggcacatgagctgcacggaaagccgtagcgaactcatcccaagcaatgttagtgggttcagggtgtgcattgcagtaattctcccatcaatctgcggcaggtcctcttagttggtgagaggcgtagagcgtcttctcaacaggtgtacactgcactaagttgagttttctatcaacatctttcaaccaatcgtcagcctcgacgggctcgacggtctgagagaactctggcggacgagacctcagaaagtctgccagcttggatctgttgttgcccatgtgagggtggccatttccatgcgcattatgctgaaaactggctatggctgtggttagtccttgcaagatttgtgtctgaactgccattaagtgttgcatgttggtttccacatgaggtggggaagggaggcgttcttctccagaattgtgactggcagtgcggtgagagcggtgagactgttccatctctgcatcacgggaaactgtgcgatgcgagcggctgctgcggcggggttgctcaacctctgcgttgcgggaaacagtacgatgcgaacggttgctgtggtgagactgctcattagctgattcatgattttcttctggctcaactctaccatccttaaaaccaaagcgggctggtgcacgagctgcacggcggggacggctagccatctaaactcccagaagagggcggggtaagagtcagataagcacttaggagggcaaggagcaaagcaaatagcaactcatatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctggccacgactccaaaagagttggcggcggaacaaaaaggcctatcacacggacggctgctgaagactgcctcctctactcctcgtcggcctggctgcctcctgtagtcggctcctcagtcgaagaaacgtcgatcggctgacgcgaagggactggcggaacctgtcgagggccggcagcagcacgggccgctggcggtgggggagctgggtagtggaaacggaacacggtggaagaaccaacaacacgcttccgcgcggtgcggataaagcgtgggccacggcgggaggaagcaactggggtgtgtccgggggtgtaggaagggctaactgggtgtgggtagggggagtacactggtgagtacggcgcacgcgagctgggggagcgcgggccactgggagtgcgggcagagccgcgggagctgtgggaggacaggtggctggcgtggcagaggcggcctgagtcccaagagatagtgtcaactgaggtgacaccctcctcggccagacgggcctccaaagcggcgtagcggcgggcaagggagcggtaagcctcaaggagtaggtcgtgctgagtggcctgagcctccgaaagctcgaccacgcgagtcagcactggctgagactcgctgtacggacaagggtacctggcgtctgagtggccagagggaaggcgtggaagctgccggaaggcggaacctccgagacggtggctgtagtcgtgggccaggcgacgaagcgcagtccaggagaggtcctggtacgcgatctggagagtgggcctggccacagtgaagtggtgggggcgaaggccagctccgtgtatacctccacgggggtaaaggtacaccgagagctcacagtgagggggaacacggtccacggagtaccccgtgtactcgggacacgagaagccaaggaaacgggagaggtcacgaagctgagcgacgtggtgaccctcaccaaaaccgtgggaactgaagctggcgttcactgccatttacaattttgaaagagggagaaagatcagtaaccgttttagaaacaaactattgaaaataaagaaaacaaaagaaaccttagcttttcgcaagtagttttgaacttagtatccttagggtcgtcctaagcgtcgggtttcgccctagggccaagcctgtgctctgataccatctcttgtcacgccccgaactagtcccgaccggaactagcccgtgacgctccaaattaacctgttaatcgataccagtcccaggaaacagtgctggtatcacagggagacagagtatcacagcaacagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactggggggggttatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgcatcaatctttagaattgaaacaagattggcacccggccaacagcttttcaaacggccacccgggccaacaacttttcaaacggccacccgggccaacaacttttcaaacggccacccgggcctagctgatcccgtcagctgctgatttttcaaacatcgaatccccttttcacaacagcaatttcacaagcagtagtcaaacaaaactacgctaggaatcacctcacatccgcccatgaccgtgggcacggctgttcgagcagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaagggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgttactcagattttaagtttgaaggcgaccgtcgatactcgcacagagcgcacgaatatcgaggcgcaactgggtggttacaaggggacatggtataacaattaaccaaggaatgatcaaatgtaacaaattaggtaggtctgccaatctgccttgcagacgggacaacagattaagtgtgatcctatcaatgcataatatttcgcaagcaatataattaaatttcaaatataggctcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctattaatgacctctaagcgcaccattagatagatctcgagatttgaggaattttggaagttgaacggagtcaatcggatttacggttgggaagatattgaatttctaagattattggatttttggtctaaaggaaaaaggatttatttaaatcctttttggaaaagaaaaagaaaagaagggagggagggaatatagacttttctcggacggctagggcgcggcccaagagaaatggagcggtctggccgagctaaatgggccggccggcccaaggcggcccaaactcgcgcgcgcgcgggagggaggagaaagagagccggtggaccgggctcaccacgcgcggtcccgggtgggacccgcttgtcagcggctcggctcaccgtgcggagggagcacgcgacgcacgcgcgcgggcggggaaggggcgcggtgcatgcgcgcggtccgcggtggacgcaggtgccgcggacccacgcgcagcctcaaggctcgcggtggaacgcgcgcacggggagggactgaccggggtcggctcgatccggtctaggctgagctggcgccgacgtggcgcctacgtggctgccacgcgggccggcgggaggtagacgacgacccggccgcgaatggacggcgggcggcggcggcgagcggcggagcgaaccacggtgatacgggcaaaagcgtgcacaccgggcggttgcacgtgacaaggggagacgagccaacggctcggattcgccggaggttgcttgacggcggcggattgtggcggcggcaaccggcggcgggagaagagggaaacggcgacgaggtcacgagaggtcgattcccggcgatgagagcatctacgcggcgtcgggaactcgacgctagcgtcggattggacggaactacgccgagcgaggccggcgacgagcgggtgctacggagctcgggcggcgacggcggcgagcacacggcgagcgacggcaacggtcggggcggcgccggctagctacggggaggctactcgtgctaccaccgaaaactaagggggggagatggagcgaggaggaagaacggagagaggcactaccgtgcggatcggggcgctgtgacgagaggccgacggcgcgggagtaatctctccggcctcgggccggggaagaggaaggagagggcgcggccggagtcctcttccacgtccttgctcgtgccggctcctccgacacgcgcaacgacgatcggcgacggcgaaacagagggcggcaatggcgcggaggcgaaaatgagggagtttggagggggagggcttgggcttaaatggacggcaatgtcggtttgggagaggggaaccgac

SEQ ID NO: 67436 - DNA, 1765 bp, Oryza sativa
actcacacttatcgatggtatttctgggacttagacacttgtcgatagtatttaatggattatctcgataataaaagatgaagaggaaagagctaatgtggtctttttcctggaagcacatcttcacatgcataatgcatttcatgatgtctttgccagtattttatcattttatgatgtggtcttcttcctggaagaagaacatgatcttggtttgattttttttaagataatggaatataacatcccagcctttactcaaaaagagctacagccaataggaatcggtttgatgagatgcagattttggccgagtttagttccaaactttttcttcaaactttcaatttttccattacatcaaaactttcctacacacacaaactttcaacttttccgtcacatctttccaatttcaaccaaacttctaattttggcgtgaaacacacccattattgaaaactgaaaacacgaggggagaagagcatcagccatcagcaattcaggtttcaggacatgccagaatcaggaccagcctcctgaacatgggtatctgctacatcactgctctggttagccaatccagaaaagtgctgttcccagactctgcaccctttttctgctactgccataattcgctcttctcgatgccacagtgggaaaacaaagcccagatgacggttatgaactcgctaccagacttgaggttctcggcatgagcttctattctggaactgggagcaatgtcacaatcaagtgagcccacacctcagctaggatctcccagcgacatgcctcatcctcctcgttgacgatgagtgcattggccattatagcaccttgttgcaatatgtttccactcagattcatgtcatgagcgtctggaacaagagctttctgcggttcttccataagcttgtcgtacacgctctgaaacgagttgcagcctttcagcatctcacgagcacactgaacagtgtcttggagggtcttcttggacaccaaaatgtcttcgggtagcagtttgcgctttgagaccagcaggtgcatacagtaacgtgacaagtaatatgtcaccgcgtatgacttgtcgagctcatcatcggtctcatccacctcagttgatggtaacatcgacatccattttaagcagcaaccagtaaaactgtcattggcaaacttgatctcgcataggcatgttgcaatgtgccagaccagaataacacgggagcatcttggtacatctgcaacggatgccaaccaataacgctcagctctcacactgagacgcggcgaggggaggtcttttgacagaggatggccctcgaggtccatggagcggagtgcttgaatgactcttgcctttacactttcatttggattccttcctttaataaaaggagtcatttcccacttaaacatggttgagcagaatccaaatgatcgcatgaacatggtgggacactgttgcagacacgaaatatcaaatcttttcaccaagttaagcatgtaatggaatctaaatagcatattcaggacaaatttcaggcatctgtttctgcaattcacaaacttgcacatggctagtaatcgtgtccagtttgattcgaagtaagtgagtacctcccacgtctccaagattatcacgctggtcaaggaatatgtggtgattctcgtttcatcaatatataagcgcagcccccgcttattaaagtctttgtaaaaagacagcggatccagatccagtgaatacaccttactgatg

SEQ ID NO: 67437 - DNA, 1632 bp, Oryza sativa
cacgcggagtccggctatggcgacggcgaggagaggagagacgagaagcggaggggaggaggtgagtacgatggagacgagagaagtcggtttggtagatagagtaaatgagaggaaatgagagagagaggaggaggatatataagagaggggtagtatagtaaaatacctccacgggcattttgggttaggggtacttgttgggccattagggatatcctccattgtagggggacagtggcggattcaccgcccggctagagcgggcagttgcccaggctcagcgtgtgatccattgagatccgagtgatttatgtgtgttgatttgctgcttttttggtaaagtgtcagttaatcacctcatctagtaatgtatttcaacgaaggagcttgattctagcaagatgggttcttgattcttgctggtgcatgcatacaagttcggtggatatcgtctatttgtgcatgcactttatgccagaaaaaatagttatgtgaattaagcagcattcaagcatcagtagaggagaccaggcatactaacagtccacttctataataatttttttgttattttaactgtacgttgaatatgtgtggcaacggtacgttttacttaggtttgcccgggcttcacaaaatttctagctccgccattgtagggggagtttatcagagagtaccctcagttagtgagggcacctatagagtgtccctgattatagatgccctaatatatgagaaacatatagccctcgattttcactgagactgcacgcagaatgttgttcactttgcttgtctatcagactgtccctgatcggccgcccgtgttttcattcaaatttctctttatcttagtttccaatcacccctcgtttgatgaggggcatgtagatcatcttcttttctgttaatttgtctttttaatgttaaaagtgttttttgttcggaaaagaaaaaaacaaatgtattttaggaattaggatggaggtagtagaggcattcttcaagttgtacacattagttggttaatggctcaatgctgcagccttgttttagcggtaagctacaaaataggctggtgaagtggtggatggaaggtgcaacacatttgaggaaaaacttgtgattactttggtcctgatatgatcaacttgctcgctctttttttaaaatcttttgactaatatgatatgatattgaagctaaacaagttggatgatcagcatttggagtggttgtctgcatcaataggcattacataattcatagtcccccatcaacttgctgctatagctatatatattctgaagtacacgctaccaaattcacactagactgattgaaggcatttatagtagtataatcatatgatctgaagactgaagtctcattgaatatagcctttggatccaagtcctttaacataatagtacatgctaactgcttgctgataataaaagatgaagagaatatgtgatcttcttcctggaagaagcacatctgcacatgcatatgcattatgcatttcatgatgtctttgccagtatttttgtaggttgcttgattgcaccaaactgagaccactcacgattgtggcttctccaaactgaaactgggctgcaggaa

SEQ ID NO: 67438 - DNA, 3102 bp, Oryza sativa
agacaaaatacttgtatccttccatagtatctgggttgcaacttccagggttaaagctgctctcattaccattggcacccatgtactcctgaagaagttttgaactccggccgttccacaaggacctggatgctacatgacgtgccagaatcctgtagaaacactttagtgccagaagactccaaaataaccagaatgggacatgccagaacttagacccatgtgttatattaaggtatgccacagctaaaagcttcaatgcatttctcagctcaaaatatgttccgtaactagagaggcaattgatgctagagcggaagctgaccagcataagggcccagactgggaagagctgattcttgaaaggtgcagcttgcatggccccaataacatacaccaggatggcatcagacaaagcatctagcaagctcaaaatggttcttttcgtagagaagaagaaaatgcccgacaagaagaacatcaccatgtagaggaatatgaggaatcccattataactcggattcgaagaaagacgtaggtctcctgattccatttgatgagaaaatatgcaataaaagcaccaggactcattttggttttcccacagaaaagcgtgtacaatcctgggccctgatcaaataaagtttacaaaagacaactttaaaaatagctaccagaaaacatggcaaatgtattgaagggtcatgctgataatgctatagtggaccatgtcaccatggcaacaagatttacattcttcatgaaagcatacttcacaggcccctgtatgggacaggatgggtggagagggtggtggtgctaacaactgatctgtatttgatactagtgaacttaaagctattattgattaatgaaatagatcacatatagtgagtgtttccacgagcttcccttaaaacatgaaattatttgtggaagactttatttgaaaatatttctttagaaaggctcatagaaacactttcttgctttctcgaatgatttttaactataaggaggtgaaagctaaaactgaaaaaaaatgaaaaaaagaaaaaagccataagcggcaccacatagaaagctacttcctccgtccaaaaatatagcaaccttgtactggatgggacacatcctagtacaacgaatctggacagacctccagtacaaggttgctatattttggaacggagggagtaggaagtaggaaggtgaaggcgtgaaattgatttttgtatgaggagttttgaagctttggacaaggtacttttagaggtgcacaagtaacatgtgcggcttctggcttgcgcacttcatgcactatatggtttgatccttttcttggtcagtactcaggaacagtaaaccataattaattggatggaatggacagcctagcaggctagcataagacacaatatatctatcattttctcaccaactagccaataagtagagtgaacgaagggtgtacctgcttcagcttgtgctccgcaaccttgctgccgtctgcagcaatgcttatcctattagggccttgttattgtttcatgacaattgtgtgtcagtttaaatgaagctggtaatggatgctctgcttttgacctgtaacaaactacgaccactaacttagtatggctcctcaccatgcagctactatttcaaatcagaattgtgattgcacaaatttagacggtgaaaactaaacatgtaatattttttatgcaatgcactacttgcggctagaagaaaaatcacagggcagggatgattcaaacatgcaatgcaaatacatcagaaactgagctaggatggcgaaaagcagctgattcttacccaggtgcaggattcagtagctgctcatgatggatggatctgcagcctgggaagatagagacaactctaggcaaaaccttcagccaagaagagcaccgagatctggaaactgggctgttgtcataggctgagttcctccttgacctcactcctaactcctaagatatagtgatcataaactaaggaccacatatcccgcggtcttgttaagtccttatttttaacacacttcctaaaatatggcatttacagtggcgcgcaatagataattctggcacttgctgtcttgctgtactcttcatttatggtaagtagtactgtagtaatacttcaacggtgttggcaaactacataaaagaaaatttgaactgtgtagtagctttcacatgtgcggacttgttcatccaactggattccccagaaaactgttgagtaaaaaaataagaaacaatcattgacttgcacaaaactactgatcccttaccgtgatttctcttaggaccttccatgatttgttcgtccatttatacaaccattcgataatcccatagcatttactcctactttcctatcacatgatttgacgagaaatgcaccgcgattaaaaaaaaagaggagatcggacggagctgcaaaaaaatttaccgtgagagaaacagagagctccatagacaacactgtagagccccatcggacgatgccgatgccatggccgaccaagaaagcatcccccaattgagcgccagccaccctcgccgccggccgcggccgctgtaccacctccgatgttgatccccccacccctaccgctgaaaccgccgccattcacctcctccgcacctccctccccgccggcgagcggcggcaacagcggaagcaaatgggagaccgaacggagggagagagagagagagagaagcagccgcggtgccactcggcccagtaagcgtcagcctccggtagggaggcaccggctgccggagcggctcgtcgatggcggctgacgaggaagacggtgccggagccatcaacttccgccgccgccgccgccgccgttcgctggaactgcgccgcctcgtgcctctaaccctctcttacacattgcggcccagtaaagctaatgaaatggacagcccatcagtaccactggatcggcccgcctccgccttctggcctacaggcccagatagaaacagacggtatcgggcccacacggcccgtacatctgggccttgactgcacacgctgacacgcaccaccactac

SEQ ID NO: 67439 - DNA, 2429 bp, Oryza sativa
tttggggatccctagttgataactggtgaatcgatgggctggagtaaataattgcctcatcaaaaatcagggctcaaatctctctgtattgttacatactctgtgctaagctccccaaaaatggcccatctcgaattaactattatcagggtcgttgtggcaattagctgggggaagggtaaaagggagaagtgaaccagacaagttcgatggatatccagagttagacccacttacatccctccctgtctgcatataattattggaattcttgaattagttggtagtgcagatcaaggtaatttcatatgccatgcaaatgtgatttttgcatgacatgtactgtggaatttattgacaaacttctatatttatcaaaaaaaaaacttcttaaaatagaaaaccaaccatcgagacagatagacaaataagtcaaacaacagtttgctacatgacataaaagattaattacaaaaccaggatacaatcaaactctgcagattaagcataaacaagataaacagaccaggattgagcttacatctgcatagctgcatatgctgaacctcagctaaaagtagctaacatgatagaaaaaatagaaatatgtcttctttccaaaacaaaatatagaaatatgcatgccaccaaacgatttgatttatctgtgtgattcgtggcagttacttatttgaacggaccatcagtcagtcaacttcatctgacccatatagacattctgacttattcattgactcaatctcaggccacacctcaatttccaagcttggacgacgtttcctttcactattgctgcatctcaggcccagtgaaaccatctttacagcatcctgtatagacgtgtcatccaacttcaattgagcatccaagatttgaagtttctccaagatcatcttttgcttgcgtgtgtccattttttccaattttttaccttccaatttatcaacgatgtgctttcttaggcccgttgcactttggcctgtgactagctgcagcagaatgatacccaacgcgaatacatctgactgaggagtcaatttgcctgtattcttgaattcagggtccatatagggaccgctaccctttggcacttctgtaatatggttaggcgttcctgtgtcgtttgtctgctgtaacaaacgggagattccaaagtcactgagcttgcatatgttttcatcatcgaagaggatgttgcctggtttaagatcaccatgagcaattggattaggcttggcgttgtggagaaatacaagagcagtgcagatgctagttgccactcttactctttcttcccatgagaatgattccctttgtttctcattaataaggcgatcttcaagggtgccattaggtaaaagctcatacatgagtgcgaatttctcactgcatgctcctctgagagtgatcaggttttgatgccttattcttttgagtatcgcaatctgaattttcagaatttttttttttggtgcaagaagagcaatagtaagaatacatgttaggtttatctgtcagacaaatattaggtttgctaaaaggtaatgcaagaagtttaatggtgctagaacttgcttgaaagggtgatgtgaactgcacattctacagaatagctttatctgtcggataaatattaggtttgctaaaaagttaatgcaagaagtttaatggtgctagaacttgctggaaagggtgaagccgggaagaaaaggtgaactgcacaatctacagaataaattgttgtggctgtcgttttattgatctattggtgcagaactgcaggtagtgtccacctctattggagtgatcgtttcagtaagtaaagtacactatttaatcaatattttgagcataaatatcgcaaatgaacagtacttgctgatgatactgtagcagcagcctcacactgagaataccctcttcagagttcagaatatttcctaaatagtgtgatttgttttctagtataagaattagttgtttgactatttcttttttttttttggtttgatcttacccatatttggtaggagaaccctttatgctatgaggctagtgctattacaatgaagcaagaataatgaatcaaagaagtccccatgatctctttctcccctccccttccagttgacaaaatagttatccacgtaatgatagaattatttacaatttatttaattggttactcacctcttgcttgaactcccgttctccttgccggctactctcattgagaatcttcatagcaacagtctcgttccgaagttttgccttgtagacgatgccataaccacctctcccgagacaatgattttggtcctttgggactgaatcatctacctctgagggattgaactcaatgaagctaaccccactactggagtttgaagctttggggctgcaggaat

SEQ ID NO: 67440 - DNA, 1566 bp, Oryza sativa
agctccttagatgtagtagaaatctttaataagttaagaactgctccagatgtgtacttcaagaatatcaaagaggctaggaatatgggagcaagcatggcattggctatgaccaagtctctgtaccccaaaattgatgttgacgccattgacggctttgcagcaaggacaagtgaagaagatgcactttatctgattaatgatgcctagaaaactgcggagaaaattgctgtagatgtgctggataggtttcagagtactagccttagtcctgctgcgtgaattgcgagactgtagacggtgagccacgattcggggtttgtctttccatcatacttctcgataccagtcggtttaaagccggccggccaatccactcgacgcaggttgcttgtgacagctgccactccatcttcatcatcgtcgtagcggtccggtgtacggtgtcatcgattgcctctttctgctcggcggtgattgattgtgtcacgtaggtcgacgggctgtcggtgacgtggcgatcgaggctgttcagcgcggcgctctctgttcatgcgttcttcatgatccctgccctcgcgattagatcttgatcccgctatgctaaggctcggttggtgataatcttgagatcggagaggtggaactcagctgccagttggcgtccggatgctctccgagttgacaggaactgacgctgcaatcattgtctttgtctggttgattatgttaagaacatggttgggtggatcttctatgaggaggatatccaagagtgtgatcgtcgcaactgcgttttgttgtggagtgcgaaaaactgacgtggcttcaacatcttgctgtccaattagatctcgtgctcgacgtcctgatgccaaggcgcactgtcgtcgctcctcaacttcccatgccaatcgctcgcgctcctactgctcacgctgcagtcgggcttgctcttgggcttgtcgctcttgctccagccgaaggcgctcggcttcctgtcgtgcacgctgctcagcagcttctcgttatcggccataaaaacaccgaaaaagagaggagtgtagttgtcttcatagtcttcatcaaggtcgtcaaaatcgtcgaggttgttgaagtcatagtagtagccgaagtcgtcgtagtcgaggatctcggtgggttgacgagagtcgacaccgagagagctaaggtagccatctaattcttccgtggaaactatcctaagtggttgaagtatcacgccgacttccctagagccagattgaattgaggtcgaggccggattcaatctggacctatggggagaagacgctcttgtagtaaagacagcagccaaatcgtcgggcagcttcattaggatcgatggataagtcgccttgtcttgatctggttgtgaagaagtagatgagatctcgtccgagtggtttgaatccaactcggacaagatagtcttggagtagatctcggccgagtccaggaggccgaacggggcggagatggcatctactcccgactagtttaaatccaagtcgagaagagaaatcttgccgaagttgtcggtga

SEQ ID NO: 67441 - DNA, 6984 bp, Oryza sativa
gcagtatggcacacttttataagtctagtgaacggaatctgcattttgcaagtttgtcgacctagacgactcatgcttatacttacaaatttaaagactgctagtttattttgctctacggaaaacataaatttagtgaagcaaccaaaatatataaaatttgtttttcgaagcttacattgcccaatagtacttgcaactttgctcttggctgaataacccaatgacatgcactgccgcattttgtctgggtccattccaccaccatcatctatataaaacaatataacaagaaaaagaattataagtatttgagaaattctaccactgtggttccatttataaggtaagatctaaaagttccatcatagtttcataaacatgctgcactatctgatagcacttaaatgtgttaaccactccagaggcctcagtaaaagacctataatatttctgaggttgtccaaccttaaaccaatcttccattttgctttgtgcatccctaaactcctaaattttctttatgccaaattgaatctgtacatcaattaattgcgtataacataaaacagggacaagcttaaaagatcttgaatattccatgtaccacatcatgttaatactataagtcaagtcgaaacctatcaggttccagagtgaaatatatgttcactacttcacttagtttgctataacagatagaaaggggcatgttttatgttgttaatttgctatggacacagaagtttcttgtcatcaaagaaacttttgataatataaacagaaatagaggtaccaattcaagtcactataaaaaatgaattttaccaaagatttttgccaacaattaaaggtaaaaggtaaaaaggttgtgcaccttcaacaaggagcattcttgttttgtctttattattctccaacatatcaatgttcacataggtagctccatttatgaccttcggagaaaacagagctcagtaaacatacaaggattcaatgctacaaactagtgcacttaatatttcacaatacttacttcatcaagagagttatccagcagctcagccaatgctgtaacgtggataaaaatatgttagccaactggtgtgaccaaacattgattgagttgtgtgagcaaataacatggcaccgttgttgtgtctgctatagcattcatgggaagaaatggtagtgcaaaggtaaaatgaagatgaagaccataccccccagagcccacttgtggcttgttgcatttgagtgcaaaaatttaggatgtacacgaacatgatccaatccggatactgaaaagagaaagtgaatgtgaaattagaatacagaaagaaaatcacagatacttgtgtatctaatccagaccgattaagaaagaaatattacacacatacagacttccataaagaacatgtctgttgacaaattcgttgtatgagtgaaaaagagaacttccaatggaagagacggaaatacatcttcctaaatctctaccacttcatttagtttcattcctattcaacattgtacaaaggcacaaccctacttacattggcagctattttcctaaaaagtgtaatcaggtctaaaacataaaataaatagaaagaagggactaaaacaactaagggcatgtacaaagatatgtacaaagatagagtcaggtatgagctctacgctatctagagactagcatcctacaatagttggagacaatatggtctctaatcattaatgtatcgaaatattttttcttactattctttcctttctttcaccaccattcaacaaaatctgctctaataaatgctaaaatctgctctaataaatgctaagagtcgactctgagaagttgtcatgcataacaaccatatttctctttcctcctttctctttcttccatgtcatcaaatttacttgcattgcaatagagagagaccactaataaagaccattgtacatgccctaacaagcacccaagtccaagtggcacccattcctaacatataacctttcttgtttgttcatatcaatgttccaatcctcaagctctgcagttcacaggtgaagtattaactattttactctatctccagaaactccccccattgaatgctactagtcacattttcagtgctgcaaaaccttaaatgccgcatggcatgaatcgtctaaggaaagaaccaaaacatctcaactccatcaaatgacaacgagcatagagatattaaaacgatatttatgatatgacaacaagaacaggattacagaagggttacgcgaccagaaaaaaaaaataaggttacctgacgactgcggcgctccatccccaagcggcttcccgtcgtagtccccggccttccagaactgcttcgtcgcgctcttcgacggccccgccgatgcctccgcccccgccgccgccgacgccgcatgtggtagaggatcaaggaaacccgggggcagatccacggccacgcccgccgcggaaaccctagcgcgcttccccgccgatccacccgccctcacaccccgcgacctcttcgcgctgccgtccccgacgcccttcccggcggaatttgagtcgctgctactcagctcgatgaaatcctcctcgacggggcgcccccttctgccgccgccgccggcggccgccatcgccaacggcggcggccgctccaccgccgcagccgccgccgcctcggttttcaccgcccgaggattcctgcgcgaaatcgagaaattccggggatcaatctgtaaaatccaaccctatttttctcttctactatctgcgaaatatttccttatctcgccgagggatcaccttatatatagcctcggcaaaatgcccacgagagctttcctaaccggcatgtactcagacccaatgacatgtgggcccacgtaacccctgctcccacttgggcccacctgtcagtgggtagagggtagccgtgtggggagaggggctttgagggcggttattacggggagctggaaattttttcggttgcctttctttgggctctcgagcgcgtcgctcggcctttttccgcgtgtaacgcctgtgggcccggcgtgtcatagagacatcatctgaggtggatcgaggacggacgcgtgtgacagttcattagtgtatgccagtgtggcacgtactcctagcttgggtggactggtgttgccatgtggcgtgcacactaggagcagtaggagcgccactttgcagttgcatgacacgtggctcccatgcacatggatcacacaagtagcaataaatatgctacaactacaaaacaactactcaatcattattactccctccatcgcattaaagcatatacaataatactccctccattctataatataaggcacaaccacttttcttaaatattccataatataaggcatgcatgcaagcatgcaattaactatgacatcttcttcattaaattattaattttttaaattctctactctcatgttatctaatcctattggatgcttgcatatttattaggatgatccaaactacaagatgataataattatttcttggtctttgagtcgagggtggctgtgccttatattttggaatggagagagtaggtggtaagagatccacgtaggattttttttactgagctggatgagagaggggaggagagagaacaagagggcgactaatcagtcacccggctcgaggttgtagggcccgtagcgatgggcgatgagaaggaataagcgctagtcgtcctcttcctccacggctgtcgctgtcacccgcgttcatctcgtcgtcctcactcgcatccgctgcagccgccatcctcgtcctccacggcggccgccgtcgcccacatccgtcttgtcgtccacgttccccatagcattccccactgcccgtgtttgaccatttggcttatcctacagtcgagatggctctgataccaacttgtcacgcccagaaattcactaataatttccgaactaatttgtgcattaaatcctcgtccaggaatcagccgaggtacacaaactgacaatttaatatacagattcatcaatataataacgttacatacattcaaaagaaaagaaaacttcagcggaattacggtctagcgaagctccggctccactcccacaggcagctcaactggggtataagccaaacgtcttctccttcgcaacttgtcttcaactgaggtttgattgattattgcaaggtgagcatatgacatactcagcaagccacacagcaaatatgcaagtgcacaaggataccaaaggatggcataatatagggctcatttgcaaaagcagcacatagcaaacatttaaaagtagtaaaacagtagagtaattaatcatcaatattaatcaatcactgaacagcacatccatgctgcacaagctcaaccatcctgaacaaccatacccggctgtacagatctatctccaaaccaggaatgtaccattccaaaccaggagctaatcaaattatttccagttatagcatcatttattatggtgagaagtgtgagactaatcatgaaagacattgttagacccgcccataaccgcgggcacggctattcgaatagttttatctggtcagagatgtaccactgtacccacaagacacaactccacaatatgtcaccatatcatcatgtgcccatgctgaacatgtcaccatttgtgtagttgtgacaagaccccttgcataactcaacccaaagcagtgcaccgttcctggatcgtagtcaccccctcaaaaccagaggcatggactccctagcgacccccgtgggcttatctccgccacttctcagtctggtgctccacaatgagccttgctatacaaagtgtccagccgttgctcattctggcttgtggttggcacgattaatgtttcacaaccgaaactcgtgaactggtccttaattgtcatgagcacgaccatcaaaaccatatgctcacaacccaccattatcaagttttagtaggcacattaattaattaaccaatcacgatagaccatcgtgagctttcattaaatatccatcattaagtaatagtgaaacattagttatcccaattgtgtgctaatgtttctaagcatggctaagcaattatgtctaacatctagctgaaccaatatataaagctcaactagtcaaattataatagccaaggtatcaaggaatagagtaatcgatgcaaacaggcaataacaaaggaataagttcacaccacccagtgacattcgaaaataaatgcacagttgaaataaatagagaatttaaatataggatcaacatgctcaaaggaattgtgtttgggatctgtgtgacttgccttgcaatattaggtcttcaattaatcttcttgaatacttccgatgcacttacgatccttcgaaacgacggaaacgccaagctaacacgtaaaacgaggaaaaagactagtaaaaaccaaataaacagcacatgtagagtaaacaaacatgtagatcatgattttagatgaatttagagacttgaacgtcctcattccgatttcatatgaattaattacgaattttacaagatttaattccaattaaacctattaaagaaaaagactattccacattaattaaaccgtttacaaatgatttataactgagagaaaagattaaagcaaagtacagaaaagattagattatattggtagatgacatatgataaaaagaaccaatatgccattggaaagagaggaaaggatttatattgattttgggtggttgagattaatctcgaccaagagttgaccaagatcggatggcttagattgatctggtaagcgggcctcacgagataccgactcaacgagtcaattctacgtgacacgggatcacccaaataatcaaccgaaaccggcgaacggaaccggcggctctgaactaaaggacgactcaacacggacgaacgaacgaagcacggggaacatctcattcgaacgaatgagcgaacgactcaacaatggctgtgactaaaccagtgagctagacacgattcacggtaaagccccggtacggcaaagataggccggtaggaacctagggatgcacctacggctagacaacttggctaccgagcaacggctaaaacggcggctagattaaagcggcacacggctgcgacacggcggcactagggcgacttggctcggctaggtggcggcggctcggcggagacacgcggctagggttagggtgacggcacagccgatagcgatgcacgacagcggcgcggcgactgcagtacgtgcactagggcagcggctacgcggcggctagcagcggacaacagcgggtgcggtgcatagcaatgaccggctcgacgctagggcggcgacgcagcggtagcaagcggctgtggcaaagcgacggcaacgctgcacggcgtgcaggcgcagcagtggtgacgcagcaaaggcgacgcagcagcagcggcaacagcaagcgacacggccgacgtggcagcatgcagcagtgacacggcacgcggtatagcagcagcttggcagagccagcgcagcaagcagcggcgtgatggcagcaagcgacggcgcaaggcggcggcttggacagcagcggcgatgcaactagggcagcgatggcgcatgggtcgactgcggtggctaggcacacacggctacgcacgggctaaggctgcacaacagcgactacacgaagacacgattgcagctacacaaagattaaacctaaggaacggaaaggaggcctcaccggggaagaccgaagaggaagaggcaacggcgacgccagcgacaacacacggagatgacgacgacgctagggccaaacaagattagattaaattaaggccctagggaaaaacctacgccggtgaacggcatgggagcggcggttgccggcgaaccacggcacaaatatgcaaa

SEQ ID NO: 67442 - DNA, 1544 bp, Oryza sativa
ctaaccacatttattgcggtttggacgagcgcgtcacgccgcatgtagcgcagtgcagcgcgctcgtttatccggtctgtgactggtcacagaccgatcagatcgtgggttaggtggcgacaggcggtctgacgcacgcctcgccccatcccgtcaggatgagagcctccgagcactcgtccctagccgaagccggcgtgttagctcctggagatggcacgttggtcccggtcagatatatgccaggcttcatcccaaccattacaagcaagatattgtatgaagaagggcgaacatgcagattgctagactgacacgtggtggacaagaatgaccgatttgtgaccggtctgacactggtcatgtcgtcggcagacaaccatgttcccacgttgcacctgcttccggcggagtggaggtaggtatgggtcatcccatcagaaggtcattcggacagcagccattgcaagtctccgcccatttatgaagagatgacagggtgatccccgaggtcagacgagtgaggacgcgtggccacactcaaaaacaagcagtgtttttagctttctagagaaggcaagccaagtttgagtaaagataggataaagtccccaccaaaaagagagataggtagaggtggtgcatgtggtatccccttgagatataaaaggaggaccttgcccactaggaaaggggggaggatctgaggagaagatcccacgagaggaaaaaagggagaagagggtttctagagtaagagctctctggctctccagctctttgtagcttcttcagacacagatccaccagaacacaggagtagggtattacgcttctcagcggcccgaacctgtatacatcgcccgtgtcttgtgctttttccattgtcgcgaaccttccacagactaggagcttagaacctcaccctgagcccccggccgaaccggcaaaggggggcctgcgcggtctcccggtgaggagccccacgctccgtcaccaaggtaatcaagaaatagggtaatcaatgcaaactagccataacaaaggaataggttcacaccacccggtgacattcaaaaataaatgcacagttgaaataaatagagaatttaaatataggatcaacatgctcaaaggaattgtgtttgggatctgtgtgacttgccttgcaataacaggtcttcaattaatcttcttgaatacttccgatgcacttacgatccttcgaaacgacggaaacgccaagctaacacgtaaaacgaggaaaaagactagtaaaaaccaaataaacagcacatgtagagtaaacaaacatgtagatcatgattttagatgaatttagagacttgaacgtcctcattccgatttcatatgaattaattacgaattttacaagatttaattccaattaaacctattaaagaaaaagactattccacattaattaaaccgtttacaaatgatttataactgagagaaaagattaaagcaaagtacagaaaagattagattatattggtagatgacatatgataaaaagaacc

SEQ ID NO: 67443 - DNA, 7764 bp, Oryza sativa
ggggaagtggaggccggtcttcttctcctcctcgcgaacccaacggcggcagcggcgaccgaaggcgacgaccacagcgactgcgcggggctgctggagcggcggccggaggtagagagagaaggagctcgcggggagagcgtttccggcgacggcagcggacgggacttgaggggatgggtagaggacgactagggggtcctttatataggcacgggagctcggttccgggcccaaatcgacggcaaaaactcgggaaagtctagtgctctcgccggagtaaggaaatattaaaccgcgaaattggaaaggatttccatagaaacttttggggatttcttggggaaaaggaagaggagattgagaggattccattcccgcaactaattttgaaataggagcaacgggaaagccggatttgggaggagaggcggcggcaactgtgcacgagcacggctggctcgggctctgactgctcaggaagatgaacagtagcgcagggagaatatttagactttttgctgggcctcaaaaacacagcctaaggaggaatgcaaattggacttcgggaaagagaggcagagggctgcaggccgaaaagaaggaagaatgggccgagaattaaaggtgaacttttcctgtttcggcccgaaaaggaaaaggggattttaattacttttcccaattaaattaatcactgaaatgatctttgaattgttaaaaatacttccaatgctcaaataatttcaagaaaaatcatgaaaatacttggacacccaaagtacttaacaagattataataagaccatttaatgattaatttaatatgtggataattactgaaatgttctttgtattattaaaattaagaattgagctccgaaaaatccgagaaaatttcagagagtataattaatcatggagaatttaataaaaattaaatccagccatgctttaaattaatgaaattttatttcccacatttaacttcacttgtaaattaatgaacagttaatataaattcgattaataatttattaaataatttataaatcctgaaacgaaattcaggctgtgacagtttcccaattatacagtatgctgatgataccttgatccttttgaaagcttctcggtttgagcttttttctttaaggctctcctgaattcttttggtcagtccactggcctaaaagtgaactatcacaaattaagtctctatcccatcaatgtagctgaagataaggtagagttaattgctggactacttggttgcaaggttggatctatgccattcaattatttgggtttacctatggggacaaccatacctaaggtaattcattttgctcctttagtggatagagttgagagaaggctaacaataagctcagcctttttaccccagggtggtaggctgacacttatcaactatgttctttctataatcctcacatactatatgtgttctcttgaactgtctttaactgtcatcaaagccattgatacagcaagaaagaacggtttgtagagaggaaataacccaaattccaccagaaaatatttagcttcctgggagctagtgtgcaggctaaaggacaagggtggtttaggggtgataaatctaagaaaccagaatgttgttcttttattgaaacacttagataagttctatagaaatgttgatcttccttgggtggatctcatatggaaatcttattgcacttcaaagtctcttcacttagtttcaaatagaggctccttttggtggaaaaatattgtttccctggtagatgtttttagagggatgctcattgcacagtgcaaacaggaacctcactgctcttttggggatctgtgtaatggggaactaagtttcctaatcttttttgggcagcttataacaaagatgaatttgttaagatggcttgctccaagcctttggaagatgctttatgctaccaatgaatgctgaagcttatggggaatttttagttttgcaatctgaacttgacaatgtccatttaagtgaggggttgggtgatcattggagctatatttggaatgttgataagtattctgctcaaagattttaaaaaatgaattattcatgcttacagcctccaaggccgcttgtttggatctggaagacaaagcgtgtgatgaaaatcaaagtgtttgcttggctcctctctttagacagaattaatacaagggacatggtggattgcaggcactatgctaaggaaaatgatgatctcacctgtgttctttgctctgggggtataagagagataaggctacatctcttctttacctacccttttagtctccgatgttgacagtatttgggttttgattggtctccttatttaaatttcttccagatgattgttctagtgagaattcgttttggtacgaaggtttcctggagatcttctttacaactcctggtatatttggaagcaaagaaatggcttgatttttcataatgtacctccaacttttcatggatggaaagttcagttcaggaaagagcttcttctacatatgtgtagaatgaaggagcctctcaagcaattagtttttgattagttacaaattttgtaattattttgtgggtttctgtttttcctagtaagatgtaaatatttctttttatacaagctatactggtaggcaaatgcctggcagtaatttgtcaaaaaaaaatgaactttgtatttatcgtattatgttgttaatctagtatttaagtatcaaatgcaaattgcagttggggtgtcaaggatatgtgtgttagtgtgtgtattagtgtgctaaggacattttagtcttttcccatatctttgtatacaatatattcccctctagggcaaaatcaatggatcaacgatttatccccaaatccccaaaattataacatctgacatgtgaaccgtatgcacctacacttatccgctactacggtctgttaatattcaggcacaacacaacttacacgatatacaaaatgcatcaagaaaatcatcgtaagatcgattattattatgcatcaagaaaatcatcgtaagatcgattattattattaactgtttatagttaacaacagctactacgatcctctccatttctaccagcattcgaagattcacactctttgcaagccaaaaggccatgacccaaccaaacctcacctacaccccactagtcatggtaacacacaagaaccgtgtcatcctcgccacgaccaccaccaccaccatgtcgtcgccttcctctcgccacccctcgtcaccacgctctctacaaatgccagagctccggccacccccaccaccacccaagaagcctgcgccgccgaccggcatcgcgacatgggcgacgccgcggtacccgccatggtggtggaggaggaggaacaggagcacgtgttccggagcaggttcccgccggtggccgtgccggacggcgtcaccgtgccggagttcgtgctggacggcgccgaggcctacgccgacagggtggcgctcgtggaggccgcggcgggcgggcggtcgtacacgtacggcgaggtggcgcgcgacacggcgcggttcgccagggcgctccggtcggtgggcgtccggaaggggcacgtcgtcgtcgtcgcgctcccaaacctcgccgtgtaccccgtcgtgtcgctcgggatcatgtcggcgggggccgtgttctccggcgtgaacccgcgcgcgctcgccgcggagatcaagaagcaggtggaggactccgaggcgaagctggtcgttgccaacgaggtcgcgttcgacaaggtgaaggacgccggcgtgccggtgatcggcgtcggcgacagggagcggatgcctggggcgatcagctgggacgggctcctcgccgcggcggaccgcaccggcgccggggtggtgccggtggacgcggcgcagcagtccgacctgtgcgcgctcccctactcctccggcaccaccggcgtgtccaagggcgtgatgctgagccaccgcaacctggtgtccaacctctgctcgtccatgttcgccgtggcgccggagacggccgggcaggtggtgacgctggggctcatgccgttcttccacatctacggcatcaccggcatctgctgcgccacgctccggcacaagggcacggtggtggtgatggaccgcttcgacctccgcacgttcctccgtgcgctcgtcgaccaccgcgtcatgttcgcgccgctggttccccccgtgatgctcgccatggtcaagagccccgtcgccgacgagttcgacctctccgacctcgccctcaagtccgtcatgaccgccgccgcgccgctcgcccccgacctcctcgccgcgttccagcgcaagttccccggcgtgcaggtggaggaagcctacggcctcaccgagcacagctgcatcaccctcacgcacgccgccggcgacggccacggccacgtcgccaagaagagctcggtggggttcatcctgccgaacctggaggtgaagttcgtggacccggacaccgggaggtcgctgccggcgaacacgccgggggagctgtgcgtgcggagccagagcgtgatgcaggggtactacaagaggaaggaggagacggagcgcacggtggacggcaaggggtggctgcacaccggcgacgttgggtacatcgacggcgacggcgacgtgttcatcgtggacaggatcaaggagctgatcaagtacaaggggtttcaggtcgcccccgccgagctcgaggccgtcctcctctcccacccctccgttgaggacgccgccgtcttcgggtaacacccttcttcttcttcttctctgaccgtcgaaacttcaagagttgattctggagtaaagttatggagcaatcaaaaccaagctttatatttctagtttattttgtgagatcatttcagccagcttcattctaattttgtatggagtttaaactttttagttggattttaattttaaaaagatggaattgtagatggagcttttgccatgtcctaaagccatgcatgcatggatatgcagggtgccggacgaggaggccggcgaggtgccggtggcgtgcgtggtgcggcggcacggtgcggaggagggggaggaggagatagtggcgtacgtggcggagagggtggcgtcgtacaagcgggtccgggtgctgcacatcgtcgacgccatccccaagtcggtgtccgggaagatcctgaggaggcagcttagggacgagttcatcaagaggatgaaaccgtcagcttgattaattaacagacataaatcattgtgattgatatcaagaaccgaaagcatgcaaggtgttaaattgcataaaaatggagttggataagtgtttcatcatcaccgagtatatgtacgtacatgttagtgattatcgtgtgaaattaccatggaaatgaattctaagtctttaatttaagtacatttatcttcgtttcttttttacaaatagccatgcttatttttttttaaaaaaaactaggaagatagtccgcgcatatgcgcgagcatcttatttaatattgtttgaatttttattatggaagcttatatgtgggtgattttttctttaaatattctgactctattctaaatctatttccgtcgataatttatttaagattgcttatgatttttttctaattacccttgcaacgtataaatcacttttattaggtcaattcttacgataaagtatattttcattacatggattctcatatatatataagtttaacatggtatgcttctcctagttaaccgaatttatagtggaatatccatgtaccaattatatttaatactggatggataccccacgtattgctgcggaatttttatatccttcggagcattcccctattgtcatgcataaagcaatattcctcattcgagtataaaaagataacatgaaaaattatatgaaaaattataggaaccaaaaactgaaaacaaataaccaagtatctgtaattctgagctggaattgcatagcatgaaaaaaaattatgcgaggttaacgtcaagaagattaaatataacacgtaatatgggacaaaataaaatggattactcttgaagtataaaattggatgcaaaagcatatacctaacaaaaaaaactaataaatttaatttggcattcagtttagagggttaaaaatgtacgatgcaaaatatttttcagcatgaggtcccaacgaactgaaatatgagcgggtgactgataactcgtacttcagatccacatgattgttttttcctcatagtccatcttaatacccatttgcagctaagtgtagagtattgaatgggagattctgatattccagagaaaaatataaaccatcagtgcacggtaatatgagaaaacaaaagtacaaactgacatgaagatgccacattaacggtaatatgagcaaacaaaagtacaaactgacacggagatgccgcaggaatttagagaggaatgggagggagaagagatcaagtaattacatgtgcttgtcggagtgattaaataattacacaatgatgttttaaccttttttattctagtaggattggaccatgacccttatagcagattttaccaatagtcgacgaatggatggaactatttatatacatgaggaggctatgcagcatgaacaccgatgaaatgatgagggaaccgttggtttttaggcgatatgggaggtgattggacgaatcgatcgataaacgtgcagacggacacgtgcgcaatattgaagtgaacttttacgtggtgtcgcatggcatccatcagggatggcaaaccgatcatatgggttgggccagttggctatgccctatgctgggctaggattaaatatcaatcgacatggatgaacagtcagatgagaagcaaagaagcggatagataaaaatcgaacagctatgctgctattagtaatgatgtggctcactctcaagatagcaaattagtattaattatactaagtgcgatcaattatatagttatactaaaaaatcggcatgcttagtcagcctatatatacttattatcactaaaaaatattacatggtaaaattggtgtgctcactaatatttaaaatatgtatatacttcattttcttatttgaatttttagagttttcataaaatattttaaaaagaaaattgtgaaccactcttttagttttaacaaatgaatatatgatattaaaaacatttatggacgtatatataaatgatttatttattatgtataagtgaaaaacatatgtgtcataaaaaatatagaactttatatcatgtcaaccaaaagtataaaatttaatgtgtcattttatacataaattttgatgaaatccaaaaaatttaatgtgtcattttatacataaattttgataaaatccaaacaagtaaagttatttttaagatttatcaaaattaattggttaaaatatatgatttgaatatttgaaagatcaattatttagtatattcagagttataggagtagtaccgagtaggcgtagtatatttaaagaaggaaaatgaatgtaaattcgttgttttagatttgtttttttcttaataatgttgggtttactatatattctagagttataggagtagtaccgagtgtggtatatttatagaaggcaaagaagtaaaagtttttgtgattgaaaaagggagatagttttggaagcctctggaatccata

SEQ ID NO: 67444 - DNA, 1302 bp, Oryza sativa
ctagcaaaagagccagataggataaatcaaaaagggaaaatacatgcatgaagtatactaactccaatcttttagtacttattatttagggtattgatacaaggggttaactggatacataccattacaacttttataattttgtgatatgtcattactattcacctgtatcaagtcataccattacaatttcaccattatttgacatatgcaatacttacccgttgaacttattttctaaattttttttaccaaattaccccttctcctcttcatcccttctctttccactccccttcctcctatctctgtggatctggttctaaatgcatgggcagtggacaaggtgcgtggaggcggaggcgtaaacaagccacggcgtacacggagctggtggtggagacgacacacagactcaaggcaaagtttgtttgcagtgttgggcctcgagctcctagtggttacgcgtgcctgggccgcacgatgttgggaggctcggtgactatgtgtcagggctcaaaaccgggagcagtgctactgcgacgactcaggaggttatgcactatgccaagatcgtgcgtggcagcccacaaccaccatcgtcgctatcagatttcatgcacgccatcgtcctgggtgttgtcgtcgctgctgacaaggtcgtcgtgctactcagtcctcataggcacattgcttcgtcgcggccgccggaagaagggaagaggacatcgatttcagctactctgctggtttgtgctaccgctggatccaaagcctgtacaatgaccatggatgctgttggcttgagctcaactcaagtagtgtgctagtggtgtgaggactaaggattggggagtagtaacaagctgaccttagcaccgcctacccctgcgtgctcattatcgatccactaatacctaagctgccagattcattgggggaagatgatgaacaggagagaggaggggaagaaggaggaagggggtattttggtccaaatattttagaaaatgtggggtatcaaatatcaatacagttgtaatggtatggcttcaaatagagaaatagtaatggtatattttaaaatcgtaaaagttgtaatggcgtagatccaattaacccttaataaaatatcacttaacccataaaatataattaggagaacgctacacatcagacatttgatattttgcaaaaaaaatcagacggtgtttcaccacatataaaaaaaatatttcagatgtttcatcaccgttgaacaatgcttcactagaaaatgtttcggatgtttcattactcgat

SEQ ID NO: 67445 - DNA, 2407 bp, Oryza sativa
cctaaaactccaacaaaacaaacctagctacctccatcttcttcaactccggtcgtcggcccccgaggaaacccacctccgtcgacttcttcttcaactccggttgccggccctcttcttcttcaactccggccgccaccccccgacacctacatcttcttcttcagctccggctgccatcccctgacatctccatcttcttcttcaacttcggtaagccgtgcctccgcctctccgatggacggcgccatggtgcgacctcaccgctgtcgtcctctgcctcgtccacgaacgcctcccatgcctcgtcgattggcgccgcatggcccgcgtatgccacacctggcgcactgccgtcaagggggagcagagcagaaactgccggagcgctggctcccatggattctcatatcgtcttgccctccgtcgctgccgttgtgtggccaacactggtgaaatagcaagagagaagaaattaaagagagagaaaagaaggaatgtgtggtggagatgtagctgtgtgtgtggataaggacgacgttcgtccgtccggaagcatttttcagataaatatctttacaccaccatgaattgtatgggacaatcgggcgataaattaagatggtgaaaggaaaatactctgtttgcttacagaccaaaccctaatgaccccacaatcgtcccacaccaagctcacaagtcccaaccgtcgcttggcgatcggacggcgtggatccaatccaacgagaccctcccccaacccttgtccgccgcgtctctcgccgtcggtcgcatcgcacccccgcgaatccccccccacaggccaacagcaaagcagaggcgaagggaagaagaagaagaagaagcggcggcggcggcggccatggcgtggcgtgcgaacctctcccggggcgtgaaggagatccgcttcctcttctgccaatcctcccccgccagcgcccccgcgaggtaccgtccgctcccccgtctcccctttctctctctagggtcctagacccgatctgaagaagaaccgcggcgattccttcctttcgcagggagttcgtgaagaagaactacggcgacatcaaggcgcgcaacccgtccctccccgtcctcatccgcgagtgctccggcgtcgagccccagctgtgggcgcgctacggtacgcgttctttttttttttcctctcttctccatggaatccgagatcctctgagccggttcttgaactttttgttcttatatcttttgcggcgtgaaatgttaggttaggataccggatcgtgttgtcttttagagttgggcatcataggttacattgcttatgtaaaatactagaatgtgtgaatgcttgagaaggaatggcacattaggttgattgcgatctgaatgctttctttaaggaaaaatatttatagagaagcattaggtttgtccaatgatataatgctaacacaatgttgttaaaaaatggccaagatttggagaaggagaaaaacaggggacgacaatgtggactagctgtagagttattgttgtgatagtaagatcatctgttcaagtccacactttcctgtgggttctactaattaaaaacctaagatacatggtttctctcatatgttcttggtatttttagacaagaaaaacattccatgacaattgtgagtgttacttctattctgcttgatctgccacagacagccaaatggtattgtgcgtgcagatgttcaaatgaactactacatgcactggatctggatttggtataacttactacaaattacagacatagtgacaacttctaactcaaggcataaacacaaaaaaaaactgaatagtctacatgactgtgaagaaaatctagagaagcttaggggatgtttggccaactttgggttaagaccagctcacaggattgacggcttaaaagcccaaagctcgctttattttgaaaatcacacacacacacacaaactctttgttgggacttgggatcttacttatggtccatatggattcttccaatattattacgatgatactctgggtatattaaggttccctcttaaacaccggcatttgtttggatgaatataaataaaagattgggatagatggaagagtacccatatggagttgtctatgtgagcaggttgaattggttgaacataatgtgacaatacctagggaactaggaaacactcagttgtaggcacctacaggtggtggaggtgaggagaggtaagatagggaggttgccttatagtttatagcccaaagctagtctaacctagcaaacaaggagaaaataaatattttctgtgaggataaatttccttttacgcattgggatcgctaagatggttaggattataaacttatcatccatcttacccaacca

SEQ ID NO: 67446 - DNA, 2495 bp, Oryza sativa
atgaacttgatcatcagtttactcgacagtactatcaacaccatcacccttcttgttacgtatactcaatggtgcaatcatcctagggaaatctgattggtcgtaactgtccattgtacaaggaagtatcatggcttgtcaaagccacacttttttttagaacacgcaggagatctgcgtatcatttcattgagatagaggaaaaaaggtggatggcgttagagataaactccgacacccacccacccggaagtacaacaccaacaaaacacacccacaagaagcaaaacgaacctagtgcactagtacgacagccctagacaaaagatcacgaagcttagaagctcctggtaggcaccaaagggcgccctcacttgcaatggcttgaaggacatcagccatgcttggggtagtgccattaaaaacacagttgtttctatgcttccaaatctcccaagcgaccaagataataaaggagttgagccccttcttctcactagcaggcaatccccttattgtccttaccaccaactggcgaacctagtagtgccctggcttggaaagttagagtagccaagccgttggagaaccaaacaccacacttgctgactaaacacacaagtgactagaatgtaattaatagtttgctgaagcggaacctggttagtaaggccgcaatgtttttaaacatagaaacatcccaagtatatactcaaatatatacatatggactctattctgatagaaatataaaacaatatttaatttggtgatgacaactataatatggagtgttattgatcaatttgtaaaaaccagatataatcatccaagtacttgtaacaggtcctagtcacctataagttgcaaaaaagctggtattttccgaggttaatgggtgttaaaactaggtagttaatacttgtttcaactcttgcttcttattgctcctttattgttttgccgtggggctccagtgctaagctgatttctctgtctttctgcacaaagatcatcatcttctcttattggcaaattttcatagccactttatagtatgtagataggccgttcatttgagtttacatacataaaacgaaaatgtatgaaacaaaaagttacaagttcactgtgaagtgactgagcgatactattgatgagactttcttgtatgtaatccatgcgcataattcatgtgttgttgatctcctaagtgcttatgcatgttttttcacgcttttcagaggttcattgtttccaagtattccactggctcaattgctgtgcaagcctcatttttcttattattcttgagtgccagtggatcaaaactttggctcatactgtttacattgcataatgacagtggccgatttcatttttgcactgatgtagtgaatttcatgttgcaccatattagctgtcaccctactactacatcattactacccatactccattatggttacagtgaccttgatacaatataatgtgtttgaagatttgattccaacagagttgacttttcggtagcaaatagaggaataacaaattgccattcacgttgcttattgttgtagctcattgtgcttggtattatattagttaggggccaagcgatataggatagtttgcctcatcatttataacttcatatgttgattataaaattaagatttgagttacttttcccaagcacataatggtccaaaaagttgtagcgtctaaacttgtaatttaatcgactaatactcaaatactccatacacccaaaaatgtaagttgtttgtgcctttacagtctcaaaagcaagactttgagtattgattctaataataataatataaaaataaaatataatgaataactaatgtatgttgcctgaaaaaataaataatactagttttctcatagtcaattgatatgatttgcaagtattaattgtttgcatgcttcctaggatgacttccattgtgggacagtgggagcactatatattggtctaatttatcttcataaatttgtagcaatttactctatgtcaattgttagaagcttagagcaagggacacctcaaatatgtctagtgtatgctacgtcctgcaatataaatacaacctgtgcgaatattttgatattttatttgtacaaatgggaactgagaaatttgttggggagaaaatccgatgcgtccacacttatcatccttttagaaccttgattggaatactgtggcaggcccagaatttgtctaattaaaacaacctgtacatgtcactaaatggaagcaggctaggctaccctctggattcgagcaatgatctgtttctatgtaagaaatcttttctggatggatttgtgcatgactgatgactatgtatattgtatgttatctttgaatcttatatataggattatgttatctatgaatcttatgtataggattgtgccttttcatatttatatattattaatagtgcacattgcttttctaa

SEQ ID NO: 67447 - DNA, 3073 bp, Oryza sativa
cccaaaatatgttgcaaagcgaataatagtaataaaagtacaagatctcaatattgaaataatgcagtgttcatctagtcgctaaacgctagtcggacggccacctactgactagcgactaggctgattaggcggcgactagacggattaggcaaattaggcgaattagacgttttttctatttctttcacacaaaaatacttattctagacattcggtactcggtaaatataggcatttaggcaaatagcataaatcatagttaagttcagaaatcatcaagtccatacaacgcactgacactgcacatgaagcattgggtttagtacaaatctatagggatagcgaacacatcagtatagctactgtacatgtacatcataattcataaatcataactttatagatctgaggggctggagctaggagagaggaagaaaaatttatctggaactggaagaacagaggaggtgaggtggtggaggggagcctgatcccctgatggcctgatttagggttggcgtaggctgcttgggtggtttcatgcttgactgcttcaatcggcgtgtttgccaccttccattgacagcaaggatgaaggatgagagggagagcaggagcagcagaggagggggatgaacgtggagcagcagaggaggagaggtaagaacgtagcggcacgatggaagatcgatgggtgcggcaacgaagtcgtcgctcgtgtcggtgtgaaaaagaggtaggcagggattgcgctctctctccatgctctcaaataaggcaacctaaatccctttctataccgagtcggtcccacgtggtgcttctaaattttatcatgcccaaattttgatttctatcacctagtcgccgcctagacgcactgtcccgttgtctaattgcgcccaggcaccgtcctgtctaggccgtctaggccgtctaggaccgactaggaccgtctaggcggtaaatcgactaattcactgcctagggtgtaaactggacaaattgtcgctgactagcgattaatcaccgtctagacgggctaggcggttgtttaggcgaacattgaaataatgtcacgatcacatgaatctaaacttccaagaaacgagttcgagatcattactacagacataacccagaaataatgcattactacatagattgtgaaatgaggaacattattggaaagtctaatcaaatcatttagcgtggtagctcagctgaagcaatgaactcatgctctaggctatagcatctttggctcagctgatccgatgcattagcacggtgaacagccgttgtctgtgtaacattgcgcaaggactgtaatgtcatctctacttgcttcatggtaggtctttcttcgcctcggggactcaagcacatctccgcaagcaaggtaacattgttaatctcttcctctgttgcttcttcgtatatcttagtggtaacaatctcacttaatggccttaccttcacctcctcaagaaaataaccggccaaattcaactttaagccattctcacttgtaaaaatcggctctttcatgagaagtagctccaatagtaccacaccaaaactatacacatcgcttttttcgtttagacactcagtttgacaatactctggatctaaataaccaaatgggccttgcacctttgtgacaatatgggtttgatcgatagaaaccaatcttgacgtaccaaaatctgaaactttggtagtgtaatttgcatctaacagtatattagaggacttcacatcacgatgaaaaactgatactgaagctgcagagtggagataatagagggctccagcaacttctgtagcaatccttaaggtgtcttcccaagacagcaagctaccattactcgaattgtaacgcaagagttcaaataatgatccgttggaaataaaatcatacaccaatagtgggacctcagtttcaagacaacacccaaaaagtttaacgatattccgatggttgatccgtaaaagaatagcgacttcatttatgaagtgagtgatctcaccttgtttgatcgtcatagactttttaatggccacgacacgttggtctgataagatgcctttgtaaactgtaccgtgtcctccttggccaagtattcttgtgtgatcaaagttgtttttctagctcttctaaagtgaagatactcattctatcagtagtggtttcatcacacgatattagttgttctaggagaagtccttcgttcttacgaaaattcttcctacgtagccgcttctggatacctttcttccatttatggaagagcatttttgcgcttaagccaggcagtagaattccaaagccagcactaagtccaatgacgatacctaaataatgaggcagccgatggttatgcatgctttgctagtacattatttactttttttttaattttctttttctgcatggtgaaattgaatggagtacataactcaccaaaaagaagatttttttgctttttcactgaagtgcaccgctttgttttgtcattgtactctgatttagcagggcacttgatgcaagtgtagttaccgacagtattattgcatatttctggacagatgcctggtgcagtggagcattcgtcaacatcggcaaccacgtacatgttgcagtaattaagacgtgagggattttagcagtctaagacaagagagaaaatatatttgtaataaggggagagtataacaatatactacctccgtcccaaaaaaattgtatttctagctgtaaggttttgttccataaaaattgtatttctagacatgtggggtccaacaaattgattcatctagataagtttccttaagttctcttaacttgtaatttaattatgctaattatatgggttaattatcttaaacttccttttaatcatttgtatatatcgaatgtgtgcatgcaatggattcattaaataaggtcatcgtggttattttctaatcctactgatttgtcctaaattagctagaaatgtaatttttatgcgacggagagagtaccaatatatatgttggctgtgtccaagtgcgttaa

SEQ ID NO: 67448 - DNA, 3048 bp, Oryza sativa
atgcttgcacttgcacctataaccaatatacccatcacctgtgttgacggccaaacacgtactgttaacgctgacacatgcatatccggtggtattctgctgcgcctctttgcaggtttggtttgtgatggcaaaatgcagattcttaaccacaaagtcctttgctgaaccatcggagactctagcactagccgtaccatccatggcaaggaactcctcgtagtgctcaccggccaagataatgagcccttcgctgatatctatgcgaacaagcttggtcggtgttgacggctcgtcggtgtatcttgttgcccaccacaagaggtcagggtttgtactcttgttgtctttgtagtaggtgcatctgagcaggaaatgctgatttgcagagcagcctttttctaggccaaatggatatggaacgctgatatttccacatgacgggctacaattgttcttactcggaaaccgatcatatcttgcgtccggcaatcctgcattgagaaaaccatgatatgtcaacagcaataatttaaaattgatgctaattacgtactgtacatatactattgatgctttgaacattaacatatatatgttaatttatcgttcccaccgtatattttcgtaagacctacgtactttgatttcgaaaggtcagattttataaatcttgaccaacaggcagtcaaattacaaaaacatttagtgtataaattcatgtttataccaacatatttcaatttcaaaatacttttacaaaatgttggtattatagatatgagggattttactgttctcgaaaagttaccgcgagagttaccgtatttcccaacgtaaaatttaataactctcgatgccttttgtactagaagacaacaaatttatactaaaaaattagtacttttttttatctctcaaggactataaaattactctacagacatatacagaatatatatatttttcataaatcaatagaaacattattttccttagaagatttttgagagacatagatatagatagaggtgtaaaaaattataagcatgcatatacctacatcacgccggcagccattgggtgcatacgggttcccttgatacccatcggtgcacttgcataagtaaccagcacgggaagctgtaaagctcaagttatcatcgcaccggctgtgcttgctggcacaggcatagctgctcttgtcacgcttggcttcagcgcacgtcgaatgatccacaatggcccacccaagtcgcacgccgtcgttctcgattctgacgctgtcgacactggttcgctggccttcgccgtgttcatgccgatggacaaactggagttgaaaaccacggacgatgggaatattccgttggcactcaccctcgtcactggtgtcatcaatattggtaggctgggtaagcgaacacaagattatcctcttcgaactgtaggcatcgagcaagtatacatcaaagttgccatgtccgatggttacccttgcactgtcacgtacggagaaagaatcgccaggtaccgtccatgacacattgtacagatcgacaccagatctcatagggatgtcaagtgaaaagttcacatagactgcttattataaaaaaaaaacaagttagatgactaagacataatgatgataagaaaaccaatttagttctgattgaaagttattttatggctgtggcttacatacgccaaaggcatattgggatggataacgagccatctcggctcgtttgtgctgattatcttaacgagccagctactgtgtcacttgaacattcttaagcaagtgtgaccagcttgttgctcctagtggttgccaccaagcttatagaagagctttatgccagtggtctctcggagacggttgtagggatcaagataagacaaccctaggaggggattgtgaaggggtttggagatcgcctacacgcaatttagttagggaagactaaggtaaaaaaaaaaaaacttgtgtaaaatattgcctgtgtgtgtcacacatctatctacatgaaaccattaccacatgattaattgagtactaactattttaaatttcaaaaatagattaacataatttttaaaagtaactttcctatagaaatttttttttaaaaaaaacaggaagcatacgcgcggaaaacgatgtgctttctcttgaaccaccccacgaactaacgcagagcagataattcctcccaccactctaattgattatcataaacttcttttgacacacatagacgaccacacttaccccccaaccccacaacccccacatagagctacgcacagtggcacacaatagaaacatagtacgtacgtacatacgtaccatagccggcggccccgatgctgttgatgacttgggtaaagccatcgctgaggaagagcgttgggggctgcgtggtggtgttgcaaacgagctggaagtcatggccccgggcgcagccggcgccgatgccgaaagggtaatcgaaggtcaggtcaccgcagctcttggcacagccagcgccatagccacctccggcgccagcgctggtctgtgcagctgccaccgttggtgccccagctgcacatgacgaagctggtaggagcagcgctagacatgccagtagcacatcaacgacgacggcagccatcgtcgtccagcctataacacccagttagcttacgcctgtggccttgaaattaactccgaagctctagctcgtcagtatatatatctatcttctgcatataataggaactttcctagtaggttgaggtataatcctggatcttcctaatatgttggatgtatgccctctttatgggaggaaaatatttactacaaataaaatatatagtgaaaacctgaaaataatcgttgaatttagaaatagtaaaagtttttactcttgattacgcggataaatttcaaacgtccatttttatattcaacggttgtttttaggtttccatcacatatgtgatttgaataattttcctgctttgtggtcgcgtggacctgtagttgtcggtaca

SEQ ID NO: 67449 - DNA, 3221 bp, Oryza sativa
aactttgcttccgacatggttggttccattccaccaagtttcgacgtcaggggaatgggacgaggttaaaggagtcaggttttggaactgacagattagactccaagtttgtctagtaaaaacgcattcactgaacagatgattcgtgtcttcaaaggcgcaagtgcacaggcagcaaatctaattacatggccaatgtcttcgaagtaaattttgtgcagtgagagttttttgatgaaggactagccatccgaagaatctcattttgggttctgccggggccttccaaagtgaaaggtagtcgaactaagcaaaggaccctacaaactggtaaagatacgcacttttggctgtgtaggtacctgaatcagtccaattccaggtaatgttatccggttcttgggaaagcgtaaccagatgaagtaaactggtaaagatacgcacttttggctcctagctgcaataactcgtgaatttcctccactgaagtaaattgtctgaaagaggttagccatttattatttgtgagttcaacttgcaccgatctttgttttctgtttgccagactaaaacatcttggtgcaatgtcttttggacagcgattttgaagccagttgtcatgccaaaatcttgtttttgcgccatttccaaccgaaatagtcgttgcagcttggaaaagtctatggtcagattcatcacaaggcaggctcatgcccacccatggcttttcttcctccttccaattaaaccataaccaacgaaggcgcaatgccctggaaaaacgctctagttccaggacaccagcacctcccaaggcctttggtttacagacggtttaccagttgatcagactatctcccgggtttgaatggtcgggatcttcacccttccataggaaagatcttctgaaacgatcgattcttttgaaaacccactttggagcttgtaggacagtaagatgatgagttggcatagcacttagaacagatgatactagggcttgacgtcccgcagaagtgaaaaaacgccctttccaacctggtagcctagacccaatcttgtctattaaaggaaggaagtcaattttccttagttttctgaaatgaagaggtagtccaagatatttgcaggggaaatattttgtttggcccggccatccagcaagaagattttgcagatcgatgccttcgcatctgatggggtagatttcagttttgttgatatttgtgtgtagcccagaagcttgtgcaaagcatgccagtatatgagaaagagctgtcaactcttcttgtttcgggtttgcaaaaaccgcaacatcgtcagcatatagcgagcacctgaatctcccatttcttaccccaaggggagcaaggacattgacattttctgcttcttttaggattcgatgaaaaggcttcatagccaggatgaaaagcattggggatagtggatcaccttgtcgtaggcccctagcatggttgattttttgccccggggacccatttaagagcacctgggatgaggaggtggagaaaagattagtgatccaatttaaccatcggtttccaaaaccaaattgtcgaagaatctctaggaggtaggaccaattcacggtgtcaaagccttcgcaatgtctatcttgatgaacaggctttgtttttttgtcctgtggagcagctttaccatgttttgcacataaaggaagttgtcgtgaattgcccttttgcggacaaaagcgctttgattttgagaaatgtaattgcaaatttgcctatttacaaaattaccattacaattcatctattcgtagccgtgtcattgtaattttacaaaattagaatcgtgccattgccgtcatgtttaacattcatctccttccttttccgtcttcttctttctttctcccatcttcttctcgaagggcttacatagtgccgaaaggcttacatagcaaatatgtacatttttataagttggcgatttgggtgccacccgtttagacatagaaacgcttgagggaagcagcgttccaggagtggtcgaactcttcgccttccagcgttgctaggctaaccactacaatcaagcatcagttggcgcagcgtgcacttcgtggcgttggctatgacctatggtgtatatgctagaaaataaacagcaagcaaggacatttgattctacacgtcaacacaaggatgaaagatcctttctttctctctccttgcttgaacagtgcaagagagctctccagttctttctttcctttgctcatcggaccctttgtcctctctgtctccgaagtcaccatcaccagttaggggatgggggtccgacgagtggtcgggcttgtcccactgtcaagttttacccacagtttgtgcaattcagtagaagaagttgtgtcatgctccttcgtcctagaggtgcttagccatggatggagttgctgaaacctgtttcagtactccctattccaccagtactcatcaggtaagtactagacaccctactcaagtttcagtactccctattccaccagtactcatcgggaaagtactagacgccctactctttagtgtgtttagcttccaattctccaaatttgcatgcgaagaggttgtgccggcttgtccaactcttcttgggcaactacattcagaatgatgcgaacccgctagggtttgtggcccgatctttcgatgagaggtaagggataactcaattagatgaagtcgacgttcacggcccgactacaactgtccaaagacgctgcgccttagcaaccgatacaccgtctccaatggtcgccgcgaatttgtggtgcgcgtcaacccggccacgagggcactcgtcctgcaagcaatcgaagaacaagcaagaacaagtaggacaagcactgaaattgctagataaagatgaaagtttcactatcaaacacaatatggtggggttccgattacaggcagacgggcggtttagccaacacgcgcgctgcgagccggtagcaagaagctatctctatcatcaaaacccgcctgttcttggcggcgactagaggtataagaagaggggaagaacgaccatagggtcgtgctccaaccctaagacgcgcccctaatgggcccaacttggatacacagcccattgggccaaaagaggtgacgcagcaccatggacagaatatagtcgggagtaaaatgacaattgcggccgctccagaa

SEQ ID NO: 67450 - DNA, 2248 bp, Oryza sativa
ttaacatcaactcagcacgttgcttagcatcaaaattcagtttttcagaagatggtaaaggcatcaaatcaattggagcacgaggcaacaaaccatacacaatctgaaatgggcacatttttgtagtagaatgcaaggaacgattataagcaaattcaatatgaggcaagcattcttcccacatcttgatatttttcttcaaaacagccctaagcatagtagacaaggttctattcaccacttcagtttgtccatcagtttggggatgacaagtagtagaaaacaaaagtttagtccccaatttagcccacaaagttctccaaaaatggctaagaaattttgtgtcacgatcagaaacaattgtggttggcacaccatgcaagcgaacaatttctcgaaagaacaaatcagcgatatgagaagcatcatcagttttatgacatggtatgaaatgtgccattttagaaaatctatccacaaccacaaaaatgctatcacgccccctcttggtcctaggcaatcctaacacaaaatccattgaaatatcttcccaaggaacagtaggaacaggaagaggcatatacaaaccatgtggatgtaagcgtgacttagccttttgacatgtagcgcagcgagcaacgaacctgccaacatctcttcgcatctgtggccaaaagaaatgactagcaaggatgtcatgtgtcttcttggcaccaaaatgtcccatcaaaccgcctccatgcgcttcctgcaacaacaacaagcgaacggagctagctggaatgcatagcttgttagctctgaaaacaaacccatcattgatgacgaatttgttctatgttcttccatccttacaatgcagcaacacatcattaaaatcagcatcatgcacatattggtctttgattgtttccaggccaaaaatcttatagtcaagttgtgtcaacaaagtgtatcttctagacaaagcatcagcaatgatgttctccttccctttcttgtgtttgataacataaggaaaagattcaataaattcaacccatttagcatgtctacggttcagcttcccttgactatgaatatgcttcaaagactcatgatcagaatgtatgacaaattccttgggccacaaataatgctgccatgtttctaaagttcgcacaagagcatacaattccttatcataagtagaataattcagaacaggcccactcaacttttcactaaaatatgcaacaggttttccttcttgtagcaaaacaccacccaatccaatcccactagcatcacattcaagttcaaaagtcttattaaaatcgggaagttgaaggagaggtgcatgggtcaacttatctttcaacatgtggaaggcgttctcttgtgatgtgccccaagtgaaaggcactcccttctttgtaagcgcattcaatggtgcagcaatggtgctgaaatcctgcacaaagcggcgatagaaccccgcgagtcctagaaagctccgcacttgtgagaccgttttaggagtcggccaactctgaattgcctcaaccttggcttgatcaacctcaatcccctgcggagttacaacatagccaagaaaagaaactctatctgtgcaaaaggtgcacttctcaaggttaccaaataaacgtgcatcacgaagagcattaaaaacagcacgtaaatgattaaaatgttcacccatagacttgctgtaaatcaagatatcatcaaagtagaccaccacaaattttccaatgaaaggacgcaaaacctcattcatcaacctcatgaaagtggtgggtgcattagttaaaccaaaaggcatcactaaccactcatacaacccaaacttcgttttaaatgctgttttccattcatcacctaagttcatacgaatctggtggtaaccactacgcaaatcaactttggagaacacaatagagccactcaattcatcaagcatatcatctaacctaggaataggatgacgatatcgaatggtaatgttattaatagctctacaatcaacacacatacgccatgaaccatctttctttggtaccaaaattaccagaaccgcacatggactaagagactcgcgtacataccctttatcaagcaactcatgaacttgacgctgaatctccttggtttcctcagggttggttcggtatggcgcacggttcggtagggaagcacctgggatcaagtcgatttgatgctcaatgccgcgcaccggtggcagccc

SEQ ID NO: 67451 - DNA, 1622 bp, Oryza sativa
ctgcacccctgtgctcttccggtggctcattatctgcatggtcagccgcaagcaaagcaagtgtatcatcatcgaaatcaatagcagaggagtactcaccatcgtttttgactaccaaaactcgcttgctagggcagtcacgctgcacatgcccaaagcccttgcaacggtggcactgaacatctctcattcggcctgtggatgccattgaagaagcactcggtgctggctgagcagcctttgtcgctgacttgtcactagatggaggaggtgctgctcgactggttgtgggtgtggaagatggagaaacagtacggccggccggaggagtggtgcgtgtctgccatgatgaagttttacctgcagaaaaattagccttggcactagcacgtcgtccctgcacttccctttcagccttacaagcaagatgaaacaatcgggtcatattagtgtaatctttatagtctacgatgtcataaatctcgcggtttaacccacccaaaaatctagccatggcagtgtcctcagtttcctctaaattacaacgaagcaagcccatttgtaactcctaataatattcctctacacttttcgcaccctgtctcaattgttgcaacctattcagcaagtcacgtgcatagtaagaaggaacaaatctagcccgcatgacccgtttcaaagcatcccaagtttgtggcatgttattaggatttttcttgccatgttctatccaccataccgaagcaaaatcggtgaactcactcgtagcagctctaactctagtgctctcaggaaactcatggcatgcaaatttttggtcaacagcaatctcccaagagaggtacgcatcaggatcatattttccatcaaaaggaggaatcttaaatttaattttagaaaaagcatcatcattattgcgtacctcgcgtcggcggcgaccacccatacctcgtcgattgttgtgtagccgtcgacgatctcgagcatctcgatcatcttgttcagtgtcagcaatatattcatcctccaaattatcctcgacgtactctccgtcaatgtcatcgtcattacccccaccattgcctccagcattgagagcatcaaaatgcctcacaagagcagcaaggctagtgtcaatgcgggcgaccgctgtctccagccctgtaagcttagtgttggtggagatctgcgtggactccaattgtccaatcttctcatttgtcacctgcaaatctgtatcaagtccttctgtgtgctgcttcacttgccttgtaaagtattggatgatgcctttggtgcgtggggaatgagatgcaccctcctcatctttatcctctggacctgccatggtttagaaatgaaggacaacaaaacaatggaggatgtaatgtaagccctacacaactattgggatgtagcttttgcaagacgctcactctcacttcactcgcagcttgtctcacaagctcttaccagttcttaccttgcccacaggagggggacagcaacccacaagttagcaaccgtggaacgaggtgtatcggtgctgtagcaacaagacctgtcaagctgtagtcgggtttgtggtggagctgttggtgggctgaaagcaatgctcaaga

SEQ ID NO: 67452 - DNA, 4045 bp, Oryza sativa
ccccaattcggcttcaacccgatggagctctcttcaaaacatatctttcggcgttagtctttctgtttgtttggaggttgtaaagaagataaattgactcaggctatttcttcagcttagaactataaactttgaggtacccagttttgaactaccgcagacttgtttcatagctttcaactaagcggcagacccgacgcgactgacggataatccaacgttaatagcaggtctaattccgcgataaaagagctctgtttccaaacagatttgtccatctgtaatggagatcacattggtggggatataggtcgcctcggggaataccaccagtagagtctgcagaaggtgtcgttcaggccatcggctgtggttcagaagtgggctcgacctgctttgggatggatgaaactgaacactgatggagcactgaacttgcaggatggagttgcgggtgcaggaattgttgcacgttcgtttgtcgttggggattcattgctcgttctgcggttataagtaacgtagccagccaaatttctaggacctatatcattaccaactccagacatcacagtttttccaaaaatatggacctgaagactggcttctccgaccttccacccgatcctgggcgatcccttatcgccactagaaatttgaaaattttgaaccgtgccactccatcacgttttccgtcaccctcctggacgtgggacccacatgtcagttctatcttcctccattattcctcttctttcttccccatctcttccttcatccccgcgatgggagcaccggtggtggtgaatgcagaggagctcgcgggggcgccggtgggagcgccggtcggtgcagactgcagaggcggtgggggtgaccgcagacaaggcaagggcggagggagcattggtgtctagggcatcagtgggcggagtcggaggagactgctgccatttctgtacattcaatgtactctactgatagaggaatacataaagttgaacataataaaataagaaattgaaagatttcgttgaaattgttcgtttggaaatttcccgaaaagctaattataggttcttctctccatcggaacaatagggccgttatgcttattactaaacttgttgaagagatgaaatagaaccaaggtctatctttttgatcagagattaaatcgatcatcagaattaggccaaaaattaggatacattctgggaaaatgaaacttccctggaagagaagcaatccttcttttttttttgtctgaatattcagttaagaccattccaaggctccttttcgccatgcataaactaaaccaacaactaggataagcacaaaaatgaaagcttcgataaaaacggatatacccaatacgtcgaaactcattgcccaagggtagagaaagaccgtttccacatcaaaaacaacaaaaactagcgcaaacatgtaatagcgtattcagaattgtaaccaagcccccccccatgggttctatacccgattcataactagaaagcttctctggtccttcacgaaccggagcttaaaagtgctgaaatccaaaatgctaaaataggaataaggcttgctattattagaaatgcccaaaaaatattatattcgtgaagcagaaacataaatgtactcccattaatgtggaataggcggaactgaattagtcaattcaagtcagcattgtcaatttatacagaatttctctcttttcctcggtgaaacaaggatcggtttttctcaaaccaaagggcttagtttagcccaccatgccgacgaggtccccggtcgttattgtgactgctgcttgtccaccatgccgactgatgcagtgctgcttgtcccatcaagccaaaaatgacgatggactgagacctcgccactatcacgatgagcttttgccaccgccaccgaaattgctcgtgccgcgactactgttgcttgctctgccattgttgtgactgttgcaccatggactcttgtcctttgccgggatggaggaagcggtggccggggacctcgtcgggggagcaggcagcggggccatcttgggtgccgggatgggggccactcccggggcctgcacagcggccgtgacggcgaggagggtgacgatgatggcgacgacggcgaagcgagccatcagagcagcgtactagcgatggattaattgaggagagggtccttgctgatagcgcacccctctagctgccgctgccttagccgcgcatcatggaggtcctcggcaacggtggcaaggatgggtactcagtcgtcggtgatgcctcctccaccaccacctcctcctcccttgaacggtgacagagaccgcgtggctcaccggctccgagacgaggtgctcgacaacaacgacgacgcaggcgcagcctggcccgacctctctaagacaatgatggagacgacggagacgacacctcctgccgcatctacggtggtggagagagaggaagaggaaagagaagagagggaagggaggtggggcccacgtgcagctgggggctaataaagatttttgacggaaaacgtgatggagtggcatggatccaatttccacaattttcagtgccacgtagccgatatactgaatagtagtgacatttttttgaattgacatatttgcagtggcatgaatccaattaacccagtaagtaaagataccgatatagttgaactgcctcctttttccttcccgcacatctgatccaaatctctacaaaacaagaaaacagacaaaaacgtgatttgcaatcaaatatacaagctattacaagaacaacggatatacaagctattaccagaacaaaggatgtaccttcacgagcatgagagcgtcgaacacctcgcgatctagcgacgcagccctgagaaacaagaatcacatactaggtgccctccaacgaagtactaccaagaatcggatgtgaaggtaggctggataggcacctgaggatgcgcttgatctggggaggggagaacttagcgaggtccataccccactgcacggcgcgacgagcctcccgtttcaggtcgttgcggctcttcctgagggcctcgccggcgccgtctccggcattcgaatcgtccgagtcttcgacatcggagggcaaagggcccgcggggcggagggcgcgcggtagagataggcggtgcgaggaggacgcgagggaggagaagagacagctcgggttgagggagggaaggagcgaacgccgcagcggcgcggccgcggcggcaacggcggcggacgccatagggtggtgaggactgctgattttctgcggttttggacgggttggtagtgggcttatctacttggtagaaggcctacgacgggggaaataagttcatccgaggtccctcaacttgtcaacaaatccgactttcgtccttcaaccaaaaaaccagatacaacaggtccctcaactatcaaaaccagtgcaaaccaagtccattggcggtttggaaggcggttttggctgacgtgacgccaacgtggctagtttaacttagtctttgtcccacgtggcatttgacgtggagcttatgtggcaatttgaatccaaaaataataaacccgtggccccacatatcagcaacaaacacaaaataattaaaaatggtggggctcacgtgggccccatatgtcagcctcacctcccttcttccctatcccctctctctttcctctctcttcttccctctcccttctcttcaacttcccttcccggcttcccgcaggcgagcgaggaggcgccctcggcgacctcgcgcgccaccgtcgcactccaccttcaagccgccgcgttcctccggtggtcaatccccatcggcgaggtccccgtcgtgcagtgactcatcaaggcggcaagcaacgtcgtcacaggtcctcgtcgtcgccggtcacctaccagccgctcgacccctggctccaatcctccgccgccccatcatcacctccctctcccgcatcctccccacctccaccttcctcctgggctgcaggaat

SEQ ID NO: 67453 - DNA, 3015 bp, Oryza sativa
gcgtctggcgccaacttccataagcggacggtgagcacgccgttgtcgagggaggcggcaatggagtcgaggtcggccgccgcccacatgacaaaaagggaagggagagaggacaaaggagtagagagcggttgccgccgctccacccgtcccgctccgcaccgccggcctactctgcccgccgtcgctgcttcggcctcacgccccgctccgctgccagccgtccagccccgccgctccgtccttcgccgcccacatgccgaaaaggggaagggagcgatgagtcgggagcggtcgccggtcgccgccgctcaacccgtcgcccgctccggccaccccgctccgctttgtagcttgctctggcggtcggagctgccgtccgctcagctccggtcgccgcctgcctttgctgtgagcctctgactccagcgagaggagaaagagagatattgaggatgacgtatggggccaatgggccccaccatttattattattgttgtgcgtagctgacatgtgggccgtatgagctttttctagatctaattgccacgtaagcgccacgtcaatgccacgtcagtcaaaaccagagaccaatactgccgagggatctcatttgcatggttttgtaagttgagggatgttttgtatctggttttgcggactgaggacgaaaatcagattgggcgacaaattgagggacctagagtgaacttattccacgacggggcactggtagttccgaccgtttagcaaaaagttcactttgtgtccttcgacgggttgggttttgtccacgtacctcaaccgtaaaaccaaatatacaaatcccaacttgatgcacatgcacgtggagtgggtcggggtcgacccatctaccaattgacccagctcatataacatatggggccaaaacaggactgcttaggaatcttcacaggaaccgtacagtaacaaatgatcatcgtgtaataacaggatcaattccttgcagtaacgtcattagaatatagtgataacgaatttagttttgtaaagttcttttttaaaagcattatgatgcgtatggttcgaaaatttaatatgtgatgtgagagatatcattatttaaatatttgaattccaaacggatctacttagcttgctaccatgtatatttgtgtgtgcaaagagaagtacttttagcacttgtgtcaatttgtggccatgcatctctaatagtactataatatcacaagtacatgattaccatttttaaaatttaattcttgacaaacgatagttttatagcagtaccgttactaataatactacgatttcacgacgatgttactgccaaaaatatgttctgcagtaacatgacatgttaccgcacttctatgatgttaataaatattgtaacgacgttaaaatatattcatgatagatctagttttgttatatttttttttacgaacattgtggtgcgaatggtcaagaaaaacaatatataatgatagttttctcttaagattgcaaatttcaaatttttagctctccataagcagaagtacaatagcagtattatttccaccatatgttgtctgctactgccatttctatcctgatgttactaaaaaactgcagtaagaacgtattttctatagttactacacttccgtgatatatatgttctcagtgttactgcactccctcatcgccatccttcatatccgtcggacctgcatattctcagtgtcctcgtcgccgccgtccagccctcatgtagccggaggagcttgtggtcgctttctcccgtagcctcaccaatttatgccggaaatctcctcgattattgatgctactgcgcatccggaaaaaactgagtaaggaagagaggaatggtgggatacggtcagacgaatgcttatggacggtataaacactcacaccaaggctctgttcacaagtttaggttcccaatccaatcagcatttacggaaaatggatagtgctcgtatagcagtaaaaaaaaaagttactacagtagcacgctggactatagatgctacttaactaggtgacatgcagggtgtcatgtaacaattatatatataacttaaccgctcccctcatgtaacctcctccccccaccccatcccacccccaagtttttccttttttttcttcaaccgtccgtgctccttccgttccctcttttttttttttctcgtgcactcgtgttgtcttgcttccctcacataaccattgataaaacaaatatattaacagtttactttcgtgttgttttgcttcgctcacataaccattgataaaaaaattattaacagattacttctgcacccaaccaaccttcatttagtaaatgaattattggattttagttacgttggaggctctgtcagaaaatcagttacttgcaaatatatcatttgattagttccttaatattagtaatgattttactatttagttaaataaacccttctactattagtaatatttttattacctagtcacctgtaataatatctttatttttttaagttattttcagtagctcggtgccttatttgtcgtagtactaccaagtgttctttttatttttaatgctatgtatcgatctattagtatttttttcacgaacgcttattagcgcatagtaaatgttttattggacgatgacatgagaagagtatttttctttttccaaattagcctccacagcatgaatacaatattacagtgtgagtaaacattttactccatgaaaattgtaggctggttatatcacatgaccaataaaatttggcaaattttgctacaggacactgctattgtgtggttttagccctaggatattgcccaaacttatttttaagggaaaacactccataaacatggtaatttgccagtggagaccgtgtcgattaaaataataattttcggttgaagaggagagagaaatcatataaaagttctaaaggcccttgggcccacatatcatatcttccatc

SEQ ID NO: 67454 - DNA, 1874 bp, Oryza sativa
cgacggcggtggcgctgcatgcaggtgacggccacagtcggccatggcggccgcgtcagcatggcgacggcgaatgtggcagcggcggcggcgacgacgacggagcgaagacggacggcggtggcagccggccgaaggagatcgtgagagatcagaaaggggggagaggttgtgatggggattgaccaaagatggaagagctggcatatggcccaagggcatttttgatatttcacatgatttctctctcctcttcaaccggaaattattattttaatcgacgcagtgtccaccggtaaattaccacgtttatagagtgttttcccccaaaagtgagtttagacggtgtcctagggctaaaatcacacaatagtagtgtcctgtagcaaaatttgcgataacaattataaacaggagacagacgtacacatattcattttgataaaaaaaatcaagaaaattgtaaccaacatgagacactgcaagagccatatgtgttctgtcatcagtgatctcattgagtgttgctgttaaatccttatacctgagattatcatggttatcaacatgtgtagtagcttacttagggactgctaaacgctactccgtaattgggtagttataaaagtagttttcgggtatgatatgaaacatgtagtgagatatgaataatcaagatgggatttgcccctcctatggagagatatctctgggcccctcgatgttgtagattatggaagtgtatggccatgccaaaggtgattgaggagtcaatcacaagttatataatctatcaacaggttcgagtgaatgattgagctattagaggatggcacatatctagccttgagcttaatcgatatcgtgaggcaaaggggttcatacaagtatatactagaggttcagccgatatgatctttatgtatgcccggtgggtcaatacgttctgctaggggccgctgttgacgcgtggaccgaaaaggagttttcgggttacagccgagtatatatgaacctacaggttcgcacgcttaatgggccagaataaggggattggatagagatccaatatgagcttaatttggatagggatccgaataggagttctacgggccttggaggcccgagtgatggatcctatatattcgtgaggggtgtgaccggcggaggcattgcatcacgtgagaaaccctagccgccacttccctccccgagcaaaccctagctgcgcgcgtggtgttccgtccctgtacatgtggataccggtagaggcaccgctggtttgcggtgctgatcggcgtgggagtacgacgaggagaacgcacgaggaggagaaggccgagccggtgcgatcgactacttcctctacatcgacgtgcgctacttcgcgagagttccttcgacttctcagcgtcttcttccgctacacagcgtgtcgagtggtagcgatctatgatctaatactttcatggttcctggtttacgcgatagaaaattttgatttatgctatcgtagggcctgtttggcacagctccagctccagcttcaccccttctggagctggagctcagccaaacagtttcggctccaccaaaactgggagtggagctaggtggagctctctcacaaaatgaactagagttgtggagctgggtttaggcagctccacaactccactccagactcaactcctggagttaaatttaggagttggagctgtaccaaacaggcccgtagcctacgcgtatcccaacagatattggtagttgtccgaacattagacacgtgaatgagtgaacaaatgaaaattcagatgggagcatatttctgagaatactgcacacatgcaaaattgcaaatgggctgcaggaat

SEQ ID NO: 67455 - DNA, 4204 bp, Oryza sativa
ggtccatcttttattccgctgaggacgcagaaatcaagtgggtgcgtacctctcgtcaccgtcaggtattgtagatcgtatctgtcccgcaccttgtgctcaagtgtatccgcttccttgctgcgaccatgtcggcgagaaggtgctgcagagaggcgtgagtcgtgacacagggcacaacagggtattttgcgcatttcaccatcgtacagtaaaaatattagaaaaagacaatcacaaataaaaagacaatggaaaaaaatctactgatatgagcccagccccttgcacaggctaattacataattgctgttagttcctttaactaactagagtgcatcgccactggaaaagcatctgaatcagaccgcctacctacagttcagttcatgcatttcaggccagattaaggacggcgaacaagacagcattcctgtggcgccatcaccactggcatccattaggacctcgatcacttaactgtatgcaatatatcctcctgttccttttcccagcttcctgaacataataaagtgaattcacgaatcaaaagaaaattcagatgggagcaaagaagggggtgctgattgcatcgtgaaaacaacactatcaatagacctgatcatgcaaccatggttttgatcactgcgaaaaccatgggcgtgaaagaagtgtagaaaagaaagaagaacaggagaaagggagcagaacatatcgaagctggaggtgatgctgggcgaatggaatcgctcatggtgttgtttgtctagaacctgcacacaagcaactacacagcaccaacaagcgttatcaaaatgaggaaaaagggcttgagcaaggtgaccttgtcctcggtgaacatggaacggggaaggagtatcttgaaggattcggcatccaccaagaaccgacatggcgctgcatcaataaaacgagaacctcccaggcggccattagttcagatctgaggaaggaaggaggtgcaagctgaccacatgattaagatctagtccaccaccatcgataccaagaacgcctcgctgcctcgaccatgccggcggcgacgcctggatccggcggcgggggatcacaggcacgcgatgaggtggtcgcccccctgccgcgccgccgcctaggctgccgcctcctgttcgacgaagctgatgccgaaggtggacggccgggcggacgatggagaggcctcctgatccagttgttgccgctatcgcttagagaggagctgcattgatgtgcgctcgatccgccgccgaggatgtagcccaatccacgttgccgtcgaggtcgatgccgccgctcgatctgttgaggcagacctccgcgtcggcactgccgaggtcctcgtcacatccggcgatgaggacaggaagggggcaagggtggcgcctgatggttggatggcggccaccgtcctattgccaactcacaactggacgacgcgccgccacacctccaacgccgacaaccagcccggatctcgcccgccattcgccgatcctaaaaaaaaggggtggacagcgacgggagtagggggcgatggtggcggcgctgcgtggacgggggaggtggcggcacaagggggacgccgatgtggacggggagggtcatctcggcggcgtcgaagccagctctacctcaaacccccgccgctggatccaggcggaggacgaccgccgtcgccggatcgggcgagggacagccccgccgagcccgtcgcccgccgttggcgcaggccatcgtcgtcgctcgctgctggcgcaggccgtcgccgtcgcccgtcgttggaggaagctggagggaccccgccgcctgccgcccggcacaccgaggaggcccaagccggcgaccgcccgccgccgacctgcaatcgccgctcaaccgcctgtcgcacccgcaggccttcatcgtcgctgccgatccgtaaaaagtggagatggaggggaaagtgggtgaacggtttctacgagggagagggagggagtaaatataggcctgtttggatactccggctattaactaatccataattagcggctccgggctattaactaatccataattaacggctgattactatagaatcactgtagcaaatcatggattaatatacctcgttagattcgtctcataaaatagcctagaagttatggaataggttttatcagtaattatgtttaatactcttaaatagcaagattccggagcgctatttaatagccctccgaaaccaaacatggccatagttagcagatagagttgatagtaaaaaatttactccgttaagcgtgggaggaggggatgcggggggatgggtgcacgggagggggggtggggtgtatgggggtgggtgtgagggggagcattttagctattacacaacctaagtctatgtgagtttagtatgtatgtgtatgtatatatatatagagagagaagagagagagagagagagtatatagaggtgtatatactccccccgattatccattagcatctgatagggccacggtgagtcagatttttttaaagaatgtattttccttgttttttgttttagttttgttttagtacacatctgacggagtgcatgtgtttcaaattttaaatgcacgtaactgatcgatctaaacacgtggaggcggtggagcgcacgcttctctggttcaaaatgattataccatatacttatttttcttcttcagaaagtagtactagtactagtatgtacttactttttgaatatcacgtcctttgctagggaatggtatatgcttctttatcttgtagaagtatatactatttcttaagaatggtatctctccttttttttacacgggtatttactgccttttctctaattgtatatactaaatccatagttgaaggagtatgtactgttttttaagtatccgataggtaaggattttttagtattcagtatattagtcgatatactatttttcatccggtatatatatactaaatctcatctctagccgtatatactaaatccatcgttgaaggagtatgtactgttttttaagtatccgataggtaaggattttttagtattcagtatattagtcgatatactatttttcatccggtatatatatatatatactaaatctcatctctagccatatatactaaatccatcgttgaaggagtatgtactggtttggttttttaagcatccggtatgtaaggatttttttagtattcggtatattagtcgatatactatttttcatccagtatatactaaatatcatctatagccgtatatactaaattcatcgttaaaggagtatgtactgtttttttaagtatccggtatgtaaggattttttagtattcagtatattagtcgatatactatttttcatccgagaactgctacaaaacgggatctcgttgcaacgggatagacatattaactgttctcttgcacgagtatcacaggtatcaggtcctaggtatcacagataccaggtaacaggtatcacaagtatcatagaagggtatcccgttccaacggaatcgattggttaaggaatatgtactgaattttcaagtaccagtatatattaattctctcggttaggtagtatttactgcatttttcaagtatatcgatccagtatactgaatcacttgttgaagcagtatatactacttttcttatgggattcggtatgtagtatagccataattgatattcaagctatctcagaggtcgcccaagtccccagagccatcgtcctatccaaattttacattggttttccaattttgttaacaacgcataatcgtactaagtcaaaagatactacatcgtcctcagggaccttgctccgtccagtccagtgcaaaaagaaaagctatagttttcaaggaattcaaagggtagggaacacaggtagctcaagctagctaggtcacattattttccgaaaaaaaaagttgcaagttcacgaagggtggaagaaaggaatcttacagtggtatgatggtgttcatgcctttcttgccttccatgtttcttaagcataacttctccctggcaaatgttctttctcctctattttccatctccaactatgtcagcaaaagaaatctttgtccgtggaggcaagcttatgttctcatctataaattcatgttcatcaacacccagccaggg

SEQ ID NO: 67456 - DNA, 721 bp, Oryza sativa
taggcaggacaaggttggtacacatgttcctcttgtatatggccttgtagaccctttttaaaacactggtttgaatatcttgcacatgattctcaagtctaggataaaaatgttctaggtacgtatcaaagggtaagaggctcttgaagaaccagcagctcatggaagagctggaaaagtcactagatgacaaagttgagaaggagaagcttgtcgaaggctttctcggttacatcatttgttcgacacaggtgatttcactttaaaatcataatctgttttcagacaaagtaaacggtgataaactggagctcattacattaagcaacgattttgtttgcaggaagcagtagtactcccaccgtttgtggcattcgctgtcagaatgaatcctggtatctgggagtacgtcaaagttcactctgatgatctttctgtcgaaggaatcacaccgtcggagtatctcaagttcaaggagaccttatacgatgaaaaatggtatgcatatccatgatccactaatccagtacgtagtagctaatgcgaacatttccatatacagattgaagaagaacaggagcctgaaacttgaaaaaaaaatggtcgatctgaccatgtgcatttcagggccaaggatgacaactcactggaagttgatttcggtgcccttgacctctcaacaccccatttgacactgccctcgtcaatagggaatgggggg

SEQ ID NO: 67457 - DNA, 1666 bp, Oryza sativa
tgctgatattttcaccaaacaattggattcttctcgctttgcttttcttgagagttcggaatattcctccttttagcatgatttgagggggagttttgtactcttgattttatcgagcaacatttgacaattaaaaaaattgagaaaagagagctttgtttaatacatatggtatattcttgtgcatgctagcaatactatgaaagtttctttatctctaacatagcttgtatgtattctagtccttttatgaggcttaatattgcttttaatggagatgatacatgacacttcaaattatgtacttgaattaagcaaatgcagtattgatgctagcgcatggtttgattgataaatgcttatgtatatgatttattgaattgttattcctcaaatagctttttaattgctcattgtacatgagaataaaaaatatctaggagagaaaaaaaatgaatactaaatccttgaaaacagtcttgacgacaaggacgtattcgatgtgagcaaaagtaatgggtgacttatccttgaaaacagtctttgacgacaaggacatacccggaataattgagggaaaaaatgagcaaagaggctcaaataaaatttaaaaattctctcaattattttgtgttagagctaatttgagaaagagtgataaatgcatttaatgatatatatatatatatatatatatatatatatatatatatatatatatatagtttatttttcaacctatgtgcttgaaaggatgttgcattgtaaatcaataaacaatcgtatgtacatattgccaatcaataataaacacaccatatatatgattacacattgtacacaaatctcacgcaagtagtagttagtatttcatacatcggtatcaatggaataaattgagctgcgatgtgggctggtttcggtgttgtcttggtcggaagatgctctctactcagaaactggaggcttctgcccggctaacctggttaagatcctgagcacacacggagcagagcattcaagtggattagttattttgttcatttcttcacagctaattaattaagtactaaatcgatagagatattgcgaaaaataagaagacgcatgcattcacctttgcatccgagtctgcggctttctgcagcatccaaattccaaacaacaaattaacgggtcagtcagttgcttgcccggtctttcttcagtaaatttcgtaatagcgggcacacttgcctttctttgggtctaactacgatctcactaggcgccacgcctgttgtggtttgccgagcctgttgatcccctgctcttgccatagcctttgcctgtgatattagacattgtacacttgatcagactgacatcccttcgataaagaatatactatactactcagattgatgcatgtatatattcatactaaccaggttcctatactgaacattgtagagatctgcaggtaacgttgtttggcttgtctttcctccttgtttagtgtcttccagaaggaatatgtagatcccatgtttagcactctagttgcataaatcttccatgtgtagctgccatcatggatttagttagtgccatatatataggaggattgatctaagttgtgcacaaaaacaaaaacaaaaaaaaaaagaacaggacgcatgcaagg

SEQ ID NO: 67458 - DNA, 1292 bp, Oryza sativa
agagcgtgtgcaattgttccctgtcatcaagatcatgcatttttcatgtcataccaaatcatggtaacgttggtcctaaaaagggataaccaccgtacgtgcagccatttgacaagccggtttcacctgagtgacacatagtttgttagacaagagggatgccaccaagttgccatcggtgtagttgccaattatcaagtccggtttgccctccaaaatgtcgagaattttggcacaagagtcctgaaattacgttggatggaaacttactataaagatcacaggcccgcgcaaagggtatcagtaactcatagtaattcatagctgacaaacctgcgcatatctctctagataaggatagatgtcaaaccgggacacccactggcgcaaatccttgccatcttcagtcttgaatggcacacgtagtatatgtgagtattttgtattttcaactggttcaagctccacattgcattttgtgcctttggcatctggtatcagtcttgtaagctgcaggaatatatatagtgcccactggtttagctaatctattcgtcattcatatcatctcatttatatatatatacctattcgtcattcactatatttcattgtacaggaatatatatatcgtgaaatcaatgaaatttaccacaagaattttcggtgttacgtgcagaccctgctgcttgattctttgaagcagctcctcttccatggctctgacttgatccaatatgtagacaacctatatatttcacgaaaccattctttagagttttgttaaccgataattaagttgtgaccatatttttaagagttataatgattatgcgcgagagattccagaaaaccggtaagttgggtacctgaccaccggtatccggcaatccaagaaccttttcttggccgaagtaaccatgaatagagaagatgacaatgttgaatatggatggaaccctgctgaagaacttctccatgtttgtaggatctggtgcctgtagcacttcagacagacaatttagtgtttctttgcacctctccgcagtgtcaccccatcccctctctaacccccactcctgaaatctgcaagaacacataatagagaaaacttaagcatgattacaattttttttgtctatctacaacttcagattaaagtacttcacctttgttcaaacttcaagtaaggcgtgtattttggcagcccactaacgaaaacctctgcaagtagcagtgctgtctgaagcttgctcacagtgtcgatggtgtcattaatcatcaacttctac

SEQ ID NO: 67459 - DNA, 914 bp, Oryza sativa
ttctatattagatttacttgttatatatttgaacaaacattgctacacattgagttttgtgtgttttcgttcgcagaggtacttgcttgggtgaaagaaaagagaccgagcgtaaggaatgcatggatgatgaagaagttgattggggaccaaaccaagaccttctccaagtatacttctacctcaccacgtcacttttggcctatagaagacaagagatcaagttgtacacgttttggattcggattcgggcctcctgacagcatcaacttcaaacggacctaactccctcattagttggtttcagagcgcagttgcccattaggtaatttatcttcccataaccagaaaattgccacacaaaaatatttattctttacctagacaatttgagccgttgcattgttctattagattttgctttgttgaattctaggttgcatcgtcgtgtcgagtgctggtttagttttagatttaatttttagttttgagtattacatctattcatcttttaggtctagggttcatcactcaagtatgtgagttgtacgtctgttttgggtccagtttttcatctcgttagttgttgccggcaccttgaaaaattgaatcgtctcatcgtcgggtttccgtttttgtgatttggagagatttttatcaaaccgttttggagttgccgtactgtgcgcgtgtactgtgcgcatgagaggagtactgtgcgcgtgaagagagactccagatcagatctattcgtgactatccgtattattctctctatagaattgttatgcagcggatttgagatatttttataaaaacggaacctacatgatatgagcaatccatttttgagatgatccaattttagttttgcactttgcgtttgagtccctgtaatattcatatttacattt

SEQ ID NO: 67460 - DNA, 1408 bp, Oryza sativa
gttgccctagtttcccgttttgtttagtcgttgcttggtagatttttgtgttcaagtttgtttgcttgtggggtttagctcacggtcgataccatgtgccgatggtatgacggtctatttaaggatctttaagtgtgtttttaagtgtgttttaagcaagagcagaacaattacagttgattaataaaagcaagagtaaagaggttccttagtaactgtttttctccttccctatttctcctcccgtcttctacttcaaatggtgacaacgaggactacccgttctggaagcaatgtcaattaggaacaaccgtcaggaaatggttcaggagatttgccagagaatggacttgccatgcaatgaaaaagacattcggctcttccaagcatgtactgaaattcaagtcagaaatggaaaaaaaaaacattcttttggaaggacaactggctctatgggttttgctcaaaggacatagcaccaaacctcttcaagctggcaaagagaaagaaccgaaatgctggaactgagctcacaaatgatgaatggttacactctctaagacaaattacaagcttcgaagagatccaggagctcattcaactaggaggactcttgagccgggtcacgttgctaaatgaaatagaagacatagtcttatggaaaaggagcaatgtgaccacatattcggcaaagagtgcctatctctttcaattcatcggctctcagcaagacaaggtttttctgttgaattggaaggcgttggcacttccaaagcaaaaattcttaggatggctcattctgcaccaaaagattctaacagccgaaaacatgttgattcaacactgggagtgcaactggatttgccccttatgtagaggagtcttcaaggatactgatcacttatttcgacaatgtgatttctgtaaagaaacatggaatcgtgtctctgctgtacaaggtattcaaaataaccagactttctcctctctgaaagattgtatgacatacatcatgcagaacgaaagcaaaacggaagtgaggagaaaggcgggtgttcttgtcaaaacttggtggcatatttggctacaaaggaacgcaaagatctttagaggagaagaaccggatgtgcaaaggacttcacaccagatcatccaagatatccaagaaagtagctttcaatttcaaccgccaagagtgtatcccttctcttacaaaatcaagatgtatggtcctggaacgtttctaagttgttttttacattgattcgtgtaatcctaatcatgtaaaccgtactttttccctccctctaatatattcggcaatgctcttaccgctttccttttcaaaaaaaaaaagatttgccagagaatcctacgcttgccaggcaatagcaagacagactcaggg

SEQ ID NO: 67461 - DNA, 785 bp, Oryza sativa
aagaaagaatcggtctttggttgagatggctagaatgatgttggatgattatcacactcctagaaaattttgggctgaagcggttaacactgcatgctatatttcaaattgggttttcttgagatcaaaacttggaaaaacttcctatgagcttcgatttggacgccaacccaaagtttcacatttgtgttttttttttgttgcaagtgctttgtcttgaaatttggaaatttagataagtttgaagcacgctctaccgatggaatgtttcttggttaccccgcacattctcgtggctatcgcgtacttgttttggaaactaacaaaattattgagacttgtgaagttacttttgatgaggctagtccaggtactagaccagaaactgcaggtacattgtcacaggttcaaggggaggatggtcgtattttcgaagatgagagcgacgacgaggtcggcttggccggtcagaccgggcgccaggccgatcagaccaccgacacacctccggtcagatcagcacaggatgtctggttagaccggccagggtcgtcgggttacgattatgttcatgctgatcgggatggtcctccagaggctacaacttcgaccagtgagggtacaaaacgtgaaacaactttagaagtcgccactcctttgcatattcaacgacaacgttcgccgaaacaaatcattggtaatataggtgaggggactacaaggtctatggtaatgactcatgatgtttgtacaaattctgcatttgttgcttctattgaacccaa

SEQ ID NO: 67462 - DNA, 2377 bp, Oryza sativa
caatatgaagttatctaggcacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaactattgtgtgattgagagaagagacccttgaaaagggctcattttcatgatgtgattctcttctttcctgcatggtaggatggcttatgccttaatgtgatccgagtggcttttccaagcagagatgttgacctgcagaacatctcagaaggaacacacctatatgagttcgactgctagtcacagtctatgaggtttgggcgatctctagatactcatgaaaggcctggagtttgacttatatgctccaaacagaggggatgcgaacagcagcccagtaccagtcaaggttctgagtgaaacctgatcacacaaaactgacaatttaaggcatagtccattgttcagttgtggtctgatgtagctcatttcctaggtggaagttcaacttaacagtctccaccaaaaccctggtatatcaaacaggcacaacattgagaacatttcttatgagccttgaaatttggtggggattgttagaataattgggctaggcccaacttatcctattaaatctcaaaggcccataataagtgttaaggataataataccacctcaggatttaagcgaggaatatctcaacctaaatagagagttattggagactccctgttgaccagttgaggtggggatcggaatgccacacgcgcgcgcgttgggccgggacgagggcgtgggcgtgggcatgggcgtgggcgaggcgaggcgtggctggcggcgtgcgtgcgtgcgtacgtcacgtcacatcacgtcgctatccttttgcagccactaacccacgttcccacgattccctccgcaacagcgcgtccacgttctttctcctgatagataaggaggccgcgagtccgatccagtttcattgcttctttcccggtgttagtttctccttctccatgcctgagttgctcttgcttcctcgcttctgatctcttgcgcgcacgagagattggaaggagcagtgcctccgaaaccacaccttcgcctgagatctgcaccgggtaggcttgtgatcaggtttttggggagtgcctcccgcacgactgctcatcgccatgtctggagttgccgccgccgccgctgctggaggagatggcggaggtggtgcgccgccgacaggagctggatccggagccggagctggtgcgccaggaggtgccgtgaacgacagcaacaacggaggcaattctgcctcaccatccagcggagggctattctcggggtataatcttctcctactgttcctgttgttagcgctattcctgttcccattgttagcgctatcgctatactatgtgcgctatgttcttgttcctgttctgttcctgttcttcatgatgcctctagcatgttattgcgttactgttatgttcctgttcctgacattcatgatgcgcatagtatgatactgggtatgttaagatcaccctacactgcttatgccatgattattgctttaacattttggattaaaatatgccgattaatgactatatttccaacaaatggcaggcctactgcgctgttggaggtgtggacagcttccaaggtgactgggagaagttgtacgacaaggtgaataacgcagcttacacatgcaatgccgactcggacgggttcaagatagatgccagtactgctaccggtgacagccccgtcttcacggcgaccatcaaaatccatttcagtgaatgaaaaaaaaacaagatcgaccacatacatgcatgtcattcgctcctgttgcacggggcacgctcgctacattctattgctgtatcagccagtcaatggatgtaatgttattctctttcgcaaaataatgtagctgttactgttgatcgtgcgaaccgatcacaccagctctcgtttgtaatgttctcgtcttacatattataataaacacgttcagccatgtagtgtgcaaaattaaagctatttacatctttatctttactacttaaaagagttttaaaaaagaaaggcttaaggcaaggtgatccgtatctccaattatttttaacgttctcgtagacgtgttagctatccttatcaagcgtgcaaaggaggatggacatattgctagactaatgccacacttgattgatgatggtttatctattctgca

SEQ ID NO: 67463 - DNA, 2087 bp, Oryza sativa
cgggtgactcacatttctattcggtcaatgtacttggcattaatttttaatgggcatatggagagaaataaattgttacggaaattaaatatgcctattaaaataaagatttacgtggtatttacttaaaggggtgttagctagccaaagataatttagcaaaaaaagaattagaatggtagtaccaagtgctgattttatttgcatgaagagactatccaacatctattctttgaatgccatgttgctattagttttttggagaatcgtctttatttcatttttgttgcaaacaccagataattttcctcaagtgttaggggattggctagtagctatgaattctaaagccatggaatatattttgataggagaatctgctttatattaggctttatggctaagtaagaatgatatggtttttgacaagactccaactaatatgcatgtattattcagagcaatttattggctttggttctggggccagcttcaaaggtgtgacgagaaaaagaaaatcatatttgttgcatgccataatttaaagtccatagttatgcagtttttcactcgctttggatagacatttagccatagactttaactttgaataagttgctatttttctttggttggtgcggttgagtcggttttttatctacctttgtttatttctcgtgtgtttaggttttgtaataagtggtatagcttcaattgaagcaaatgttgggtggtattacccattactatttttttaaaaaaaaaacgtaaaagaaactagctagtggtggttcatcatctgtcatttgtcactcctagacacgcggggtccaccaacagagtagtcaccccttccccttgactgctaggccttgtttagttgggaaagaaatttaggtttggttgtcacatcggatatatggatacacatttgaagtattaaacgttgttgtcacatcctgcttttcgtttcaggatttataaattatttaataaattattaatagattttatattaaatgttcattaatttacgagtgaagttaaatgtgggaaatccaatttcctaaatataaagcatggttggatttaatatttattaaattctccatgattaattatactctctgaaattttcttggatttttcagagctcaattcctaaatgatacaaagaacaattcagtaattagttaatcaattaatgatctaattataattatgttaagtacttttcttgtttaaaaatccttaaattataaattgttgtttaaaaggatttttagaaatgattttaaaagcctaaaagagaagatctaattttaatttgttaattctcaatataaaattgggctagataaaattttgttaaatacttctcttgattctttagttcctagatttttctgggatttatttgagccaaggaagtatttttaataaatggaattacatttcatgaataatttaaattgaaaaaggttttaaaatttccccttttggctttgggccgaaagtcggcccaagtctctctctctttctctcctcggcccaagttggcccgcagccgggcgcagccgcccgcgcgcgctctccctcccgctgacaggtggggcccacctgtcagacccgtcgtctacctcgtgctgtcgcccggccgaaccctagccgagcggcgccgccgatctccttccaaattcgcctgcccctttcctcctccagccgaattgtttgaggggaaatgatcctcgagatctcttccttttctcttttggaaacatcggctaatttcgtttggaaatcatcggattcgatctcgaatcggattcgtctgtctcccccgaaccctaaactttccttctcgccgccggtcgccgtgggcctccatcgccgctcctagcctctataaaagcacccccgagacctcctctctccgccgccaccctcgccttagcccgctgccgtctgtagcgccgcctccacgtgagaccttgcgccgctgtcgccgccgtttgtctagctgtgcgccgccgtcgctccgttcgtcgtcgtcgctcgggaaggccgccgttgtgatcaccaagtcg

SEQ ID NO: 67464 - DNA, 1843 bp, Oryza sativa
atgattaattactctactgttttataattctcaaatgtttgctaaatgctgcttttgcaaatgagccctatataatgccatccttttggtatccttgtgcacttgcatatttactgtgtggcttgttgagtatgtcatatgctcaccttgcaataatcaatcaaacctcagttgaagacaagttgcgaaggagaagacgtttggcttataccccagttgagctgcctgtgggagtggagccggagctttgctagattttattttccgctgcagttttcttcatggtgaggactaagtgcctcttaagtaagtatttatcgttttagttaatttgatgaatctgtatattaaattgtcagtttgtgtatctcggctgattcatggacgaggatttaatgcacaaataagttcggaaattactagtgaatttctgggcgtgatagttgtctaataataaaacagattacagattccgtcaggaaactgcgagacgaatttattaagtctaattaatccatcattagcaaatgtttcctgtagcacaacattgtcaaatcatggcgcaattaggcttaaaagattcgtctcacaatttgcacgcaatctgtatcgtaattggtttttttcatacatttaatactctatgcatgtgtcaaatattcgatgtgacagtgtgaaaacttttgttttgggaactaagcagggcctaaacctccaccgatacaaacggcaagcaggcatgcatgcctcgctaccctcagcatctccatgataccgccaactgtctcccttgcatttcagcagcacaaattgtctcaactaatggtttagaacaatatgttaaatatcaaatagttttaaatatctaatgttcaagaacgatagatgcctgccccaactatgacaaaagggaattgaacttaagacctcccactttcgagtgagagaccaaatgaccaattatcatacaacctttcatgcatatctaaatgacttgggctttctatttgaatatttattaatctccactttcctgcccaggagttaccattttcataatcttctacattacatctttacatgtctcgttgtgtaagaccgtttggaattattttgcctaataatagtagtaaatgtttcagttcaagaaacaattgaggatttaataacaagctaacagtccctttttagatggagttaacaattccaatggcatggagcaaatctctgaatccattacttaaaaaacaatttttctatacgagaccccttatgttgcatgccgtccgtaagtgcgggcttctacaaaaatcgacctccattttcgcatacggctccttaagaggtcctgtaaaaaatcgactttcgcaaatgggacacttaggccgctgcgaaaatgagtttatttttacaggtggacctcttatggtggatcaagaagcaatagattttcacatgtggacctattaagttgatccgcgtggagggcgaatacggcgacggcggccctcccccgccctaatccagtggcggctgccctcccccgccccaatccaatggtcgccgtcctcccctgccctgatccagcggtgatgatgggaggaggaggaggaggaggacagtggcggctaagggaggacagctgcagcggctgtgaggatgaggatgacagtggcggcgactggaggatgacgacgggaggaggacaacatcaatggtggtggctggaggatgaggacaacgacgacgatggcggcgatatgaggaggacaatgttgacggcggcggcaggagaacgacgacggcagcggcaggaggacaaggatggaggcggtggcaatgt

SEQ ID NO: 67465 - DNA, 3129 bp, Oryza sativa
atctccacatatattttatgtatgaattttttgaaaaaaattgatcgaataaaaaccttccattttgtacattacatgtttatttattttctgaaaatataatatctgatcgatattcttcttggtactagtagctggtacagtggagtagtggacagaacattatatattcattgatgtgagacacgcttatttatttcgagcaggatgacagggaacaaagccagcgcaccgacgtgagaaaaatagccaacaaaagaacagtaacaattgaaataaaatatatcctatatatctataaagttcatcctctaagtgtaattaatgttatttcttttttctctcattaatccacatcaccttaattattttagttcttgatcattaatctatggtccaaattaactctatccttttcttctcttaatggagtcatattaccttagttttgcctttggataattatctatattatctgttttcttttccttctctcattgagcacaatcaccttagttttgctttcgaatgagcactgtaagtatgatttaaattgttataaactaaatcatcttaatttgtttatagccttcttttcctctatggtcgattaaggatgaaagttatataaaacatataaagttatataaagcatataaagttatgttgttaagctattttacatgttatttctattattatcacatattttttttcagtaatgtaggggtttcatctagtatataataattggtaaagcctttaagtggtgttacttactgaaatataggtaagcggtaaaaacttctggctgagtacttcaccgtatatctatcatctctaacatatcactgcaacaaatatggcattatatatattgattcatttccttgtgacgactatgcaaaacgtcattgatctataaagtttccttagaaaagcatcataaagattagttggtttattttagtaatgaatcgaaggcagggaaaagttatttaaaaacatatataattaatgtcttacaaaattaagctttctaacaactaataatctcatgtattttaatttatagagttcatgaccgtaaggcatagttggagtcctgaaacctgcctatcaacgatataatttaaaagtacattttacgtgtaaggtaccgttgatcgagtgtccatccatcaagaagactataacagaaggcacaacagtgaggattgctaattaggacagtattttcgatatgtgcaagagaaaatgagatggagggagcatttgggggatttgagtgtcattgtagctaaagggggcatatgcgacacgctgcgatgtagaggggctgagcgccatgttggctgtcagccatgaacaaagggtgattggactagttcactgatcttaaacatgtaattttcaagtgtactaagctaagtgataccacaccacaagtttagagatcatccatgtatttcactctaaaaccaataaggtattttatctgatttgataattaaggtggtgcaaaatctgatttatagatgtgagtaattgatttctcgatttaaacatttagtaatgggggcaaaggataatctttatgtggtatttgctcaagggagtcgtcttaacaaaggataatcttgcatgacggaattggaatgggggtttaacatgttgtttttgcatgaaaaatgagacaatccaacacttatttatggattgtcattatgcaaagtttatttggagagctgttcaattttcttttggattacatcttcctagaagcatacctcatatgtttaatggttggcttcagggtgtggacaaggacaagagaaagttgatacttgttggtgcctctgctttatgttgggccctgtggttgtttagaaatgatagggattttgacaaatcatcatctgtttcctatatgcaggtaattttcagggcaacatattagcttcggctgtgggctcaactacaaaagtgtgaggaaaatagagttttcctgaatgttgcatgtcgtactcttgagtcaactgttatgcaactttttgccaaccatggatagagattttctactaggctggaataacgttttccttgtcatgttaggtctttcttttaattttggttggtttgatagttttatcttgaattaagattttataagtctattacttttttaataattggctgtatctcttcggagtaaaggccgagatgtttcattccattatctaaaaaaagtaatgggggcaaaatgaaaattccacttttggttgccggtgattcatcgcacaaacagctaattaatggcaagatcgacagggatatactctttgtatattggctaatcttaccaggtgaaaagagaatttgatcactggagcaagaagagccacgccatctgctgcataatggtcctccgattgaaaagcaaacaaaaatagtaaacactactataaaaaacatttttcccgacgtggggtcttattttcgtaggcggacatgacccttagagccaaataaccgtctataaaaatataaatcagggtgaattttgatgtccgcctgcgaaaatagacttgaatataaatagacttgcgggcgctaattttttttctaagtctcacacctttcctccctccacacctctcctcttctcccctcccctcacctctcctcatcggcctctcccgtcccctcacctctactctccccggccaccaaccgaaggcggcggcggctcccgggggtggcggcgtgtgctcccgacggcgacggcgggcggtggcggtggcggcggagggccgcagcggcaaggaggcgaggcggcgcgtgacaagggggtttgaggcggcggcggcggctcccagcccccccctcccagatctggctggaggggagcgggggaagcacggctaccggcggctcccggcccgtccctcccagatctggctggaagggggaggggggagcgcggcggtggcggcaggcggtggggacggagtgtggcattggcgaggaggcgaggcagcgcggctcccgacaacggtggcggcagctcctggcccctccctcccatatctggccagaggggggcggggggagcgcggcgacagtggc

SEQ ID NO: 67466 - DNA, 5797 bp, Oryza sativa
  unsure (1)..(5797): unsure at all n locations
ccgaaattcaacccattgtactgacaaacccaagatgccgcttctgctgacaaatcacccattgtaccaaaatttcacgaatgccacgacacacttgagctcgcacaatcgcagccggctgaggcaccacacgcccatgatctaagagtggcagtgggggtgtcgaatagggcggatcaccatgaaatggtttcatcagactgacgtgaaaaacattattcaatcgagcaccagcaggcagccgcagcttgtaagcaacatcgccgatccgctcaagcacttgataaggcccataaaacttagaattaagcttagaacgggaaggcactcccaaagagaccgcagaacgccgaagcaatcgcagccacaccgaatctctagtatggaaggccaagtcacggtgcttggcgtcatagtatttcttataaacctgttgagcctataccaatcgatcacgaatataagccaaaaaatcatcccgattacgcaaaagctgatctacggccgccaccttggccgtacctggctcatatgattgaattgttgggggattcctgccatacgacactttgaaaggtgtctccttcagcgacgactgaaaagaagtattgtaagccactgaagccatttgcgaggacgatcaccaactagacaatggagatacatagcaattgtcttgtttaatgcctctgtttgcccgtctgactgtggatgaaaagctgaactcatgtgcagctgcacatttgctagacaaaaaagttcttgccaaaagtggcctgtaaaaaccggatctcggtcactgacaatggataccggaatgccatgcagacggacgatatcatcaaagaaagcggcagctactgaaaaagcagaataagggtgcccaagcgcgatgaaatgcacgtaccaccgacaaaatcactgacttgccatgaaacttgggaaatccttccacgaaatccgtagagatgtccgccagactttgcacggaatcggcaaaggttgtaacaaaccagcggtgtgcaaatgttccactttgttcttctagcaaaccgtgcaggcttgcacaaactcctggaccaccgcgcgcaagcgaggtgtatgaaaatatgtgccttcacccgatgcagtgtcttctgtatcccttcatggccggcattgtgggctgctgcaacgacagtgtggaggtgcgccgaatctggcggcaagtatatcttcccaccgaatgtcaggagaccatcaatctccccccaaggcccctccactgtacaagcatgtagttgctgccggagcgcctggagtgctggatgtgctgcattctccgctcggagcaggtcaaacaactcaaatgaggggggcggaaagcgccatagcctgcggcacaatatcggcatcacggcgggacagggcatcagcgacagtgttttaacagcctggcctgtactccacccggaaatcaaatcccagaagcttgctcacccatgcgtgttgtggaattgttggcaagcgctggtccagcaaaaatttcaggctataatggtcagtatgtaccacaaatgagagaccccagacgtatggcctccaatgccggactgcttgaaccaacccgatgagctcccttttgtaagcagcgaggcgagcatggcgtgacgctatcggccgactgaaaaacgccctggtcgagcaccttgatgcaggacggcaccaaaccctgcacccgacgcgtcacactcgatgatgaagggctgcgcgaaatctggaagttgcagtgttggggcagacgtgagagcgtgttggagcgcccggaacgtgcgctccgcatcatcggaccaagcgaacgctgccttcttgaggaggcgtatgagggttgccgcgatgacgccaaacccttggatgaaacgccgatagtatccggcgaggctgaggaaaccgcgcaacgctcgcaccgaacgaggggtcggccaatccaataccgcctagactttctgtttgtccacagacaagccttcgccggagatggtgtggcccaagtaggccaccgacgtgaanccaaaaaacacttgaggaagaggcggtgctgctgcaacaaggagaacacagcccggatgtggcaaaggtgctccacccaggaaggactatagatgaggatattaaaaagagtaaattgtattggtagtacacaaacttgttaggtgggtgcaatttagtacgtaaacttgtaaaatgctcgtttaggtacacgaacttgtctagttcatgcgaacgaggaccaaaatagcatcgcaatgttaattttacaaagctgatgttgattaggatgtgacgtgcatacgtgtagtgagtatgcattagacatataatatttataaatttgatatgtactttatccttcatcatggaagtgatgaatttcatatatttctaacccttatatcattgctcgtttttttatcattttctacgatcactatatcccattctatttttattgaagaggtgtttatctaatagcaaccttcttagatatatgtttacatagtatcctgatgagcccctaaatcagtaagattagtcacgttgtttccttttctccttcctccgcacacaccagacaagttcatgtgccaaaatcagcattttataagttcgtgcactagattgcacccacttgacaagttcgtatatcggcgatgcaatttactcttatcaaaaaatacaggtacgaaccggcggaggaacgggtgcaggacttcgttcatcaatgcttggaacgtggccagtgcattggtgaggccgaatggcatgacgaggaacacgaacaggtcttgatgcgtgcaaaatgctgtcttctcaatgtctgccggccacatacggtgtgatagccggaatgcaaatccagcttagtgaagtaggaggcgccttgcagctcatcgaggagctcctccaccactgagataaaaaatttctccttgacggtccgatcgttgagagcatgatagttgacgcagaagcgccagctaccatcctgtttcttgacgaggagcaaatgcacggagaatgccgaggagctgggtcaaatgatgccttgggagagcatgtcggcgcactggcgttccaactcgtccttctgatgttgcgcgtatcgatacagccggaccgccactggcctagaatctgggaggagatggatgtgatggtcgtgattgcattgtgacggcagtccccgaggctcgacgaagatggtggcgaactcctccagtagaccagctagcacgtcggggccagagcacgcgaacgcgtgttcacacggcttgtcgatgggggcgccgatgctaagccaagtgatctggcagccagcgcgcgtgagagtcagttgcaacttggtgaagtcccatataatctgaccaagagattacagccactgaatcccgaggactgcatcaaatgtgtctagtggaatcacaaagaaatcagagaagaatgcttcattgccaacgaggaacatcacattgcgcgcgacgccagaacactcgaggcgatcgccgttggcgatgcatacccgaagaccatggcatggactgaggagcatgctggggtcggtagcgacatcggcgttgatgaagttgtgcgtggacccggagtccaggagcgccaccagtcgctttccgttgatggtgatgtggagctgcattgtctcgctcccaggaagacggacgcccgccatggcatacagggagattccagggtccccatcctcagcattcggtgggttggtttcattgtcgtccgccgaaggagcgtagagccagaacaagcgcttgcaacgatgccccggcgtgaatttttcgtcgcagttgaaacaaaggcccgcctcacactgggattgcatctcttctggcgtcaaagtgcgccgagctacgcgtgcagcccggacaggcgcagcggcacgcgctgctgctgctggagcggctggagcagatgctactgctgctattggggcaacgtgtggcgctgctggtgacgcggctgggcgagttgctggtgcgcgtgcgggtggcttggccggttcgattgggaccgggtcttctatctgcaccctcaactcatatgcacgtgccaaactcattgctgtgtccagcaatgcgggtgcctccagctcaacgtcgatgcgaagcttgccctgcagccctgcggtgaataactctattttttgtacctccataagtgggccagcacggctgagaagcgacatgaatttctcctggtagtcagcaacggaaccagtgcggcggagttcggcgagggtccccaacttgttgtggcgaagagggggcccgaagcgcagttccaccatctccttgaagcgtctccacaacggcgtgccgtaggcttcttcagcatgcgtgtaacactcctgtgcctcgtctgtgagatggaacgctgcgatccaaatcttctcatcctcaacggtgtgctgtccatggaaaaattgctcacaacgacttagccaagtcattgggtcccctttaccattgaagatcgggaaatctcacttgtggtagcgtggaacccgactgtctgttgtgccgtcatgctgatgctggtttgaggccgagggtttggtgcccacgatccccttcgtgtcgacttcagcgatcttgttgtctaggcggctgatggcgatggtgtgatcagccatcgttgcctccatccgcttaagttggtccataatggcggtcagctgcgacgctgtcacctctatgtttgacggtagtccagacatggccataggcggacgaacgtgctctgataccaagttatcacgcccgggcaacggtcgaagattatactgatggaacgaaggaggccgcggtctccgctgacgtagttggcgaggtatggtgatgaactggtatagaagaaagaaagaaactggcaaggaggaagaagagaattgagggagaaaacacatataggagattagagattgatttaacttttccttaattcctccttaacgattacatctctttaaataaactctaactctaactcttatccaaacaaaccaaaaccaaaaagattcaagaagtctctccttcgacaccgtgcgcctgctgccgagatcgtcgatgatacggaatatccccccacatgacagacaccctatataatattcgatgtgacacatcaaatctttacacccctggatctaaacacccccttaggcctcgttcggcaacaagggggaatttccccagggagattcacccaagtgggggatttggtgaataccctcccgccacccaatcccctcatcaatcccttccaccatgggattagcattagatttgttcggacaggtaggggattggtttgtttggactagggacgaaggtttcaccattacaaaagattttaatatgcggcgcataaagttgcagaaattcaaaacaccacccagaaaaatctaaaaaggaaagaaaaaattacgaaaatggtaaactaactaagattggttgcacaatagtctagaaagcatgtcaattcagactataagattagtgcacattgagattatagatacaaatgtagatagctattacagtaacaagtagcagggattaaattgtacaaaacaaaatgacataaactgaagctaaatcattaatatctaaaagctaatcttggttgctagaaattccccaaattaattgcacatttctcaggtacatcacaataatagaagcgcgttattgcaagggtattagtacctcctccgttagggctgcaggaa

SEQ ID NO: 67467 - DNA, 2624 bp, Oryza sativa
tgagaatattgtgtcactgacagcagaacaacaacatataatagctacttctataaccaatagtttgtaaaccacatgtttaacccctattgaaatagcttaactagcagcagtcaacagaaactatacaggttaatagaaactacaggccaatagacaattcatatatccaaaatatcaatctccagaagagatcctacaattttcaaagttcacaagaactaaacactacagtatcaatctcacattatccaaaatcaagaatttttttcttcgacacagtatactcttgattaataaaagtagaaaatttcagttccaagactgaaactctgaagcatgacagtcacctaaaaagtgtctaattgcgggaataacatcaactgcatgatttctctatttatacacttctaaagatttggtgttggtctacgaattaatcaaaaaatgcacattgaaaggaaaaatggcacaatctacagtttcagagaactgaaactcccaaacctgcacatgatctgagactgaattttctagctaaatttcagcaacctgaaccataatttcagaatttcacaattcagaattgagctcaatttcagcaggtccccaacatatacactgcagtaatgcagtcagtgggcaagaaacacaagcacatttagagtgtgtagatggaattgatgttcctactcttgttgtttttaaaaccaaaagaattgcatattcctgggaagctgttaagaggaagatgtgatatttctctgatccatttccacagtgaaggacgcgtttcacaaggggcatcctaaattcctaaaaatgatggcatcctttagagaattacggggtcatgggaatcaacaatcatcttcagatttcgtggaacacgtgttgtattaacagatccaatggccaaagcagttgatagtcactcaaactaccagaattaaagggaaaaaaacaaaacagaaacaaaatcagaacaatatcagattctatgctaactgactggaatatacttgctgtcaatttcagctaatgactctgaacaaacacatgccattctctattacaaatgcatatgcgccattctctagaactaatgcacagcaaatctgagcacccaatgacagtagtaaaacttagtactatataaatctgagcactgtttaacagaacattatcgaaacacaagaacagttaatttaggcaagacataaacaatagaaactttaggcagaacatacctcacaaaagcacccaatctcatgtatatcaaccctgtcaatacaagaaaaccaggtaagacaacatgctctgaaaattcgtgtgagctacttactacactgcagggcttgcgttgaaagctgaagatagcaatgttagccaaaactagcctaattaatagtgtgaaattagaagggtaggttagtttagtgttttgccgggtataaaggcttcaggttgggttaaattaggatgcttgttgggtggattaacacttaacagccgcaactttagaccttagacacgccacaaatttatcttgaagctaattgtctgtaatgctgataattgacaagcatgcatgtaccatcttgaatcgtcgatggagttcagaagaaggatggtgtttgacatacctagatgatgtagcagaagatgctcctcgtggttcttgttggagaagacccggtgtccggacagaggtgaccgaacagagaagtaattgccagcggatcttgcatggagggatggcagcaaaacataagcttcctcatccacacgagcagcgacggggagaagagtaaggggctcacctgatgtctgcactggggaagtcagtggcggccgcggatgtgtctacaagcggctgctccggcagatcagatgtgaggcggcggcggtgtctacagtgagaggaggcggcgacgcgagcggatgcggtggaaggcggcgacgcgagcggatgcggtgaaaggcggcggcgcaggaggatgcggtgggaggagccggcgcgcgacgggacgagaagagcggcacgggaggcaccggcgcgtgacgaggagagaggcggcgcctggttcttgcagccgtttgatcagggcatcgcctggacagcgtagattaccccaacgacggttgaagggtatttccgatcatttcaaccgttacaaccgtcattagaaggctataaaagaagccgtctctctctatttttccacacaccttaagcaaaaagcttcatttatctttcaagtttagtgtaggctctagagtatatagtggaatagaatcttcagtcctcgaagtcttcaaaagaattcgggtatagctttagtagcttttccttcttttgtaagaattgtacattatttagaatactcttctttgtactattttggtattgtactattttccgagtatatgaatatcagttttattatatatccgagtaatatttattatgatgctagcttatctgggagatggaatagtgtgggtataatgatcgtgtatacgatgactatgtcattacgatgatattagagtagtatttggtaatttaagcgtggtgtttagattactggatatcattatttgtggttatatgtcgcgca

SEQ ID NO: 67468 - DNA, 2324 bp, Oryza sativa
ccgagcgtgtatatagtcctaagttaatttcccgaggagggtacttctccgtatttagccccggttggatggtcatgacggattgtcgtaagaaactcggcaattggggatggcttctcaaagcaccatgagggcatcgaaaagagggtattagctaagtaattatataaataggatgtatgtataatatgtatgtatactagaagtataggaataggctctttctattttcttcccacttgcctagataattacgaatgagagtatagatgcttctgcttagtgtcactctacccttgatttatattaacccctgcctagactttggttattacaagtcatatataaattattagtacggttctttctattataatcttcccacgggattaaacaaatacgatatccttgaaatactctcgggtgaaatgctacaatagtatatctctgcgcttacggatgaactctgtatatttctgcaccattgctgggaattatatttgtagtaatgtcgttaaaaaatattaacactacatcatgatgttgatgttagtgaactgagcataagcattcagttgccattcctgcgtctgtgctatgtgtccttcgaggttgtattggatctctcccgtttgtatatcacgggtgtccatcctccttgtgatttctcccaagtcccaacgagaggaacttgagcgccactcgttgggggacggaggcataccgcttgatctgggggaataagtgttcatgttcccctagtgtatgccatgaggcgcccgccatcagctctcgctggcactttcccagaccgagcctccgatgctgtggtgtggagcttgggtccatccgagtgcatccccagttggcttccaaccagcctcgtacatctgcacagatgttgaggatgttgaaccttcttgattcatttcttgccatgttgcgtgtgtccctgtactgatgatacggatcgaaattgttagaattggtatcaaatatactagtcctatttggttatttggttacagttggacttggagtagtaatatgtgttagggggtggagtcagagtcaaactctgtaacccggcatttctcttaaatagagagggggcaccacaatgtaaccgtggcgactacaatgtagcgtagacatgtagaaagaggatgacggcatggccatggactcgtatgaatatcaccattatttttttttgaaaggagtcaccattattaattttgatagataaatgtcccttttatttgctggaaactaattgttacatccataactaagaaaccaaagtctcttaataaatagatgttctatgcacacgtacgcgtgcgcatgcacgaattattaagagataataaaaaaaaagatacttgatcgatcatacacagaattcttgaaagttaacaatattatcgtgactccatgcatgcagacgatgattattattatatttctatttcccttgtcactcctctgggagagggccaaacttgtgctgcagaaccgcgatgaattcgctggaggtgcagccaccaacgctgacggttgatgcacagttcttgtcggtttggtctgtgcagattttgccggccttttccagtttctcttctttgatgtaaccccagtaatttgggaagtgatctttctcacgtacctcggtgtaagcctgcgacaagaaaaaaaagctttaattcaattctcttttaagatttagattattggtctatataaaataaaaccccctctttattaagctcggttgaccttatttagttagttaattactccctcaggttaaaagtaattgttattttggacatattaatatttgattagaacaagattttacaagtgttttattacaatatcaacaattattaatgttggcatcttgcgacgatgagtggtcatatttgctggtcgttttcttacagagttctgcgtggcgctccaaggaagggaccatgcgaccatgaagtcccggacctggccgtcgacgtcgcggccgcggaagacgcgcgccgcctcgcagccgatcgactgcgccgtcgggtgggcgtggaggaacgccagccactggccgttctggaacgacgccggcggctgctcgtggtagacgtagccgtaccagtccatcgacccgccctccccgtcgacgagctccagcgcggcgccggtggcgttgtagacgagcaccatggcggagacgccgtcgccgtaggaggccttgagccccagcgcgtgctgcagcgcgtccaggttcttgccctcggcgtggatgaggcgcatcgcctcccgcgcgcggtcca

SEQ ID NO: 67469 - DNA, 16320 bp, Oryza sativa
taggtaagtctcagcttacatgaatcacgtgatcatagataggatctcacagacctgctgatactacaagataacataaattatagtgagcctgttattgtttaatctatattgcttatcacgccacaactaatttaacacgaacaatcaacctagattttcccgttaatgtgggagttcctagctagtatagacactagctagacagagatcgtcctcttggggatagagtactactagtactatataagaggggggagttgagttggatcatgtaagctaatagatcgagctggattagctagatcgaccgtataagctaatagatcgatcgatcgagagatggcgaactgcttcggcgatgttgtggacaactacaagctggacgagatggagaggtacgtggggaaggccaagaggcaggaggaccgtgcacgggaggccatgaacctggtgaacgaggacggcaaggacaagaaggcggccagctacgtgcagggcgtcaaggactggtacggcaacggcgagtcgacgctgtgcctcgtctacaacgccaccggcgccaccctccgccacgtcgccgaccacgactggtggggcttcatcggccgcaccccgtaccccaccgagatcggcaacggccagtgggcggcgttccaccacgtccacaagtccggcgactcctccggatccgaggccgccgtcgtgtaccgcggcaccaacgccgacggcgtcgagcgcgacctgctcgtcgcctggagcacgccatggagctctttctaccggaacaaggtatattcatatcaaattattcttcggcgccattgctaattaaaattgtgtcgccatttcgcagtcgatttttcctcggtattttccaattatctccaagattcatgctagtattcttcctgttcatctacatcgtatcagatgtagaggtcggatttaatatccattatctggtttcggctgtcgcggtagaaaacgagaatattaattaataaatatataaacgtatatatgtttctctttgttaatggcaggcctactgcgctgttggaggtgtggacagcttccaaggtgactgggagcaattgtacgacaaggtgaataacgcagcttacacatgcaatgccgactcggatgggttcaagatagatgccagtactgctaccggtgacagccccgtcttcacggcgaccatcaaaatccatttcagtcaatgaaaagaaaaacaagatcgaccacatacttgcatggcattcgctcatgttgcacggggcaggcccgctacattctattgctgtatcagccagtcaatgaatgtaatgttcttctctttcgcgaaataatgtagctgttactatcgatcgtgtgaatcgatcatgtacaccagctctcgttttattacatattataataaatgcgttcagccatgtaatttgcagcattaaagcaaaaatatcagtatttacatccttatctttactacttaaagaaccttttttttttaaaaaaaggtttaaagcaaggtgatcctttatcttcaatttcttctttctataaagctaatgctcactaaacacctaaagcacaacatgcaagcatagtatttattagtactcctaaaacctacatacaagcatgccacattaacccaagcacataaagcttaacatgcaagcatatagtaattatttctacaatttatttcattctaaaactaaacagacatatgctaaatcatcattctcaaatcattttcataatatttcaatccaaatcattttatcatttctccaatatctaacatatatcccgtagaaaagcatggggcatcatctagtttttaatattatcatagacatgttagctatcctaatcaagcgttcaaaggaggatgaacaaattgctggagtagtgccacatttgattgatgatggtttatctattctgcaacatctagatgatacattgttttttatggatcatgactttgagaaaactaagaatatgaacctaatactttgtgtttttgaagagctctcttttcagaaaaatgaaatattctgctaaggtcaagcttaagataatgaagaacaatattctattttgtttgggtattgttagggatatatcttttctggttaattatcttggttttccaatacatttaggaagctgactaacaagaattggaaattgttacgggaaagaattgagaaaagcctaagtagctggaaaggtaaacatatgtatgtgggtagaagattggtttatttaactttgtattaataagtctaattatgtttatgattttttttgtttgatattcttagaggagtgcttcaaaagattcattattatagatcaattttcttttggcaacggataaacttaagaaaaaaaatatagacttacaagatgagatgtcatctgtcaaccaaaagaatagggtggacttgggttttataacatagatattcaaaaccaatgtcttctaagtaaatggttgtttaagttaaaatacgaagatggagtatgacgagaaatgcctaggaggaagtaccttaataataagtcaataagtcaagtagtgaagaaaacgagtgacccacatttctattcaatcaatgcactcaacattaatttttaatgggcatgagagaaataaattgttgtgaaaattaagatgcctatcaaataaagatttatgtggtatttacttaaaggggtagtgttagccaaagctaatttagcaaaaaggaattggaatggtggtacaaagtgatgcatttgtttgcatgaagagactatccaatatctattctttgaatgccatgctgctaaatttctctggagaaccgtttttatttcctttgggttgcaaacaccacataattttcctcaaatgtttggaaattggctggtaaccatgaattctaaggccaagaaatatattttgtacaagcatctgctttatattgggctgcatggctaagtaaaatgatatgttttttttgttaagactccaactaaatgttttatgcagatattattcagagcaattttttggcttcggatatagggccaacttcaaatgtgtgaagaggaaataaaagtcatatgtgctacatgccataatttagattcagtagttatgcaagttttcgataactttggatagagaattagcaatagacttaaactttgaataagtttttattttcgcttggttggtgtagttttatcagctttttatttatctttgtttatttatagtgtatttgagtttcgtgccaataactttgtaataagtggctatagcttcaattgaagcaaaggctaggtttattatccattaccaaaaaaaaaacttttaaaagcctagtacgtggtggttcatcatctgtcatttgtcactcctaaacatgcgggccggggcctaccagcagagtcgtcgcccctctccactcccccttgactgctaaatctccaccaatacaaaccactgcaccatctcgagcatggcttcctcacatggcaagcaggcatgcctgcaggctaccctgaacagcacatattatctcaactaatggtctagaacaatatgttaaatatctaatggttcaagaacaatagatgccacgaattgaacttaagacctctcactttcaagtgagagaccatttatcatacaaccttttatgcatgtctaaatgacttggccgggctttctatttgaatatttaatctccactttcgttctcagaagttaccatttttcataatcttctacattacatttttacatgtctcgttgtataagaccattgaaattattttgcccaataatagtaataaatgtttcagttccagaagcaattgaggatttaaataacaatctacaagtcccttttagatggagataacaattccaatggcatggagcacatctctgcatcatgcgaaacaacgagattttcatgaacatcaaccctcgcttttcaagttgacgagatcgttttagatttgagtttgccatggttattcatagggcataacgaaagttacttttctcacattacacaatggtttgaaaacatgtaataatatatcattacacattgtaagtgtatatattttagtaatatattcactataagagcatttcctactgcatgtaagtttagcctcatctccacatatattttatataagtgtccatacaagtcatatccggcctctatgaattttttgactatgataatagaatatagaaaaaccttatattttgtacatatggatctcatcaatattcttcttcgtattagtagctggtacttcatcagtccaaaaaaaaaaaccaatcttgtattaagatgtgacacatcctactacagtaaatctggacatactctatgttgtttagatttgttgtactaggatatatcataccctagtacaagattggcttttttggatggagggagtacagtagagtagttgatgtgagagatatgtttatttatttacagcaggatgacagggaaaagggccagcgctgcgacgttgcctctccatcaagactactaattaaagcttcatttctagagatttgtatatacataatgccagtgagaaaaataatcaacaaaataacgggtgaaatccaatatatcctatatatttataaagctcattctctaagtgtaattaatgctatttctcttttatttcattaagccacgtcaacttaattagttttagcccttggatgattaatctatggtacaaattaattacctccttgtcttctcttatggagtcataccaccttatttttgcctttggataattatctatattatctcttttcttttccttctctcactgagcacaatcaccttagtttgcttttgaatgagcattgtatgtacaatttaaattgttataaacaaaatcatccaaatttgtttatacctttttttcctcaatggtcgattaaagatgaaagttatataaagtatataaagttatgtagttaaaaagctattttacatgtgttatttctattattatcatataaaattcttgtagcaatgtgtggggtttcatctagtatataatattggtaaagccttttaagtgttcttacttgctgtaatgtaggtaagtggtaaaaacttctggctcagtacgatcactgtatgtctatcctctctaacatatcactgcaacaaatatgacattatattgattaatttccttgtgatgacgatgcaaaacgtcattggtccataaattttttttagaaaagcttcataaagattagttggtcgattttagtgacgaatcgaaagaagggaaaagttgcaaacacatatataattaatgtcttgcaaaattaagctgtctaacaactaatactctcataaattttaatttatagagttcaccaccgtaaggcataactcgagccctgaaacctgcccatcaatgatatataattcaaagaacgttttacacccatcaactatgcgtgcaaggtaccattaatcaagtgtctatcctacaaagaaaagaccatcatagagcgtacaactatgacaattgctaattaggattgtattttctatacatgcaagagaagaatgagattgagggagcatttgggggatttgggtgtcattgtagctaaagggggaacatgtgacgcgctgtgatgcggaggggttgagcgcaagagtgttgcatgcgtggtgcgccatgttggcggtcagccatgctcaaagggcgattggacctaattcacgggtctatacatgtaattttcaaattcacggatctaagtgataccacaccaaatgtctaggaaccagccatgtatttcactctgaaatcaataaggtattttaggtttggtaattaagggggtgcaagttctgattcatatatagctgtgattcactgcaataaatataaagcatagtgatgattggagatctcgatatgcaatggttgcataggctgacggtgatgatcgaattattttagcatgaaaaatatcatctgatacgttaattgtcagtattcctggcacgtgtactaaacaatcttacgttgtcagtgttgatttaatgattaactgatcagataatatgctcgatcgattaaacttaatttattacatgcctgaaccgcgtgtttgagtaatttcaccaataattagtactattaaattgaggaagcatgatacgtagcgatagcatttttgcctcgattctcatgcatggcttaaaattgctctactattacttatttttttcaacgtacgttaaacacgatgagctgtctgtccaaaaagttcgcttgtaattttcaatacgaaaaattggcagttgtacagtgcgtgttacgcacgagttgtttatcttatacccagctagatttgaatcttatagttttgaatgatgaagatagctagctggcctgcagtcttggttctgccagtgtgtatacgttggaagtgcatgcagatcagggcatggaaataaacgttaaagaataaagatgctccaggaacgtctaaattaacaaagataaatactccctccgtttcgaaatgtttgacgccgttgacattttagcacatgtttaaccgttcgtcttattcaaaaaatttaagtaattattaattctttttctatcatttgatttattgttaaatatatttttatataggcatataattttacatatttcacaaaagtttttgaataaaacgaacggtcaaacatgtgctaaaaagtcaatggtgtcaaatatttcgaaacggaggaagtatgatgttaatgtcgatgtggaactatttggaccaacgtagtacgtcttgcattctcactctgattaagcacgtcgttcgatcttatcaactcgtatcgtacacaatcatggtgatcggaggttcacgtgtttgcgtaatatcaccacactatatcggaggttcacgtgatcgaatatgctcgaacgattaaactttacatgcctgaagccgcgtgttttagtaatatcaccaacaattaattagtactattaatttgtcgttttgaggcaccatgatatgtagaagatacttatgcctcaatcatggctttaaaaattgttctatagtattaaataactttttcaacggttaactggattcatgccattgcaaatttatccattcagaaaaatatcattacgattagtctattcgtagcagtgtcatttcaattttacaaaattagaaccgtaccattattgtcacgttgtgcatccatctccttccttttccgtcttcttctttctttctctcccatgttcttctcgaagtcaagccggcgaaccaatcctcggaatccttggagctcagaggagagtgagtttgccggcgaggttaccgaacccaaccatagtaggcagcgatgaggggaaggtggcatgctcggtgtggatccagatagttcgctctgatccgcgtactaaaatattttttaatacaaatattttgctgtcctacattacttggttgtaattgtttatattatcaacccaaactcgaatcttatctgccagtgtgtacgcgcctaaaaaactattgtactatttaacaatcgaattaaggggtgtaaattctgatttctagattcaaactattataatgggggcaaaatggacttttcagtttggcttgccagtgatcaattgcacaaacatctcataaatggtaaactagatcaagagggatatagtcttgtatattggctttttatttttggctgaggatgtatttccctaagaaaatcaataaaagacaaaagttatataaagtttataaagttatacaaagtatataaagttatgttgctaagctatttcacgtgtcatctctattactatcatataaaatttttcagcaacgtgcagggttttatctagtatataataatggtaaaacctttaagtggtgttacttactgaaatttaggtaagcggtaaaaacttctggctcagtacttcactatattgattaatttccttgtgacggctatgcaaaacgccattgatctataaagctttttttaaaaaagtatcataaagattagttggtcaattttagtgatcaatcgaaagaagggaaaagttgcaaaagcatatataattaatgtcttacaaaattaagcttctaacaactaataatctcatgaattttaatttatagagttcaccaccataaggcataatttgagttctgaaaacctgctgtcgacgggggatacccgtagaccagattacgaggatattggggtacgttggtacgaggatcttctcgatacgacaacaagcacaaaaaagacaagaattatactggttcatggccctcgtaaggtaataacccaaatccagcttataaaaaaagtgattattttagtgcttagctaatactatagtagtaattaattgcatagacatggtgtctaggtagttagtctatgtagttaattgcctgtgtttgttgtgtatcccataatatgttagaggttggtgtagaggtggtaatagccctcgaaatcaccatagttctccctgtccgggtacgaagtagagcatgttcttttaccagcgagcatgctagtgcctgaagcatagcgataggattaaaattaagctttctaaacatgccagtgtcctaggatgaagctgaagaagagctaaacacacacattccctatggaaattcgatacattggaatacttccgggtgaattgctatagcagtatatccgtgcgcttgctgattttatgtgaacgcaagaaataccaacaatattctaaacgatacttccaggggaggatacgatgtcgagagagccggcgtccctgtccaagggaaccaggacgtggctttcacctaaagaaatcaatgggaagattagtgaaaaagcaacaaagcccaaggggaatgtggggtccgcaggcatcgctgttgctggcacgaaggttaggctttcgcccgaagtttttctaccctcccgcataattgagtgcctgctaggttcagcagcctccaccggctaaatcccttcaacacgtagccaccacgccaacgccttggcgtcagccaacaatcattaatctcgacctccagagcgctctagatccatccacatgggtggattggagagggagagggtgacacagaatgatggatcctctctcccccacgtgaccatcttgtggtggcgagatgccactgcaagagggctgatgcccaccaaatggcgctaccatcatcgccgccttggccaggctgcccgtgtcatctatgcaatgggccacctagccacttcatcatcgccttgtcgtcctcccataacggcaaccttgctgccacaacgctccagccttcgagacagcctcgtcgcctccgtgtcgtacttgccagtaaaatggggttaatggaggataaggaagaagatgacacgcctggttcgggcataggctctcaccagagaaactttcgtggcgttgtcagctcgtcggcctcgtcatgggcgtgcatgttcctagcaacccaacagagtttagcccgtgcaactgggcactatagaacgaggggcgagcaagaggtttttgtggaaaaatgggaggttaaatggtgggctcttgtgcgtggtccatggacggggtgcagggccttgtgttgtctctgtcttctcgagcagcccagcgatggaacgggacggcagggcatttcaggggctttgcttccttttcagaaaaaataatggaggaggagatttggtcggggcatgataattttggagaatggtgtgaggtggatgatgggtaggcccacttgcaatggctgctaagggctagtcttcacggagaaggctcgacttggcctgggaatagtcgtgcagggttgttctctactccaaaagaagatgcgcaccacatgttttacaggggggggggggggggagaggggaaaggtgtggacgctggttggtttttcctgggtggatagatcgattatgtgtagagcaagccatgatgaacagtctgatagaaaggcagaagcagaagagttatgatttcactgtggtgaattttgaaagagggctaagtgataagaatatattccacattttcagcagtttgactgatctacttgggacatcaaattagttgataaaataatgccaatttaattaactcacagtttttcaaaatgtgtacagtaattttgtgaatttttccaggagttttgtacaaacaaacaaattattaaaattcttccaacctatttttagtgcatatgaatgcaatgatgaatgtctgcaaaatccaaaaagaaggaaaataatattaaaagacagaggaagtcatttcactgattataacatgtatttaaacttttaaaatttttgggtctattacattctgagttgcgattcatgaaaaactagatgtagatttattagttcatctggtaactccaatttgtatgcgacttttcctcgtcgatcttggatcttatatgggtcgttatatgttggtgctaacatagccttcatctgaaatatatgcactcctttcattagtgacatgagatatacaatctccaatttcaaaactcacgtcctgtcttatattaaccgaatattccttatgttcactctcagcatagtcctgagttgtttctcgccaactttggtccaactttaaggcgtcttagctacacatttttccatataaatctttataaggtgccattcctaaattgatagctattattataggtgaactcggcgaatggcaaacaaatctcctatgctgatccatacataaatgtgcaagctctgagcataagatctgatttactctttcaatatgtcctctagcatgtggatgataggctgatttgaataccaattgagcacctttatagacatggataccaaatcttgccttgtcgatcggcatttattcattttattataagtccattacccgacattatttagccggttgcgcacgctgacagttgacaggaactacatactcatgcaatttttaaagaaaattaaatgattaacttgcaacgatttgcctagcccctgtgagaaatgatgtaggcaagctgcatgccatcgggcatggtggcagtatggaacttgagatcagtcaccggaggcgccacattgcccccggttcccatgatgaggtccaccagcacgccggcgacggcgacgaacaggaggccggcgacggcgccggcgacgagcccggccatcgacacgacaaagacgccgagctcgaggtccgcgaccgcctccgtcaccgcgccctccaccaccacctgcaccgcgaaggcgcccacctccgccagcgcgttcaggctgttgcggagcaccgcctcgacggtgtgctccgccgtgaagatgtcccacaccatgaggcccgccgtcgccaggagcaccgccacccccgccgccgtcgagaccatctccgtcaccggcatcttggccctgccggactcctcgatgatgctgttgtacacctctagcttctgcgcgtccgtcagatgctcgaactcgccctcgaatcccaacttgttcttgtgtcttcacatcgatccgatcacatccgataatcaaagattacaactaattcaagaagaagaggagatcgaactgctatatatatgtatggtaattaattagcaataacttcttaccgtttgacaaggtcggggaacttgatgccctcctgcttgagcatcatggagaacgcctttgacatggcgcgggcggagccgctccggagcctgttgcagtgctcgaacatgcactccttgaacatggccgtgtccttggccagccgccggaggttggcgacgtcgtcggcgtggaggccggcgaggtcggcgacgagggagtcgtagtgcgccctgatctttccgatgcagtccacgcgcaggcagcagttgcggacgttctgcatgctcatgttcaggccgtacttgacgtactccaggacgtcctccgcgatgctggccttggcctcgccgccgccgcccgccgcggcggcggcgtacttgtccctggtggccgagccgtcgtcgaggaggtcgacggcgtggttgtacgcgtggttgacgctgtggaggtacttgacgcgctcgttctgggacttgaccgcctgcgtgatctgggcctcctcgttgttcctcagcaggagggccagcttcttcagctgggatacctccatcagcatcaccaggtcgcctccgtcccccattggtgccgccatcttcgagcttggatcaacgattcagaggacctgcaccaaattaagaaattcatgttattactgctactaataatgattatccataaatgctagctttggatcgttggccatgtcagtcttacacttccaacaactgttcaagggaggtgagagcccgaaactatttgagtcgatctacatcaagatgctcccaggcgacgtctatttatggttttaggctgctgtgttcgtgagtcgcataaaacgaatcgtgagtgggagttgggaaactctctccccaaacacataaaacggatcaataagatttttctaaagcaacttaattttgtatagaaattttttgtaagactgaagatcatctcctgtcacacttggagttttcccttcccttaggtttcaaatcattaataaatgacttcaagaatttactttggttaaccaggagaaaaccccagttaacaatgtatttaataatcggaattgtcagggagaatttttttacgaattctctttgctctagaaaatcactaacaggacttaaagagtaaatatcagatcactggaggcaatgttgctaagttaaaagtgtcaagttaatctccttccttcgcctttggtcatgaattgtgcccaattcactcccctctcagtccgcggttttgttttgcatgacgaaccgtacccgtgtcagtttgcaggaccgttttctttccattcctaaagctgcaccgcattgttttcctttttgggaagtcctagttccctagttttccttttccctccctctctccccagccggccgcgccctccccctcccctcgcgcgcgtgcccctcttccccctggagtccgactccctcccctccctcctagttctactccttctaggactcctcctttcctaatcctgtccacccctttagaagtgttcctcccctagttttttacgttttccccgagtcctagctatcatcgtccccgccgtcgtcaccgtcacgtcgccggtaatctgttttccctcttaaatgaattggttaatccaatgtcaattatctcccgtctaacctggccgttgtgtcctctctagtgctgccgtcgttgtcgatcttgccggaccgccgctgccgtcgtcgtgttccctcgccggttatgcttcccggtgagaacctccctcctgttttagggttttgtttccgttgttagccgtgtcgtcgtcgtagcccgtgccgtcctagaagctgctatgctgccgcgtggccgccgccgttgccgcgccgctgctcgccgccacgccattgctgccgctgcttgctgccgagccacgccgccgcttgccgagccgtgccgccgcttgccgatccgctgtcgtgcgcgccgctgcttgccaagctgctgtcgtgcgccgccaccgcttaccgagccgatgccgtgtgccgctgcttgctgccgagcctagccgccgctttgtgtcgccgtgtcgcagccgtgtgccacttaaacctactcgagttgtctagccgtaggtgcaaccctaggttcctaccggcctatcgtttgtcgtaccggggctttacaatgaactgtgtctagcctgctggtttagtagcagccattgttgagttgttcgaacaaggtgctcccctatggtttgttcgttcgtccgtcccgagtcgtcctttggtttagagccgttcagagccgctagttccgttcgccggtttcggttgatcatttgggtgatcccatgtgacgttaaattgactcgttgagtcggtatcttgtgaggctcgcttgccagtcaatccgtcctttgatcctatgttccttttgggcttaaatccctgtcaattgattaaggttttttccgtcaatagtaattaacacagagcaccttgtaaaattcataactaaataatctgagctccattttaacccattcaaattgcagtaaatttgttagaatgccaagaatccattaaaattggtttcttttgctgcttcagtagctttttagcttgtatttattgtgtgccttgtctgtcgttagactccagcagttctgtcgctccagtttattttgaagtggttgccgaggtcccgtcagctgaagagcaaggcaagtcatacaaatatcattgatcatattgagcctatttgcaaaaccctttctttttctctcaaaattgcattattttataatgtcatgtgagatggaatttacctgtaaactcagcctttgtttaccctgcttcattgatagcctgggttaataatttgactagatgattggtctaggattgcttagccatgcttagatcaactagctcacaatgggattcacaattttatagtccttatttttatgatgatgctatgccatcttggcatatggttaattaattaaaatatgatttacttggtgggtcctgagcacatgcatgatgatttatttggtggtcgtgcccatgataattaaggaccggttctcgggaatccctggaagatatacttaattatcgtgcccatgatttatttggtggtcgtgcccaaatgggctccatgctgtactcgtagtaaccaagccagatgggctccaggctgaatcttaagtataatcttttctaactagcgcaccattgggaagggtaagcgtgatggagtatggatggaccgggaggcactctatgctgcttccggatttacctaggcatgagtgagggctgcctgctcctggattttggagtgggagcgaaaccggaggtgggtgtgctggttagggatggttatatggagggttttgtcacgatttcctcctttgcagtatcgtggcagttgatgtgcactagggttcccgatcttccgaaaggttctgataaacaacgatttggacgcagtcgcgacacaaatcgatccggcttcttgaacgcgcacgctattgagccccgcaatcgcagcactacgtctcctctggttatcacccgtgtcgaaacgcggatgacctcgccgagaaggctaatccctgtttgccaatcgaagaacacaaacaagaacgagatagaaaaacaaccaaaattgcagatgaatgattaagctcacgagttggggtcttacaaaccgatctagcggcgaaactgttctcgacagattaatctaagcaaaacccgactctaaacgatgacggctactgaataaatgtgattagcgacatcctagggttgccctagggcgcacacccccttgggctaagcccatgacacaattacaaggcccaaaacccaaattagattcggactggatgaggtacgtggcttgttttgcagattcccgacagctcggtaggaattttgactgggaccaaaaccatctgaaagtagactccataagctttccaacaagtactcatgggccccgaaattccttctaaatcagcggctaggtacgtttgattttgatgctgtcaggaggcccgaatctgaatccaaaacgtgtacaacttgatctcttgtcttctatgggccaaaagtgatatggtgagctagaagtatacttggagaaggtcttggtttggtccccaatcaacttcttcaatcatccatgcattacttacgctcggtctcttttctttcacccaagcaagtacctctgcgaacgaaaacacacaaaactcaatgtgtagcaatgtttgttcaaatatataacaagtaaatctaatatagaacatatgcacctttggttgatcaatacataaggtggtcatggttatatctgaactagttgtatcctcatcatcatccctttcttgattggaaaccatcctcggtttcaccttgtaatggagcatactgtacttatctttgtctatcacaacatcctgtacggaacatttcttgatggccatatgattggatcctaaaatctttgtagtcgaaaaaccacaacattccccttcttg

SEQ ID NO: 67470 - DNA, 2231 bp, Oryza sativa
gtactccaggacgtcctccgcgatgctggccttggcctcgccgccgccgcccgccgcggcggcggcgtacttgtccctggtggccgagccgtcgtcgaggaggtcgacggcgtggttgtacgcgtggttgacgctgtggaggtacttgacgcgctcgttctgggacttgaccgcctgcgtgatctgggcctcctcgttgttcctcagcaggagggccagcttcttcagctgggatacctccatcagcatcaccaggtcgcctccgtcccccattggtgccgccatcttcgagcttggatcaacgattcagaggacctgcaccaaattaagaaattcatgttattactgctactaataatgattatccataaatgctagctttggatcgttggccatgtcagtcttacacttccaacaactgttcaagggaggtgagagcccgaaactatttgagtcgatctacatcaagatgctcccaggcgacgtctatttatagttttaggctgctgtgttcgtgagtcgcataaaacgaatcgtgagtggaagttgggaaactctctccccaaacacataaaacggatcaataagatttttctaaagcaacttaattttgtatagaaattttttgtaaaagaaaagtaccgtttaatagctcgggaagcgtgcacgtgataaacgaggaatctgagctgggaaagcaacacaaccttaattatgctggaccagcgagcgcaccgcaaagatatggttaaatggaagggtactattatttttttttaatttggcaactactaattatgtcccttaattaattatatatataaatcgagaaaattcattgtgctctgaaatttgcattatgtataaattagtttggtgcaggtctaattttggtatagcttgtccactatgtagaaatttcatttagttggtgccaaagttagttgctagaatgtatgttttaactgtaataataattgacaactcttaatggacgatcctagcaaggtaattctttttgttacgctagtgccatggccgtgcattctaatgggatccgaagtaataagaacgaagagttttcatcggccgggttccttttttatccgctttttctgataggtcttgaaaggactggtttcggcaggatgtgttttttaggtcgggtgattcgatttatgtggagaagtacattaatagagggaaggaggagaatgacttgtttttttgcagtgtagcagagttcaatataaagggtttgtttggtaagactttaacccctaaatttaacccctggaaaatagtttagagtggagttgctttacccttctagcttttttaatgactcaagtccgctccacacccattttgatagaactaaaaccgtttggttgggttcaaaagagctggagctatagtccgaccaaacaggaaagaaaacctaacgttggcaaaacatttaatttaactatgcctggaagaaaaataatttgaatttttttacgagaataaaatatatttgaaaggaatcgttttttaagattccatgaaatgtagatattttggttcttacattctggtaaagatatttttgttgtgatttgtttaatgtctctctcccaacctgaataaaagtgtttagattcatgaggacgacatctattatgggtctataagtgaccccgtaagagatgtttgtgtcgggtcctcttataggcccgtcacatatgagttcttacctgtgacgggccatcccttcgagcctcatctacaatgagttctagttcatgctagtattcttcctgttcatctacatcgtatcagatgtagaggccgggtttaatatccattatctggtttcagctgtcgcggtagaaaccaagaatatgaataaatatataaacatatatatgtttctctttttgtgaatggtgttagaataattgggctaggcccaacttatcctattaaatctcaaaggcccgtaataagtgttgaggataataataccacctcaggatttaagcgaggaatatctcaacctaaatagggagttattggaggctccctgttgaccagttgaggtggggatcagaatgccacacgctcgcgcgcgcgccgggccgaggccgtggccgaggcgttgctggcggcgtgcgtgcgtcacgtcgctatccttttgcagtcactaacccacgttctcacgattaccttcgtaacagcgcgttcac

SEQ ID NO: 67471 - DNA, 733 bp, Oryza sativa
ccgttctgtagtagaacaagctcatgagattcagatgctggctaaggaacttgagaacaacaactgtgagttgccggacaagtttgtggcgggtggcattattaccaaactaccaccttcttggtcggactttgccacttctctaaagcacaagagacaagagttcagtatttctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaggcaagggaaaggcaaaggtagactgctttgtgtgtggcaagtctgggcattgggccaaggactgtcctgagcgcaaagacaggaagtctgccaacatggtcattagcgagggcggaggaacatcggggtacggtaaaatattacctatagttctctctgtttttcattcacctgattggtgggtggacactggtgctaatattcatgtatgtgctgacatttctctgttttcttcttatcaggtcgggagaggtttctccttgttgatgggaaacgggtcgcttgcggctgttcatggtgttggtacggtcgatctgaagtttacttcgggaaagaccgtgcagctgaagaacgtgcagcatgtcccttcaataggg

SEQ ID NO: 67472 - DNA, 792 bp, Oryza sativa
ccttgtgtttgtgatctgtgtgacttgccttgcaatattgggtctccaattaatcttcttgaacacttggggcgcacttgcgaaccttcgaaacgacggaaacgacaagctaaaacgcaaaacgaggaaaaagactaagaaactacaaataaacattacatataaagtaaacaaacatgtagatcataattttagatgaattatgagacttgaacagtctcattctgacttcatatgaattaattacgaattttacaagatttaatataattaaagcctatttaaaaaggactaaataaatttaattcaatttatggataattttaatatgtagatctttattttatacaacttttgcaacttgaaccacattaaaccgagttacaatgaattagttatgaatttttaaagattaaaccggattaaaacatttatatagattttaattgaattatgacgcaataatgaattatttttgaaaaggaaaagggaattattgcgtcagcgggctcggctcacggtggaccgggtgcacggggcggtctaaggaaacgaacggccgggatctaatcgattcaaaacgaacggccgagatcgatctaacccaacgcggtccatgggaaacggcgtcgatgacgtcagcggtgacgtcatcaccggcggcggctcggcctcgcatgctcgccggcgaacgacggcgaagcggctcaaacggagggtaccaacgcgtagagcttggctcggcgaactcaccagcggcttggacgacggcaaacgacgacggatgacgat

SEQ ID NO: 67473 - DNA, 1577 bp, Oryza sativa
aaatctccacgagctccctctatatctgtgaaaaataagacaattgctagagaaataagggatggggatcctggaggtaaatcacctcccactttagaagttacagatggaaagaaagctgtgtagaagtctccaggataagcaacagtgatgataatgtggtggttgagaagactgttgtgattcttgaaaatgaggtggtttcaacacctcctctcattctacctcctggaagaacatcagagaatgaaacttctagcaatgacagaacacagaagcccagtatggaattggagtacactgccatcagggctccaccttctccagctgttcttcctgaagctgagaaccccaccatccatagacacaatgaccagggtaattacgaggtatgatgcttatcttcttctcagttgtttacttaaggcttccgcttatcttcttctcagttgtttacttaaggcttccgcttatcttctcagttgtttacttaaggcttccctaaaaggttatctgttttttttctgtttctttgcacaaataaggtgtttatgaagacttcaactagaatgcaacagttacttttgttctattaaattccacaagttgaagtgataaaagaatgcttgtgatgactaggtgatgacggagcatctgaaggatgagactgaggaattgaccttgtctgctgtggagaaaccctaccaggccccttttgctagggtgacatcgttggagaatgattcagccaccattcatgcttacccccatgcactaccagttgaatctgaaacacctgtgcatgccgagagcattagggctcgagtactagacccagtatcgacagtttcagtggaggagacccctgaagcaaatgaaaaacctcgtaataaggaatcaaaaggcttcaggaaacttttgaagtttggtaggaagagccacacatcaggtacaatggattctgatgcatcatctgttgacggagccttagccggagacggtatgatactcgccccttaacaatccattacttatgagtaaatttcataataccagattttaagccatatatggtacacaaaacaccaggttttattaacaaggacaccaggttttattaattttcacataacactagctacatgcgcgcaagtaacataagtatataacacaaaacaccgggttttaacttttttcacataatgctggtacatttgcacatacaagtatataacacaatacaccacatatttttagcctacaactctcagcagataaggtggagccacataggctggaccatcaatcaggctagcaatcctgatttgtgctcctctggtgccccaccactttgacaaaatgctgcaccgctcaccatcttgcgctgtcttccatctccaaatcatcagtggacctccctcaacctctgctgcctcctctctgttcactgcactgcctcagcagccgcggcacggtgccccatcgtccacccccagctgccacgctgggcaagatgggcttagtgacacactatctaccctctaaccatgctcacaactgctactaaaaatgcttct

SEQ ID NO: 67474 - DNA, 7917 bp, Oryza sativa
agactgcgctccccatgctactttggttcgtaagatggcgcttggctcttcctcgacttgaaaagccgagacaaagcttaaggtaactctgttgcacccgtcaactgaactaggatgcatcgttgctggtgtcattgatctcctccccccccccctaattgttttgtagtgcatgggtgatcgggtggtcccacagtcagagcaatttgagggggtgtggccagaaacggaggacatcctatatgaggatggattatttaagagaacatgaggggaattaatcatgctggaaaagagcagcttcttcgcttgtgtgtatgagtatcctatcgtggttaattgacggatactttaatttcctagatatataataggtggtatacttacatcagtaatcatacacatgcatggttgcctattttataggctttacaactccattgaagactatcagtctatcggtgaagagcaactccattgatggtatagggttacatggacctctaaatctagacttttgtgaaatttactaattatttaagttagtttgtttacggaaggtcatcatgtaagtagtaatggcatcctattaaaatcgagataaagatagaaaaatttaggacctatctattggtagtcacgtttgtttccaaaaaagaggaaattgcaattcactcaatgtttgtgggtttaacacttgttgctggtgcttaatgtttcagggtcaatgctgaaaaccctcatttcgcgagatgactctggttcttcatctaaaggttagaagttagaaacgcgctctcaattaatattggttgccttcaacctatttggtcaaatgcatttatgcatcggttgaataatttagtggcaggatttgttatgtgaaactagaaacctagctagtatctatattctatctggttttcacttttgtccttctttttagccccttagcgagagattttggcaagaacagcagtgcattctatgagttggttccaaaagttttcgtttggtaaaaatggatgctaattgtgttttgctataatgtggcctgcagcttctcggtcgttctccctactgtcaccgttccgcaggcagaaggtgattgtactgtgaccgtgagttggctgatcctgatctgtcatgttaatgcagcttgtgcattaactaatttgtttcttagtagtacatacacatacagacatgttagtagtacatacatactattgcctacatctgtgtacgttgcttgtaagctgtgtattttgagtgcgcgtttatgtgactttctgtatatgtagtacttggtatgcatatgtatattatgttacacacaagcacaaaacacattcgtttgatcgatcgattccatttgcatatatattgatgatgtctcgatcccgcaatgaagctgcgaattagccatgctaataccgttatatctgtcaattgtggaacatcgaatttgcagtgcacgacgagagcgagacttactgctaattaattttggatgtttcagaacaataataaagcgggtttgacgggagaaattgaaagaaattaagaaaggaaaggaaggaagaaagagcagatcgattacctctgtaaagaaattgtagtttagtacatgatataacaatactgatgaatgcatgaatcaactttgtaaaatggaaatggtgctttatgcccaccggtatcaaagcaatcgatcgatccgagcaaatctgaaattaattaaattaaagagaaggcaaaactgccgaagatccaagatcccaccaacagatactgtatgtgcataactaattataaattcagtgtatatgtattccttcacgaataagcaaagaggatttgattcttctcagcttcttcccaataacttttgaaacggaaaccataaagaaaatggacatgtgaaatggatggagcgttttgcatccagctagcagtatgatcatatatagtgtcgtactatggtaataggaataatatataggggcaattaattgctcctatccaacaggcaccttactgtccggtaccaaatctgagccatccaatcagctcaatcagatggtgaaaaatctgtggtacctccagatacaaatttgctcccatccagcgggtaccatcggtactagaatatttggagtggtggaagggtaattttgtcttttcgcgtagaagtgtccaggggagggaaatagggttttctaccaaatctttgccattcgatccgtgagaggagtaggcggcgagcaaatctccccttcccatccgatccgatccgtgagaggagtaggcggcgtcggcgacttgcttcgtcggcctggacttgatccgcgggaggcggcgggatccgtgggaggcagcggcaacttgcttcgtgggaggaagcggcggcgtcggcgagttgcttccgtcggccggagcgtggatgcggggcgggcagatttggggcgagcctgcgtgtggctcaggtgggcttcgcacgggcggggctgcgctcgccgaggggaggaaaaaaaagagattagatgagaaagcggtgccgcacggagggaggaaacgagaaagagcgaaaaggagaagagggggcgcgactactttctctgtttttcaatcgtacccttctaacatggacggatggatttatctctgtaccttccggtactagtacctaccggtacaagttgctggatgggagcaacgctcttgataatataatatctattgaagtactagtaatttctaactttttcggtaaaaagaactacagatcaaaatttgaggataaacggttcgaatgtcaattattaaatacaaaattactaaacctcgaaaggaaaatagagacaaaatcttgtaaatttctaatcttcagatctactttgcgattcgtactccaatgggcctctcctccaactctgatgactttgatgaacttcggcgactgatggtgacaacctcgaccaattagggccccggatggtggcggtgggagatgggagacagtgagatgccaaagccataggaataggggagactggtgggctagcattgacggtaggggcaaagcgaggcctctgattaggagtcgacggccaatggtgaaaaatctgacagcggagagctgccgaagatgtggaatacggtgggacaggggcacctcgctgtcgctagcttgaggaggagaagaggggtggaagggagagggagagaatcggaggaggggatggttctcaccggtgccgctcgtgcctttgggctttggcagctagcgagcgaggccgggcggtgtaggatgctggtggagcgagtgaggagaattttataatttgtaaaagatttttgaaattgtttttgtctatcaaatgccagtccctagagaaggtatcctatatatatatacatcatcaatcgatcattcaattggactcagctgcatcatatatatcgttctagctagctaggttagctaggttcattccatttccatttcaatattgttagcaacaatggctgcaggcagcggcagcggcagcaatcctaaggactaccaggatcctcctcccgcgccgctagtggacaccggcgagctaggtaagtggtcactgtatcgcgccgccattgcggagttcacagccacgctgctgttggtgtgcatcagtgtgagcaccgtgatcggtgagaagcggcagtcgggcgagggcggcgccggcgtgcttggcattgcctgggcctttggtggcctcatcttcgtgctggtgtactgcaccgctggcatctccggggggcacatgaacccagccgtgaccttcgccatggtgctcgcgcgaagggtgtcgctgccgcgagcggcgctgtacacgatggcgcagtgcgtgggcgccgtgtgcggcgcagggctcgccagggcgatgcacggtggcgggcagtacgcgcggcacggcggaggtgccaacgagctggcggcgggctactcggcgggggcaggggtcgtggcggagatggtgggcacgttcgtgctggtgtacacggtgttctcggcgacggacccgaagcggaaggccagggactctcacgtgccggtgctggcgccgcttcccatcgggttggcggtgctggttgtgcaccttgccaccatccccatcaccggcactggcatcaaccccgcccgcagccttggccccgccctcgtcctcggcctcggcaccaccaaggcctggtcccacctctggatcttctgggtgggccccttcgccggcgccgccgccgcaatgatctaccatcactacatcctcaggggcgctgccgccaaggccttcgcctcctcctcctaccgatcaccccatttttaatcccatgcacccttgcaatatattttattattcttcgatctactgttttaatttgttttttataattatatccgtaattcatctgtactgtctgtacgtaatctagctacatacatatatgtatggttgatttttcatatttgcaattcaattattctatattttcctacttcatcttcaaaaattgttgtactgtctccattgtagccacatgcatgtatactcttatatacaggaatgcgctaaagcgcatctgggttattatgccataattaaaacgcactcttcacggatgcacccccacccccatcccctgacaccacccacctcacttttcaaaatgcagtacaataaaatgatcactaagatcttgcttctggcatagtacattaattataagtaaattatctacagtactatacatagaaattggacgatgtatccatctacaccttttaagtagggagtaaattatttgcttgaagtgtaatcctaccatgcccctgtagtcctgcactgcaggtttcactcaacattaattaaaatcattttccgtttgttagatttttactacatgtagtattagaaaacctcacgtacgtataggattaaaacccatgatcttcacaagtgggcctatagctttcagtattttttttttacaattacttgaagacatgtgtattggaatcatccgatcatgaagggagtaaaataaaatattgacgtgtactggagtcatccgatcatagagggattaaaaaaaatagtgatcaagtccataggccgcaaatatttgaaaaaaatgaaattatactgttgaagttttttttaggagaatgacgacagaagatctgccggaatttaattaaggggtcaaaaaccacccaggaagacctagggaagagttacagcaaaaggagaaattaaggtggcctgaaagccactttgcgcaaatctatatcttgttttacccgatatgctactgacaattctgagctagctaaattttggaaaattctactatttctctctagctaaatgtttcaccaagttgtcaggagagcaccgcgagcgagcgttttttgaccttctctttctgcacctttaagctcatcccaccaggttgagatgcgggacggaagggaattgagagctaggggcaaattttgccacatacatactgtagtccatacttgtttaacaaacggacaatccgcgaacagatgattggtgtcttcgaaggcggaggtacacaaacagtaaatccaattacaagaccaatatcttctgagcaaattttgagccattaaagttctttggtggaggacaagccaaccaaaacatttcatttttggctcagcctgggctttacagagcgtggtaaaatcaattgcagtgtatgaaccagcaaactgatatatatatataagcactcttggttgtatatgttccagattcagtccagttccaaactatgtcatcaacattctgagtgagttgagcaaacctcccaattgcactagctcatgtatctcctcaactgaggtaatttgtctgaaagatgataaccaattgttgttcatcaactcgaattgaacccttctattctttcttctattctttctttttgctaaagagaaacagaggggagctaaatctttttttttctcagaaatatatgagatacgaacggttctacacaaataggcctgatcgtcacgcaggagagaagcgacgactatacttaggcggtattacagtggagtaaagcgaccgttgtcgcgcaggagagcagcgacgattttgacggtaacatggtggagtaaagcaaagtggtggacatcgcagttcggcagcgcgaacttgtgacgaaatcgtaagaccaagtgacgactgggacgttttcaaaaatgctcacacttagatgaccggcggggtggagaaaaatcggacgatgtctgccactgcagcatgttgcatgcaaagaatcttttcttttcttctttcttcaaaagatttttttatcgtaaactatttatctaatctacgatctgattgcaccactgaattcgttacaattaaatctttacaacaagaccacacatgattatatttcaacaaaaaaatattttaatttttttattgatttttttaatgttgcatgtggtctcttttgatgtttcaaccagtagttttacaatgtttcagctagtgtactcatgatgtttcactgtgtacggatcaaatgtgtacggatcaaatgttgcagtggaacgcgccgttgcaataaatcacccacatattttggaaaccctctattaagagaatttggtttgtttttttgttccacaaaaaatgtttcacctagtgcactcacaatgttccactatgtatagatctaatgttgcagtgaactgaaatatttcattacaacaaaaaacccacatattttggaaacctcctattaagaaaatttgtttcattttttgtttcaccgaaaaatgttccacctagtgtacttataatgtttcactatgtatacatctaatgttgcagtaaactgaaacattctttcgctatttgctgaaacattgtttttatataaagtgaaacaacaccagatttaaacgagtgaaacattttcgatctacttagtgaaacaattccgatatacctggtgaaacaccgtgcaacatttaaaaataattcaataataagctttttttttcatcggaatatatccatgttttgaagatttaattgcaacgaatttaatggtgtaatcggatcatgatttggataagtaatttaagataaaaatcagtttaaaagtagttttgcacgtaaatcggcgctgacgtcagcgtccgattttttcctaaagcatcggacgtccgacgggtagccctctccggacgttttcgaatgacaagagagcaatacgtatgtcggtggccgtagtgccacatcgcgggccctgccgcagtctcgtagcttaataccatgagaaacttaattaattaattgattagtgctcttaattgtcgctcgattgtctgtccacaaggccgtcgatgggcatgtgccaaataggcacccgcacagggccctcgttttttgggggccccatataaacatgaaggaccacttcagctatagtaatgcaacacaatatcagctaataggcaatagcccaatgggtagatcaataatggtaggcctgacccaaattcaagagaatgttgtgcgatcgttgatttcgccttctgttggttgctgagcgatctaattccgtgtggcgccgatttcagagatcgagacgacgagacgtcgatcccaattccattcacggcgattgaggcggcggcggcgatacaacttgctccttgcgattccaacgctccaagcggcagcggcgatggctttgccttgctaccttgtctcgtctcctagctcctgcctttctcctcctcgtccgctcatcatcgtcgactcgaccctcaacagctcgacctcggaggcttagacgggtaagattagatag

SEQ ID NO: 67475 - DNA, 1382 bp, Oryza sativa
ctgctgctgctgcttccttgttggcgttgccctctgcttcattctgcagcttgctgctgccgtcttccgccgccggcttattttcctcatctttcttgtcagcttcggctgcaggaggaggaggaggcttgcccgcggtggtcttctcctcctcctcctccttgggctttgggggcgggggcaccacgaccgtggcgagcttgcctgtgcggcggtggatgtactcggcgagcttgtcgcctgagacggtaccggtcaccgtcagcttgccggtgctcaagttggtgtcagcggtttggacccctgcgcaggacacgagtacacgagcagctaattattaagttgctagtcaattactataatatatcgatcgatccatctcaaggctcaagcagacggtacctcacctctcatcttgagaatctttttgtgcagttgctgggcgcaggcctcgcagtgcatgttcaccaggagctccaccgtcgtcacatcgctcacctgcgaatggacgagcggcggccgcggggatggctggtgctggtcttggtcctcggtactagttgggggcggcggcggggagatgacggtggcgttgcgcaaggtcttgtggcggaggcgagcgcagagggcttgagggtctacgatgcccgtgacggtgagctggttgccgcccatgtccacctccacgccctgcacgcccttgctccgcaggatgcaccgcctcatcctcctggcgcaaccggtgcaatgaagctccacgcccaggatcaccggtgccggtggcggcggcacctgctcttcttccttgctccctgcatctgctgctgctgcagcttcctccttcttctctgccgccggtgctacttcttccacctgcttcgaattcttctccttgccgccctcctcctgcataattcactccaccgctcaatactcaatataattatctgcagactactggctgcatatatataataaatgtacacatgcttcgatcgctagcctagctaccttgtcgtcgttgagcttaacttgctcgcccatggcgatcgaattagaaggagtagctcagatcttcttcttcttctcagacgagctagctagctagcttcgaacgtacagaccagtccagatgactgatcgatactcagctagctagccatgtgatattgtgatatgtagtactgcacaatgcggcgacttatatatatgccccacctcagctagctagctagctcaaaatgctgcattgatttttctttttcccggagaatctctactgcctcatgccaaagcttctaataagccgcagccaaatatctatgtcaagcatatgcttagagctccatcgttttgtgttttgcttatctgtcaaaccaaaa

SEQ ID NO: 67476 - DNA, 1611 bp, Oryza sativa
atacgccaagacacgccgccgaatatcgacttcagggataagcacagctagtaccctacggtgtctccggataggagagacgaaagcgctatctctgatctcaccgggcacggattcgaggaggaaggctaccctgttgtcgactacgagtcagatcgtcagaccgacatgtcgacaatagttagataggctaccccaacattgtactggtgtggttatcatgaataagagcaataccggcttcggccaacaggatgtagggttattacctgaccgttcaggggcccgaacgtgtataaaaatccctgtctccgtctcttttacctcagtctcgcgtataccctagcaccgacgatccccatactgtccaaataccgtagtcgcgacatcaaatgtcgacaacagagtctgactctaacttcaccccttatcacatattacaactccaagtccaactcctaatagaactagtatattcgacacctattccaactccaaatccaaactgtaaccaaatagaaatagtatattcgacacctattctaaaaaacttcaccttgagaaatatacgtcactcaaaagtagtagaatcaccatgtctatccattggtcctccaaacctgggttgtcttctttgcagcttcactgtaagctgcccgatgagtctacatcaaacccgctgccttagaaagactccgctagccatataacttcttcctctagactccacttgcaacagtctagctccaccttctctcctatcatcacttgtcttgtcaagcaaaattggactcctacttagcggtcacatcatagactccagtttgttaaagagaacattttcttccttgtcttatgacccgagctaaaaaattcaatatacacgctttccaaaatccatgcgtgtttatgctatattgtagtcgtcatagttatattatagtgtcccctctttatttaagagagttgttgggttactagattcgactttaacttcacccccaaccactggcctattacaatttcaagtccaactcttaatagaactagcatattcgatacctattataactctaaattcatagaacttgtttatttgttatttgacacctattctaaccgttatccctcgaaaaagagtggagtagatcagtaattagcttaatagttgccttaattagcttgcaatgaggagaaggaatggtatagtactatgccgagatcgagggcacctcgatcgatcgccggggccggatcggaatagtgtggcaacttaattaattaattggtgttcgcgcgtcatctcttgtgattataaagctactccctccatatcataatataagagattttagataaatataacacatcttagtatatctagatttattatactagaatatatatatatatatatatatatatatatcatatctaccttatattatgaaacagacgagtagctaactggagacatggagtatataggtcgccgggcatttatgtacgatcacttaatatattaactaattattatagtggagtagagatatagcaaaggtacctcgataactgtaacgtcccgtcccgccttcccccaggaagggcccg

SEQ ID NO: 67477 - DNA, 3415 bp, Oryza sativa
agcccgcttacatctgatagctttcataggtcataagactgccctcacagaccaatctacaccagccatgcgcaccatgcctgcgcaactgcgacacacgcgcccgtgaaaccgcgagagtcggctctgataccattttgtaacgtcccgccttctcccaggccgggcccgcttacatctgatagctttcataggtcatagactcctcacagggcaacacatgtcccgccttcccccaggccgggcccgcttacatctgatagttttcataggtcatagactcctcacagggcaacacatgtcttttctgcacactttgtcctcactcgtgtgcacccgggaagaatttcccggtcggtcacccatcccaaattgctccaggccaagcacgcttaaccctcccaaattgctccaggccaagcacgcttaaccctggagttctttggagattgacttctggaaaagaagttgcaacttgttgatatgagtattctattaatcctattaaactctaggccgggatgttacaataacaggccagccagctgcgttcatgtatcctcgatcatgcatgttcaagggtatgtataacagctgattagttcgattttacctcaccccaagccatgccacaaagagatcactgctttaaaaaaattgaaacggtaattaactttaacaattaatccccctatatttttataggattagttaaatcccattcgaataaatatcaaggacaaaattaatgttgcgaattctcttatatttcaacccccagaacccattatgtttatttgtagacaaatgcaagcatcaggcgcaaatgtatagagctaacgcagccgacaatttaatttgcctcattagactcttgttttccatatataaaattattcagcgtaattagagtttgaagaaacaaagtatctatgtattatatataatatattaagagaggtcgtgaaaaataacgagctagccagtttgtttgcattgcagttatagaaattaccatattaattagagaaaaacatatttacacgcattaggctagctctggtgcaaagttcaattttacgcgtatgtgctagagttaattttgaacatacataataatcttataacaagcagaacgatagctagggttgtatacaaataaattcaatttctacttttaaaatctgttatatataaaactttgaatctatttaagcataagttaaaatctgtatatcgagtcctattccgtctaaaaaaatctagctacataagccatcacgtttgagaaaaagagagattaatttgttgtactattagattattattatgggtccaaataatatagaactttggtatagatttttataaatatatacttgtatatgaaatgcaatgtatttatggaaacttgtataacaaattcaattatacttttgaaatatactatatatatgtaaattataattaaatttaagaaaataaaaggtaagagttatgtataaaagcaacctgtaaatttaaaaacgcactgcacaaatttgggcgataaattttctagtaaattattgtaataaagaagttttgatcggagaaaattgaaatggaaggctaggccggtagctatacactgtttggcacatctccataaatctatatctgatctgcgattacgtttataaaaaatgatagattattttgttatcattttaaagaaaatataaaattttaaattactataacttaacaaataaattttaaattcaacgtggatgaaagatttaaagctgtgtcaaacatgatttaattaactagaggagatcatgcatgatggatgatgagagagagacgctgcacatgggttgtgtgggtgttggtcggctttaattcttttcttccatctgaagtgttgggaatcctgaatccgccacttcatgatgagtcatcaccgtcacaccgtccgtcctcatgcatatgtattttggacagcactggaactggaatatagtcccaatgcagagtgatcgatctagatacttttctgttttccacgtaacttcataaactaattcaggccaatcatgtactccgatcgtcctacgcacttataatttacaattctagaatatacatgaaaatatttggattctcgtgcattatattggtgtccagaaatacttatgtcacgtaaaagtttgaatattcaagatgcttatatttaagagtatatattttctattattagacatatagtagctcaatactaattaattgtatataaaccgtaggtgtatgaaccagatcgaccgactcataatcctcccacttactaaggacaatgctaatgtagatctatcagttttcatacttatcatgccatatggatatcatgtatagaaactatatattttatataatagatgatttatccaatcacctatcttctctttatttaactacataatttttaaacttggttttgcctagaactaatatcttgcatgagaatggtctatcatctttttcatctccttttcccctcttctcattaactctcttgtcattttttttcttacgtgacaatatatttaatactatagagactagctgaagcgaaggatttggtctgccgtaaattatgatgcaactagatgaatagattgtattgattggctttaacacacccaaaaaaaaatcgatcagtagcctaggattagttgggtagatagcttgcgatcgtgtgtgcatgattagtagtagttagttagttgttgccaccatgcttgatggatcaaattaatacacgcagctaggtagcttatttgacacctgtgctagattgctcaatcgatttgcttaatttatgtggtagggatctcctctgattagggagaacaaactaacacaacaatggaataaagctagatcacctaccctattaaacaacaaagatcattatagtaattaattattggagcactactccagtttgtaaaggaagaagaaagtgtgccttttcagctcagggacaaaggaatatggattcagaaaagttagcctttttcccattcatgcatggatcctgctccctgcttgcttccacagctgcacgcatgcatcccactcttgggaggtataaattgtttgagcagtttgcctattattatccatcctgtctaactattacctccgttaatttattaagtcctactaatatgatctttcgatatttatagcactggaatatatgtcattcgataataggttattacattttagaataaagatagtattaagtaatcggcatgttgagaatttacaaaaatcggatttagttcactctactaaattcaatttagatgcataatttataattttatgatataaattaatttcaccaccaccaacacatttt

SEQ ID NO: 67478 - DNA, 2244 bp, Oryza sativa
catgacagatgagactacacgcacagttaagcgtgcaggaaacaacaggaaaatccaatccaatccatccaaatgcatggcagcatggagtactatactagtaagctaggatggagatgatggtgcccccaggtccaaatggcggtagagatgccacttgtggtatctctggtgtgatggcagcagcggtcgcaggcgaggcgcggcggtgcagccctcaccgcagcatcctctcagctcctccacgcatcgcccgcagcacctaattaataggataatcacttcacttcagttcatcactcgttcgttcgttttatacacattactgctaatatctactgtaagaatgaaagaaagaaagaaagaaaaaattgctggcattagcagagacgacgaacgaacatacaggtaaagccggttgcagtcgatgtttgcgcagttccggtgcctcaactcaaccacctctgacccacatgcatagcatctccccagctctgaactgcttctgtttctcccctcctcctcctcctcatcatcatcatcacctgctccaggcttgtacgttgccggtggcagggagagccgtccatcaaacacgaacaaattccccacccatcctgcagacccctcctccttcagataattggacactcctcccttcaatgtatacaggttccggaagcccttcttcctgggaacatagtgtacgggaatgaaacagactcgaaagaaagtcttattagaacgccagatgcatactatttccattccacaaagtgagaatgtcgatatctgcttacctaagaattgttgaatacacatcacatcttatgccaccagtgcagtacattaatatatctgtattttctttgtctataccatttagaggatctgaagaatccatctgcatacacacacagttacacactcagtaccaagtaggagtgtccagccgaaactagtccaataactaacaaactctactgtggcatacatcacagtagctagtcttacctcctgctctgactctgagagcccaaaggatgtgctcctgaagcagtccacattaggtcgctgagctccttgaaaatgtccaatatcccattcataatctgacaagaaatttttttaaaaaaagggaagtagaaaaacataaattccagtccaaaatcaaaagagtgacccgatagaacaggcagatccatcgagcttgtgatatatgaaaaacaaacctacattatgtttgtagttgaaaataggaaaaaaattacgaatatacttatttttacaataatttatatttatatacctgtatgtggagaatttgcgtaaatatacccgtccaaaacgcgggatcggcagtcccgcgggacggttggatgcatgcagatgcatgcagctgatccgtgaccgatccatgcagcggtcacgcgcggctggctggcggtaccgctggcgcggtaccttgcgtcagcccgcatgccacacgataccgctctttcgggctgcgagagcgagacggtgccgcatggctgggctacgggaccgccggtcccgcggaatggtagtgcgggaccgtctcggtcccgcgaaaccacactgtgaaagatgtatatttgtgcagattttcgccacataggtatataaacgcaaaataatgaaaaaagaggtatatttttaaatttaattcgttgaaaatatagttatattttctgtacagctcctatatttattcttaaaatacagttttttcttataaatttgtataagaaaacacacccttttctctaaaagggaattatatcaactctacatatatacggtcaatctacactataatctagacatacttccgacattggaaatttttctctcaatagtctccgactctctctagccatggtaaatatacaccacagatcataacagcaccactctaccaattacaaggatttatggttttgcctcctgttatgcaaacccttttttttctattaacacaacagcactaatagctattttcagccgtaaaaatatgcttatctctattcatcacttgttgatttggcagtacttaggaaacagctgctaaactatacaagtttgtattaaataaaaatatactttaccattcctgacatcgaggagcaaaagcctccttccagagctatctccagctgcttcactcgatgacacatcaaggcattttctagcttcaagtctttccctccactctgatggagt

SEQ ID NO: 67479 - DNA, 2232 bp, Oryza sativa
aatgatggaacaactacatgaatggaccttgcgctgcaccaaaaagaaaacttgaaacactgcatttgaaaaacatgtattggtgtatactgcactttcgaaatgttgaaaagagctagggtaattgctctagaatatgctaagacatcaacttgtaaaagctccaaatttccaggcagtggacaattgattaataatatttacaccgcagatcagagtttagttgaaggggtgcacaaaggcaagtctcatgggcagcagaatgtgaggggtctcctgatcttcatggaagatgcagtcgtggagttgggaagatttactttggactcctgcctagtaatggaactggaacagaagttggggtagctactcactccgttactgaggaaagacaggatgccatttccataaatagactcttcttaccaaatccttatcctgcgctccactcaaaatccaaaagaattgtttccagctttgttataccaagagaattattgtttttagataatggaaatgaattacattcccaggttctgccgttaggcacccagccagcccaaagaatataagaaacccagttaaggttcacagcaaaataaacatctcttccagagcaggaatcagtacgatagacaagttattttttcattcaaatgtaacagcagcaaaaggagctcggaggcataaggttgccaccatatagcatcaggagaaggtctaggccattttaaaatatatcaatgtatatccaggagaagctctagaaactcgcacgtctgattatttgctcagtatctagacccttgaaagaaacagtttcattattttttttatacacattgtatttccaatcatgtaaaaaaaatcatctacattcagttagatttagaagtttagcaggttagtagaagaatattttttcctgtatgacaatcttcagttcattgagacacttgagaaattcaatatagaaagcagatcagcgtatccaggtaagctattagcttctgtttcccctgtgcagtagaatgaaagcatggcttacctgaacaagcgatggtttgtaccgcagtttcaagcgaggaaaagcatggccacataacgatggtgaagtttggacaagtagatcacgaaatcgatggtcttttctaagccagtctgcatatgctaccgcatctttatgtggaccactgtactgtgacaagaggaagaaattagagtagaaattgatataaaaacaatcatattatgtaataatttgtacatgtaatgcagggctcagcacattcatattatggctagccatgctaaaaaataaacattttaaagattttcaggttttcttcttcatacatgttaatttattcattgctgcttaaaagagaaaatgcaaggtaaaaggcagtgatattattgtagaaacatatgtacatcttcacagttgtggttgactttgttgttaatctactttttagcttattcacctggttattgaaacatattatttgtccacgcttctaaaaatctaaaagtaatgtttattaaaaaatttcttctacggcattgcttataccagttattttaaggtattagttaagtttattttataaaatatttaatttatcactatactcgagtagagagtccacggcaataatctaaatcaagccggaccttaagcaacacatgtgcttgttactaaacacaatcatcattcattcatgttaccatgtcaccagtctcagtcaagttgtcatataatgataaaagacatggtaaataccgtagtactccatgttggtggaagcactagagcgatataagaaaagaaagaaagaaatgaaacagaagcttgttttacctgggcattgattccctgctcgttcatgtaaatgcggccatgtatgttcggccctgagagagagagagacgagtacatataaattcttggtacaatcaaatcgagccttgttagctgcaacaatttcacatagaggagaagagggaagaggaagagggagagaaggaataggaacctggaggaagtggaggtgcctggacacctcggcgcgggggtcgtcgatggagacgaacttatagaaggtgacgacgacgaactcttggggttgtgcaactgcaactgtggcggcgcatacgggggacgaggaacaacatcggacgagggaaggaggaatgtgatgggggcgaggcgatagttgtcgaggcgga

SEQ ID NO: 67480 - DNA, 3400 bp, Oryza sativa
tccgccgtctcccgttcctggcgccgattcggtccgtacccccatctcttctctttcctcatccttcaataatatatactcggtatagtagtaatatatcctcttaattgcaccaagtactccaattttttgattgatttctccatccttaatccttataaattagtagtatattggaccaactggttttgctgtccttgccctcagttgttcggaatggcttcagcaagatccaatgcctgcgcctttgccctgaagcttcaaacttcacccgtattattaccaaacaagccattgcctctgcttctgagtcggatgcggagcaccagcacagggcgtacatgcatctcagctatgcccttctcttggatgacccccaggactgcatcatccgctgcatcggtgcctccaccaccgacaatttccctgaggagaccatacaaaacacccttgtgcccaccgattgggtggccatgatgaggccctcttattggtccagcgccggccacttcgatcctgctgtgcccgaatgcctcttttacaggcttcgctccgatctatgcctcgttcaacaaatcaacatacagccattcagaggtcagcccacccatcctccttccttctttttactcctcttgctaaatactagtattacctgtctcttgcacccagctttcttccagtatggtgatccaatatactccgcaaaatatgtccgcttccagatgggttacccaaagacacctctaccatctcaattacttgtatctcatgataatgaaggccagttggctgctgatgacaactatatctggacgtacacatctccacaatttccaatgctgcaggtcagtgtttttcatgccgtcacatgcctcccctaaaaactaagcattcttgatgcaggatttatttttggcatgtatgggttggtttaccaatttttgctagcaaatcaaacacactctacattaccaaaatttcagaaattttcacatctaagcacatgcaaccttctaattccaaatatgagcaggtaatggatggaattctatttttaatcaagaagcccacatgtgtgtgcagtggtcttccatcggacttaatgtcaaacgaaatataacaaactaatggctgctgatcattggacaaatcactagctcgtagcgacttgtttaggtctaattgattgtttgtcgtcagaaaagaaaatcttattaccatttgcaattggttggatcaaccattacgagatagggcaccgtgccgtcatgccgttagtctcgagctttcttcgtctttttttttcttaatccatatttgacttggatgttgttttcgttttgaaaattggaactgtagcggccggttgaaatataatccatctgcttggatcatcaaaatcataatattatgtgtgctaacaaatcttgatttgtttcacatagaagctgcatcagcaaagggtaattgtaatactagcaaaacatgttaatggatcatttgctttgtgcctgctagctagtttgattagaaacagaattcaggacaatacatgctcacatttggaattatgaggttgcatgtgcttagattaaaaaaaatcggccaaaattttgtagcatcaaattttttttatcactttggttggtaacaaaccaaatacaatatattgccctactaaaccaaccctacatatcctggtagcagttttttgaatgtgctagatgtagaggggcaaatcttgtgttcctggtccaacatatataggtcaatacatcattgcagttctcgtgtgcaaacttgctgaatgtaaataatgtaccatattccaggaaagtgtccttcagtcttttaagcttccacgcgcagttctatgcatcggtggagttgtgaagattgagtttcttggtagggttcagaaacaggaaatggatgatctatattacatatggtgagttgggtactgttgagttattgttttgttctgaactttgtttcgttgcactgacaatgtggcacatgtactaattttcagcatatctcatgtccaaatagtggggattccactgccgcgggaactaggagtagatccttacaagaacggtgtggtcctcaagtactatccagatactcgcagatctggcgtgtgccatggtgagtcatcaggggatgatggtcgcaacagcccctctaagtggcgcaactttaccacaagaatcttgcactcaagctcagctcgacgattaggatggaaccaggccatcttgaacaggctgtttggcgcgcatgatgcatctgaggaagaggaggaagagacttaagaggatatatatggaaattcattttgtcccatgtgatgtatgctcactgtgtttttaagatccttttctcctttttttaacaagatgagaatgcactggtgccttgtatgtaagagatgctgtgagtgcatccttgttgaatgctactataatacatgctgtatacatgaacaaggattaatgagcggagcatagaatggagaagatgctgctactctactgcagttctgttgcatatggtttgcaattgacgatttgtttgttcgacaggaaaatgcacaataaatgaaggcatactagtatttgttgcaggaatgagttcaaaggcatttgatagagagatgagtggagaattcgctgcagaagcataatttgttggagaagcatatttgttggagaggcatatttgttggagagatgttggtgaaggttgcaaatgatggataatcagggagcatttcccaactcgaatcgaagaaattggtcctcaggtgatctggagcactgacctacctgatcaaaatcacaaaatgtggattgtttgaattgggtcttcagttcttcctgcaaggtttttttttgagagagagagttcctgcaaggttcaggaggagagagaaggtgtagagagagagggggagagagagaagggaactgcagtctgcattgcaatcccccacccaacccaacccatgaaatgaaatgaattcaatgaacccatatcgatcgattgatatgtgcctccgcctccgccgctctgcctcctcctgggccgccgccgtcgctgaccacgctcgctccggtcgccacgacgccgcgctcactgtcttccgccgcgttctcgccgtccacccgaccaccgccgccgccgacgagctcgcctgctccgccctcctccgctgctgcgatgcccgcttggcctaccagatacacgcccaggcatgccggcgcggcttggtggcctccaatcccgtcctggcctgctccctgctcgccttctacgctgccgccgcctcctctcccaccgccgcaataccgcctgcctgcaacctgttcgacgaaatggcacacaagga

SEQ ID NO: 67481 - DNA, 1311 bp, Oryza sativa
  unsure (1)..(1311): unsure at all n locations
gtccgagcgggcgcggcccactggaggcaagctctcgcgctctatccttgcatgctccaagcgggtgcgccgcccactcaacacaccttcgcccagctactctctgcgtgcgcctccggccgcctgcaccaccaaggcactcagcttcatgctcagctcctgcgctggggagcgggtctcaacctggtgctcaagaccgcgctcctccatatgtactgcaactgcggcaacatgggctatgcccacaccgtgctccactccacgcctcaaaccgacgtcgtgctctggaccgccatcattactggctacgcgcggagtggagacctccagtctgctcttcagatgttccgctccatgacccgtgctgcagtgctgcccaatgccttcacctacgctgccctgatctctgcttgctcctccttccgggcactgcagcctggacggcagattcatgcccgcttgttcaagtttggactagagcatgatacctcagtctgcaatgcacttgtggacttgtacagcaagtcctccagccgtttactcgacttgttgcacactttccatgcagtcgacaagccgaatgtcgtgtcctggactgccttgatcgctggacttgcatgccatggcagagatgaggaggcgtttttggcattttctcagatgcggcttagcggggtgcttcccaactcgttcaccgtctccactcttctcaaaggcagtagctcctcgctagctttcctgcatgccaggaaaatccatggctacattctcaagaccagctttgaatctttggatgcagctgttgggaactccttggttgatgtttatgttaggtttgcaaggatggatgatgcatgggcagtggcgaccacaatggccttcataagggacaggttcacatacacaagccttgctagagggttaaatcagatgggccttcaacagaggacccttgaaatgtttgtccggatgttccatgaggatgttgatatcgatggtttcagcatcgctagcttcctttcgtctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgc

SEQ ID NO: 67482 - DNA, 1088 bp, Oryza sativa
tagggtatcgcagttgtcatcataatgaagcattgtcagaaacaagagggaaacaaatttgctacctgaataaaaaatagctctaatttggcatattttacttatgggcttagtgtagatgccctaactggttgaaggtgagttttagcaacttgtgaatgaataatcatctgcttatgtgtcaaatttgaaagaagatacctcttgtaagctgacatttttttaatattatgcagctttgagcaattctgtatcaatctaaccaatgagaagcttcaacaacattttaaccaggttataaactggaaatactccactgaaagttctacattttgtttgatttaggttattcaaccactttaactttgagttctctaatcaacacatctttcattaacagcatgtgtttaagatggaacaagaagaatatacaaaagaagaaattgattggagttacatccaatttgtagataaccaagaaattcttgatctcattgagaaggtaaataaatttagagtcttatttaataccatttttatgatcaattttggtgcctatcatcaaaattgtggtaaccattaagcaagacattacagttgtaatctaatgaaagcattgagtactttgaatttattatatctctttcactataactaggaagatgacaagttacatgtcgttaatgatggttagtaattaaacttttatagcagcttgctttgtggattctaataattatgttctataacttcttgcatgccatatttgcatttcacttaatagcgtaccttcgacccacgaacctacttatgtgtcaaataagtggtaacccgctagtttccacatcgtggctcagcttgcgcacctagagatgcaagtggatagacccataaattcatttatatgtcaaattagtagataacccgcaagtcaatccgcgggttacgtactaattttgcctataagcgggtacgctggttggcccgcctgtatccctatttctattgctttttattttattttctcaagcaatacatttttatagcctacttgattttggttcatgcacacttataggtcttgtatg

SEQ ID NO: 67483 - DNA, 2954 bp, Oryza sativa
tgcatagataagggcaacttatttagttattttgatacatcttaggcgggccggataaactagaacatgatactattcttttacatgtgtgtgtgcgcgcgcgcgtgtgtgtgaaatcttcttggaatcaaacagtaacctacatgtcacttcaatttagacagtttactacctattcttaaacatttttccttctgtatagtttacatgcagaaaaggtgcaatttcaccatttttaagttcataaaattgatttttttatcagggagttttagaagcaataaggataagttgtttaggataccctacgaggcggacattttttgaattcattaatcgctttggtattttgcaacccaaagttctaggtcgaaggtaaattaatgtttgtttagttttttctcatttttacgggattttttctctcctatatttatgctaatcttttcaccaatactaatgtgtttgttggcagtcatgatgaagtagctgctactaagatgcttcttgggaaagccaatcttacaggctatcaggtaattattttaaaatttagaactaattcccctaaaaaaagttataactaattaaatcatgagtaaattcttttcatttcttcagcctgtcattattttattccatgaaaacagtaacctgatgctatcaaacaaatcaatttccatgatataatgtgcatttttgtttacgaggccactcctctctgccatttagcagttgtagtttgtttcatataatagtttttttcccatcatctttgcctgatataaatcaaaaggatattgaaatgcactaatgttggaaaatacaagggttcccataacctttatatatatatatacacacacacttataaaatagtgtgttaacaaaagttggtatatcattttgctaatctatgatctacctcactttttctgatttcaaatttacagatagggaaaacaaaagtgttcctccgtgcaggtcaaatggctgaattagatgctctcagaactgagattttgggactatcagctaaaaagatacaaaccaaagttcgatcgcatgtggctcgtaaaaaatatgtcatgttgcaacattttgctacacaactccaggcagtatgcaggggtacatatatatttatatatattattttacatacaaacactatttctttcccccatgaaattggctttaaggagagagagagtgacttctatccttcaattgtcgaaggtacaatcgcaagatggcggtatgaaactatgcgtagagaggcagcttcattgaaaattcagacatgctaccgtaaacactgtgcaaggaaaacatataaagagatttgttccgcgtcaactactatccaatctggtttacgtggtatggctgctagacacaaactccatttctatcggcaaacaaaagctgcagttattattcaggtatttacaaggttttactttagtcagctatcgtgattattttttttcattttaaggttttaattttaactccataaaattagataattatgagtcaataaattactcatttaatgatgtcatcccttgcagagtcattgtcgttgctacttagtgctctcaaattacaaaaggatgatgaaagccataataacaactcaatgtgcatggagaggaagagtggctagaagagaacttcgagaattgaaagtggtaagagcaattactttctccattctccctttcccctaggcatcaagctacaacattagaaacttttgttttgcaaactccagtgtagcttgtcatcaatctttctattttttttcattatatagttcttgttgttttatttcttcttaatattaaatcttctctatttttttgttcagtgcatgtcttagtgttaatgtggtaagcgcactacaagatactactggaataaaagaagtatgctagttatatgtagaaaggaacttaacagtaccggcaatgctgctacaaactcattatgtaacctagtttgcatctttcatagtttctatcaatatttttgcacaggcactctttttctgccttcctagaattgaacgaagagtaatgcaatttgactccttttatgccttcctagtctaaaaatcaatatccaatttgatttttggtgtgacttgccacttttgcattgctttcaggctgcaaaggaaactggtgctctacaagctgcaaagagtaaactagagaaggaagttgaggagctcacttggcggctacaattggagaaacgcatcagagtaaactagtgcactaaacacatgcactcttttccattaagttatctttatttatagtgcaaatgcatatagaagtgacatgatatttcctatcttttactacaagcaaagttatccatcaataaagaattatcatttaaatggtgtgatatctctaaggcacgctttgacctaactttacataccaacaaatacgttatgtctatttgcagtatgcctctattattatatgtgctacatataatattgattacacttgtccatttatagtaagttgtctccagtgaaaaaaaaagatggtatttactttaattacgaaaagagcatagtcccattgtttgaactaaccaacgtcaaacaaataaaaagggatggagacacaagaagtggaaagatagtttggcagcaagaagaatactgatagtttggcagcaagaagaatactaatgctagtatgatagcaaagtatcaggcattgcataacaccacaaaatgaaatttcgatgattatgtaattcctatgcttttttattcatatttgcaggcggatgtagaagaagccaaggcacaagaaaacaagaagctccagttacaattgcaggacttacaaatgcaattgaatgatacaaaagaattattacaaagggaaaaggaatctactaaggcggaaatggagaaa

SEQ ID NO: 67484 - DNA, 3531 bp, Oryza sativa
acataaatgatcattagattttgccccaactaaccactatggtcttgtccaagtttcacattaactccaagttgcatctttgacattgatttcaaacaaaagggtatacctatataagataattaaacaatcatgacgacacatatctactcataatctttgtatgataaagttaggtatttaaaaacataaaaaatggtcagataaaaaactttggccacatgcttcctttgataacaattgtttatgattcagaaatagtgttgaatttcagcagaactaatatgatacaagattgttttttaactgtatgtcaactaatatctgctcaagttagtttcaaaagatttaataagggttgtaggatggggtatttggaagttatcttgactcttttattcccaatggttttatatgatcctcaggtatttcgtgcttcaaacattactgttgacatggatcttgtgcgccaagttgaggccaagtatcctgcatttctttttaagcaacaacttacagcttttgtggaaggcttatatggaatgatccgtgataatgtgaagagagatatatcttcagtactcacacttattattcaggttaccccatctatcacgagtcatccgcaggttaaaaattatttcgtattttaaacattttttgtggtaccattatgggtctgagaataagtatacttctttggaatcttgatgcgcaagctagcattgcaagttgagaactagagtactaagatgattttaggtcgatcaaatttgtcttgttccccttagtagaacgcttgaaccctttgcacgcaaagtttgaagaaaatcataatgtcgttatatgatgtgcactattgtgcacttgtgctttgagtttttcttggttattgattaggttgtcatatagattttgaagcttcatgatagttgtataccctttttctcaatgagtgttaattatatatctaaacttaatgtcaagcagttatttatgttcctagtctaatgtcgattcttgtatgatattgaacacaccaagaagtgccaaagctggtttattaacagatcaaggtaacaattggcaagcaatagtcaatcatttgaatgacctcctgaaaaccttacaagaaaattgtgtaagtgttaatgtgcatatcggaattgcatttggttacgttgtatcttgatttttgatcactgtgctgaaatttcaggtcccatcaatttttgctcggaagatatttacgcaaatattctcattcatcaacgctcaactcttcaataggtgatttactgctgtctggatttttaattcccttttccaaatgttttctcattttcctggtactatgttctagccttcttgtacgccgagagtgttgttccttcagcaatggagaatatgtaaaacaagggctgcaagaactggaagcatggtgtacacaagccaagccagaggtaagcaaaaacatgttattttgctagtattctttttcaagatacacactttgtggtatgacattattctcatgtactttgtttaaatgccatcaactatataattcatacatgaaagatttgtgcatgtattgtttgacatattgtattaggggtgatcataattaccaaacatcgaacctaattgatctgaaccaataccgaacttaagtgaaaaccaagcaaaaaaaaacaatgaaataattcggtttttttttctaaaatttggttttcgaattacatcatcaccagttcactaatgtcttgcatgacctttacattttatctatttaagaaagcatcatatggattcaacactatctgttagtataaaaattattccatattacaatcatattgtgttgttagtatcttttcagtttttttccttgtgcagtcgtacctaactgagacactaacagtatgcaggatctgcgtgggatgaacttaagcatataagccaggctgttggtttcttggtatgtaactccaaacttaaacatgtggggcgttattaattactattatatatgtgaaaaaaataaaactgatgtaatgcatggctgattttgaatgatgtacacatgatctttcatagacaaaactaccttcttacatggggtttcttgttgtattttgtggtgcgctataggtcatcttcaaaaagttcaggatttcatacgacgaaataatcaatgatctgtgcacggtaagaccgcccctccctccaaactctcacatgaaaaaaagaaaagaaaggggatgtaggtgaagatgaaattaaacccattggcattattatatatgcaggcactgagtgttcaacaactttacaaaatatgcacgcagtactgggatgacaaatataatactgaaagtgtatcggaagaggtgagcagtagatgcaactaattaatataatgcatgccggttgagtacttgagttaccctttgcaaaacgattcaagatgaaggaataagacgtgcatgaaggtagtcgttggtgtgttgaaaatattttgacgagcatcgatgcttggttgattgtacataggtcctaaatgagatgaaaacattgatgaatggaaaggatgcttcggatggtaccttgaaatcattgatgaatgaaaaggatgcttcggatggtacctttttattaaatgaggagataaggtacgtactcaaatataacatatagctagagttttactagtactaccttcgttttctaatacaggatgtcattaactttttttaaaacgtttgattatttgtcttattcaaatttttttgcaaatataagaaaatttaagtcatggttaaagaacatttgacaataaatcaagtcacaataaaataaatgaaaattacatgttttttttcaataagacagaatagccaaacatatatttaaaaagtcaacagcgtcatatattaaataacggagggagttctattttgttgtgttttgtccgtgctgaaaatgaaaagtggatcgaaggaggttgaattaattagtttggagattattaacatgcagcatgccgttatcattggaggagataggcgattcaatggatgccaaggaatttcagaatgtggttccacctcaacaactccttgacaaccccgcgttccaattcttgaagagctgatatatactatattacggtccagctagcaatcgctgtaaattagtgtaggtttccaacatgttatttttagtatagcgatctctaggccggttgggttgggttggtggtgtgtaatgttcacccacattctttataggcatcatatgcatttgacattggttctttgtgtaagtaaggtatttaattactaagtactgtacacgtagggggatcatagaatagagagagagagagtcatatgtactactaaaactagctgacgagtaatttgtagtttgtacacacagacaaatagtccttatggatgatatatgatgaatgcatcatgtgaatatatatatacatacatacatatatactgtaattaattaaag

SEQ ID NO: 67485 - DNA, 7736 bp, Oryza sativa
gagggatcctgaagtggtggagcgcggatcggccgtcgaggcctttggctctgtaatgcgagaggaactccggcatggtggtgctcctgtagagcggtggcggcggcgtggtggtgacgggggcgtacaccctggtgcaggcgtagtcgggacggaagaagcaggcgacggagaggcgaggctccgcggcggcggtggttgccaacacccggtgctccacgcttcggaagaggtcgttggacactagctggaggaggtcgccgatgttgaccaccagagcgccggccaccggagggacgtccacccaccgctggcgctgcctcatgagcacctgcaggcccttgctctcctgcagcagcactgtcaggaagctggggtcggagtggcgtgtggtgcccagcgtcaggtgcggctccgggcatggcgggtagtagtgcgctgccatggtagccagccccccaccgaggccgccgaggtactccggcgggagccccagcgcctccgacagcagctccaacagcgccccgcccagcctctgcaccgcctccacgtactcccccaccacgcccctgcacgccggtgggatctcctccgctgccggccccggccgtggcgtcagctccagcaacagcgtgtcacgccagttggcggccggcgactggaacaggtcgaaattggagttgaacttcaccctccgcccgctgtccctgctgtaccaggctttcttgccctccgccggctgctcgttgaaccgccgcaccgccgccagcatctcctccaggagctcgccggggatgccgtggttcaccacctggaagaaccccacacactgggcggccgccctcacctgaccaaccagatggcctcggtcaacgtccgcctgcagatcgatcaccgggataacatccgcatcctcctccgcatcgtccagtagcagcgggtggtggtggaagatggcggggatggttgtgacgccggcatcgacgaggcccttcacgccggcctttgtgtcgtcgaaggcctggaggtcgcgtagccggtcggagccggagctgctgcccatcgatcgatgacctgatctatccattccagagaggcagggacacactaatccaatccaatccaatcgattcgatgcgataccgattatacagtttactacttgtagttgtagaaaggaagggagggactgccggctatgccagaaatgggccgggtttcgtccaaatgttgtttcctattaggaataagtttaacttatgtccctcaattatcgccaagacttatactcgtccctaaaccgcaatatcagatatggcgtgtccctcaactcctaaaaccgtgcaaataaggtccaagaaggtttggagtgtgatttcgactaatgtggtacctacacggtattaacatggcacttaaagttagaaaaaaccatatatatgacccacatatcagctactgttcagttaaaaactagaaaaattatagtgagacccatgtctcctccccaagctcccagtctcctccgttcgtcagcaattgcatctccgacggcagcgaaggagtcttcctcccttacccacaatgcgagcttgtggtggtgatggattcctagccgcaacccccctccccctggctctctggcgttgccatgacgacggtgtagccgagaatgcttgacacccggtagcagttcgatcatgacaagacgtcggccgacatgatgtcatggctcaagatgttcttgccatagcatagcaggaggccgtactagtaccggaggaggatccagcgacttggaggcgggacccatgcaacaacggaggagacggggacagggagattgggttggaagaggagacctgggtctcgctgatttatttttttaattttaaccatacagttgtcgacgtttggtgtcgcaattcaggtatttgcatagtatggggatcgtcgatgctaggatatacgcgagactgaggtaaaagagacggagacagagatttttatataggttcgggcccctgagttgtcaagtaataaccctacatcctgttggccgaagccggtattgctcttattcaccataatcacaccagtacaatatgtgggtagcctatctaactgttgtcgacatgtcggtctgaaggtctgtaacgctccgctttttgtgaggcgttaaaaactaattcggcaaaatcctaatttcaaaaattccgttccttgtgtgcgaatctaagtcgtgccgtggatctcagtttaaatctatcgttgttccctctcgtcgccatcaaaatcctccacctctaaaatgtcaaccccaattcatcttccaaagtcaaacatcgaaattcaatcgcatccttcgaattcccgccaaatacctgtccccatttccgaaaatatcaaattcccatctcgaatcctttccttgattcctccctaaaccctcgactttgaatatcgaatttgaatccaaatccaaacttcaaatctcaataaaccagcctcctctgtgaaagtctaaatcgcctccctcaagttttgtgggccgattttgtccccctcggcccatctctctctcagccgtcccctccctcctccgcacgtgcgccgcacgcgcgtgtgctgagccgacgccgagctgagttctctctctctcgttctctcgatctctctccccgtttcactccctcccggcgacgatctcccgcccgcgagtttgaaatcggcgccgttgcttcacgcgcgcgcgcccgcgcggtcaccgccgtggtcagccgcctgcgccacgctgccgctcggccccgctgcctgccgcgagctctgcagcgcgtgcccaagccgctccacccacgtccgtccaaaactgagaagcagagccctctctctcccgcttctctccctcccgaaatcggcatggagcaaagccccctttccaccaccctatctccctttttccctcttcggttcgacctctctctctcccgcccctgttcgcttgcgcttggaggcagagacgctgacaccggtgcgccagttcgccgcccccaccttgactgcgccgagctgcccctcccccgctcgcgaatcaatttccaccgcccgatccaccggcttcgccgctctttgcatcctcgtcgtccgccgctcttgcgtcgcccgtgaccgccgccgagcgctcaaccgccaagtcggtttccacctccccaaaccgacctcgccttcgctataaaaacccgagcccctcccatcgaatccttctctcgtttcacttccatcaccgccgcgccattgttgttgctcgccccgctctcgccctcgccgtccgccaccgagcaccggaggagccagtgcgtgcgtggacgcgtgacgaggagctccaggctgcccattgccacctctccctcccttcttccccggccgtgcaccctcggtgccgcgccgccccgccgtcgcgtccacctcgccgcgactccatccgcgccgccaacgccgtttatctcgttggtgagctccccaccgaaccacttccccttgtcgcacgccgcgccatgcccgccgccgttcgccacagctcgccctcgcacctccttggctcgcgtggtagctcggctagcctctcgaatgcgcgtagacgccgtcccaggtctcgccgccgcctggcatggcctcgccgccattgtcgcccgctcccggagaccgccgtcgacgctggccctcctcggtgctcctccaccctatccggagccggaaacgggatccccgactcccagagatactcccaccaccttgaattgaatccttgtcgcccctccgccgtttccctcttttttctcaccgccagcgcgcgccgccgcaatccgccgctgtcggcctttctctcgccgattccttgcgccgcgaccctccccgtgtccccttgaaccttcccaggctgccgccccagtcgccggcctccccacccactcccgcgccatgtcgccccttcagccgccgcatagcgccgccgcgagtttgaatgcggtgaccatcgggtcccgcgtcactgcgtgcgcgtcgcaacaccataccggttcggctaagcccgagcccgcgcgcccttcgctcttctcgcgcgcggccacgtcggcgtgccggcgagattggccgccgccgccggccgtcgtcgcgcgacgtcttcccgatccgagccgtggaatgagttccccttctcctcctcctgccgccggtgcctgccgcccactccggttcaccgccgttcgtcggcgcctctcggccgccgtgagccgtccgatccgggcgagctcggcctccctctctcgcgcttgcgtggcagccacctcagccgtcggccccacttgacctggtcaagccggcgcccagtcagccgccccactcctcctccctctctctctctctctctccgcgcgcctcttgggctgcctccttgtgcccgcgccggcccaatggctcggccgagcctccttcaaccctttgggccgcaccaatgccacccgaaacaagtctaatatacatccctccttgattttcctttccaaaaaggatttaatacatcctttttcctttgttccataaatcaattccttattccaaaattccatgtcccgcttgtcagttgtcacgccccgaactagtcctgaccggaactagcccgtgacgctccaaattaacctattaatcgataccagtcccaggaaacagtgctggtatcacagggagacagaatatcacagcaacagaggtctctttattatagagtagagatacagtcatgttgggctgcggacagatcccgagctcacaactgcattacaaaagggaaacggaagccaggacttggaccaaacaacacaggcgcggcttgggaactaggccgaaaccctaaaactcatcgtagccagcttgctcctggaagaactcctcatcagcaggatccgcttcatcttctttagcaactgggggagattatttatatagagcaagggtgagtacgggggtactcagcaagccatgggaaataagtgtttaatgcatgcttcaaggaaaggctgttgtttttgcaattgattttatttgaactcctttctgaaaacaactaagtgagtgcttctcaaacgacacggatgagacagtgcgtctcgtccggtcggagtatgtgcaatgtatcagtctttagaattgaatcaaggttggcacccggccaacagcttttcaaacagccacccgggccaacaactttcaaatggccacccgggcctagctgatcccatcagctgcagatctttcaaacatcgaacccctttccacaacagcaatttcacaagcagtagtcaaacaaaactacgctaggaatcacctcacatccgcccatgaccgtgggcatggctgttcgaacagtttgttaacctctgcagagggggtacactttacccacacgacattactaacccggatcacccagcccgtggggatcagccacgtcgggagacctccaagctttcatgacaaggcattttcaaagccgacacaggtttaccatatgccgacgagaggggtcccagaccaacaacaggttaggtcccaaaccatactgtgccaggaagcccaggggtcctccccgacaccaccccggcggatccacatgtctctcggcatcaaggctcccctgataagctagttactcagctaggggtgtcccattccacccatgtggtcgtacttgtcttatgtttggatgaaattccaaggaaacggtccttaagtgcaagagcgggaaaccgtacacccggtacattccccggtccgcggttttggaaattcatttagttcgcaagcaccaacccaggtgtcgggttttccaagtcttttgtaaaaccaaagttttacccaagttgttaatcagattttaagttttgaaggcgtccgtcgatactcgcacagggtgcacgaatatcgagacgcaactagatggttacaaggggacatgatataacaattaacaaaggaaggatcaaatgcaacaaattaggtaggtccgccaatctgccttgcagacgggacaacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtctttgggctccgaaactacacgcgaaacgggacaactcaacaaacggcgaaaataaagccctattaatgacctctaagcgtgccattagatagatctcgagatttgaggaattttggaagttggacggagtcaaacggatttacggttgggaagatattgaatttctaagattattggatttttggtctaaaggaaaaggatttaattaaatcctttttggaaaagaaaagaaaagaaaagaaaagagggagggaatatagacttctcctcggtggctagggcgcggcccgagagaattggggcggtccggccgagctaaatgggccggccggcccaaggcgcgcgcgcgggagggaggagagagagccggtggaccgggctcaccgcgcgcggtcccgggtgggacccgcttgtcggtgactcggttcaccgtgcggagcgagcacgcggcgcacgcgcgcgggcggggctgcgacgcagtgcacgcgcgtggttcgcggaggaacggatgcggcgggcccacgcgcagcctcacggctcgcggtggaacgcgcgcacgggaggggctgaccggggtcggcccgacccgatctcggccgagttggcgccgacgtggcgcctacgtggctgccacgtgggctggcgagaggaagacgaaggcgccggccgcgaatggacggcgggcggcggcggtttctccggggcgccttgcgacgatgaggggcgacggggcgtacaccgggatgacgagggagaatgagagggagcgagccaacggcttggattcgccggagggagtccggcggcggcggatttcggtggcggcaaccggcggagtgcaaagggggaaacggcgacgaggtcacgaggagccaattcccggcggtgagagcatctacgcggctacgggaatccgttgctagcgtcggattgggcggagctacgccgagcgaggccggcgacgagcgggtgctacggagctcgggcagcgacggcggcgagcacacggcgagcgacggcaacggtcggggcggcgccggctagctacggggaggctactcatgctaccaccgaaaactacggggagagatggagcgaggaggaagaacggagggaggcactaccgtgcgggcggggcgcagtgacgagaggccgacggcgcgggagtaatctctccggcctcaggccggggaagaggaaggagagggtgcgctcggattccccttccgcatccacaaatgaaccaactctcccagcacttgacaataaacggcagaagcgatacagagctgcgaaggcagcagcaacaatggctatgggaggataagagagggagggcgcctgagctttaaaggcaacaatatcagtttgaaaccaacttagacggtcaaggcacaagctgacactgagcactcgcttccaatcagcaacaaggcggaagaagaataacgcctgcggcaggaaaaaggaaaaagaggcatagaaatggtgctcgcccctttgttcttt

SEQ ID NO: 67486 - DNA, 1257 bp, Oryza sativa
tcgcccccgggggaggcaaaatagacttttgcggaggaatttgatttggaaggatttggattcgggattgaactcgacgatagatcggggatttgagatctgagatggcacggacactagacaacagcaaagaaacaaatttcgcaattagggtttttaagagataattttcccgctaggcgccacgacggaacgggcgctacatcagtgaaattcaataatattcttgagaatattatttctataaattccataaaccatttctcgtattccagaaaattccgataaatctttttcttgtccagaaaatcaagttaagcttccaaaattcatatctcccgatccgtaactccgattgactccgttacacttcctgtaattctctaaaattgagatctatctaatggcactattaattagtctaaatagggtttttcttttggtcttttgtttaggttttcgattgtttgcgtatagtcgcggttaccggatttttgtcgatcgtgggatttctcgaagattcgtgaagcttcgtgaagactttgagcaaggcaagtcaccctttgaccaattgctcctataattggaaaatcattattattttgtttgcaacttgcattattagaatcacccgtttaacttgcttggcctcggtttgcatgccaaaccgacggacctacctagtagtcgcactaattcctgtaggctgtactaccctgattccttgtagctccacctttgtggtacctcggtatccgtgctctctgagcgcgtataccaaatatcccacatacaccgttgtttgtcgaaaacttgggaaatgggtttgagaagccttgaaaacccgacatgtggtgtcggcgtgtttgaaaataaaataaattgtgaaaactcgcgatgcaggggttgtgcctgtgtggcactgtcccgtattcgcatataaggactgattcctgtgggaacttcatccgagcatataacaagtgcgaccacacgggtgcaatgggacgcccctggctgagtaaatagcaaaccagggaagccttgatgccaagagacatgtggattcaacggggtggtgtcgggtagaaccctcgggcttcctggcatagtatggtctgggacctaacctgttgtcggtctgggacccctctcgttggcatatggcaaccctgtgttggctttcgaaatgccttgtcatgaaagccttaaggtctcccgacgtggctgatctcacgggctgggtgatccgggtta

SEQ ID NO: 67487 - DNA, 21188 bp, Oryza sativa
atttgttgcatttgatccttcctttgttaattgttatatcatgtccccttgtaaccatctagttgcgtctcgatattcgtgcaccctgtgcgagtatcgacggacgccttcaaaacttaaaatctgattaacaacttgggtaaaactttggttttacaaaagacttggaaaacccgacacctgggttggtgcttgcgaactaaatgaatttccaaaaccgcggaccggggaatgtaccgggtgtacggtttcccgctcttgcacttaaggaccgtttccttggaatttcatccaaacataagacaagtacgaccacatgggtggaatgggacacccctagctgagtaactagcttatcaggggagccttgatgccgagagacatgtggatccgccggggtggtgtcggggaggacccctgggcttcctggcacagtatggtttgggacctaacctgttgttggtctgggacccctctcgtcggcatatggtaaacctgtgtcggctttgaaaatgccttgtcatgaaagcttggaggtctcccgacgtggctgatccccacgggctgggtgatccgggttagtaaatgtcgtgtgggtaaagtgtaccccctctgcagaggttaacaaactgttcgaacagccgtgcccacggtcatgggcggatgtgaggtgtttcctatagcgtagatttgtttgcctgtgctttgtaaaaagttgttgtggtttgggaatcgttaccagaatcagtctatgtggcagaggatgacctgagtggtcaagaaacgaatctgtgtgattcgggatgtctgcgggcatcatagactaggcttcccgagtggaagcggattgttgtgctgctaggcagctggactctgggagtccgagaaaatgaaaaagctctgggagccgattaatcaagtgaaatggctctcggagccgagaagtaatgatctgacccgggaggtcggtacagtaccaattgagttgttgaaaagcatctcttaagtcgatttgagacgcaagtctcttttcgacccaaacttaaaaagaagtaaatcacttagtgatttcaaaatgatttcaaaattaaagatttgcaaaacaaccttgcctctcttccaagcttgcattaaacacctaaattcccgtgacttgctgagtacgaaagtactcacccttgctctatataaatatatatatatatatagttcctccgcctcgaagtgaagatgaagtgaagtgaagaatagggtttcgtcctggttcccagccttcgcctgtggtgttgggtgttagtccgttggttccgctgctgctgctgttgttggtgtttctcgtccacgtcgtcggttgcattctcgggctgttctgagttgcaacctaagttaaggtaaataagtcctctatttattttaaggattgcaatgattcatattcgtcaccgtgggtaccagcgctatgtcctgggactggtactgagatcgcggtttcgtaggaagcggttcgcgccgtttttcctacgacacgcttctattaggtgccgttctacggtggtgccagattggggtgtgacagagaggtgtaacatcccggcctagcgcttaataggattaatagaatactcatattaacaagttgcaacttcttttccagaagccgatctccaaagaactccagggttaagcgtgcttggcctggagcaatttgggatgggtgactgaccgggaaattcttttcccgggttcgcacgagtgaggacaaagtgtgtagaaaagacatgtgttggtctgtgagggcagtctatgacctatgaaagctgccagatgtaagtgggcccggcctgggagaggcgggtcgttacaaggtctgactcgtagtcgacaacagggtagccttcctcctcgaatccaatatggatacaatccgagtagtccttgtcgtttacatgtagaactctgttgtctttccttatctagaactctctcgaggtcagtttctgtataagacatggtatgtggtggatcgtggtggatcctgccgagatttagtcaactactattaggtatgtggtatccataaccctgacagtagcccccgacttcgatgcaaatgaacgagttcatattctcaaccgcagactttggaggaactgttatcgagctcacgtgatcgttctcggtgagtttagagataacattagatttcctttatcagcctcgtgcaggcaccgaaagggtttgtctaagtcaatctctaatgccgaccgagaaagtacagagcatacgactaagtctcccgtcttgctgtaatcgagaatttggattgaactcaagaaattttatctcggcgggtacaccatctcttcattccgtattccttgtcgagatccagcaaccgttctcgaacaatcgagaaggcgtagagtctgcgacagagctttgtcaacattggtcgtactcgccttagtcgatcttggtgtagcactatagagacatggagtcttcgtcaatgtcgcatagaattttcctgaaatcaatactcagaaaagaatatcaaatagaaatagcccctgagcgaacgctcaaagggtgacatgttataatatgtatggaaaactgtaaatgaattaaatttacagatcaatgttttgtatatgagtgtcttctctcttaccgactccgatcagtcagtttgtagagtcatacactctccctagcccccagccttgtcgtcagagaatcgttctcggaggataaggctcttggacccttgacctgccttggttgaacaagcactgatcctagcccccagccgtgaagttggaaagttaatttccgattacacggcttggttaatacgcacggcgagaactcttacatgaccaggtcttacatggtctttcgtctctacaggatctgacaaggccttatcggctctgggcgtccccagccgaagatcccttaggttcctcggaggccttgttaagacggcgtaaagggacaataggataggtttcaacgctaggtgtcatcgtggtaagggatctctgggtaaaacacttggcgatattatgtacctgctatcaactttgttgaagtagaggtagtaggagaaatcgctacaccgctggtcgaggaccagatagtagtcgtaactcgaccacttaaagtggaagtagtgggagaaacgctacatcgttggtcgaggaccaggcagtagtcgtaactcgaccacttgaagtggaagtagtgggagaaatgctacatcgctggtcaaggaccaggcagtagtcgtgactcgaccactccaagtgaggcgagagagatcactacgttttactggttcgagaaccaggagtaggagtctcttaatcacctataggggcgctaaagttggtttattacatgtgcacatcatgtggccagcatgactcacatacccaacttatagcatatcctgatgtctgctcgcaatcatgtcgggtgatcaagccgacgacgttcgcgaggaattatccattaacaaccttttctcgagtagtccagcgatggccggtgctatgagataggtcgtcggtcttcgttgataggttgggtgcgataactccgcatttgtcaagaatgttctcaataatggagtgtactcgaccacaacctactcgagtgctcaattgttcctgaaaattattttctagaagcaagacatatagcagataatatcgagtatgtactcaaaaactgcgtggatcttctagcattatcaggatataacgatcagattaaatatcaggcattatgtaaaccgtaaacaagcatgatttatacagaagagaacggagcgagcccccagcgttagactgtagttgacctgacatcgaaagcactcgcacaatagatattgtataaaaaacatgctctaggtaaacataataaattattgatctgacaatgctatatgatctgaataggtacgataaattgcatataaaatattgcgtacctgtgtagatatatgacggatatatctacggaattaatagattaatttaaaaaaccaatctaccaattaccttactgcgtactcattcgatatcatgtgatctgacatctcttggtacgccgcggagcttgaggcttggtcgatctcgagagatcgagttgttgatgacgatgattccgatctcgtcgggggacatactccggttgggttagatctcctatagccgaagttgtcgagtagtatgttgtcggagaatccatcttcttaaacccatctcgtcgaaatcctagatcaccaaaatccccctacctggcacacactgtcgatgtttggtgtcgcaattctggtatttgtatagtatggggatcgtcgatactaggatatacgcgagactgaggtaaaagagacggagacagagatttttatacaggttcgggcccctgagttgtcaagtaataaccctatatcctgttggccgaagccggtattgctcttattcaccataatcacaccaatacaatatgtgggtagcctatctaactattgtcgacatgtcagtctgaaggtctgactcgtagtcgacaacaaggtagccttcctcctcgaatccgtgcccggcgagattagagagcgctttcgtctctcctgactgtatccggagacaccataggaaactagccgtggctatccctaaagtcgatatccggcggcttgtcttggcgtatgtaggcttgtatgttgtcccgtgtattatgttgggtgttgattgaggtcgttgattgtctgtgttgatcgccccatggtgggtgtccccctgtcctcctaggggggcttgtatttatacccataggagtccccttgtccaagtagaactagggaaaccaatatggatacaatccgagtagtccttgtcgtttccatgtagaactttggttgtctttccttatccggaactccctcgaggtcagtttccgtataagacatggtatgtggtggatcctgccgagatttagtcaactactattaggtatgtggtatccataaccctgacaacagtcattgacatgtcggtcccacggttttcctaattttaagtgccacgtcaacaccacgtaagcgccatgtcagcctaaactgccaaaaccgtcttaggaccttatttgcactggttttgaaagtagagggacgtgtcatatctggtattgcggttaagggatgaatttcagactcgatgacaaattgatggacctaaattatacattcctattatatcgtcgacttctgtctacaggattttattggacctaagccgacttatgcggggacaccaatgttttaaatagcgggctaaggcatttagcagtttgcttcttaaacagctatagctgcagctatagcaggctaaatggagctatagcggctaaattgtacatgagagcaaatagctagaatccttctcaaacatctatagcgggagatttaaaaccctgggggacacctaactcgcgcgtacaataaaataagcgcttagcattaatcacactggtagctttataatataaaataatataaaataagttgatttttttctaatttaggttgaaattttttaatgtgagctgaaaattttaattttgaaataggatatttcaaatttttagttgaaagttttaaattttaaatgtaaagtttttaaatcttgagttgaaagttttcaaattttggtttggatgttttaaatttgacttgaaagttttaaaattttgagttcaaagttttaaaattaagttgaaagttttcaaagtttgagttgaaagttttcaaatcttgagtgaaaagttttagtttttattagaaagtttactcaaaaatttgaaacttttcaaacttgattcattttaaaatttataagtatattcatttttttcaattcattttgaaattatttacttctaaagtattattcgtttaagttactgcttattatgtgcaaagatatatactgttaacttgcaaatatatgcttagcagaaagacggactctgaaataaatattgaaatcatcaatcagtagctctcaattaggcatccatgcatacatcttttaagcaagagaaaggacatgtatgtggtcaggcgggcggtcaagcttgaagactgacttacacgttgaccaaaaaagcacgcctaaccaactcaccccaattaccagtataatccttccctccctaaaaagaaaaaaaaaacaattctgttaattgatgtacctcgcgggagtactaattaattgagcctctgcctttcaaaagtgtagtgatccagtaaacaattctatccagccaaggcatgcatgcagatgagaaatgcatgaatgataccatctggtctcgctgtctggctgtttgatgagccctaattaacatcacatatactatttaatttaagcaactgatgatgatggaatgaataacccagcatatagtagtatgtagatatgtatagtggagtactctagtagaagatgcatatgatggaaaaagaacaagggatttttttttaaagacgagaacaaggaattgattcagctaatgtagacatatatgcatgcagcatctagctagccaagtcatccatcacatcatcagatcgatcagctaaccttaccttagtagctctctggttaattaattaggcacacgtggggaaatgaatctgtcgctaaaacggagtagtagtagtaagtgcacaaaccaatcggccaaaaaaacggggatcgatcgatatatactctacattatagactccttaagtccttattatatgatcgatttccccacctgaagccggataatcatgaaatagtccgcacaaattaatttcagtttctagaatctgaatatacacagatgcagaatgtgcatgcacctggaattaatcctgtacatacgagaaaacaaataatatgtcacattttgttctaaaacactgcgaggtggcattttaacggaaaggcaatatgcgtaatattttatccggtgtattgatctagtgagtggtattttatccaaatcacaagaatggagtgacatatcatttgttttctcatatatattattaggtgacggattcagaaaactttttaggcctgggcaaacttaataatagataactagcacacacgataatccatataatttaccattgatataacacatgtgatgtagtgaggtttaattgctttgctaattttcttgttaatgtggtttcattagtttgtacatgagtttgattagctaattttcaaaacaattacatagagtattgtgtactccctcgattttacactataaaatattttaggttttaaataaattcatatatggatcatgtatgtgcttcgtatatgtatctaattttatatggatgttagtgaatttagataagagataaaaagatcaaaacatcttatagtatggatcaacgtggaactaagggagtacctactactaaagatcttgcatagtattttgataagatcattgacagtaaactaaggcctcctttgaatcaaaggaaaaaaaaccataggaattttagagcattttatcatatggaaaataattctatagagttctttgaaacaaaggattgtttcctatcctttttttttgaaattcctatgaaattgattttactagagcaattttagaggaaaataagcatgattcctcttctcatgttttcctctccatatgtctaagattcttgtgtttttcatttgtgctaatcaaacaataggaatcctcgtatgttttgtttcggatctgctcagttgagtcaatctgtgtctcactgtcttgttagtgagtgggtgtgtgagacagagaaaaaaaatcatttactggttaataaataatgaattactccaattaattgtgcaagttgcatggggtttggggagggggaaggagcagagcagtatatataaaagggcaaagcctccgtccatttattcatactcgatctattattcggcggcggctgcctctgcttgcttgtgactgtcgtgtctgtgcgtgtgtgtgtacgtacatactccagtatatatatgcattgctgcatgtcgcttcatcctcaccgccgccacggcgacggcgacgtcgacggatcagcatcaggatcaggatcagcgcgcctcaccgccggcctcatcaacttcctcgaatcgcgtcgcgccggcgccatgagcaccaccaacagctcatcctctgtctctgtcccagccatggacgcccatggacaggaggaggaggaggagccgatgcaggtgcagcaacagcaggcgttccgcggggtgcgcaagcggccatggggcaagtttgcggcggagatccgcgactcgacgcgcaacggcgtgcgcgtgtggctgggcacgttcgacagcgcggaggaggcggcgctggcctacgaccaggcggcgttcgccatgcgcgggtcggcggcggtgctcaacttccccatggagcaggtgaggcgttccatggacatgtccctcctgcaggaaggggcgtcgccggtggtggcgctgaagcggcggcactccatgcgagcggcagcagcggggcggcggcgcaagagcgctgcacctgcaccggcggatcaggaaggcggaggaggggtgatggagctggaggacctgggacctgactacctggaggagctgctagccgcctctcagcccatcgatatcacctgctgcacaagcccaagccaccactccatctgatctctactcgtattcctcacacgcgcagaggatgcacatcctctgcactacacttgtactagcagtggttaacatgtggatccggttccatgctctgattgttgcttatatttttcaaggaatataaacaaatccgatcctgagttaattagtgtaaatatatagattttgggtttcaggattaccatttttatttttggtggcaccatccagcttaacattgctccgattcacaaaaagaaaaagaaaacactcctactgtacatatacatatatgggcgagcaaattaaagcgggaaatgacgctgtgtttgaaatcgtctaatctgggcccttgttttggtttgctttggtccatggacagattgacggtgctgacgtcacgttgcatgaaagcgaaccgaacgcagatgttgacctggtcaagtccaaagtccaggaggcacgcacgtagtgattcacccacgtgcgtcaatttttttactcactcaaaagcacccagcaacctaaatagtgccctacaatataattatattccctctactatagcactactcctatgcaaaaaaagaagaagagagatattcatttgtaagattattttctactccagcaacttctcttttttagattatccattaccttaaaaaaacaacttttacagtaagtaagacaaatttgtaaaagataatagcctcaagattaaagacacgtggcaaatagatcatttcctccgttggtttgtttgcccaagtgcaatgaattgaaccagattgttgacgaatggggaggagtactggcgattaaaggacgatggatggatcagagttggcaactgccttttaattcatcacatgtggccttggtttgttgctcccaaaacaaaaccaaaagaaaaaaaaaagtcttgttgcctttgactcgaattaggagtattaacaattactagtagtaattgataacaatccttttgcttctgtaaccttctttccttcattctgcgtgcctgttatatatgctaatgctatcggtacaagtctagaagattgagaccgtaatactcttttatcttctctggcctctgggatgatgaatccggcagctcttccccaacttaactgtcatccagttcagtttctttaaagacgacctatctcactacacgtgcgggagttgttattatcacaaaaacataccgtcacggacaaattgtttcaaatctaaccaggcctttggaacatatatatgaatttcagaggattgtcggaagaattgcaataaatcctgcaaaagaatctataaaattcatatagtatttctttaaaacttattcctagcttattagtttgatgaatttcgtaagtatgtttgcattagaaattggtggtcaaattaagattatctaaaatgttgtgttttcttttggattgtgaactaatcgagtgagttgcatgctggctgctgtcttcatcaagacatgtataaaatcgatggaaaagccagaggtcgtggtgcaaaaccatcggcatggagtagttctcagtgtcacgtgaccaaaacaaaaaggatcatttcaatttcaataataataattataatactcctccttgattggtgattgcaacctgtccttgcttaccttggagacgaagagcatatccgttgagcttgcttggaattggatagcctaccatgcaatgcgtaccgctcctgcttccttgctgccgtaacttctaagaagcatccaattgaacacgtgcacgctagttgcacccttttttaaaacatttttaaaagaagaaaaaaaagtggactagtagtataaataatttctaggaaatacagtatatggtacacagcactagcattcagtttgacctgtacctagatcactagatggaggagctgtagtatcagattcatatgcgacaaggcatgatatgcagtgaaaagtggaaacgagaagtttgagcctcatcagttggcctaataagccaaggaaaaaccaaaatttgatttattttttaaacttgatttttttaagttgattttaaaatatttttaatgtattttattttagcgttaacttttaaatcgttacgaacaaatatataaaaaacttactaataaattaaatttttattcccttataaactgatgaggcttattagggaatatgggcaaccgatgaggcttagtcggttccatccattccttgccaacaaatatatactgtactatatacttgtgtgcagcgatatgtgtgcggtgcagtgtgtagcatgagcgttactaagtggtactcatccattgacaatcccaacatagtacattccatccgcgagcaatgctgcaatcgtggaatccacatccacacatgctgctttcttggagccgtcctattacgacttccctcacactgcaccagcactgccactacactcctatactagtagtagttctatgcatctactagacgacgacgactactactatcgaagtggagtagtatcaatgtatctcctccggaaaaaaaaaagaagagggttttgctgccatttctttgggctcttctcccctgatcccctccccctcccccggagaatcttctgatttagtactataattacgtgcattacagtaacaaaaagtgaatcccttgggcttggctttgccactagtatgctttactacagcagcggcagtagtactagtatgacaatcgcttcctggaagggacctcattgtcgcccgccacagcaaagcaatttcgtgccagggtcacagagagatgcatgcttgctggctgccaacatgaaacttcccctttgcatgcttgcttccttcacaaaaaatcacaatcacattgctttcgtcttgtgatagcacatgctactctcatctttcttcttttataaggggaacctccgaaaagggcaggaagttcctgtaatttcactaataagaagaaaatacttgattcagtttataagaaaaaccgatctcaaaaactttacaacagcacaattaattaaataaaaccggccaaaaccctgacattatcaaattgagctaaccacgcagacccagacccactgacaaagaccagcggtccaataagggaaaactcctaagatgaagccttcgagaaggacacaccgacagaatggcgagatcgcccgatccaaacggatataaggttttcacccagagagatccctttaggtggtggagaaggtaaaagatgcccaaggatgtcgttgctagcgtcggcaagccgcaaaggctttcgcctcagagtcccatccaaccaccgcgtccacgaagaaagccacttaatgccacttgcacaccgaaaaccaccacctgtacaacacggccactgaggcactggtgctcaccgatccgttgaaagcatccgtccgtagccccggtcgccttccaccaccacaccacaccatggagctccacagagagaagtgggctaaacgaagagcggccatagctcggcagagcttgccaagacgacctacgtcaccaccttgcatgtcccacgcggagctccacgtcaagccgcgtagctagattgtcggatccgccggacgaccaccagttggacagtctagcctgctagaaaacctggacctggatctagatcttgagaaaaaacggaaggggaaacagagagggaaggaggaaggggaaggaaagacagatgaaggatgagaggcgccgccgccgcaggtggcgagccgagaaaaatagggtcaggagaaaaatgagaaaaggaagaagggaaggaggaaagggaaaggataagggacgaagggagaaggaggcggggggtgggggggagcctactactcggcgttggtcacctcccgtgagtcgtcctctattcctcttgtctttcttcaattgttattattgtcataaatcaggagaacataggattatgtagggattattatgtaccagcccggccgggcagatggaaccgtctgtcgaattcagtaaaacaaagttccaggaagcagatataattcatcatggttaatactttgattggttgcaataaactggatggagttacatgctaataatttaaaaccgcaagcaatactagtacttgtttgcctcggctttggcggccttccaagggcaaacacattcaatttggtcctgcaaggccctcatgctctccgcgattgcaatgcaagtgcaatttcagaaatatactactacttacaagcaatactactcaggaatgactcaccagatatttactcaggccatcttttcggagctgattgctctcctccctcactaacattcattcgcttcaatcccctcagtgccactgcaacaagctaatgaggcacacattagattgcgcaacaagtgaacacagaaactattatgcatcaatcaaaaatacaattctatgtgacttcaccagaaaatataatgactgattgttcaaggaactctgggaaacagttccacataaatgtttcttactccaaaccatttcaggttaatttcttccaaaaaggaattggtctacagcattcaacctattgtgcctagtggttagagattatcctcccagtgacaattaacagcacgtcaaggatgtgctactggaaaaaaaagcatgacactgtacatgatctggatgcatcatcgcattgtttcgccatgccacaagaattgtagtactaatccataaagggattgaaatagtgagcactcaccctactgggaggttcattttgtagtctgggacttctccgaggctctgcattctggttttgcaaataggactgaccactttggagaagagacgatggactctggttttgcaaaagcgataccctcctgttcgagacatcagccgacagattctggtgcggcaaataggacagattgtgattttgcaaattgggtagattgttctggacaaaggatggcatggtctggttcttcaaatagggtggattggtcagggcaagagatggtagattctggttttgcaaaacgggtgatctgtcgtggacaattgatggccctgaagtgttatctgcatggttttccctagaaaatctttgtcgagtttcttcggttggagtactagtaatagcagtattgttgcgtgaatactgagtggcggcagctcgagctccggctatggcggcagtgacactgggagatttgtctagtgcggcggaccttgaggagtgaagttgaagagatccagggttgagagagaggggattggtggggtcagggagtgggaaattgacaggcagtggaccttgaacaggtgaaagacccctgactgctccctcatagatctgtgacatgacagaaagaagatgaacagattcattagaaggacaagtgagaaaattaagcagcagctgcattgtttatgcactgtgatctctcttatgttatttagaagagaagagaggacacacccgtctctctaaattgtaaacaccctggtaaccacgcatgtcgaatggaaccaccagtttctgcattgcattgcataattcgcattgcagcaaaaaaaaagaataatacaattaagcaaatttagaatgaaaagaagtgcagcgtgaaatactagtgagttgaggtgacctgtgggttttcacaaagccagcagaagtcggtcaatgcttcgagcctgacctgcaggtagtgaagaagatgattggaattgggaaggtgcaggtagtagtaatagagtagggttgagtagatacagattggggcacatgttcccaggaagcaagctcttgagaggtgacacagcctaccacctcgacgcatcctattgagtagtagtaggagtatgagaattgaactcctagcatggtagttgcagttagtagtagagagtagcgtcgtaccgaggaggcgggagacagggtagtggtgcgggaaggtgatgttggtgattccgtcgagggcgtaaatctccctgtagaactcctccatggccttgatggtgtccgcctcggggaccttggaagccgcgtggatccaaagccgccctgctttcaattcaattcatcaatcttaatcttattaatcttggattggaggaggaaggaaggaaagaaagggatagatagctaccggtgaggggcgatggccatgagcggccctcgacgcgcttgattccgtggacgagcagcgacgcccacggctggtgcatcgtcaggcaagggttccggagccttcccccgccgccgccgcgcatgccgccgccgccgtgcttccaatccaatcggaatcggaatcggaatcgggattgccgtcgaatcgctcctactcctacctactctttttttttttttgaactttactcctacctactcttggtcgaggggaagaaggatcatctcatctgtctgctcttgtcttgggccaactgtgtactgctatttgttagttgggccaaattaaggctttgtttgggcccaacatatattatatagactgtgagcgtctgattttttttgatagatagtactcctagatggtttcttcactcttaattaacaactggaactactcgtttcttatacaaagtgagtctaacttaactggctagattacttgtggtggaactatcccaccaagtttaaattctagatttaatacgagtgctcacgattacgtctaattatttatggcagacgacgtgtttgtagtgacttcgccaatcttaagtcaatcactggattatcattcaatggataagaaagctgctatattttttaaaaaaaataaaagaagaagaaagaaaatcgcgtgcgcctgaaatctacacattcgatgcatagataacatcattggatagccatagattaattaagatggtctccgcaaaacaaattaattaatactcatacatatataccggcaaaaaaggaaagaaagcagagatggaatcagttcacattgggagtaggtactgaaagtcgtagtcgtatggaatgacgtcgacgaggtgatggatgttgagacggtgtccggaccacctgaggcaatcaaccatggatttcctgagagaccaggacgtgggcagctggtcgcaaatccagcgaacaagcgagtccaggtcctttgcgaagtcgtgcatgttggagtgtatgaggcttgggatcatcagcctcctcctcgtcgatgtcaccaccagcgatgcctgcagatactccagcttcgccttctccagatccatcatcacacgatcagccttgtatattcgtagctgcaatgcaatgcaaatccattagttacagttgcattcaacagctagctagcagcttaatggagtagtaattaattaccgcgggagatgatctgttgccacagcagagtgcgaacagaatgttgggttctgagctgttgagcccgtaacgactcctcacctgctgttcttccacatccacctcgcatttccagaattcctgcattctcgaatggatataatcgttgccagagccagagccacgagaagaatgaatgaatgaaatgcctcacttctttgacactggatggctgtctgaggatgaaattctctatcaccaaggcgttcaacttttgccctgatacattcagcgtggccttgttcttcagtgcaagtagcttttcagggtttgagggtagtccattgtgcaaaatcccctgaaatacaaagttgatttaattgtcatcatcagctagacagtccgtttgtgcagagagaccgattcgattcaattattaataaatactccacgtacgtacgtgcatgatgcaggtgttgtatatgttgagccagaaggcaagcttttggtggtgagtgagaaacctcaaatccacatgctgcagtgcctccagcatccccctgcatatgaaatgctcaacttttaattactaattagtggatctgctgctaattagcaggtgcattatcaggtagtagcaaataaagtaggcaagcattagtgtaagtacctgagcttggtgagcaggggagaggtggagaatcctctgaggtcgaaagcggaggaagtgaagctgacgaggttcttgtaggggcctatatctctgacgatggaatccgggatggcgaagatgccgtagtgatcctgctgccccgaccggcaatcctgctgctgctgctgtttgttcattaccaggctggtgtcgattctgaagcttccacctcctcctcctccctgatgctgcctggtcagtgaaggcgatgaggaagaggacctactactagcgttgttgttgttgttgtcctgctgctgcagctgcaggtcggcgaccctcgaggacctgagcagtcggatgaagatgcagatgaggcacttgacgatcctctccgacagcttgttgggctgctgcaccatcttcttctttttgttactactactactagtatcatcgagtgaattaagctttggactgggagtgggaggtttattgctgacgatggtcatgagaggatgatgatggcggcttgtgtcgaggccgttgatggcctgactgatgaagaacatggacttgatgttggcatgatctcctgctgcagatcctccactattaacattggcattgacagtgtcgtcgtgggtgaggttgattgcattctgggtagttgtggtggccgccgccttcttcatgcttcggatctgggtctccaggcgggcaatctcctcctccaccagcaccagctctgctagaagctccttggcctgcatccattttcattttcattctcattcctagctactccactaactcatcgactctgcttctggcttctaccttgtgcgggatgaatgcagggatgttgtggaggacggatggagacgacaatgatgatgatgatttggtggtgtttgagtgctgaagggcgcggtttaggatatcatgcaccgcctcctcgttccgcagctgcttcttcagctcactcacctgcttatattttataatgtacactgcttattgcgtctgctgctgatccaacaaataaatttaagctaattaattaattacctcttgctcaagtctctgccgcagccgccgcgcgggcactgttcttctgctctgtaattgaaattaaacagctagctagccttgtcagatactacaatatagtacgtattttttttcagagaatggattaccggacactgtcatcgatatgatcgaatttaattagctacaatggcaattaaggtggatgggacgggatcaatcatcagacctgaggatgagggtgaggatgggcgtcatcgtgagacgacggtggtggtgcagcgccggtgccggagagcagctggtgaagatggggcggaggagtagtgcttcccgcggtcacgtactcctccatatactatactagtgcactgtacgatgggatgaactagctagcgatggttcattatattagaaccgtctggcgggagcaagctagctaggtgaagaagaagaagaatgatcgatgatggatggatcgaggaggaagaaaggtagagctagagcttagagagagcagatggttgggagggcgctgtcgtacaaggattggcaggtgaggtgcggccgaagtacgcaaactgctgctgctatgtttgggcgatccgatccagggaggggaggggattgatcaccgatcgatcgatcacctatcctatatatatgcaagcaaccaaacacttctagttctagcttatgtggtagtcgatcttgtgctagtgccatgggttggtggcgtcatcgagcgcgcgcgttacatcccatctacatttcccattccaattttattttaaatactactactacgactactttttttcccttccacacaacacatgcctatcttgccttgtaatccacacgcacaactgcatccaccatgtcatgtaatctctctgtttttcctctcctctccttgttgagtgcaacctactcaacaccgctaccttacctggcgccttcttttctctgcttattttctgtatcttagtgcagttgggtggaatcaacattttcatcttcactaaccacctgctatccgtacgtaccacgcatgggttttaccattttaacttttttttaatcatttatagctagcgtccgttatattcttactgttttcgacattcatctcaatatatacaagatggggtcctgcacatatatctcttctctgccatcttcaaagccaagtcatcctccttccatatgtattcccaccgtgtgtaacccatgcgctcgcggatcatacgtaattaaataactactgcatctaatgttttattctcaatcaccctcctactatatcctaatttatatgggcatggtccgttagaacgtatgagtatgttactggttacaacaaaatgacaatatatttcaagaggcctggatggctgcaaaatttcctaattcttccctctacaacgggtaggaaaggattattttcccttgttatcctataatttattgagtgaatggcaatttgggtcacattttattacacaagtttactttggaccacccttaaaccaatattttcactttggacccgagtaactttgttgttttctcggtttagaccaccccaaacaatttattcatcaccccaacctcaattaaattagttttgatacaccggtgaactttcccgtatatatcttcataaaaatggacggtagatatgaaccgtaaagagagttgggtggtccaaactgaaaatggtaaagttagtccaaagttaaacgattactttaaaggtggtccaaagtgaaactttacgaacaaaaggtggcctaaactataatttactctgatttattcatgcaagccaaatggcatatataaaaattaatccttataaattcaaattatttgttttctctgtgaacctaacaagccgatttgaacctaacaaattcaaattcctatctccgcccctctaccaccggcccagccccctcccccccccccaaaccgccgacccctcccggtagtcaagaagatcctcgtccgacctcggcaacaagagcgacttcctcctccgctctaaccccgcccacaagatccccgtcctcctccacgctagtcgagtccctgatcatgctccaataccatgatgacgccttccccgatacccccacctcctccctccgtcgaactcctcctcctccggcgaagccgacaccgcgtacgcgcgcaccaaggcaagattctaagcagactacgtcgacaagaagctctaccgctgcgggatcaagctatggaggctcaagggggagctgcaagccgcggtgcgatgcaagatggtggagatcctctggacgatggaggcgaagcgggagttcttcttttgtagcggcgggcttggcttcaccaatgttgcgctcgtgctattcacgacatggttctacagctacgagtggtgcggtgggttcagcatcaatgaggtagcgccaaagctggcgacgtgggcacgacagtgcatatagatcgactccatcgccaagcacctcccctcgccggagaaggtgcatgacttcatcagcgtcctccgaaataagtacgacgttaagtagatgggatctcaacatcgatcggtctccgtcgagtgattcatcgtgagatcgatcgatgcaaagttgcagggattgattggctgtttcgtttgctatgtcattggctttcccgcgctccctgccttgtcgctctctaggcacttactggtggagagaggagatagagatagagaaaaagagggtgaagtgaaggaagtgggtcctactattttttattttcttgtttgattgacataatgggccctacatattttttttaaaaaaatttagttttcaattttgttatttttttaatcaaactgcacgtcaatgtcatgtgggacgaagtcctagtcgaactagtcacgtaggagccagaaccggagacaatacaaccgaaggatttcatttgcactagttttgtaagttggtgttgtatatttttcggttcaagatgaaaattggactgagtgacaacttgaggagctaaagtgaacttattcttataaaaggccgtgggtttacccgcaaaaaaggggggccatggatcgttgggccgaaacaacacacaggtcatccggccgctctcttctttgggctggtggaattaattatagtataataaggaaaagcagaaagaaaagcgtggcacggcacggcgacggcgagcgatacaagaagaaagaaaaagtctcacctcggaacggaacagcagcatgtgggcccacaccacacgtctttcgtcgcaatgccacgccatcatcgatccctttccttcatcaggagttaa

SEQ ID NO: 67488 - DNA, 4878 bp, Oryza sativa
  unsure (1)..(4878): unsure at all n locations
gccctcaactgtatttctaactctaccaatacaactttaacctcatgccaacttttctatgttcatgtcttagtaatgcgcgagtctcccataggtgtttcacttaatgttggttctggaaactgaccccatgcatggcgccatgtgatttcttatttaggttggagctgtatgatcttgctgagctcaaggttgaaggggatggcaattgtcaggtattacttcaaatatgtactctttttctctattttatgctctacttatctcttttagcatgtatcttatacacagttccgagcattgtccgatcaattttaccgcaccactgaacaccacagatttgttcggcaacaaatagtgaaacaggttattcttggtgaagtcatcatgttttcttgttacaactctacttcctcatctcatttttccctttttcaaccgttccacagcttgagtcttatccggaaatttatgcaggatatgtccctatggattatagggaatatctaaaaaagatgataaagtaagtatttctcgtttttattaacaagtaaatctttgctttatagtgtaacattaggcattttcactttgtggccacaaaatcgaccaggaacggggagtggggtgaccacgttacattgcaggctgctgcagactcggtaaagatgatgtttccacacttcctgacttattaaataattattcttctgtttatcggaattatgctgtatacagaataagagttatttgtattggacagcatggtctgggattcattaagtgatgaataatcgaaagaaatcatatatatctgaataatttaaatctcaacaaaaaaagaatggtattttctctagtttttattttggtaaccagcataccttaacaggtacgtagtatattgcaatctcatgcacatcattaatatagtataggtattgctccccctggacttggtcgtgttgcttttgtgctacttgatttttcttctctttgcccaacactcaaacttcatgattctcataggtggtattgtaatgtcctcccttatcataataccaggcctatacatctgttgtgttctcgtttgagattgagtagcattttgtgaatgaccaagtcatggatttcctagaaccagggataccgtgcatctgctccttgctatcaatgtgaaactcaagtatctgcattgttttttgcagtatggtgtaaagattttcatcctgacatcattcagagatacttgctacattgaaatccttcctgttgttcagaaatcagaaagaggtaacctttcttttcaaattatgttgctactgaattgtattactgaaattagcaactacttatattatccagtcaaacatagatgcagatcttcatcagttgatatgacccgccttatcattaagaatctctgcatgtaacttcattgttcttagttagtttgcatagtggattgtactttttcaatagatgtgtatctaatgtgtttctgttcattttttccttaaaaaacccagttatatgcttgagtttttgggctgaggtgcactacaactcgatatatccagaaggaggtacagtttgtcatttagataccgtgttcatctaggagtgtctctttggcggattgatgcggtagctcaccagtgcatgtttgtggtgcagagttaccagttatggagaacaaaaggaaaaggtggtggcatttttagatcagcaactggtgtacactccattgggctgggtacactccatttgatttgatttgatgttggttagatcagtggccattttgttggggctatatgtcagtgtaggaatgttgatttgtgagtgtacataacacatttagtcaggaggaagaatagctgtgacaatagatgaatgtatcatgtattggatattattgatgttatatagggtcacttagagttgggtttagaatagagtagctgggtgtggagctatctaaacctcttctctgtctctaatttattttgcaacatgtttggttgaaatctaactctacgagaggtgaagctaaagctttaccaaacaaacccatacgagaggtgaagctaaagctaaacccacaggagtatgttaagaagaatcgattcttttcttctgacgtaatgcagtttgcatattataccactcgctttaatcatagatacacgatggtcatacatatattatgattaggacagtcaaaccttcaaaattttaaacataaacaacttctgaaatacttagtttaaaaacaaaagagcggtactaatagatatgatactatgatagtacttttcaagacatatgcattgatatttttttagaggaagagacaaaaaaaagaaaactagcatttaaaaactttttatggttgatatctcacaggtttgacacaatctcttttaagctttaaatatttataactggaaagagtgtatttttgccaagagatacgaactagacactcttttatgttgatagcgctagacgtctaatgtgcacgtccaaattaaaaaaagaagcctgtctccacaaacttaatttaatttaattccagagaagattagaggccacaaatgatatatggtgctaccttcaacttaaaatatactagcaagttttttttttcaaatatatactacgtagttagatgttgccatattttaagacggatggaatagtggtgtgtagtttcaaaattgaaatcgagatcagagcgagtatatgcaacattttgtttttatttgactctgaatatgaaagtatgcatatgtaaaaggaagagtaaatttcataaaactacatactatattaccaaattattgtaaatctacaggtgtaaggtggcgtatcataagattacatatttaacattttatttataaacaaatatagttttaacactaattctctagcaccaatgttatgtttgagttataaacatgtaatagttgtgattaaattgcagctgaacttgtagttttgtgacaactttgcgattttcatcattaagtctgcagtgctataataaattaggttaggtattaacttcctatagctatataatacatcacgttgaatctgtagttttatgatagtttggtgcaagtaaatctgtttattcttaggttaaaatctctcctataaatgcttcgtccatctcgaataaacaaaacaaattcgaaatgtgacacattgaagtactacagtgaatctcgacatgtgttttagggttgtttattttaagacggcgaaagaatttttaaaaaaaaaattttaaaaaaaaaaggggaaaaaggggaaaaaattttttaaattttttaaaaagggaaaattnttttttgggtnttccgttncaatatgcactagggttgtaaacatatattatggattcgactcgatcatcgtatagtttttgtaaaaaatattccgtaaagaaaaggaaaaggttttaaatagaagcgtgtggtaggtgatggtgaggaagaagaggagaggagacacgcttgaaacggcggaggccggcccggaatgttctggaaaaccaccttttctttctcgcaggagtagtatttttgagggtttggtttcaaccaaaaaaagtccaaatctgaaaacaagagagagatcacagcagccgccgccatcgccatctctcggacggaaaccctagacgagcgaccatggccaccatgccaagcacttgcgcctcctcctcctccctcttcctcctcctccgcgtacgtacaccctttccttcccttcctctacctaaacccctactaaaccatggattggattcattgattttgctgctgtttccagagggacaggaggagcagcaggagtgccagcctccccggacccgcccgccgtttgggggttgtgcgcgcctccgccaaggagatcgccttcgaccagggatcgcgatcctccctccaggccggcgtcgagaagctcgccgccgccgtcgccgtcaccctcggtcccagaggttcttacttccttaccctttcctcaaatactagtcgctgtacaccatttgtcccttgatcttgttggtttctttctgtatgcaccttattaagccttttgtccttttttttcattctgctgcaggcagtgtctgactaattcttcttgtggtattgtaggaagaaatgtcgtcttggatgagtttgggagccccaaagtggtcaatgacggagttaccattgctcgagctattgagctcgctgatccaatggagaatgccggtgctgctttgattcgtgaggtaacaacaatcttgctctctctctctctctctgagctaaacattaacatacttaccttgtttcttctaatgcttaaaccgtatgcattctctgaatgtgtctactttctaacaacattcactcatttctgtcaaacaaaaggttgccagcaagacaaatgactcagcaggtgatgggactacaaccgcatctgtcctggctcgtgagatcataaaattgggcctgctgagtgttacttcaggggcaaacccagtatctatcaaaaagggcatagataagaccgtgcacagtttagttgaggaacttgagaagaagtcaaggcctgtgaagggcagtggtgatattaaaggtgagccgccacataggaggatttcggtcctttcttttgtataaaccacatagctagctagcgccctccatgatgaaggaatatctaatcttgagcatttctcctctgtctttccctgttttagctgttgctgccatatctgctggaaatgatgacttcgtcggtaccatgatcgctgaggctattgacaaggttggccctgatggtgttctttcgatcgagtcatca

SEQ ID NO: 67489 - DNA, 1515 bp, Oryza sativa
  unsure (1)..(1515): unsure at all n locations
cgatatattctcttcattcatgctaaagtggttctacatttatcccgtatgtgcagattgacagaggatatatctctcctcagtttgttacaaatcctgagaagtcacttgttgagtttgaaaatgctagaattcttgtcactgaccagaagatttcttcaataaaagaaataattcctttgctggaacaaacaactcaactaagagcaccactcctcataattgcggaggatgtagctggcgaagctttggcaactttagttgtcaacaagcttagaggaattctcaatgtagctgcgattaaagcacctggctttggtgaaaggcgtaaggctcttcttcaggacatcgccatcgttacaggtaaaactactgggcaggcttattggatttattttttcccgttctcatgatgttccatgtttgttaaccaatagctctcacgtctttgttaacaagtacttcatcttgctactcagatatatattcatcatttgttatctttttacaattatttagtatttatgcaatacacagacagagatgcttacatgaattatgacataaacctgcattgcataatccaaatatttatcatctggtttattggctttgtacacaagtcattctactgcaatataggcaacattaatgcatttctttgccatctagcaaaagtgacgcgctaacaaagactctactaattgccaccacctgattttgtattagttaaagtggttggagccagtaagtatggtaaagtccggagacagaactgagttacctgaacatagaactttgagaacatatctttctttttccaaaaagcctacagcttgtttcatcctgtggtgtgctctatctctattgcctgtctgatttactgttttttaatgcggtgtcttttgtttcaggtgctgaatttcaagccaaagatcttggtttactggtggagagtacaaccgtggagcaacttggcatagcccggaaagtgacaatctcccagtcatccactaccattatagcagatgttgccaccaaagatgagatccaggcaagaattgcacagctgaagagagagctttctcagacagactcagcatatgactctgagaagttggctgagagaatcgcaaagctttctggcggagttgcggttataaaggtaggagctgcaaccgagacagagcttgaggatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcagga

SEQ ID NO: 67490 - DNA, 3343 bp, Oryza sativa
cagatagatcaatatagagagatgtggcagtaactaaaagagcctgttcttttttaaaaatctgatttggcagcttatgcgatgagtgccacaatagcacccatagaaaggtttgtgatagaaaattccccaaaaaattccttgtttgcaagagcgagcttaaaaacagtaatatacatagtaggtgatataggtttgcggtgctctcttgccacagccagaaaataaaagtttacgatgcaatgtcaatagtcagctctgaaatgaaccaaaaaggaaagtataacttacctaagtaagaaaattactatagaggagaaaaatagatagataaaagactaaaaagaaattacttcgattgcattccatagtcgaacagttccatcagaagatgatgtagctaactgagttgaattcggtttgaatcttatatctgtaataaagttcgtatgttcttctattttagtatccatgttaagattgtccatattccagaggaagacctgcaacattgtagaattctttagaaccaaatatgccccagatatacaaacatctttacttctcttcccaagtcaaatagaagaaaaaggcactaagaaaattataacatcattctgcatgtaaaagtggggcaaaggatgtacggagaagacaatgatgaaatgtcattactggaaacacaaatttgattttgccagttataactgtgtgaaaacatcaaaattacttttattagttgaattgcagttatagaagaaatagcaatgatcttcaaggaatatatattcttacgatctggcacaacagagcaacttcttgcgagagaaattattaaaccccctcaaaatatataatagagtttaacaaagcaacctttttctcatggccagcactagccagcaatttcccatctgtggagaagtgacagcaaacaaccttattgttgcttgtacggttattaccaaactcactcaacgagagacctacacaaaaatgaacttattctaaatttttctctgttcacagatgtatgacacaaatcaagaacttgaaatatttaccctttaaggaatcctgctctgaggaccctttcttcaatgaagcaaatatgtcccgcccatctccatcatcatttgacaaaaatgaatcaacgttttcatcaaaatcaacaaaactatccagattatcctgtcaataacagaagttactcaagcacagccaactgattgccaaaaactgataacgttgatggaagagcacagcacataccatttgatttgaggatgaagcaagtccactggttccatctgcaccgcaaattaatgaactcttttgtacaatgttcatgttgctagccactggtaacccaccaccaggtgtgtgagtggaaggagttgagggtggggaagggccaacagtatttcctgtgcctgtactattagctgcgccggaagaggttggtttccgttttctagtattctggatatcaagaataattggaacattcaggtatcgcccatatagagttagggaaagttgatattatttgtaacaagctaattagttcattcaacctgttgcaattgctgctgctgctgctgtaattccataagacggtgacctgagggctgctgcatttgagccatcttcaactaataggattgcaaaatagtgtgtgcagttaatgaatacatgcatacagtactaaaaaacgacaaaaatagtataattacccatagaatatattgtgttgctagaacaaggtgaaaatgaacctccagaattgttctcaattagaaattatcacattatcagagaaagcgaatatctaagccattgattttgaggtgggtccataagttaaaacaaaaaaaaatactgaaattcggatttagattttttttttaaaatacaagataaagagctaatgtcaaatacaaagcagggaaaactgtaatattattacaaaataaaacaaaatggccagtttaatttccattcaaatatcaaagaaaatatcctgagtaattataacacagaacaaggaacagaaagtgaaccactaacgtagtgttcttaattgaaacaggtgaatgtattgatagaaccgtagaataatatgaaagcaaaacataggtcattatggatatgcaaacttatgtttggacatgtcattaactcttaaataaagtttctcagaccgattgcatactgaccttcatcatataatctgattcatctggtcgaacctttggtgaaccagatggagctggagaacccattctagcaaggtcattctgtgattgtgcttgagcaattaattgttgttgtggcgataaaagttgaaattggtttggagatgccatcaactgcttctgcacacctaaatttgaccggagttggtcaatacctgggaccttcagcaggcaactagtaggtaagcttttcttcaaggaaaccagagaagtatgcaagcatatggaaagggatatcagcaaactcactgtaagaggccagcctttcagtggtacactaccaacaccttgatttaatcctaagtagaagcaaaagaattataaggaaaaatgtgccttccatcatttactggaattgctaatcaaacgctgatggccacatgctaactagctacaaataaatcaagaaatccccaagtgtgaactttggggctaaagcttatcttccatctgagaatactaggcataaaaaaaaagcgcttgtacacaaaacagatttttatgggaatgtcatgcacctattccataaagtccaaggttaccatctgttttcctcatagagaaacagagagaatagttgtgtgattgcaattaactcaccagtggaaactaatccagattttggttgcatcattcctgatccatacaaagttgaagggtctgtaggcattgatctttgtgacatggcagcatcacctttcatgtccttgaaaatggttggacagagagtaagaagtgagaggcggtacataaaccaatggagtttgagaagatggaagggtattacaggttgctggtttcttgagtggatctgctgtagagctgacatgttgaccgaggcaccctgaaccagttgtctgaatggcgagagttttcatgaggaacggtaatctttgagatggttgctggggggaagaagaaaataaagttacccagtttggttagttgctggtttgaggagagcaatcctgttagcgtccaggagttggtgggaagcatcggaatcggtgggattggggttcctcattcggtcttgcatcattttagaagcgaggacagcagaaacatcagagttgagagcatcc

SEQ ID NO: 67491 - DNA, 3077 bp, Oryza sativa
atggtctccaactccaatcgaatcgctcgcgctcgcgctcgcgctcgcactcgcagtctcgctcgtgtgccgatttggatttgccgctcgcctcgcctggaactggaatccaacaacaaaggaggaagaaatggaaccaggcgtcactgacaattgggccccacccctcttctcttcggtcaaactgacttgccttcctgccttacctctccttcattccgcttccacccaaatactacttataaggtaggaggagtttttacaagtgatttataatttagagggataagactattaactgttttgtttaatttagatttagaaattataaaattttaataggatggagataaggaattggagaagaaactctctcctttccaatacctaggtatggggtgataattgggaaggaattcctcctttactcgacctaaacaaatcacaaccatccgttttcattaatgacttaatctccaactaaactccctatcaatttccctcgcctttaccaaacaagatattgagattaaaaaatcaaatttctatgatattgggattaaaaaatcaaatttctatcttaatctcatcatcaataaactcctaatcccctttgctcgagttgccaaacacgccgctactactcctataagtgtagttgtggtttttttttccaacatttcaccgtccatcttatttaaaaaaattatagaaaaatttaaaaaatagtcacacataaagtattattcgtgtttttattatctaatccgtacctaattaaaaatgtgaagcttccagtagtttttggtcttttttttctattttttcccgattacgttgtcggttttttctccttctgaattttgttcgctgttttttttgccttataatgatttggtatttttgtcatcctattttttcccatcgctgggttttcatgttcgatcccgccaccgcaggccaaaccctagcgccgccgcaacgtcaatatgtatccccgtgcgtttctcaaattaattgcaaaaatcaatttctcaccccctcccccattattttcctcatgatttccactttcaattcgactttaatttgctggatttaatctcatttgttgatgatggccggccggcgagcttccctggtcgtttttatcacgagttttgtggatttgcttcgattttgagaaaacgaaaataggagatcgaggggaataaaagccctcaatattttcggagttcgagaaagattcagtcggatttgatggggagtatcggctccggcatacgggcacgggactatcttccggtcttccggatgttaaagacggtagtcggctatgcgagcagggcctgtggctccacttgtgggcatggccgaagtgaggcagggcaagtggagggaggtagaactgagctagggctgaaatggaaggaaagaatgagcttttggccttaaaaaagaattgtcattaactttttcagctataatgtatagcaattctaatgtttcaatttatttctcacctcctaatagttgttgtatcactgaaaaaacatctttgcatgttgcaacgcatgagtattttttctagtagcaacaaaatcatgtacggttttggaacatagatttttttgaatagaacgaacgaccgtaacggatgttggctcaatccgagggaaattatgtggaagctttgcatcgattactaaaactagactttctcaatttagagacttaagagcagaagaaaagatggaaaaattcaaccatctcccaaaaagagatgtggcaatcttaaagagaaaattatctaccaaacaaagatatctcggcgggatcaaatatatgacccaattatgtatatacgtaagatttaagaacgaggtgttttaacgtaaggcagaaggcgcgaagagcccgggctgctgctgtaggatttgaaaagggagtcattgtatcgttgggtcggaggtttgctccagaaaaattcggaacaaaacgtctaccgcgttgaagcccacagccccatggagtccgattcaaccaggaggattacgccatgctaatgtgccggttcttattcgaagaaccttgccttttgtttagcttgagactcaatcattgtggctctagtatgaatctaaggttttaattgaattgattcataggatcgcaacaagataatttctaccagaaaactaaagattcaaagggttaggtttttctttttttttctagggtaataattcaaagttataaaattcaaacaaagatacttatcataaaaaaaatcaaataaaacaaacagtcaaacattagacataaatagtgtaaaactgcagtccatctaggttagtaggattgaagcacttgtgcctatcagcatatccgatgaatatatttatctttttttaattgaacatatatattactcattattgtaaacacaatattatactttttctgtccccaaatatgttagcttttatacatggatctagatccgttgcaacttctctgaaaatattaatattactcgagtggtacttctttcccatgtttcaaatactcctgacaggacctaaataagttattggacattctcttaatggtttctattcagatgagcttattgacggtaccttttctagaaaaggtcaataaattccaaaatctatttcgccctcgagtagcaacaaaagttatgcctagattcgtgtacaaaaatgaacttgttttcggacaaagggagtatacctttgttttggcttccatggcattttacctgtggcttaagattagctaggtatatgatttcaaagtcacattagtagctttaattataaacagagtagaaaactttgaatctacaaaagacaatattggttgtagacgaggtcacccgcgaatgatacaggagctagctaggttaagatagagataataaacgatataatgccaccatggtgttaattaataggcttgatgatggcaatataataggaggcagaccacttagtgatggttgagctaaattgtggtggctagaattggaatgagatatatattttttttat

SEQ ID NO: 67492 - DNA, 1300 bp, Oryza sativa
ccttgttgacatatacaccttctacatgcaatacttccatgtccttttatcttcactaggctaaaaaaagtaaagaacataggccaatcaaagctcttgacgcttggtcacattgccacccctcctctttccatcgccgagttgctcctcatattctctccaaaattaagtatacatcacaagttaggggcctccatttggtgttttcatacgatcgagggcaatgccagatcgtgagatttagctataatttatcaccctctttcttggctttcttgatcatcaccgtgttcccaaatattacagacataagttggtggtatcgattgcatcatgggatagaattgatgtctacaattttggctcgataattccatcctacgcaatggtaatagcttgtttccttattgttcttgtttctttgaatatcaaaacttattattgcatagcatctttcttttctaacatggtgttaccttgacttctgttgaacattccacatattgttagacaaaaaatatttgacaaataatgcatatgagtcgaatgcatttattacgctatgtataacaatttgtaccacaaaaattcatgtatgtgcattaacactttatgatgcacatgtgtgcaatgagttatttataacataatatacaaaatgcaaatagaattgtttctccttagttattcaagtataaatgtaagtcaatcatatctctcttttttatggagacaagccaatcaaatcttaggatgcattttctagctgatacctcctccgcctcctcctccttctcattgtactctctacacaaacactactaaaaaaaggtaaacatcatgaaccaatcaaatttctcaatgtgccgcctcctctccctccaccacttactcctcctgttatcctgtcatgaatcattgctaaaaaaagtaaactccagaagcccactagatctcataatgaaagccaattaaggccctcaatttgctccaagacgacactacgatcaagggggaaattcactcagatttcagttaggatgccaactcagtatttacaatgctcggcaaattggcatcacattgcattgtcgggctgtgctgatcctctctatcctagtctttgattgtttcgtcacgcgtaatggtacccatttctttccttccttttctcttccttttatatacatatcaaaacaaatttatgagaatgcattacatctttatttttccagcctaaaccctcttcatgtcttctatatgtttgaagatgtccaaatgcaattaatcaacataatag

SEQ ID NO: 67493 - DNA, 2795 bp, Oryza sativa
cgtgagtgctgagctgtcctctgatctgtcaagcacccaagtgatttctcagatacaagaaccttatctttgcaaaaatggttatgtagaaaccatttgtgctgtacaggttgacttaaaagcatatatgaattcgacatgtttgcacaatgataagtgaaagtaagcagaaaatatttgcaccacaattctgacttctgagtaacattggttagtgaaatcaataatcatgcacataacaatagaacatcaggaaactgttttatcaaccaggcagtaaatacaagataagagtgatttttagagctttctgaaagaaagtttagttatcacaccaagcataccagctttagcagcatcttcaccatttgcatctccattcgaaatagaaagcgtttccaggttttgcttcatgttgtctcccataaacataattccagaagcattaaagggaggaaattcaaaccgtgcagacattgcctccggttcaacttcaatccattggccagtttcatgctttcttctccacaactcagtgaactgtgtgcatgccttcctattgattgacaaaacaccaaaggtgtgagaataaaggaccaatacagtactcaccaactgttccagtggtaattttgttttgctctttaatggaacatatccacacctctattctggtgtaatattccagcacagactacattatatcaataatgtatgaatcaagacaggtcagctgctgctatattgatatacccaattttatggtcgaagatatttgtatgttgcaacaactatcagcattataacatgttaatagcatatgttaatagcaccagaatagtataaaagaaaattgtagtgtagtaacatatagtgatatagattaggctcctgataaattagcagccatgtgaaaaaatgtacggggtattcaaaatgggaaatccaattcagcaagcaagacactaccttgggcatatcaaggtagtaacacttacatcaagcgtgaagcaccaaaacggtctgcgaatgtgatcaaaaatcccaggttgtcaatattaaacccagccgctacagcacgcgcaaaggccatagcctgctccttacgtaagacaattttgcgagtctccagaactctaagtaattgaactctgcaaattatgaaacatgtaaagaaatggttccatttgcgtctgagacacagactttgtccaaaacaaaatacagataaagaccttaaatgttacatgtgacatgtcacttcactatatgattattcaacctgcataaggaccttacatgctccacatactgttacttcattacatggacatgcaatgaacaggtgtgtttcttcattaagtaggagcatgtattgctacacgaaaattgtctaatttaagaattaagacattaaatgttccatgtaaaccggttttgttgccagatattagacaagtttaggcaacgtgcacggaaaaggggggatattaagcatagaaatactttgaattctcctcctgagttgcattatcattctgcacaggtggaggtggttgaatgcccggctgccatgacacagaatatcagaattatatggcacaattagaaaagaagaaagttttatccatgcaactttaccttgtacagaataagtgatttatccccatcaagatcgtaatttgtcttgctacctgtaaggtgcattcggcagcagagcaaaagataaaaaatattactccaaattatttgcagttcagatcaacccatcatgagaaaattcacacattatttcttgtaagttgtaacaaagaataaagctcttgtgcacatttaagtacaaaaaaaaacttagaaccaccttaaaaataaataggttacattatgcttggtaaaaggtgaaccaattagttttactagtgataattgcacaaacaatataaattgccatttcccctgtacattctattgcattttaatagttctattatgcacctaactcaacagttgtgtctgatgttacattacaccaactcctatagtgaatagtttagattctaaaacagcatggcctgcatcctacatgcatgttttgtggtcctagcaagtagcgatatacgcttaattttcggttctcaataagtagtgctgaataattaggtaaccaagagaaagcttcatagatgtgcagtctgttcgatgcatgacgatgaaaagaaagaatagcaagtgctatacctccaatgcattccgccaatttttcattataatcttctacctaacgaagcacaaagaagagcatgtcattaatcatatcatatttctaatattaagcagtagtacactacatgctatagcataaaattctatacttacagatctcaatccaagattgtcaccgccctggccagtgatggcatcctcgatctgcaatatctcagactctatagtcgttactcgttccaggacctctggtgtactgacgaaacggacaaacctgccagaaaccaaccatgcaaatgaccaccacctgacaatggcatgagctatcagcaaatacgatccaaccgaagcacagcaccaacctctccacggtgccccttgtaaaccatggtgcatcaatctctgggtctacctcaagtgtgatggagtaccctccctttgcaatctgttgttgggcaaccttgagatgtgcaacgaacgggttcagcaaaccagaggctatcttctccttccgtccatttgctatcacaactaaatcacacctacaaaggaggaggcgaaacaaaaaaaaa

SEQ ID NO: 67494 - DNA, 2464 bp, Oryza sativa
ccaattaattatatctacaacagcacttgttttggcccagggttgtcactcgggcatttgacatcagacgctatcttcccaggtggaaggaagatgtcaactttaccatgtccggcaatcaatattcccaatggaaggaccgaacttgtaatcgcgcaaagatgaaacctggattggatcagaccacggcaccaccaccagaagaagaagaagaagatccggactgctcaccttgtgcgggtgggggtgagctggaacaccgctgaatcaagccgcgtctccggcctcattgcagagcgattcttcccaatccctccttctcttcagatcttggagtatgattggatcatcagatgctatggaccagcggaggaaagaacaaagaaaggagagaattttggaacagagcaaatgcaggttgagacagactccctccctcccagtactgggattgattggattccttgttaccagtagaagaagggaacaacgacaatagaaacagagataataaataatatcaagggcaggaaagaaaaataaatactgctagtaaattagatagataaacggcgaggcatggaaccaagagagaggagagtggtgcagacagagagacacaaggattggcttttattatcggagatggtggttgttggattagaaatgaagaaactttctctataataatgagatgagaaatgaagaaaatgtttttaagaataacgagaaacgaagaaacttcttttttttagaataacgaaaaaaattatagaaaaaaaatgagaaatggagaaactacgctatctccaacatatgtgtattggcatgaagtatccgattcagttatggatgacttaatgatgtggtaatgatcttgattataatgatgatgatgaggtggttgcgtagttagttgcattgcatgtggtagatgagagagagagagagagagagaggagaggcggtaggcggttgttgtttcttcttcaggcaggtgagggtgagcctccgggtccgggcagggggatcatacatacatacatacatacatacatactggagtgagtactgtctactagtagtattagaaccataataatactgccttccatagtttccattccatatgagctgtcgagatgtgcatctaatttcgctcgctggaatgggtgaggtgatacgtctcatcatcatcgaccagtgggcatcaattacctaacgaactgacgctacaacactctcaatcggcatataattagtagtaggagttgctatttattagttagcgaataaatcacgccttgtaattctaattctaataattctaattagggagggagtcgcctagaatagatcacaagagctccgccgtcgattgatgcgtccatcccaaaattagctgctgcgccttcatatataaacgacgaatgaattgattgattgattgattggtgctctcttttatcgatctggaaactggaatatattatatatatagagagagagagagaggggcaaacaagaagaaaagaagaagaagatggtggtgatggtgaggcagcggcagcaaaggcagccggtgatggtggtggtgatggtgtgctgggcgctgctggcgacggcggcgcgcggaaactgccgcgacgagtgcctcgccgggtgccaaggttgggccatcatctgccacctctcctgcaacagcgcctgcctcggcgaagtcggcatctccgccatgagcaccgccacaccacagtccatcacggatcaggatcagcagcatccatcacagcagcagcaacaagcacaacaatcggtctccgtgctcaagggtctcgaccctgacaaaatctgaaacaattgttttcttgctaccattcattttcaaatcccatatacatacactgcactacacacacacacacatggaataattcatgttttctcttcaaattccattgctctttctattaattattaatttacacagcacgttccacatagattagtattgtcaacatttttgccccaaccatgtacacctcacccctaaagtaaaaaaagtcattcatttgtctaaactagtataataacaaattacgggctaccttctgtaacgaagccaacgaatcaaaaataaacaacacaaactctatacgtacgcacgtctgggaagctatgcaagttaagattctggcagccgtcgcgctgaggccccttctcctcttcatctccaatccttcttcatttccacagtttcacggatctgtcatggctcgcagaagctatcatcccagtgaactgagagtgcgccaaagcagctataaggccttcatgtgcctggaccgtgtttctgtgattatctgacaagctccatagctccatcgtctgcacaaatgacaccaaagaccatcaatcagttgccattccgacggttaaaagtcttttggacacacaagacata

SEQ ID NO: 67495 - DNA, 976 bp, Oryza sativa
tagaatatcacgttctctctctctctctctctcactcacccttccccttaatacccccactctcgctccaacacacagcctcctcccccccccccctccatgttatgataggagagaaaagaatgtgagaaaataaacaagtctctaggctcttatgaccatggcaaaaggtgttcctatctagcatgttggcaatcgcagaatgtcaaaaggcagttatatgtgtaaaggatttacctggtaaccaccaactatcagaacattcggatatcttggatgaaatatgcaagactggtattggtttccatgagatcttaactcatggatgcatgcgcctgatgctaccgaccaaaccttcacagtatcctgacttacagatgccacacgttcacccttttcatcccaacagatgcagtttacctcattggtatgaacctaactcaagcaaacaaaacaatgattgattaccttgcgttgcaaaagctgcataagatcaagcatcccatatgtattaccttaggcagtgagtgcaaacttgcctccttttcaacatcaacaatattcacaatgcttccagttgccacagctaggagctgtccaatttgaggctgaaacctgaccctaccagtaccaccctgtttcatctgtaatgacatcaagtaaatatcattgaattggcccaagtgtgaacggtttacaaatttcaaaggataaggaaccaaggaccaaccctggagatacgtgaaactttactttgaccaattttccagaaacaaatttctccattgtcgtcacaagagcatagaacctctgtagatttcgggtgaaaatctacagaggttacatgggaactatgcccatgaaaagtctgtacagcaccagttcgctggaaaaatcgagaacatgtttgacttaggttaccagcaaaacagtaaagtgtgatttgactgcctcatagtcaaccactagcatcatg

SEQ ID NO: 67496 - DNA, 1961 bp, Oryza sativa
tgtcacccaaatagatatgttagaaacatatatgaatggtacactactgtttcttagccctgaaaggagaatatctttgatggtaggcatataaatgttactaatgtgaagtgtctaaccactaatgagagtgaatgttaaaatgaaattaattaagggatgacttttgtatggtgtttctactgtcagcacccccacctccccacccacaccaaaaaaagtggagtggcacgaaacgtacctccagaatttgttgctgcactgacctcccttcagcctgagctttgccacccataaatgcaagatactgcataagcattttagtgctttctgtcttgccagctccactctctccacttactaaaattgcttggctgatacgattattgatcataagtctagacaggaaacaagaggggcacttgagtatgatccatatatatgtgacatataataaggcaccataatgtgagagaggaggaaaacccacctatacgaacgatctgcgatagcaaatggatggggacccagctcaccaaattcagctcctttgtaaattcccatcatgtgattgttgtagaggtgaggaagcctttgaaatggattgacagctattaaaatattcccagtataagtctgaaagaagagcttaaatgcattagggaagctacaagaaaatgaatatcatttgagaaaattatattggtagcaagcataggtaaacaccaagtagcagaccccccccctcccccactccaaaaaaaaaaaaccgaattcgtcattgttgggcctaacagtgtgagtttagacaagattagccccctacctaaaaaatagcttcttcttcttccactcagagcattggcagcattggtcctcgacgtgggtacgggatggatgaggcagagatggcagtggaggcatgggacaggggggggggcatggatgcatggttggttttgtcctgccttatctaccatttctgatttgaatccgccatgaactcgaagatctggagacctcccgcccgcagatgatgacgacacttgggcgatgagggtggggtagtttggaaaagcaagccatcacatgcatttctagttcgctgccgtcacaacgtgctccccgtcggcgcagtcgcatttgtgagagaggaatgggagctgggaatgcagatcctgagaaaaaaaattgctcaaccatgcagcacattgatgaaccaatcatcgacagtgtcaagaggaaaaggaataatgggctgcccatggagaggcggtggccaacagtgccaccaaggaagggaggcaggtgatggaggaatgaaaatatgggggggggggagaattccaacataatttggctaatctgcttctactccatctggtcaaataattcttgatgttttggacaaagattgaggtcaaacaattagtacttcaactatcaataattttttaaaacatttaatttggagacactagaacacgatgtatagattagtccctaaaagtactttagtgcaatgaaacatttacttatttttataaaatatattataattgaaaatcataatcaaagagaagttttggagaccatgcagctgtccaaaacatcaagaattatggaaccataaggagaactaaccaaaccagcacatccaagatgattagcacacaacatgcataaacaattttctataaggacatcccagcactcacaagggtaaagagtttttttctaaagtatatataaccacttcataatacgaaacaaagctacttatatattagggcaaaataaatagataactcaagtaaagtttttttttatcttattggatttttttattaagtcaatgataatatttgatatgggttagtttcgattgagctgattattttagtggtgctaacaccaaaatatggtagtgtagaatttgtatcaaggccctgggggtgcag

SEQ ID NO: 67497 - DNA, 724 bp, Oryza sativa
tttttctttttttaaagcaatgtcgagacaaacaatgttcatggaagaagttataaaaataagcgaaagtgttttcattggatacaataataataaagctaaagatgatatgttgggagctcaacttacatatatttcattgagtgcatatctggactttagattttggagtactcctggctcatgcaaataagctagccttgtcatatcctccacaccacctcggggagattctgtatccttaggataggcacttcccacattaatggtgaccttcttgccagaagtgcagtttactacgagatcattttcattgatctcctctaccaggccatccatccaagcctcatctgggtcctcgacccagacatgagatcccacaacgaaacgactcttggaagcctgtaatgtagtttaaaaaaatattagatggagtatttggagccgatttcatatagagaaagaggagtaacgatcacacacaaaggcataggtatttgtacacagtcctacttgtctacttagatactacaactaattcaatttacttaaaaaaagtgaaattggtggagtgttaaaatggcatcacaatgttctgtgcatagatttgaggataattcagtgagtgctaaataaaaataaaaagtatatcatatatattcgctataatatatgctagcatgagcccatgcgctctctctctctctctctctctctctctctg

SEQ ID NO: 67498 - DNA, 16659 bp, Oryza sativa
aatctgacatttagcatgttatttgaccagtaccaggagcctctagtggtgtaacttgcaaggcgtgtgaaaattctctatgtcggattatatgcttatgatcgtccttttgtattagtggcatttttttcccatgcactcctttagaacctacaatttgtataccttgtttgtttacatacttgttgcactagcagggcttgaagaaagatgagatcattagtcaggtccagctggatttccaggaatctgcaaaggagattagtgcccttagaggaacgctgaaaacagtaactgatgagagggaccttttatggcaggaagcaaagcagctgagaaaaaccatcagcatcatgcaaaatgagactgcctcactaaagaagaaaattgaagcccttgaggaagacatacttgttaaggagggtcagatatcaatactacaagataacatcaagaatcctcaacttgacttcatctgcagtcctagatcagtgaaggagtttggcctggagtgaaaactgcatacacagaaaaggttttagaacagagattgtcagatagcctcaatagtttatacttctgaagacaaagatagatgcttgtgaatacagtgttcatatgcttctacaatatcttcgctactccataccgatatgttatgcaacccattacccagcttataccttttgtaaagcttgcgtacttctatcttaatttcggaagcttcaacgactattccattttttttttctgttttgttcatgtctcttcatgaatccggaagttgtggcaaagtagaatgagatattccagtgtcaatgcgtttatcttgttttatcgactgatgatcaaagagtgagcacatgttgcatgaattgatggcctaatggtaggtagctagacaattcaggtgtcctttttgccggtgttgtttgctgcactgggagcgattggagaccaaaacctgcattagtgggtggtagatcagcagcaactagcatctagcatttgcagtagtttcaatttttttttcaatgaaatgcatgcgacagtttcattctgcttcctgcaaatttggtatttaagcaatatgttggggttcctggctttggctttgtccaacctttttgaataattatttgatttttaggtatctttcaaccactggtgcaatgctctgagggactgtacgctgaaatatggtcttcgtctgttcattaaaatgaagggtgaaaaggggcgtctgacatagatatgcaaggttccataaaaaaaaaagtactagtagatacatactccttccgtccaataaaaaaccaacttaatatctgatgatataacatattttagcagatgttttcaaatttatagtactaaaatatgtcacatttgatcttagattgattttttatgggatggagggagtataaaagaatcaaattaagataggtgtgcctgttctctgtccatgtggctttgaagcttgtgagcagcggcagcgtaaggtagtcttacctctcattcattatttttataagtttgtgtcagacagacattaagggtgtgtttgagaagaacgagatagagaatattagaaagatacgcaaaacgaggtgagccattagcacatgattaattgagtattaattattttaaactttaaaaatagattaatatgattttttaagcaacttttctatagaatttttttttaaaaaaacacaccgtttagtagttcaggaaacgtgcgcgtggaaaacgaaacaaactcactcgctttgttctccaaacgaacgcaccctaagtctggacactgtgtatacattatttattgagtggaagtgaaggaatacctcagtggttaactataagtgcaccagatctgtttaacttttgagcttgacattaagaaacgattacatcactccgaaagtgtatgttgcattggaactctgaataatttgtttttggcaatctagaatcctctctgggatatttatatttggtcagtgaacatcggtgaagaggagtatgttcaagttgatcttggtacagactgattaagataggcattaagtttttgcctaatccggattagaaaaaagaagttgaccagaacaagatttggagagctaccctcatgtctgaatttcctgaatcctggacgtcccaattgattttactattattacatccatgcatgtatgtctagtctcttcctctcctgtttagtagtattaagagagaaaaatcttccatttttctcaattagcccatgctaattaacttgccctcctttttgtaaggtttcttggactatatatgaagaagcatcaaccatctcttaaaaaaaaatgaaccagggacagagaggagacgtgtgatcgattgggtatagtagctctggaaattaaggggagaaagggagacagatgcctagatatgagatggtgttgtgacttgtgaacaggtaggactcgcattgaatggcacggtgacacgatctctatctgttattctacctctctttgaagtcattgtcctgaaaggattgcatattgaatgcaaaaacacatcgaaaagtcagaaggacgaactaagtatgatatctccttactgatgctcgacggcatagctacttgcagaggagcaaatgcccaatttggttgcaccaaaccaaaaagacgatctagatgaagttcatctgtagctaccgattgaaaacgagacccaaatattaaagccattgatgcttctattacaagctgacatttacagcactagagctttcagccatcctattgatcacgatgttggacacgtcttgtgcaactgtgtacaatagcgatagagatagacgaagataaattaattaaacgatcatcttaatttgtactctttccattctaaaatataagagtattttttatccgattctaaatttttatattttaagatggagtgggtattaattaaatagataaattatttagaggacattaagctttgaattgaagctgctgcgcagatatataaatattgcgtcgtctcccatgtcgcctcgcgtctcactgcattgttgtggatcgagtagctatagctagctagtgatggagatcttggtgagtgcactgctcctgctcctcgtgccacccttgtccgccctcctcgccgtcgccgcgccgagcctcgcgtggccgtcggggtcgtcgtcggtgaggaagctgatcgccaagaaggtggcgccggagcaggcggcgcgcgacgagctgctgcgcgtggcgcggtacagtagcgctagcgccgccgctgccgctagtgctgtccaacaaccaggcggcagcgagagtagtcgtccggcggcggcggcggcggatgatggtgggcggccggatcagtgcgcggtgtgcctgagcggcatcgaggagggcgacgaggtgagggagctccggtgccggcacctgttccaccgtggctgcctcgaccggtggtggttgtcggcgcggccgcccgccacgtgcccgctctgccgctgccggctcctgcagagcccgtcggcggcggcggacgacggcgacggcgacggcgaggaggattcggactcggacatggtgatgttcatggcgtacctgcgaagcagtagcacctggctctagccattaagggcgtgtttagttccaaaaacttttctcaaaaacatcgcatcaaatctttagacacatatataggacattaaatatagataaataaaaaactaatggcatagtttgcatataaatcgcgagacgaatcttttgagtctaattaggccatgattaactataagtgctacaataacttacatgtgctaatgacagattgattaggcttaaaagattcgtctcgtggttttagtttttttattcgtgaccgaaaatcccttttgacatccggtcaaacgtacaacgtgacaaaaaaaaaatatttcaccagctaaaacatgcctaattgatgttcgagatggagaggcaggcgatgcatggagatcacgtcgcagcatcgatcgatcggcatcaggcaggcagcgtgcgagggagaactagaagagcgccacgtagagagggaggcacgtaacgtaacgttggttgatgtccgagtgtctcatcactcgatcgcccacgcctctattttgttggatgaggcaggcccacgtaacacgcgtacatcgatcgatcttgtgctctgagtattttatacgttgttcatacaagagagatgttcctgtcctagtatcattgttattggttttatgtcatcatgtgtatcgttggcgtaatagtatcagagtaagtgttaattcggcgtagttctagcttcaatttcatctcttatatagagctgaacctcaaccaaataattttagcttcacttaaaaaggaagtaaagtggagctgattatagtgctctcacaaaataagctagcacgactaatatatccttctaaagtactccctccttaccaaattgatcattatataatttttcaaattgattagtgtcatataatcgcgtggacacggatttcatcggagtacaattaatgtagcataggagaatgtagtgcatgctaaggatataattatgaattgtgttttaatcgatgcatgcattatgagataatgtgtgtatattgtgcatgacgtcttaaactcttaatcgatgcggtttaaataactttttgtcttagtgcacaaacattatatgtgtgattatcaatttgggatggagggagtagaatttaggagttagagtcctatcaaatgaacccaaaacttgttttggtgcatagggaccaaagtgatgcctgagaatgagtatgtccatgacatttgtgactaattttagtgtagatcggtgggtttttcgtatatgtgcgttcgatctggagctgcatgatcagtcccaaatgacactccaacaccgtattacaatttctggttgaaattcgattcactctgcctaatgattcaaatggttccaactccatttcggataaggatgtttgccctcaacatggattaaccgatcgctttcccgtaacaaattaaaggaagtcaactgcatgaatgcaccctagaattaatgaagtcaaattgaccgctacgtattgcaccctaaattgaaacgcgatggatctaccacaggttcaccccgatgaactagatgaaccttttacagaggaggaagtttgggccgctttaaagcagatgccggcagaaaaggccccaggtccagatggctttaatggtaccttctacaagaaatgctggcagttaattaaacaggatatcatggatgttttccagtgtttgtataacctgtcaggaggaaactttagagcactcaacagagcagcaattaccttgcttccaaagaggaacgcccctaccttggtgaccgattttaggccaatcagcctcattcactccgtcgccaagctgatattcaaagttctaacaataaggcttgccaggcagatggatggactgatctcggttgcacagagcgccttcataaaaaaaaagatgcattcaagacaacttcctgtatgttcggaatgtgctcaggaacctaaatgccagcaaaaagccaacactttttttcaagctagacattgctagagcttttgattcggtctcctgggaatatttacttgaactgatgcaaaacatgggttttggcccccggtggagaaattggatctgtttgctcttttccaccaccactttcaaggtagtcctaaatggagaccagggggaatgcattgcacacagacgtggcttgaggcaaggggacccctatccccctatctctttatcctggctatcgaccccctgcaaaggcttctacatctggcgaccgaaggtgggcaactaaccaacatcggaagtcgccatgctagattgaggacttcgctttatgcagatgatgcagctgtttttctcaaccctgtacaaagcgaggtggatgttcttattaccatgcttagggactttggcaaggcaacagggctgcacgtcaatcttggaaaaagtctggtggcaccaattcgatgccaggaagtagatctggacgacgtcttgcgtagtttttcgggggcaagagccagcttcccactgacttacctagggctaccactcactcctggccgcctacgtaaggtgcatttccagcctctccaggataagatcaaaggtcggctctcgggatggaagccatcattgttgtacatgggggggcgccgaattatggtgaactcagttctaagtgccatcccaacttacaccctcacggtgctgaaaccggcgaaacaatctcttcaagaaattgacaaagcaagaaggcggttcctgtgggcaggtaacaagaatatgcatggcggaaaatgcaaggtcaattggcttaaagtttgctcacctgtccggtacggtggtttgggggttccgaacttagaaaagtttgccagagctcttcgactgagatggttatggttcgaatggaggacgccagagaagccttggatatggactgaaacaccctgtgatgaattggataaggatcttttcgcggcatcaacgagagtccaaattggtgacggacaaaaggcgagcttttaggaatcaaattggatcagtggccaaagcctaaaaagtcaagcaccgaatctttataggcattcgaagaggaaaacccgcaccgtccaggacgcgttgcaacaagaaagatggattaacgacatccgccacagcctcaccattccccttcttgatgaatccttctatgtttaggaaattttagcccgtgacaccccacaactaatagagggggtacaagactcgattgtttggcaatggacaactaatggggaatacagtgaaaaatccgcgtaccaattccaattcaatggaatggtactctcgccatcaacaaagttgtcttgggaggcatgggctctggcaaagtgcaaaatcttcagttggttggttcttcaaaaccgggtgtggacagctgaccggttacagatcaggggatggccaaataattatttctgccagctatgctttcgaaatctcgaaacaatcgaccatcttctgtttgaatgcccggtctcaaagcaaatctggtttgggattctcacatggctgcaccaagggcacatcatcccgaaatggaacacaagtagaaacctcttagattggtggacacaaggaacaagcgacccggaagcaacaaaacagaaaggactcagaactctcttcttgctcattgtttgggaaatctggaaggaacgaaatgcaagaatctttagagcaaaggaggcgacagtacaccagatgattagtcacatccaagaggaattaggttggtggagtatggccggcgctaaacacattgggagaatgttgcaatgaggagctaggaaggctacatgcaagcttgtttgcatgttgtcatgtacagtttttctctttcttagccctttggctatttgtactttttctccttctatcaatataacgccagtcaattctgaccggctgttcgaaaaaaattgaccgcttcgtggcatcgatatcgatatgcttcgcccgcatgctagtagtaagcactagcatggattctagggcttagctcagttggttgatgggtatgggtgtatgcctagaccattcaaattcgaattatgttgaagacaaattggatgcctattttttaaagagtaaattgtattggatgtaacgaattacataagcttgtaaaacacacgttttaatgtacggacatgttgatgcatgcgaatcagaaccaaataagcatgccatggttaatcttactaagtttgaatgtttattaggatgctacatgggtacacatttcagaatgatgccatctagacatatgtgtactcgatcaaatacatagtaggggatgctaattatacagtgaaaaaaataccagtgatgcagtgaattaaaaacaatggaagaaaaaaaaatagtggtaatttgcacatatagtatgcctcatgacctcctgacgtgtgcatgtgccattctaagcatgtttcaacttagtatatcaaccacggttttggcgtcattaattttgcacacaccagacaagtttgtgacaagtattttataattttttccactgtactatgttgcatccacctattaggtttgtgttaggttaatataatttactttttaaatacagagtcaatctagtctattctatgttgatccctcttggttcgttggaaagaaaagttgcacggatttttctcgctaacctagctccggagactgcatgccgttggatcttgcggtgaccgtgcgtcgtgcgtacatgaatccgcctgacccaagcccacgtgggccacgccaagggaggcccagacagccagattagcaggccttacgcccgttacgcgacgtcaaacggaacgaagaataagttcatcttaggcctcttaacttgttaacgaatctgattttcgtccttcaaccagaaaaccaggtacaacagaggtcccttcatcttatctctatgactctatcctccctccctcagtctctccggcaggacgagaggagcgcgaacccaatgtcgatcttgccattttttattttgtgtgtgaaactgacatgtgggtcccacaagttttgttatttttcttggtcaaattgccacgtcaacgccacgtcagatgaacacatagtcaaaatagctacgtaggagtcacatcagccaaaaccgccatctaaaccgccaagagatcttatctgcatcggttttgatagatgagggacccgctgtatctgatttttgagttgaaggatgaaaataagattcgttgacaagttaagggatctcagatgaacttattccacggaacgagacctaggccttcttaattccaaaacgggccaagggcccaagttacctgagctctaaaatatgttgcttcacaatataccggtactatactctcctccgctttttataatatataaagttgttaatttttgttacaacctttgatcattcgtgttatttaaaaatttatgcaaatattaaaaatataagtattgcttaaattttgtttattgacaaatcaaaccacaacacatgaaaagatatttacttaaattttttgaacaaggtgatcaaacatgatgtaaaaagttaacatttttaaaaaaaacagaggtagtactagcatttctaagacgaagaaacttaagaaacaaacagcaaaatacaaggatcaatgagaattactcgaaccttgcaaaagagaatcattcgcaccacatcgatcaacacaagaatcacgcccatcagagtgaatctttcgttgaaagtttaaccacagagtgaaatttgcaagaggaagagacgtgcagatcgatagttaagaaaagagttcgtcgtttcagctcttgttcacaacagccagcatccccaagtacaaacccccattgattttcctacagagatcgagtttaaatcatttcgctatgaacattgtggttggttgattagaaagaggccgaagtagttcgtcgcagctgctgcttcggctccggctggggcacaatctgcattactggttccagcttctgcgtcaagaatgctttcaggaaatcgacgcagctagggaatgttgagaaatcagcaacagcctgtttcataaaaacaaagattcagtaatgcatcaactgaactgtagaaaaaactatatactactccctagttaattaagacgatcgttcagttcaaattagaaattcgtaccaccctgaacagtcataatctgtcctataagtgcgcatctggaggaattagtacattgagaaaatatactagagcaagtaagatataaagaaccattttttgcagagtactacgtgcatgatttgtccacaatgtcacctgtttaacctcaaattgcaacctttgctcgcccatctatgacccagcatcccaaggagtaccacatttgcacacacacacacaagatgctaatcaaggctcgttacccctctctctctctctctctctctctctctctctctctctctccactgagcatccagctcaattataaacctaacaactagtaagaaaattatatttctagtttggctttaactaaaaaatgactttgcagagtttgtgcaaactgggagccacagaaaagatttaaaaacaaacaaagaaacagtggagctgaagctcacatcaagatcagtggaactgagtactagcagtgagcaattagtaggatttaggaggagaagctactaataaacattttttttgttgttaccttgtgctccctgaggcgctggttctcctcctccaaccgcgagatcttgttctcgagctcgttcgtgtatgcctgcgttgccaccacatgagcgtctcacgaatccatggggggggggggggggggggggaaggaaattgaagcttctctgcagattgattcgatggatggaaagctcacctgcttccgtgctcgggaccgcgccgccgactcgcggttcttgatcatgcgcttctgcctccgctccaccgtcttctccaccacgccgtccacgccgccgccgcgcttccgccccgccacgcccacctgcgagaggaaccccgcgacgccgtgcccgtccacgcggttatacacgccgtccaccaccgccccggagccgcccacgtactgcagcgtcgtcgtcgtcggcggcggcggcggcgggtagtgcccacgcagccaatgcgcgccggcggcggaggcggcaccgtcgacggcgacgccggcgcgcgagaggaagtcctcgagcgtcatctcgcccatgggcgtcgcgtggtgccggccggtgctggcgccctggatgtcgcgccacacctcgtccaccgtcttcctccccgccgtctccgccgccgccgccgcggcggggagcaccgtgcgcaggaggtcgtccaggttcatgctccgcagcggctcgcccaggtggctctccacctcgttcagcgtcaggctgtacaccgacccctgccgcgacagtgccccttcgccgccaccgccgccgccgccgtggcacgacattgcgtggactcccatccacacacgcacacacactcaccctacccacgtgcgatcagctagctgcaaacaaaaaaaaatggcgcggaaacattaacagaagcgatcttgccggcgatgtaggaggaaagaaaaatcttggagcatgccaagaaaggggagaatcttgcaaggaggggagaggttttacctgagcaagcaaagcaggggaaggaagggaccagatgagaagagaatctggagagagaagcaggggaggaagaagaggaggagatggtgatgatgaggaggaggacattaataatctagggttgccacccacaaagagggtttgggcagtgaaagctactgatgtggggggaggagtcctgaaagggaaggggaggaggaagaaagaaagaagaggagcaagcaacttgagctgagaaaatgctttgctttgctagctgatgaatgaatgaatgaatggaaagaaagcctaactttttggcatggccaatgttccagggctgtaggtattgctggggtagtagaaggaagcagtattttccaactttttttttttggtttttggagggagaactgtggcttgtggggatgagcagagtactccacctccactgggctggctgggcccaaccccaaggtgcctcatcaatctcaaaagaagttttttggggctttctgtttgggatattttagtgtttctgctgtagaactttttttactaacacaaaaataacaaatttgagatattttggaaggaaaaaaaaagcccataatttcttcctcctttcatcccgttcatcgatgttgttatcgctgacttccttatatcactctcaagtcacagtcgcgggagaaaactccgccaccacaccttgagttcaatgctgtcacaactcatgtccctctctctgtttgctagagaggggagatgggcgggtggttgagatttaagaaaatcacaatctatagtatattttgtaacatatatttatttatataaggaatcgttgtgcttctcttcaattgctagtacaaaatctaacattaacatataacggtaagtatgatttaccgctctaaaccatgggttataccttcttttgtccctgctacctctgaattctttcaatcaagctctcgccctactaacatccaccagttattgtacaagtgccattaacataaattttgtatgcgatttcaagaatagttaagaattccaggtcgataatagcagcaatagcaattgtcccagagtaaaggaagcatgccaatgtagatggacatgtagtagaggaagatattttggaagaaaaaaaaagagacataaatccctcctttcctccctctgggcgttgttgctttcaccgccttgcttgtactactgccacgtcacaatcgtaggaaataattccatcaccttgagttctaagctccatcaggattcacgtccctctctctgttggctagagattgaagacaatgttttttactaggctaagatccatggctagagagcaggtggttgagatttaagaaaatctctatcatctatgtgtttctgtaatacaagacataagttataaagcaatcactatgcagctcttcagctgctataaaacccaatgttgacatataaggctgtgtttaatttctggaaaaagttggaagtttgaggaaagttgaaagtttatgtgtgtaggatagttttagatgtgatgtgatgtgatagaaagttggaagtttagggtagttggggatgaactaaacacggcctaacagtacatatgattcatcactctaaaccatgggttatactccctccgtttcacaatgtaagtcattctgtcatttcctatattcatattgatgttaatgaatctagattgatatatatgtctagattcattaacatcaatatgaatgtgagaaatgctagaatgacttaggccccctttgattcaaaggaaattcataggaattttagaggattttattcctataggaatttttcctatatagccctttgaatcaaaggaatggatcctatgaaatcctataaaattcctatggaatgcctcttcccatgcaaattttagagaaaatttaacaatgaggtagaacctcttggtaactttccttcgagtctatctctatcatccaattactgtgtttttcccgcggttcaatcaaacggtcattcatgtgtttttcctgcattttgcaatcctatgttttacacttaggtggtgtttgtatccagggacttaactttagtccctgtatttagacactaatttagagtattaaatatagactacttacaaaactaattacataaatgaaagctaattcgcgagacaattttttaaagcctaattaatccataattagagaatgtttactgtagcatcacataggctaatcatgtattaattaggctcaatagatttgtctcgcgaattagtctaagattatggatgtgttttattaatagtctacgtttaatgtttataattagcgtctaaacatccgatgtgataaggacttaaaagttttagtcccatctaaataaggtcttatatttctatcaaaatcctacgttttttatattcctacgttttctcaatcctgcgattcaaaggggcccttgcatcgtggaatggaggaagtacattctttgtccttgctatctccgtgagtttgctcaatcaagctctatagctggtaacatccagtactacgtactcgtaccaatatttgtaaaagtgcttgtaacataaattgtacaggcttttacatgttgaattcaaaaatagtgaagaaatgcagccggataatagaagcacaacagtaaccgtcccagagcaaaggaagcatgccaatggaggacatgtactaaacactgtgcatagtctgacatcttttgcatcgtttgggcattggatgagcaacacaaggagggctggctggctggccatgggctatggctagtcaatgatggattggacgtccgataaaggcagagacaaatgaacaaacaaacgtatggagaagagaagagcagcacaagatgccggctatcatagcactctgctactacggctgtgtctagttcagcgcaaagtttatattttgattaaaattgaagatgatgtgattggaaagttatgtatgtatgataggttgatgtgatggaaaaagattgaagtttggatccaaactttggatttaaacacagcctactatgtaattgcagtgacctacacaacaccctattgtggataacgtgatcatctgacagtttagtgtgtgactatgcaaaccaaatactactagtactgctcgtactcgtagtactcggacggtcaaactgattgattggctcaaggggtttagggcagttttggtggggtcccttcaacaggcaaacgatatggatggaaaggaataatattggatcatcctaggtatctcagtgaatctactattacgggagaaatcggatcaaagttttcttctgatgtcctgatcaactggaaattgcatgaaaattcttaactaccctgaaataaacatgaatggattggcttaacctgtcacaccggttctgaactcagggttgtcctttctttttgtcttagacattggttagatccagggtaaaaatttttactgtgccacatcgaatatacggacacacatttgaagtattaaacgtagtctaataacaaaataaattacagaatccgcctgtaaaccgcgagacaaatttattaagcctaattaatccatcattagcaaatgtttactgtagcaccacattgtcaaatcatggagcaattaggtttaaaatattcgtctcgcaatttacacgtaatatgtataattagttattttttcgtttatatttaatattctatgcatgtgtccaaatattcgatataacatcgtgaaaaattttaccggggatctaaacatgcccttatagattatggattgccacgggcatagtttctaagctctaaaacattcaaagaaattctagtgaagaaagtttcttaatcaacatttctttgaaaaaaaattcaaatcaatttttcagctttctaatatttaatttattatgctgtgtcctcaaataattgtcatgaatttaattttatctatcagttacaaagaacatgccgaaaaaaaagggaaaatcttcatcttactgaactgaaaggagaaaatactattaatgcactttgtcgtttaagaccaaacaaatgcaagctacagattgtgctaccatgtaatgcagtgtgtctcgctcgattatatgcaatctgttgaacttgttgactccttccggcatactactagtaaacatgcaagaaaattggtcaagtcatttctctcatcaagtctgtctttcaggaaggaatccgattccttctttcctatacacggtaaagatagaaaaagaagctgccgaaaacggcatgacgcactatctagtgtccttcatactccatatatttatttgtcattgttaatttccaaggctacacaaaaaggcacaggataaagaaaacaaaaacttgttaatttgctagggtacagaaaaaggcatagagcaaaggaaaaaaaaagtgtcacgagggaacatttcatgcctgcccctgcctgcatataggactatatggctttgcatcgccgttgaagatcagccaaggaatggaatttgtaccatacaaaaattaattcacgggttttcattatgcatgtttcagcaaatcactaattaatatggcatgtacaataatcattcataaaaggcacttagtctcactcaacaggattttagagtttttagaatagaaaataaaaaatatattttaggttaatgattagagtctttattgtcttaattattataagacacatgtatgcatttaactatttgccacttttccaattggcaattaactatttgttgcccctatttcaacgatatgtgggtccacatgtatctatgacatgtgaatccagtggcaaaaagttatttgtcacatctaaaagtggtaaatagttaaatatctacaaatccgatggccctaagagtatagccatattatgttgttaaaaatgttgtctagctcacttgaacgatcgacatggaagaaataattgcttactaattaacaagatgctggaaatgtcgctcgatcatgtaactagatgatgttagtctgattcccttttaattccattaaccagcagcgcatcacatcttcttcggcagcttgtttaattattcaccggctccggtttagcgaaacaacgtcaactttgccttaaagaatccgaaaacatcttgcctggcccaatcagatcgccggatgcaccaaaaaagatttctaagcaaattaatcatgttgattagccggcgagcttatctcctagtactagctaatgatggtaattattgcgtaacgtcattgatttgtactaag

SEQ ID NO: 67499 - DNA, 11924 bp, Oryza sativa
  unsure (1)..(11924): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaattgtttctaatatctccactggcagcaaggataatattcaggtagaagtgttttctgacttttgtgctttctcagcaaggataatgtccatgtctatttttgctgcatcatcttccatgccctacattaagtgattgtactactatgttttgaccataattcttccaacaggcagtaattgatgcagatgttataagccctctcattttcctattaaagacctccgagaaggatatcaaggaggaagctgcttgggctatatcaaatgctgcgtctggtggttcaaatgatcaaattcagtaagttctagccaggaattgtcttggtattcttttacattcaaatgtatgtttaatgtattttttttgtgtcaatgaaattgaacctggtgctctgcaatgattattctctatttggccacagatatttggtgagtcgaggatgtttggagccactctgcaatgttctcacttaccaagatgctgacctagtatatgcgtgcctggaaggtcttcaaaacatacttcaggcgggtgcagtggggaagcaggggcagggttccacggtgaacccgtatgcacagtttattttagaatgtgggggtttggataaactggaagatctgcaggaagtcgacaatgatgccatttacaagttagtcatgaagttgctggagggttactgggacgaggaagtaagtgatgatgacccaaatttaccaacttcaaatgactctgcagagaccgtggagacggcatctgaagatgctgcgcagccaacagagccatcggccagcccaaatgaaagcgaatgacttgtaatgcttccttcctgtaagatgtaaccatctggttcgttggtgtcatgccaaaccgtcactctgccgaatttataacattactacaatttatgtattatatactaatgaaatttttgtgaatgtttgagcaggaatttgatcttaatttcccttgtccggtgaaaagagaatgaaggcatgactgttttttggggcaagattttctcgctgtaaacagtgtgagactaaacagtggatgaaaagacctgagatactctcatctctactactaccaagagtccaagaccaacacaaccatatcagggtactgtacttacctgcacaattgtcgtcagcagaggctagtggcacaatctagttttggttcgtgttgcatgcatcatggcaagttgccaacctcatggctaagcaagatatgatcaacttatgacttgttaggagcgatacgtttcgctcaaaaaccatcaattccgttcatacactacgtgttggcttccatcaatcgctatccaagatatctgagtttgtacgaccgtaatcagtaaacctgcatctctctcgatccaagtcaattgaagcgatcgaagtcaattgaagcaaatatagtaggcacacaaaaatatacagcctcaatcatgtttgtttaatttaccgacgtggtcgatattaatgtatgtaaattctaagtgtgtatctgaattttttaagtgtcaccttcaacaacactgggttgatggaagctaaccaaaccgaaagctaagctcgtcgttcacctcgtgcttcaattcgatcgatcttgcttgattcaagtgcatgccattttgacaattcatggctcgaactgaactggtgagttccaaaggagactttcatatggcatgggcagagagatgcatgcaagttgcatatgccaatattctcaaacgacacgttcctgtatattgatcgacaactacttgttcccaacatagttaggctcaggttatgcatgcacatgcaagtttattataatttctttcgtttggaattggataagatgtgtacatgcattatctgtggttgtttgcatcttctcaggagaaccatgcatatatatcccttcatttcccgaaagaaaaatggtaatgtataactgaagatatgattggtgaggatatatgtacacgcatattccttatgctgtagtaacatatcttgcgaatatatataattgcaagaatttggtggatgcaatatatataaatgcatcaatcatgcagctgcttgaaaggagtttatcgaggaaagacaatttgaggtaagcacgacacatgctcgaatggtcgatcgaaatgggacaaatatgcatgcgcgttgaggaatatgagataaattgaatgattgaaagaaaaaggcgtacatagccagcagtgtgtgttccgtgcaagatcgaagcagtacatcaacagcgctacaacttgtgtgtctcgattcgattagaggatgagattggatgagatgcattggacttttgctctttcgccttcagctctgcacttttcaagtcgtctcgttgcttttgattgacttgcagatgcacttttgtcacctgcatgcaattcgtggccaatatattccatggggcaattaagccggccggttaattactgaagaaagtctgaaacgacgacacatgcatatgatgattgatgaccaaaggtacagtttaattcagagatacatagacagatgattgcgaaatgtatggcagggaaacactagctagtcactagtcaattaaaggtagttagttgtgcgttttgatcggccggggatttgcctcaaatctacctacaagccagcttcaattaagatgcatgcatatgacttaaaattctcttaaataaactaaaaaaatactagtccattagcgctatatagtaggcgatacataaggatcacgtatgtagaaagcatggccggtttattcttcctcttaatttcttgccaatttagttgagatctagctcgatcgatcattatcgatagagttagaatgacagtaattaagaaagatgcggtagctatttgtggatatgtatctgcatctcgatcagcatctgcaatcaagctagctagctacttgtatgcacgatacatatactggcattgtggatgtcgctgttgcttctaacaagccgatcgatcgacttaattcctggcggttcgggatacggtattttctatccacctctcttcgagtacggtgaaccgtcttatctggcgttggacaagcgaccagcgttatttggctcgctccgtttaccatgctttcttccttggctagcgaccctctgctcttatctgctttggcgggctaaaggccccgctaaatgcaaattcttcctatggcttgtgcttgtgttccagtaccgcagttggatgatcgatcttctacaaaaagcgtggcattgacagtcactcggcctgccctttttgcacccaagagattgaaacggtgaaccacatttttctcgtctatgtgttcacctgttaggtctcgcaccattttatgtctcctcctggcttgccagaccttgcatctccccgtggctgcttgctccaggtgtggtggccgacctctagggcttcgatttgttaatcctgtcggtattctggtaactgtgaaagtagcggaactccagagtgttcgactatctctctcatcggtttcagtggttttggagtttatccttaggaaggttgcctgtagtcaactgcgagtgatgtggcttttgggatttagtggggcacaaccgccacccatagcctataagagcagtttttagcttttagattccccttagcaacttttgtgggtttcttttgttgctttttccttgccccggtaatagtcttttggttgtttgtgctgtctaactaaaattatgttttcttctaatatattaaagagtatttttaaaatgacttaattaactgtagatggactaattatattagccaccctccttaggaggctaaaaactatatactccctcaatcttaaaatatttgacgccgttgactttttaaaaaagtttgaccgttcgtcttattcaaaaaatttaagtaattattaattctttttctatcatttaatttattgttaaatatactttttcgtatacatatagttttacacatttcacaaattttttttaataagacgaacggttaaatatattttaaaaagtcaacggcgttaaaatttagggaaggaaggagtatatcagaacagaagatgattaatttggagacgtacactattacttatgtacgtatagtcggctaatgcgcttcgccatcgatcagtgtcgcagctgctgtaaattaacagcatctaatataattggaccatgctgcgtcgatgatctgaaaaggaacaagcttgcttgaattggcgccgccgccgaccgccgatataatcattacttactgttattggccggagcaaactagctagctgatcatattgtcgatcgattaatttgggcccagctatctagccacgcaaaccgcgagggaatgaacggaatgattctaatcgcacgaattaattcgatgatccatgtgtggcggcaagctagcaactactttttcatatatatatctctctctctttcctcaggtgacgcctgaatctcatggatcgatcggttcgtccagcactagcaactagtagtattacttgcttaattagctttcagctggaatattactcccataacgtacaaattaatctcatttttaattctgattcggaaatatcatcctcattaaaatgttctgattccccagctaagctagctgacagagaaattaaccaaaagcattaattttgtaagaagcagcaatatatgcaggtaataatgcatcctttttttgtcccttttcccatgctaactagctagctaaaagcgacccatgctagctagcttgcacagttaaccccactagctaacatttcttccctgttgctaatcataacgtgccctttcctgttggttcttagtgctgctccctgctgatctctcatctgcaattacatcacttgacactgcttgttaccaagtgctaaagctagctagatgaggttgatgcaattagcctctgagaaaagtgtagcatcacaaacgtacgcgtgcttaattaatgcagtctttgtttaaaacgaaaaacaaaactaatataatgttcgaatacttagaagtcagttgtattttataattgcaaattaacaactctgagagatatgtgtcacaatcggcaccgtcaccaggacaaacaagtttgcaaatatcactactgattaatggactaatattatattggctggtcgtttgtacagtaatgaaggaattgttggtgattgatgaggtgtttcttttctgctaaagataaaaataaagttaagacatggtgaaaacaattattacttaattaattaagttgtaattattacaagttcaaaattttaatttgtctaatattttagagtaatttttacatagaaaacttttatacaaaagacactatgggctggttggtttgaggcctaaattaggcttaccaatatttgtcaatttcaatagtgtttagtgtctatttggtttgaagccaaattttgacatgcctaagaaaataggccattttaatagtgaacttagactattttggcttcaatccaaacacaactttgccttaccaaaattagtcatgccaaaacttgctaaaatttgacaccaacaaaatttggtaaggcctatttaggtcacaaaccaaaccaaccatatatttatcagtttgaaaaacacgtaataacgaaagccgagatagaattatctggatcttgatcagacaagaaagtgaccgatccatgagtttgcttatacacatatgcatagatacagatttcttaatcagtcccacacctcaccatcatatcacaaggagttccaaaagtcttattgtggtatccagatcatcaccaaattaagctagctagctagcttgatatacattattacaaacaaattaaaccaatccgtttcatccgtcccgagaaattaagaatggagtaattcaggcagtatagtaaaaaccaagcgatcgattaaccgtacatccagactaatttaattagcactgtagtttatctccatccatgatcatgcatgcatgcttttacttgatgatcatggaggaggaaaactaccaagtgtagcttaagtaattactccatgcatgttccaaaatactactactgtactaaagtgtagctaatgtactgtacttgagaattgacgatatatgtggtaagaactggagacgagattattgggggttaaatcaaatcaaattaacctccaaataataagcatctccttcttctttaatccacacaaatgtgtaggtgtaggtaggaaggcatcatatttggtcaacggttttcacaagccaagcatttgcgtgtaccatgggtcgtcctcagggccccacatggccatggtctccacgtcaaactccggcagcgccgccgccgcgtcgtcgtagtacagccccgcgagacccggcagcgactccgactcggaccagcagcacgtcgtcgtctccgccgcgcgcgcgcagacgaactgatcctgcatctggtggcacgacgccgccgcggtcggcagtactacatgttgggccatcgtcgtcgtcggcggcggcgcgccggcgacgctcatctgtggtgcttgatgttgctgccacatggctgcagagtcgttgctgtcggccatggcgagcggcgggtgatgcgcgtcgacgacgaggtcggaggtgatgcagctggtggcggcggagacggagaggtcggcgtcgtcggcgtcgtgggattgggattgggaggagcggtggatgcgttcgaggaggcggggcatccagaggtagcgcatgaggtccttgaactgctgggagttgacgtcgcagttgaggtgcttggcgtgcttctggacgcgggtgcgccagtagttcttgatctcgttgtcggtgcggccggggagatgctgcgcgatcttgctccaccgattcccccaccgcccatggagctccagtatcagcagctgctcctccgccgtcatgttccccctcctcacgtccggcctcaggtagttcagccaccgcagccggcagctcttccccgtccgcttcagccctgcatgcaccatccaactcaattcatctatccatccatcgatccatcggagaagaaggaagaattgctctgcttaccggcgcagcgcgcgagcgcgttccagcggccctcgccatgggcggcgatgtagttgacgaggagcaggtcctcctccaccgtccacggccctcgccggagctcgtcgccgccgccagcctcctcctcgctgctcacctctcgcgccatcatcatcgggcagagcaagtgtgtagtagagctagctatatcgtttgaggaaaatggcgggagagctcgggtcgggctttggccttatatatagaggagaggagaggatgataatggcatgtgtggacttggaagaaaattactaacaatcaagcagcttaattagcttaatcgatgagatagctgctgtgctctgatcgattccaaaagcctaaagcgacggagctggccatggatgccatgcgtgattagtttatcttttggaattacaacaccacattaacgatgctaatccacccacacacgtcaactttgacgcctcctctgacttatctccttacttccttcccaaatctctctctctctctctctctctgttttgtctgtctctgtatccagtttgcctgtctcacatatgccaacttcactgtactttcattagtttcacatcgatattgatttgtactacttcagtgaaaaaaattcagacttttctgaatcatagcacaatataatttagttcttttctttttgcatgatcaggacatagatttctttcttagccttaatttaattaggctttttgatggtgacaaggccggattaattgtggctgtcattttagcttagatttatcagatttatgtgctgttcagagttgaaacttgaaatgaacacacccacaccatctagccaagtttgtcaacatgctactgaaaataactggtactataatacaatatacaactagtacacattttgtcactcaattatgagcaatcagtcaactgcttgagctaatatcagaatcttttgcaacccaatttctgctaactaaattaccaacttgatcattctaaaaccaaaaacaatcacaaatacaaatacagtacagcagggtatggtcaggttccacaccgcgcgttgaaatttgagcatttggattgaattgtttttcagctagggtgcccaattttgtcaaactcgcagactctggtctcctctgatctgtcacagggatctctatcaagtccaagcaaagtgctgtcatttagaattgcagctgcttaatcacacacacactgacctggatgatcagtccctggtattggatacaatcgatcaagtgccgtggtctcgtccatccattgccagattgtccctgacattattgtttttcttttccattgccaaatgccaaagctaggtagccagattaatagacatgttcctgttcatgcatatgcaaatctgtttgcttgctagcaaaggtcaaactattctctgaattcgtgggtttttaaatgggaattattctatggattaccatacgtgtattcgagttgactcatatatgcagaccactgtactgttcaatccatatgtgtccatatatgcagatacgcttgcattttcgaggttggggatgagaatctcagataaaatagtgtttgtggtgtagcatcttgtaaataggcggtggctgtgaagcctcgccatccctgtacattctctattttcttaatatattacggtcggcgttctttgtcgacccgacgaaaaaatgataaaatagtgttcagtatgcagacatgcagtatggtaagacatgtttttctatagggaaattattgtttttttcgagacattcccttgtttatattatgtcacccaaataattattaatatcttttaaaaattgataagataaattaatatgtgatttattacttctacaaatatacaaattcaaatttgacttctgcacattataacaaaagaacaaattaaactataacacgggcattcaatttttgtttctttttttaaaaaaagtgcataagtcatttaaacttatatatttataaaacaatataaatcatattgatctatcttaaaataattatgattatttgagtgagcgaacattctttgtaggaacgaaaacccatctacttttggtaattgctatatctacaactaatagctgctactaagtgctcatcaccgaaaaataaaaatccaggctcaaccaaccgtgaagcaattaacacaagcatgtactcaattggtattagcacaatgttcacgactcctaatctattatattattaaaggaatagaaaaaggagccttcacgttcgctctcatggcctagaaattctcacattaatcgaagaaaaagaaaaaatagagtccatatagaaatacaatttagaaagagactagagtccatatagaaatacaatttagaaatagctaaaattcggaattaaaatataaggaatattagaagaggagactagagtctatctacaaatacaatttagaaatagttgaaattcgaaattaacaaataaggaatattagaagaggagactagagtccatatagaaatacaattaggaaatgactgaaattcaaaattaaaaataaggaatattagaagtagagtatagagtgcatatagaaatacaattaggaaataatagaaattcggaattaaaaaaaaggaatattagaaatagagtatagagtccatatagaaatacaattaagaaaaaaagaaattcggaattaaaaaaaggaatattagaagtagagtatagagtccatataggaatttaaaactaattaaaatttagaataaacataataaaattaaaagtagagtttagagtccgtataaaaatacaatttacaaataactaaaattcgaaattaagaaaaacatgggaagaagagtttaaagtcaatataggaatacaatttagaagtaactgaaatttgaaattaaaaattaaagaatattgaaagatgactttagagtccacatataaatacaattagaaataataaaaaaatcagaattaaaaaaagaaatattaaaagacgagtctagagtccatataggaatatatataatttacaaataactaaaatttgatattaaaaataattaataactaacacatatataaaatacaatatgaatattacacattagtagtttcgtaaagttattgtaaaatttaaaattatgttgtcattgtaatatattttaataatataatgagaaaacatatatgctattatataaaagaaaatataatgatgctagccgcacaatctgtgcgggtcgctatgctagttaagtaattaagatggggtcagagctaatcaacgtgattaatcaaagggtactgccagctcttgttccactgacaagatgacaaagattagacacgaaagtgcatgtccttcagggttaggatagtgaatagggttcctcctttattttcttttcagattatgcatgcagcacgttgtctaaatccgcgtacgtgctaagccacgatctgcaagatcacgtcggcgatgagcaggtaaactgatagattaactaatcgatctgcaagtgctcgtactatcatgaactttttgttgccgctgcaatgcgtactaattttgtattctagtagtacattgtctgatgagaagtgggggacacatcacgagattagcgagtgggaaagcgggttttgcttgtgcaaagcaagctcctcaactctcttttgttttttcagtgtttgatcgttggagcacttgcaatactagcttgtgggtcagtgtttgtaggctccaaagggttcaactcagtttcattcaagaaaagaagaacaaaaaagaatgaaaaagatggctgcgagacagggctaggtaacttgtttcagatgaactccggcgccgcttttatgtgttccaattctggaggctggactacttgatggatcaagattagcaaaaggctgtcttgagatgagttgtgttgatcttttgcaaacttatctagtttttgttcaaccatttggagtaatttagacagggaaatatttgaagaacatgcagcgagcaacaaggacagtgcaactattccttaacaaacaaaaaaaaaacagatgtatttttagcaatagaagatctgaaccctttttggacactaatatggattcagaggggacagcgtctgatacacgaggggagcttaacaaaaacttgttgatgaaaggaacttgtcccgagtttcaggacaagcctaagaatatgtcccttaaagcagcagcaaacatgttcagacgtgattagcactaaccaagtaaccatgacattgtgttctgctgtgcctacatctatatgatactcgtttagtacctagtagtatataatagagataaagttgccatccttcctccgttccattctttcctttcttatctttgctatattcttgtttcgttttgagtgaaagtaaagaagactttgctcttgattgatcccaatttgattgcttatattactacttcgatcgttgaagtgaaaggaacgttcaggaacatggcatttgttggaaacaagatgaaaattattctactataactttgatgaaacctaccagcagcttccacgctctaaagtta

SEQ ID NO: 67500 - DNA, 8258 bp, Oryza sativa
  unsure (1)..(8258): unsure at all n locations
nnnnnnnnnnnnnnnnnnnnnnnnnnnnnnnnnnnnnnnngcactcagctagtagaaagagaagaagagagagtgcctttgtgtgtgtggactggagaagaagaaggacgacaacaacaataaggagaagttaaaaaggataagaagagaggagaggagaggagacgatgctgccagccacgagtccactgtaggaggaggaggaagaaaggaggaaagaagcaagtaggggcgggcgacgacgaaccgagcgagaggtgctgggaaacaacagcgacaactaccatttataatgccctcttgactaacgcctttgcccaaattcaatccaggaaaatgcagtactacggtttttaataccacgtgttgagtggtatctctcctcgtgcgccgatgaacaattgtactaccaaaccaaggcggcttctttcgctcaaaaacaaacaatttgccttgcaatacacaatactgctgcgtacactccgtcagtgaccaagcaaatttaccagcatgatgcttgtaaaacatggttcaagctctgaaaaacagtttttttaattaaaaaaaagctccgaaaaacaattgcggagttctgaacttttttgttgcaaaagggaacacactgttcatcggctttaggggtggttcctagttcctgctggaaattaaaagcacaataattagacaaggtaccttcatttgctacgtggcgaactctgtgctaatggccaaaaggaccaacacaatcagggccctaccataccacccacaccacatgtagtagcagcagcagtttacaagaggcctgcaaattctgttggggagaggtagctaggtctcctccgtctccatggagatggagaccacatatttactcattagccttatcgcacagctattgttttggttggttcctctaactctgagattaatttcaggatttcaggccccatgtaaaggctggctggaccatcatgcccatcttcttcttcacttgtgtcattctccctaccatttctccatgtttatctgtaggtgtcggcaggtttggccagcttgctctctctaacttcatctgcaaattaaaacccagcaccttgatagcgatccacgcgtttactaaaggatcgttgaaagacacctctttcatctgcgctgctcttaattcatgctgttgtatattcattctgaaaaatgttgtgttgctgtgctgtagtcagtaacagactaacagtaacacgcctcatgcacattcaattttggagaggtcaagttgtaacataaagaatgaattctcaggatcagatttcagaagacagtgaatgagagagagagattttgcaccatgtttatgcctgatgctttgattgacaacaaaagcaagtcaactgtattagcaacttgcaagcgtggagagtagtactagtatatcgaatgctgctgggtcgaccatgtttccggtagcagtggcaatgattggcccaagtattctagagagttttattcagttatcgacatctcctccccaatcctttgatctgatacaccacgttgtacgcaatgtttgccaacttatttaatccagtttgatagttctatttcaggtcgttatcgctgttagtttattttgcttctttcttcaagtctccaataggagggatcactacatttgcaaatgccgactgaattttttgaaagatcgccgactgaatttattaacttttttttttctgaaggtcagtaaacttggtgtgacaatttcttgccaaatttcggcacaaaaacaagatgattcatactagtactaagaaaacaagatgacttgctttaactttgtgaagcacatgccatctctccaaaacccaaagtgaacaggttctctgaacaacgaacaggtagcagaatagctcgcggtgttgcatgtgtaggatgtcgcacgcagcagcaaagttttacaagagttgcagataattgacgatgacaaggatgtgctccctcctcatcaggcaaggatctccttggatcatctcgaatctagatagatactcaggaagatctcaggagcaaatctcgtcgtcaatggtgttcagttcactgaacagggctgtagaaacctgcaatgatctgaacattggagttccaagtcattgcttggacttgtgtgcaatcatttgtccatgttcagatcactttgggcgatggtctttctgaatgacttcagaaatctaactctatatcacttatatagcatgaaacatatgcgtagtttgcttagaattttttttgtcaaagtttatgaacttttgaatcttgagttcgttgtgtcttatatcactttcataaattctgaaatttaaaatgcctaaaaaatttttgagcacatctctgttactcaaagcacttgaaaatgttatactgccacatcatctatatatccaaatcagtttcagcttaagcaagcattggcaactgtgaaaattctcattttattcctccatattctgaacatgtttgacttcgaatttcagtaggatgccggaaacccatatttcgcacgctcttgattttttgggggattttttcgtggtgatttagtgggtaaaaatggggaaaggttggtcagggaagagaactccgaccccctaatgagtccgaataaagctgaccgagtgaccggttacctccttccgttgaagaattttgagcacatctctgttacttgaaaaatgctacactaccgcacagtctatatccaaatcagctgcagcttcagaaaactccgaaccccctgataagcaatgcaaaacctgtaacttaagcaaaagcattggcaactgtaaaatttctcattttatgtttccatcttctgaacgcgtttgacttcgaatttcagttggatactggaaagccgtaccccgcgtatccttaacatttttaggggaatttttcgcggattaaaacggggaaagatttgggggtcggagaagaaaacaccgaacccaaccccaaaaggagtccgaataaagcggagcagtcaacgccagcggcccgtcatctccttccgctgaaaagtcaaatcagtcttcgcctacgcagactcccgtcgcgctcactgccatgtgggcccaaccgccaacaaaacccggctccgccttccgaggcgagcacggtcgtcgtctacggcgccggcggcagtccagcggcggcgcacggagtcacgatgccggtcgtcgtcgagacgagattgtgcctgcagtcaagatcgcaggcgacagtacaagaagacctaacgcaacgtcttgtggttaaaaaaaaaagcctacaatgctgtttaattagggtttagtccattcagtcatccaccgaaccctgcaaccccaagcgccgccgcttccctccttttttgtcgctgggccggcgggggcacgccggccaaatattttaagcaaaatccggcggccggcgcctcctctcacgcggttatctatccaaagctgaaggtgcgatggccgccgccgccgccgccgcgagctactcatctacttcttggagagtccgacccggcctaaccccatttcgctcccctctccagccacacccgcagggacgactccagcggatagccatcttcgccacccgcatccgcatcgcaacaccctcggcggcgatgcagtcgtcctcaacgcggcacaggttgcgccccctccccccatttcgttactctgataggtctgcttcactgtaaaatgctgtattcctgtccatgctatacatgtctgaaagtctgaaattatcctgagtgcatgtctgaaagtctgaatttatcctgagtgcagagcatttcataggttgcatgtttttctaagtatttattagctactcacccaaaaccctcatgttgttttcaacataagcaggtagaaacctccttgttcaagtaaataactatattcagtactctatatgtcgagatatggataagaggggcagttagggcctgtttagattcatactatcattttaaaccatatcattgtttggtaaaatcaacaaatgtatggcggtgtttactttgttatcaaatattggtcatgtctaaagaatttgacaatatcatatttaatctatattttagcaatgctaaattttggaaaggttgaaaatagctataaagtgaacaagcccttagtatattgttccacggcaataaaagctattgcctgtttattcctttctgctgcctggttggggtaatgcatagatgatatctataaatactctttattcctactatattcaaagaaattggcacacctggtgccggttcgtttccccaaaaaatagtaagctggttaggtgcaacagttagtctgaacttcttcttctttttttaggatcagctactctaaacttttgaagaaccgtattttgttagtttagcagcattcagtttaaccattccgctctcatgagacgtcaagttactcataaaaatcatagagtttttgcatttttctttctgcaccaagaacaccaccctgcgccaccagtacttttcagcacaaaagagattatagtcatttttactattttatccaatgcaacagaactcacactgtttgttccacaggcttgaggcagtgaatcatgaccatgaaacaatacctgaaaggtattactatacatacaaaaaataggcacttttagtcctcaatgaacaggatactaaatttttgcctgtccgatttaggcttgcagtagtcactggtggaaacagagggattggcctagaagtgtgccgccagcttgccctccaaggtgtgacagtcattctgacagcaagagacgagaaaagggggaaagatgctgttgagtccctttgccatgaatctaacctctccaacataatcttccatcaacttgatatcctagatggtaacagtcgtgcctcattggcccgatacatcaacagtagatttggaaagcttgacatcttggtaaaaatacagctgtttccttctctttactacaaagtctaaccaatctgtttctacaagaacgaacatatactgaagatcgcgtgagaaatgcaggtgaacaatgcaggtgttggaggggttgcagtagaccaggatggcctgagagctctcaacattgatcccagggtttgggtatgtagatttatgttagctttttactttctctggattgataatacttattgttttggacaaagctattttcaaactttaaaaactttaactataaataacatctaaaatatttattgtagaaatatggtgaccatatgtatagattggtcttaaaaggtgctccaataaaatcatatatttattgatattatatatatatatatatattataataaaaaatagtggttaaagttgttttttgcataccgtgtctttgttcaaaacaacaagtattatcagccagtaggaagtagcatatttgcatagcttcaaatgcctcccctattttgttctctaatttttcccttggatgatatggccccttacagttgtcagtagttttagtgtcagatatccttgcgttattttggtgcgtagtgttcattgcgaactttgaacactggtgtctattcaattaaaaattctctttttgatgcacaaatgaatagtcagcagcaaccatctcaaccactaaaaaatgtgtttgcaattcagctatccggcaaagcagtcaatctgatccaatcagtaattgtacaaacatacgacgaggcagtaaaatgcctcaacaccaactattatggattgaaatggataacagaagctctcctgccgctactgaaacaatcgccgtcaggagcaagaattgttaacaccacctctcttcggtcagagttgaaggtacaaattctttctattaaaaaaaagggtacttctgtgcttcaactagcttacctaacaacatgatagttcctgtgccaaacttgccacagagaattcccaatgagaagctccgcgacgagctgcgcaacatcgacatctgggacgaagcacggatagaagcgatgctgaacgagttcttgcttgacctgaagaacgaacggcttgaggaggcaggatggccaacaatgctgccggcttacagcatgtccaagaccgtcgtcaacctctacaccaggatcctggccaagaggcacccggagatgcgcatcaactgcgttcaccctggatttgtcaacacggagatcaactggaatacagggatcatccctcctgaagaaggcgcgagaggtgcggtcaaggcagctctgctccctcaggatggaccaaccggttgctactttgatcaaacagagttgggtgaagcttggtagtaaaatatagcattataaaattattaagcatgtttaataatcatccttccatgctagcttagcgatcagagctgtgtaaacatataccactacatgattcatggatgtttcacagactaaatttgttatgcaaggatgcttaataatcaaccacttttgaatcgttttgcatggatgttcagagatgctcagggagtggggaacgttgatgatgtcatttttttagaagggtattcttttactctggatatatacaatctttttaaattagaaacttagcctattaaaacttagccctcaaataatccaatccgaatattcgatcttatagagatttgaactcaagatcttaaaatgctactcagaaaacttcaatcactagtctccgtaccctttcatggtaatgctggcatatgctactcgtcttctcggagataaggggcacacttggccctgccgtgaccaaaatcctatcaaacgtgacacgttgcaatacgtgtccaccctctaagggacgtgtcgcctagccgtcgcacgtacaggtttatatatgttcatcatcagaggcgctaccctacgacgaacaggaaaccaccaatttagcagtgcagtgcgcgatcatgtcgtcgacgcaggagaagcgaggcgagcagatggcgcgcgcgcgggaggcggcgcgcgagatcacgcccgaaggcaccgagcgcgcgcgcgtggtcggcgaggaggaggccggccccgagcaccaccgcgccggcatcctggaggcggcgcagcggggcgcctggtccctcgtgagcgccgtcggccgcacgctcggcgtcgtgagggacaccgccgcccagaccaagcccagcgagtacggcgacgcggcggaagcgaaggacaccaccgtggagaaggcaagggagacgaaggacgcatccaagcagcagaacgaggagctgaaggcgacggacagcgttgcaggcgagcgtggaggcgacgcggcaacaagcggacgcgggcaggtggcagggaaggaggaagactagtacggcccgcccatgtgatccgtcttgggccaagtcggcccagaaacgttgacctaattattagacttggaataagtacactttgggtccctctatttgttgcccagtccgattttcgtcccttgaccgcaaaaccgggtatgacccagcccccaacttaagaaaaccgggtaaacgtggttcctcggcgttttgaaggcagtttggctgacgtggcgcctacatagcttatttgacttggtcttcgtcccatgtggcattgatgtggcgcttacgtggcaattatatctcgggaaaataataaaaaacgtggccccacatgtcagctgcacaaacaaaaatagttttaaaatggtggggcccacatgtcagcctcactcatctcttcttccctctcccttctctctctcttctttcctttcccctctctctctccttcccaggcaggggacggcacgggtgggcggcggagcaggcgagctccggcggcggcggcgggcgtggttggcgctgctccccgaccggagcgccgccggtccgcgtgaaggcaggtccggccgttcgggggggtctggcagctagcgctacggcggcggcgatcggcggcgggagcgctgggcgggaaaatgaacggggcggcggcgggaagagcggcggcacgaagccgaaggggtgctagcctcgtcgtcatcttcttccggcgcatagtcgtggagcggccggcggagcgacgacgacgggcggcgggcggagggcggagtagaggggcggttgacggagcgacgacgggcggcgggcagcgtggcgagagcactgcgagggaggaggcgagctcgtcagggtggtcggcgggaaaa

SEQ ID NO: 67501 - DNA, 8188 bp, Oryza sativa
cccggtcgccgagcgccgcctccctccttgcccggttgccgcgagcggcccctcctctcacccagccgcggcgcgccgcctccctcctcgcccgaccgtcgcgcgccgctccgcccaccgccccctgctgcgccgccgctcaccattctgtaagggagagaggagggatagagagtagagggggctgacatgtgggaccacaggggccccaccttttcttattatttcttgtagctgacatgtaggtcccatgttttttatattttcctgagatcctattgccacgtaagcgccacgtcaatgccacgtgggacgaggaccaagtcaaagggagccacgtaggcgccacgtcatccaaaaccggacacaatccacggttttataagttgagggacccgtcatacccggttttgcgacggagggacgaaaatcggactggccgacaaatagagggacctaatgtgaacttattccattagactttgtgtaggtctaatagcccggaaatgttggcccaaatgttaatggaagaaggtgcaggcttccctgaggaaaaaagtccatatgtatccttcaacttatggttcgtgtctgattttgctcgctcaaccacaaaaggaataagtttatctaagttcccttaacttgtcaatgatccaattttcgtccttcaactgaaaaatcagatacaatgggtccccttaactaccaaaaaccggtacaatataggtcccatggtaatttggatggcggttttcgttaaggtgtagcctacatggctaatttgactagtcttcatacgatatggcaatgacacggcgcttacgtggcaatttgatttggaaaataataaaaaatatcggcccatatgttagttacaccaaaaaataatttaaaaatggtgggctccgtgtgggcctcacatgtcattctcacccctcctcttcttcctcctctctccccaactcacctttcttcgtctctctctctctccaagcccgcattgcagggagatggggatccatgggatgttgcagagcagacgaagcgggggatttgggtttggtttatgctagttttggaacaagaccaacagtcagggggtggccagtgcccggtggtgagcacagtagcgacgccctatggaggaaggcggtggagggagctcatctatcaactccggtggcgagtgcttgtggcggcgctgcctccctcctcaccctgctgccgcgtgccgcccctcctcactcacacctagagagagaacgagtagagtggagaaagaaatgattagaggggagttggggtgagaggaggaagaagaggaggggtgagaatgacatgtggggcctatcatttttaaattatttttttaactaacgtgtggggccacaaattttattatttttcaaatcaaattgccacgtaagcgccacatcatataaagaccgagtcaaattagctacgtacgcaccacgtcaacgaataccgccgtccaaaccgccatcagacctatattgcaccggttttaacagttaagggatccgttgtatctgattttctcgttgaaggatgaaaatcagattcgttgacaagttaagagaactaagatgaacttattccacacaaaaccagacatggaggctctgtcaaatacgtaaatcggcccaatatcatgctgaattgctgagtagcctactcaatatctagcccaacctttttccccctttccgtgatgaattcatatgcgtgcaaaatttatgtgatctctcctgaggcattcgctagctgtcacgattggatcctcgattaccttccatacttgagctatgatttactatatatgctgcacctaggtgtcatggcacctatcatttgcatgtgacttaaatagttatagaaaaaattaaaaaaattagtaacatcgtttgtgatgatacaagtctatacacaaacatgcaagactaaatttgatctacaactagagaaacaaaaataataaaatcagacattcaatagtacccgtacagtgcagataaaatttcttatttttgtttcttcatatatcgatcgaatttagacttgcatgtttgcatagtgacttatattatcatggattatcttatcaaattttatgtattttttatataattatttaaattacaggcatacacctaggtgccatgtcacctaggtgtaaaaaatactttctgttatagtgctggactcgataattttcatagttaagggaggcttataatatgtttttttgcgtttatgggatcaaaatggcctgtagttaaggcaggcataataagtgatgagttcatatacgtgcaactgcaaacttatctgatctctcgcgacattcactagctgtcacaattggatctccgattacctcccatacttgggctatgattttcctacaatgaattaaggtgcaaacgtggaggatgaaactaaaactcgtctagattcatgcagaaacatagataagtgttgcatttgagtcgctggcagaggatgaattccaacccaaatctgctgagatatcaattgccatgatacgtcgggtccagatcctctagagttgggtataactctatcgggtggagttggctaaatctgtgccattcggcatacttcaagggctaggcttaagccacattaatttatacttaaaaaccagtaactgaccatgcaacaaataatcttgtatcaacagcttgtcacgagatcatttttactgtataattagcacaaaaaattcaagattcatctattatttaaaaaaaatcatacacattaatattgatatggttcgctgtttgcatatatgtgaaagcactatgttgatatacactgactgccgctttagagttgatcgactatatctgttgtttggggaataacaaaacgttattctgttacatttttttgggggtgagaacttaatcaaatcgctattattgagcaaacacatgaaaaaattaagtcataaccattaatttaaggagttaatttattaggtgaaaattccttaaaaaaaacttattaggttaaattgacgaggaatgatctcagccgtagaaaacaatggatagcacagatttggccaactccacacggtagagttatactcaactccaggggatccagaccctgatacgtccacgaaatgcattcctctcaaatcccagccggatttggcaccaactaatggcggtgaattggataggttaattcatagatgaaggtaattgattgatacgggctaatatcatcttgccaaaacaaacatgccatccaggcgtgtataacaacacatcaccaccattgcaaagcttcttcatcgatcgccatcgtcttctccagtcctcatgcaggctatggcgtccttactcccaattctgttgctcaccgccttcctatcgtctaaacctgcactctgctacatcaatccaggtgcaacgccgccacagaaaattggcacgaaatcttcaggtggccgtgcaacctacatcgtgttcgtcgagccgccgccgccgcttggccacggcgatggcgaggacgaccactgccggtggcatgaatctttcctgccactgagtgagctcgccggctccgacgacgagccacgcctcgtccactcgtacaccgaggcggtcagcggcttcgccgcgaggctcaccggcggcgagctcgacgcggtgtccaagaagccggggttcgtgcgcgcgatcccggacaggacgctgcagctgatgaccacgcacacgccggagttcctcgggctgaggaaggacgccggattgtggagggactccgggtacgggaagggcgtcatcgtcggcgtcctcgacaccggcatcgactcctcgcacccttccttcgacgaccgcggcgtgccgccgccgccggcgaggtggaagggctcctgcagggacaccgccgcccggtgcaacaacaagctcatcggcgtcaagtcgttcattcccggcgacaatgacaccagcgacggggtggggcacgggacacacaccgcgtcgacggccgccgggaacttcgtcgacggcgccgcggtgaacgggctcggcgtgggcacggtcgccggaatcgcgcctggcgcgcacatcgccatgtacagggtgtgcaccgtggaagggtgcaccgagtcggccttgctgggtggaatcgacgaggccatcaaggatggcgtcgacgtgctctccatctccctcggtagcagctttgctgcggactatgacaaggaccccctcgccatcggcgcgttcagcgcggtgtccaagggtatcgtcgtggtgtgcgccgccggcaacaatggcccggcgttcgcgacgcttagcaacgaagcgccgtggatggtcacggtcgccgccagctcagtcgaccggcggttctcggcccccacgcggctcggcgacggcagggtcatcgacggcgaggcgcttgatcaggcgagcaactcgagcggcaaggcgtaccctctgtcctactccaaggagcaggctggtctctgcgagatcgcggacacgggcgacatcaagggcaagatcgtgctgtgcaagctggaggggagccctccgacggtcgtcgacaacataaagcgcggcggcgccgccggcgtggtgctgatcaacaccgacctcttgggctacaccaccatcctccgggattacggctccgacgtggtgcaggtgaccgttgccgacggagccaggatgatagagtacgcggggtcgagaaatccggtggcgaccatcacgttcaagaacaggacagtgctaggtgttcgtccagctcccaccctcgcggcgttctcgtcgcggggaccgagcttcctcaacgtcggcatcctcaagccggacatcatggcaccaggtctcaacatcctcgccgcgtggccctcgtcggttgctcgcaccgatgccgccgccgcgccgccgtctttcaacgtcatatccggcacgtccatggcgacgccgcatgtgagtggcgtggcggcgcttgtcaagagcgtccaccccgactggtcgccggccgccatcaagtccgccatcttgacgacatccgacgaggtcgacaacaccggcggcccgatcttggacgagcagcacaacaagaccatgttgttcgggcccttcaacaccggcgccggccacgtgaacccgacgagagccgccgacccgggcctcgtctacgacatcggagtcgccgaatacgccggcttcctctgcacgctcgtcggcgagtatgtcctgccgatcatcgtgcgcaactccagcctgcagagctgcagggatctcccccgggtggggcagtcgcacctcaactacccgtcgatcacggtggagctggagaagacgccgttcacggtgaaccggacggtgaccaacgtcgggccggcggagtcgacgtacacggcgaacgtgacgctggccgcggagacgtcgctgaagctgagcgtgtcgccggagacgctggtgttctccaaggccggggagaagaagacgttcgccgtgacggtgagcgggaggttcacgaaggcggcgcaggcggtggcggtgctggaagggagcctgagatgggtgtcgccggagcacgtcgtccggagtccggtggtgctctacatccccgtcgcttccgcaccgccgtcgccgccgatgccggcggttgggactcggcgcggagacaactgggcctgaagttcttcatgggctatgtacatgggtcgtacgctttgctgtgtgaatactaataactgggccgattttttactataatcctaatgggcttttgggttactctcgcacgcagtttcagcccatcagactgtactggaaaggattgagatactctacctgccactttgccttgttaataacgggttggtttggtttgagtcctatattggccttaccaatatttggcaatttcaatagtgtttattgtctatttggtttggagccaaattttggcatgcctaagaaaataggccatttcaacagttaatttaggctattttggtttcaatccaaacacaattttacctttgccaaaattagccatgacaaaagttaccaaaatttaacattgacaaaaattggtaaggccaatttaggccacgaaccaaaccagcccaacatgtgtgggtctagggttcatcgggcttacatattagtgatggaatcagtttacttcgaaggttgaggatcttgatccgtactataataacacattttacttagcttttgcaattgaattcaactgcatctactactagagtaagtactctagttttgctattttgcaagcttcacatcttccttaatataagctcgacagaagggcaggagaaatggaaagaagaacaggacagacagaaagaaaagcttgagctcggcatgaagccatggggatggagatcaggatggcacgagagcaccttgcagcttttatggtgctcttgctagctgaataacggccggtggaaggtgagctacaggaagattcgtccttatagcaataaacaatgtcagcatcggtgcacagaacctaactgttcgctgttaaacgcaaagcagctcttcagttcagttcagttcggttcagctcttcagttcagttcagttcggttaggttcagttgacagcaacaggagcatcacttactaaaccaacacaaaagtagataggacactacctctatccagattcgttgtaacatgtagtatctcatttactcataggttagttttttcttatgggatggagggaatactccgttccttttaaaatacagtgacctaaaatggatggggtaaattttaacccctatttatattcgtagtattaaaacgcgtctcatactattgtatattgttacattttagaacaaagtaaggactccacttggatggttcagactactctacaaagactgcgttgctcgccttcattcaggtaaggagagagagccttctctaatctctacaacgaactgaaccgtgtgagcgagatcaatcttaacgctctgaacattggaaatgcaggacaggaaacgaatcgaatccgatgaaatttcagacgccagtaaaaagggtggaaggtacggtgaaggtaatatcaaaacgtgagaaagaatctgctgcgaattggacagcagtagcagtgaaaggtaagatcacagtagtagtaggaggagcattttcaagaccaacccgtttacccgcgtgcatttccacgtcaggcccgtacgaaagtagaagccgcagttgccacttgccactgcagctagctggaatagcttaccgtacagcattcagctggatcactcaaaaaaaaaaatctgtaaaacatcacaccaactcttcgtttgcactacccgtcccaaaataagtgcagcattagatatctgtatccaacatttgaccatccatcttattaaaaaattttaaaaaaattagtcacacacataaagtattattcatgttttttcatctagtaccaataaaaatactaataaaaaattcaaataagacgagcgatcaaatattggacataaatattgcaaaattgtatttattatgggaaggaggtattactgctacttcacgtttgcgtacgggaaattcgtttgtactccattgtcgagaaaatctcagggctcattagggtcaaccttcatttttatttttgaaaacaatgttaaataaacaaacttaaaaagtaagacatgattgatagttagacttaagagtagaatcaaatgaacaattgtattttttctataaacttgtaaagatgtttgatttaggataaacccaaaataacttattacataaaataagtttcaaaattttagtcaaataaaatcaacaattttggccgtgtttagttcccttcaaacttccaaaaattccatcacatcaaatgttttgacacatgcatagagcattaaatgtgaacgaaaaaaaacaattacatagtttgcatgtaaattgcaagacgaatcttttgagcctaattacgccatgatatgacaatgtgatgctacagtaaatatttgctaatggtggattaattaggcttaataaattcgtctcgcagtttacaggcggaatctgtaatttattttattattaatctatattctaatactttaa

SEQ ID NO: 67502 - DNA, 1428 bp, Oryza sativa
tgagcagggccaggggcatggatagtttacaaacaagtctaccagatgtgtccatggacccgccatcttcctatacaaacgcaccctttgatactcaaaagattcagccacaacttgtgctattaaagaacgttggttacaaacgtttacagctttgcacttaggtcctgtttagatcccaccctcaaatttttcaccatatcacatcaaacatttaaacacctacatgaagtattgaatataggaaaaaaactaattgcgctgattgcgactaatttacgagacgaatctttttaagcctaattgctatatgatttgataatatggtgctacagtaaatatttactaatgactgattaattaggcttaataaattcgtattgtggtttactgatggattctgtaattagtttttttattagttctgaacaccccatgcgacacacatcctatataatacccgatgtgacacgtcaaaactttacacccctaaatctaaacactcccgtaagattactataccaacctgaatctatctctgtttttttttctctttcacagaaggatgctcccatgaattactagctgatgagtatggtactatggtgtgtactcattcaggccattgatgatactaccaagcaaagttatcagccgatttattttttgcttgatgcattactgcattatccctttgtaattttactttgggacaaataaagtagaaaaaggtggacaggggaatagaaaacgagtagtacaaacgttggaacttgaactcttgactgacctatcaccaaccatctcgtggtactagcacaccacttagggctgtttagatacctcgtaaaatttttcactctgtcgcatcgaatgtttagacatatgtatgaagtattaaatatagaaaaaaataattactagattacgtgtaaattacgagatgaatcttttaattctaattgctccatgatctgacaatgtgatgttacattaaacatttgctaatgatagattaattaggcttaataaattcgtctcgcagtttacgggaggattatataatttgtttttgttattagtctatatttaataattcaaatgtgtgtccgtatatccgatacgacactccaaaacttttcacccatatatctaaagacagttttaatctccatccattctccaaacatcgagatctctgacgagtataggccaacaaataattcctccatctcaaaacaaactaatctcatattaaaatataatgtatactagtacatcgaatctgaatatactctatatccagatttattgtattaaaatgtatcgtatcttagtatagagttgttttatttttaaggcggatagagtactctaaccaactcaacagtcaattaccattagaaaccacctgcgacaacactactg

SEQ ID NO: 67503 - DNA, 8001 bp, Oryza sativa
agcttagtgcttcaggtgctgaccaatactgttttctatctgaaaaaagcagcagtttcagggttacaattgatggtttcactgaaatactacaagtgaaatgtatcatcccagcaggaaccaagtttgtactgtattggtcagcagatgaagacactagtcaagttagttgcagtttgattaattgttaatcagacacaaaatttcaatggcaatgaggtaacaacttgctcctccaaatatctgagtagcgccattaccgcggcatggaaatgatgggcgatggaattttagtaacactggtctgcttccaagttgaagcgtctttgactgaaattgctttaaaaaatctttagacccttcaatgttcaaatgcgtagataagggtcatgtccagcgtacagttaaatactaggccacaagcaccactccgacgcaaacactcgatttggtgactaggctagctgatcactgatgacaaaactgaattcagagaaaaaagaaggcagccaacaaagtgcagtgcagtcgaatgcaaattgcaaagctattgcaatattcaaacttcctttctcgagtcaaaatttaagtgatgatgatgcaagccaggacctttttccctttttttcattttcacaaagacaaataatgctgctggttgcatgatatatgagacttgtatatggctgagaaatggtttgcttggcgctttcttgaatttagtacagcaattcaggacagggccttgactttgcagtcctcgtttgatgtgcgagctaggttaggtgagtgatggcataaaaacgacactgaaatgagttcgtttcaggatgtgtttgtttatttggtatgccaagaaatgagttgttgcagggggttgctagtttcaatgcgaggtccttgcagacaaggacgtattacaaggagcatcatcttctagaagaaattgattgactttgagatgatttagcagcataatcagtggaggggtagttagctcaacaagtgtagtagtatgcagaattcagactgacagccgtagtgaccgagcaataaccctgacattagtagcagtagtagtaatttagggtttccttggatgatttttccaagttttaacagtggtaataaagtttaagagaattgagaccatgcgttgacacaagtctttaagatgcatatatagaacattccacttaatttgaacagatctcaacgaggatagatagaattagctttgactcggagaagaaagtttgatgccctagaagtaataaaatcttcagtccatccacaacaactggcagtaaacgaacccaattagtgccactccaagaccagttaaacacactagacatgatgcaaatgaatctttaagtcgtaatgttagtgggttggagaagaacaagaaattaggagacaggaatatatcgaagaacgaaacaggagatgctctgaccaaaataaggggtcacatctcgatcgatcgctataattgtattgttgttgtggtcaagtccgacagtgagacaagatcacaagaagatgagagagctgacaattaatcaaaaccaacaacttagtataagagatcgatcgtggaatggaacatcaggtgcaaaatgcgtgagtaggcaggctgctgtagtagctttttgattagtcgtaatactaaaaggcagcaaattagcttgtctgaccagtgaccacccaagcaagcagatggacaaggatgaacatgatcatcatagattcagagaagccacttaatttgtctagaagctgtatgcatgccgcaatcgttgccggttcctcttcctactattagtcaaattcaatcttggatcttctcttcttaattatacagtattgtaatgatcttctgtatgactgtttcaacatgcaggatttgtaaccaaaaaaagaaaaagagagagagagagagtatagcatgatcttcgttggtaaactaacgttgctagttatcccggggggtaaaagtgaaactgcattactactactgaatcactgatagatgtactaccactagtatactttgtctagattcagcagcactagtataatgaaatactctagtagtaatgggcaaaggaatcggattagacaaacgtgtgtcgtcgcgctttgctgctgtctctgcttcacccaacaacaacgcgcgaatcctgactgcctagctttgtttcctttctgattttatttcatttttctttctgaatcatcatgcgctgtgcatgcatatccatgataatcttcaaggatatttagtaattcctttaaaaaaaggatattagttgtatattgctgttctttttaatctctagagtagctaagattctctggattctcatctgatgtgagctgcttctttttttccctagaccagtgagcgtatgtgcgtgcatgcatgaatcgttcaaaagctcatgcgcgcgcgccgcactgtgctgtgcatgcatcgttctaaaaaacaagaaatttcggccgtagaaggggtcggatatttcatcgccgaacccctaaatctcgtttaaaaaaaaaagacaaaccccgatcatttggatcggtagagtaaaatttcgtccctctccctccttttccctcttcgatttaattttcgagatcccattaagccttgtttagaaaaaaaaaatcctgtctccgaactccctacacttgttgttttcatcttgaaaagaacaaaaaaacagtaattcgtactgattgggcgattggctggtggtagtattatgtattgtattgtaggcttgtagcccaaaagaataattaagggaaatcccaattagttaattaagggtgtaattagcaaacgaccctaattattcccgattgagaccatccatatatccatccacggtggtcgcgagccatggatagatgggtgcgaccaccggctcctcggcgtacattgggcttttctgcggctgctttgatctatatgggccgtcaacatgtggcccactatgatccatccatatgggccgtagtttctctcatgggcttcctcctagataacgcccagtacagcacagcccatctcgaaggtggagccgttgccttgccatctcaccccccccccctcgtcgtctcgtcgccagccgccgccgccgccgtctcgccgccggctgacctcccgctcgatccccatccgtcttccgcaccatcccccccgccccattcctccccatgcgcttgccgctcggtcgcgccatcctctatctaacctagctcctcgcttctcctccctctgctccgatccgcgcgctcccaccacctgcgcctcgcatcctacctcgcctgccgcttcaatccggaccttctccacctgcatcctcctcgtcttcagctccgcccagcgaaacaaccggcgtggtcgcgtccagtcagctcgtctgccttggcccgcagccagcgcctgatgccggcaaggtgttcgacacaactcccctgaggaggtcaatctgttatgttcttggccacacgaccatctgggtcgtcgtctctcattaccaggctctgcgtgctccacaccgtttcctggatcgtttcatcgaggcaggtagcgaggttcagcaccggcgtcgacaatgccaatccaggggctcactgccggttgtctgagcttttccggccagttcgcacagagaccagttgcgttattattgggcgagcgctggagtgtgggaggtggtcaaagtcggttgagctggagctggagggcctccatgtcgagctggatcctttcgtcgtcaacaaggtgctccgtggcttgttggactcggggatggcagttcggttttactggtgggcagagtcacgccctggattttatcataacaattttgccatagcgtacatcataagcttgctgtttgtagatgacaatttcgccctgctttcggagttcctgggaagagtaaggagccagggggtagcatttcatcgctctctctatcgggtacttttggctggctatgcccgagctggcaagtttgattccgtcatagaaacatttgatgagatggtcacatcaggttgtcgtgagttcggtgtcgattacaacaggttcataggtgttatgattaagaactgttgctttgatttggtcgagaagtattacaacatggcacttgcaaaaggattttgtttaactccattcacttactcaaggtggattactgcattgtgtcaatcaaacaggattgagcttgtagaggagcttctgactgacatggataaatttgggtgcttcccagatttttgggcatgtaacatatacgttcactatttgtgtggtcacaataggttatatgatgctttgcaaatggtagagaagatgaccatgaaaggaaccggcccagatgtcgtcacctacacaacagttgttagctgtttatgcgatcacaggaggttctcagaagcagttgggctctgggaagaaatggtgaggaggggacttaaacctgatgttgtagcttgtggtgcattgatatttggtttgtgcaagaatcaaaaggttgatgaggcttttgaattagcatcaaggatgctaactctggatatccaacttaatgtttcgatttataatgccctaataagtggtttctggagagctggcagcatagagaaagcctacaaaactgtgtccttcatgcagagaaatggttgtgaaccagatgttgtgacgtacaatatccttctaaaccattactgtagtataggtatgacagataaagctgaaaatttgatcagaaagatggaaatgagtggggtgaatcctgacaggtacagctataatatactgttaaaagggctatgcaaagctcatcaactggacaaagcatttgctttcgtttctgatcatatggaagttggtgggttctgcgatattgtatcctgcaacatactcatcgatgcattttgcagggcaaaaaaggtaaattctgcactgaacctattcaaggaaatgggttacaagggaattcaagctgatgctgtgacttatgggattctgattaatggtctttttggcataggatactcaaatctagccgaagagctttttgaccagatgctaaacaccaaaattgttcctaatgtaaatgtgtacaatattatgctgcataatttatgtaaggttggtcatttcaaacatgcacagaaaatattttggcagatgactcagaaagaagtatcaccagatacagttacttttaacacactaatatactggcttggaaaaagctcaagagccgttgaggcccttgacctttttaaggaaatgaggacaaaaggggtagaaccagataacttgacatttaggtatataatcagtggtcttctggatgaagggaaagctacgttggcttatgagatatgggagtatatgatggagaatggtatcattctcgatagagatgtttctgaaaggctgataagtgtgcttaagttgaagaacaactaagtttttcgaaaacttgagcttctagatgctttcttgcttgtgttgcctacatggacataccaacaagcttgaaggtccgatctactcttaatggatctaaggctctaagctggtggatggttgaacacagatttcatgaacacctcggcttgatgcatgcagtactttgcaccttctgaaccagaccatggcacacacaccaaggtagcaaagcgacaaggtactattcttttaaaccttctgaaatatggacactatgctacttttctcatgtaaacatcatacatctaactgtgattctcaggcttgtactttagcagatccaaaagaaactatgcaagattgttcaggggacagatctagcggaactagataatcgtggttatagctcatgtaaatcatttatgatcgtaactgaagacatatgacctgatatctcctatatatatgtatcggcaaaaaaactttcttatccccatatattgctacaatagctatgaatgttggttcctggaacttttaatcacgagctaacacttatcgctaggctgtgacatgcaaacccacaaaggcaactttggggacaaacatataaatttttttcatcggtgctatctattgttataatgtctggtttgtccatttgcagattcaatataacataagatgacagctatgtgttttaaccaaatctggactggagaaatcagcaaaagctggcagtaaggcaattggtgacagttcaaccgtatttttatcgggtagcagtatattacttcatgaagcaactggttgtgctgttttttaatggcaacccggaaggtgtcatcgaaatagcatccgaactacattgtggtgttgcggtaatcgatgattttgcctcaagttatatgtcaggtagctaattagcacttgctagtttgtgttataaccttaagctttaattattgaaagatcttgtgcagcctgcatgcttattttgtagtgtttggcattcatgttcatcgtattgctgaagcatgtttttattcatttctctttgtcggtgcagctaaaatggtgtataagacagtggatttggaagatttgctggtggaaggtttactggtatgtggcgttgtcaaggcagttgatgaccatattcccatatgttcaatcaaagcctattcaggtctgttaactttcggcagataaatagtctgtatggtttgcttgttgggattccgatggtcagctaatgaccttttagtatccttgcatttctaacctttttattacttcatttcttgtatctacagggccaaatctttttaagtttttgaataaatttcacaaaactacatatactttgaccaaattatcacaaaactacagatttaaggatatatatcacaaaactacagatttagcaacaaatttatcacaaaactacaggtttaagactaattatcacaaaactacatatttaataataaaattatcacaaaactacatattttgggggttaaattcgttgcactaatattatgtttgagttgaaaatgttcaagttttatgattaattgatattaaacatgtagttttgtgatatctttgttactaaaatctatagttttgagatattttatcttaaatctgtagttccgtgataaaattagtgttaaatctgtagttttgtgatacatcatgttaaatctgtagttttctgataatttgaccaaaatacctgtagttttgtgaaatttactctaagtttttagttcttcagtctaagatttgcgagattcctgagctgcatactgcaaagcctgtatgcaatgcattgagaaggacgattcaggaggttggcggcccatctgataagatgggctaggcctctgcctgtcagggaccagtcctcctatccttaaaaacccccctctcttttttcccgtttcgtatgtagtactgtatacagaggggggctgccacctgccagtccgttttcgtatccagcatgcatttgtgtgggagcagtacaaactgatgaacatcctggcagctttacttatattgatataacagtcatataaaaactgcaacatttcagacaaccagaattgatgtgcatctcacaatgaggattttaatctcaactctgaacactagctcctaattggtcaacaatcactctacaagaacaagaaaagcaagagggcttgaggcagatcatgttgatcggacatttggaaattatcctggctaattgaattgacaagttacaaaaaggaacatctcttggtagcagcattcgtgactgcagaaggtcttctcacccctggagaagaaaatcagtaattcagaattggacagatgatcaattaattcttttgtagataatgatcacttgatcaaatggcatcgaaggatgtgaacaatattgtatcttaagtgccagatgatacttgatagtagttcagttggttggcgatgtagtcatcaatgtgttaatatgc

SEQ ID NO: 67504 - DNA, 13534 bp, Oryza sativa
aggaaccatttcaattctcttaaaggaaaattgaaaacattacaaatccaaacagggtcaggaaaatatggttaacggtgaaaattactgggcaaaagctaaggtaccaccccaggaagatagtattctctgcatcttgcagttacagtgagatatatggcacataaacaatgccagataaatattagcatattgaatacccataggtggttgtgaaacaaagggaacaggcaagaagcaatcgttggattgattcatttctaaaattaccacactctattttctgatatttgtccaatattcaagaaacaagcatgttctaatttgtgatattatcatggaaaaagttatcctactttatttacctttcggttgcttttcatcttgctgcctctttcctcttgggagagaggaggggagattaagcggcaagcatagcagctgctgccacctccagtttccatgctattacatacatgtaattatgctgccagaaaatgagtataatgaagtcacatgtttctgaatattaatcaaaacaatgaagttggatgaatttccctccgctacacagttcactctagggctcaaaacacatctcagtatcagccattttatcagaacccacaagcaacaacttgtctggatacacttcgatgtgcccgaatgcactagtaccaggaggacactccaatgcagcctcaagagtccggtgatgtacgccatgcgagtccacagagtgacctcccttgtggtcgtgcccggcaaagcatgccttaacacatttgtactggcgaacaatagccatcacctcatcgtagttccacatgagagctgcaaaagaagctgagccaggatccattgggagatgactgcataggatgacattttgccggcgtgctgatgcatcctggaggacatcattgagccatgacaactgctctttaccaactccaccattaaacatcacaaaccgccggtcaacgccaaccagaccgtcagggctgttcttgtcagagtttgggttcttttcttccaggaacttcattgcttcggcagtcactggatggtcacggggccagccaagtgcactgaagtcataagcgtccaggacaacaaatctgtactcgggacatggagagaagtcatagtatgcacgatcagaatcggttggcatcttcagcaacgatactagcttgccacgaggaaggttatagaggcaatggttcccaaacatgtggtaagttgggccatcaaaattctcaaactcatcaaggaccttctgcactgcccacaacgatttgtcctttgggcaatatccatcaatgatgtcaccaaagttgattgaaaacttgatgttgtgttgtttgttccatgtgctgacagccctttggaggacgctgatgctatgacggtagtagcgtgggacaccaaggaatgagcgaccatctggaatatcagcgtactggacatcagcaatgacaccgaaggaaaataagggttccctagaagatgcatggattactccatttgtcacagccatcatctctgtgatagaacctggaataggtttattcagaatattgaatcagttataatataagcaccatgccacaataacgaggaaaggatttgagcacggtctaaacaggtgttagaactctacgttgtacttttctactttaatgctactcttgcacattactgaagtcatagtctacactaacaaattcaccaaacaatttggtaaggctctgaatcttgatttccccttaatcagtcataatcccttttagaagtgtttgactagcagattagctccatatcatgatatgggagcgttcaaagtaaaatgaatctctttgtatctatatgtgatttttttttaattgccaaatgattgatattgaaagtctgaatttggattgcggtactaaaaactggcattcaagaaaactaaatttgtggtgattttcaagaacatcgaaagaacaacactgaaatgtagtacgattactaaaataaagaagtttgccgtttgccttgtgtagtattaaaattaatgtattgcaaagatagtgcgtgtttgccttgttgtatcaattttgacctgaagcaattatcagtgtacaaaaaaatgaagaaagtggggaaccctaattattacggagctggataatttgattaattatttgaaatataatcagaacaattgatcacgtgttgcgcaaaatcgaaaaatgataggcataccgaatggaagaagggccttatctacgcggcggtgttccccaacccctgtctccacctcctttctctacacggagagaaatggagagaagaggagatcgagggagatgagattacttgtggagcaagaagaagaggaagaggcggatgacggcggtggtgcacggcggcggcgagggatggaggcggatggcgtggcgtgcgtgatggtgatggctaggatggggatcggcggaagcggcgggcgaggaggcggatgggatggattaggatgctcaacggtgagcgatgatgcggcggaagccggcgccacctcgcaggatggagatcggcggcggcggcggcggcgggcgaggacggagacgggatgatggattggggaagtcgctctgctgccgcctgcggcctgcctatggcctatgggtcatatgcacaggcccatgaggctggaaatttttcatctcggaaaaagttcacctgcagtcctttatcttgtcatcgagtgttaaacccgtccttgaaccggaataccagaatcttgtaaaaccatgtcacatttggttataagacagtatcgctctccagttttggtgacttgacggttgagtcagtgtgggacccatgtagaccccgcatatcaactggcaatcttcttccacctccttcccatctcaacgcaacctccaggtcagccgacaatgagtaggggagaagggtggcagccatcggggacaagctcagcgacgaaggcccccgggtgagtggctcccaacggccgggagtgatcgcgtcatggacctgtgcacgtgtggcggctgggtcccaactgcaactataatgtcgccttcacttgtgcgcgtgagggttggggattctgcctcgtcatgctagtcaagctcctatcccgcatgctcagagccacccccactgagatgcccagaagccaatgtgttcaggtgtggatatatacagccaaaatgtgtatagtatgtggatcggtgttgaagtgaaccaaaccttgtaaggacaaatcctgtcatatcttataacccactaaatcctaaagttcaacatgcaaggatatcttataacccactaaattctaaagttcaacatgcaatctaaagtttaacatgcaaggacttgcatgttgaactttagaatttagtgggttataagatatgataggatttgttatttctttgcaccattctaaaatatcatacaagtatgttgtattatctataattctataaaatcatcatcccacataattcatataatatttgaatatatttcttcactatttttcataggactctatatacctacagagttcatcatcacttagttaatgctattttcttcttctctcattaagccataacgtatcaatttttttaagcccttatatgattaatctatagtccaattttttttcttattttatactctcatcagggcaacactaatgtatatagaaaaactagtccatatagatgggacccatatatatatatatatatatatatatatatatatatatatatgagctttaactattgtaaccttcacaatgtatatatatagcaaataatattaggagagagagaaagtagagacaaataacatattttattctctatggccatcccatatacttatgggtagcatttattatttattcttttctgtggactagttccacaatattgctaggtggctgaataaaatattgtattgcttatggactacttttgcactacattgtggatgcccctaagctatatcatcttaattatttttaacccttagatgattaattaagctacgatcgaaattaccttcctttttttcttctctcgtaaagccacatcaccttacttttacatttggatcatcattatgtatacggtttaaattatcgtaaaccatgttaacttatataaacttatattatctagctatattatatagggcatgttcactttgataccatttcaaccataccatttttttacaaagttaaaaaaaatgtttacatttagtttgttgctaaatttggtcaatacgtaagaaatcctgccaaaattttaacaatattaccgaaacttgataagatttattatagctacgatctaaataggctcatattatttatatttattacggacagtagatattgtacaggacagcgcgcacgcggccatgccgacgagtcacgcgcatatagcggagaaggagaagaagaagcagaagcagctagcatagcaggaccgaatatgaatgacacacacacaccgaccagatcgcaacatatgtcatccttgagacctttaatttgacccaacaagggtaagctaggtataccagctgatctactacgtgtgttgttgcaacagaatggatcaatcgtttcttaattctgcacccacgcgtacgtacatgtgtctgcccttgatatgcccatctacaaccagcagcagttccagattcttttctttttcttaatttttactctctagctagtagccagattgccaaaatactctagaaacaaattaaaagactggaggagaggcttctgcagataccggccatgcacgtttatccccaaccaaaaaaaaatgaagatgagatttgcatattctttccatgcaatcccctcccatttcaccacgtgcctcccttcacggatatataaagcgaaccatcggaatattgtttcctcaggttggttctttactccagcgacacatgcaagcccttttttttttaatatactacgtgttcccttttattatcccatccgaattattataatatattatgcaaatggcgtaatcgtcgtctcttagaccattttttgatttccgaataaatggacaccagattttctaaaccacaaatggtgtgtttggcaaacgaggtaatatgagatgtataagaatgaaaagggacgatgaatgaatgactagaattaaacgaggtgtgaaaaataaataactatgatgcaattaatattatttttaaaagatgtgatattatttttctacccccatttactgaacatacccaaagttcataccatatagtctgagtgctcctcattccagcttctagctccttccgttactttttcttttcttttcgataattcatttcctttcattcagttaaggcagtaggaattgaaggaattgaatgtaggagataaaaaaaaaggaattgaaggtagcctccgatcaaatcccagtaaacccgccccgattaaaatcaacagcctaaattttgaaggctggccagaaataaaaggaaagaaaaatcaataaatatggaaggatccccattgcattccaaactgcaacggataaaggcagtaaaaaaaaacaccatccgatcgaatattcgatcgagagagctatctaccacattccaaccgccttaactttcttacctttaatttacatttaccaaccaggtcagtaataatttcttcctttttttactcactttatccatttcgattttgctcacgtaatcaccggccataccatgacgccgaatattcatcgcacccagccttacttaatcagtggaccccacttcataaatccagaaagaaatatcgcgccaacctgccgaggcccgtcctttccaccgcagccgttcgatctcccgtgccggacacgtgtacgtcccagatcccccgagataaccgtcctcaaccgcaaaaccgccacgggtagaggcgaccaggctccctatttaaactcctcctcccgctacgaactcctcatcaaaatcttgcagcacaccaatccattgaagcaaattaacatttctcttgcaaatttcgatctagctagatcatttgcaaagcttgtttgttgatcgatcgatgatggggccgaacgtgtcgtcggagaagaaggcgttggcggcggcgaagaggagggcgtacgtgacgttcctggccggcgacggcgactactggaagggcgtcgtggggctcgccaaggggctccgccgcgtccgctcggcgtacccgctggtggtcgccgtgctcccggacgtccccggcgagcaccggcggaagctggtcgagcaggggtgcgtggtccgggagattcagccggtgtacccgccggagagccagacgcagttcgccatggcctactacgtgatcaactactcgaagctccgcatctgggagttcgtggagtacgagcggatggtctacctcgacgccgacatacaggtgttcgacaacatcgaccacctgttcgacctcgacaagggcgccttctacgccgtcaaggactgcttctgcgagaagacgtggagccacacgccgcagtacgacatcggctactgccagcagcgccccgacgaggtggcgtggccggagcgcgagctcggccccccgccgccgctctacttcaacgccggcatgttcgtccacgagcccggcctcggcaccgccaaggacctgctcgacgcgctcgtcgtcacgccgcccaccccgttcgccgagcaggacttcctcaacatgttcttccgcgaacagtacaagcccatccccaacgtctacaacctcgttctcgccatgctctggaggcacccggagaacgtcgacctcgaccaggtcaaggtcgtccattactgtgcagcggtaagcattacatgatcgatcatctcgataattcgatgaatcgatcggtgaatgatcgattatctgatcgagcgatggatggcatgatttgattgcagggttcgaagccatggaggttcaccgggaaggaggagaacatgaacagagaagatataaagatgctggtgaagaggtggtgggacatctacaacgacgagagcctcgactacaaggaggaggaggacaacgccgacgaggccagccagccgatgcggacggcgctcgccgaggccggcgccgtcaagtacttcccggcgccctccgccgcgtaggcgcgctcgtcgccggcagtggccgccgtcaagtcttgatagctacaataataattggcgcttattaaggagtgctagctatgattaattaggggacatgatctgcataaacattttagtattgcagatatatcggtcatggtcttacttttgagtgtgtttttttttcttttgtttagtacgagggaacacccaaagtctgtattcagtttgtaaatacgtacgtatatggttggtctaactataaacagatctgcctactatacatgtacgttactgctgatacattttgtagttaataaaggtttttcttctatatacctttgtactagcttctatgatattgtcaatgtctttctcagtgttgttaaaatcacgattctgaactaaaagtttcaagctctaagtacatatagaattgtagaatcaaaaatcttaaataagattgtcaagttataaaattgtactacctccaactcaaaataagtgcagccgtgaatatctgtgcccaacgtttgaccgtccgtcttatttaaaaaattgtgaaaaatttgaaaatatttagtcacacataaagtactattcatgttttatcatctaatagcaataaaaatactaatcataaaaaaatttcaaataaaacgaacagtcaaacgttgaacgtaaatagtgcaaaactgcacttattttggaacggagggaggaagacaatcaatattttgataacttagcgtcctgatctgaacatgtaactacgtacctaggcctgtgttgtagactatatcttttcttttaagatgtgaaaattaaagaatgaaaggtatgatataagaaaaatctaaacaagagatattatgaaaaatgaaagagaagataagagtataaaaaagggaaggaaatcagatacgtcttgatccagaatgaagcggtaatttcggatgttgtcatgtacatgtcgtttggtttggaaagcgatcatcatcaagccgttaattgacatgaatgccaagaatgggttccagagacgatcgatcagcatcagcagcacatgcacaggagagggggtggtttggtcggtgcaccgcccacgcttaggacaattcaattcaattactggctgacggatcatggatcgagtacgctaccttatccgaaacaaaacttgagactactccctccgtcctaaaataagtacacatttacactgttcacgttcaatatttgaccgttcgtcttatttgaaatttttttatgattagtatttttattactcttagatgataaaatatgaataatactttatgtgtgactaaatatttttaaatttttcataaaatttttaaataagacggatagtcaaacgttgggtacggatatttacgactgcacttattttggaaattgggcgcgcaaatgacgatggacgggtgacacatgcactctcctgtctcctgagtcgcaatcgaatttgcacacctgtcggggtacgtggccaacgcccttcatcttcaaccacgtccacgtactacctaccttaattatccacccgtttcttttttctttcttttgctgcttgaattgcaccggtgatccacttaaccaattcaaactgcatcatccgataagtaacaaatagtacggttagtaaagtagtctctccgttatatattgatcatcacattatccaaaaatagaaatttctaaagttattattaatattaccttgggcagtgtttaggttccttcgaacttctaaaaattccgtcacatcaaatatttggacacatgcatggaacattaaatgttgacgaaaaaaaccaatggcacagtttgcatgtaagttgcgtgacgaatcttttaagcctaattacgctatgatttgacaatgtgatgctacagtaaacatttgctaatgatggattaattaggcttaataaattcgtctcgtagcttacatgcggaatctgtaatttgttttgttattaatatgtaatttgttttgttacttcaaatacgtgtccgtatacttagaaaaattttggcacgtgaactatggccttggtccttttgtttgacacatgtaatcttattgtaatttgtatctatgttgcatgcgaacatttaatgtaagtgttgtagagggagttcaagtcagtatgtctctttttatgttttttcatcacatacttacattaaatgaagcacagagtagtttgctttttttaaaaaaaaatatatgatgcacaatataaaacggagggagcaagtagtagcccccttgtcatagtgccaggttcaaagtaagcatcgcctggctgcctgaggattaattcgtgaggcaattcgaagggcgctgaacgaaaaccataaggaaacagatcaaatcaaaacagagtttgagagtaggcgatgcatgcatgtcaacactgtcttgctccctcctaaccatggcacgtaccttcattcgtcgcctcaccatcgccctcaccgctcgggcgacgacaaatcaggtactccctcagtcataaaattagactctaacatagtttctgatatactattttgaccaacaaaatctatataaaagtaagatattttaaataaaagagttatatattatgatagtttatttaataataaatctagtgacatcaattttacgtgattgatttttttatttttttattaatagttaaagttgaaaatatttgacttatcactgcgctaaaaatacttatatttattttggaatggaaggagcactccatccaccgtctatccatccatctatgtgtaatgtgtttcctgcctagcttgactacggctcagctcagcttggatgagcacgtagaaatgagtcatatacgtagtatatatgtgtgcattgagtcacctgggacagcgaccgccgcgcgctgcaggctgccatcgtcttgccgttaacttcagtactcacatcaggaaagggagacccggccattttggctaaccggccattaattagtcaatttttttctagagtacaaggggcagacggccttgtctgccgacggttttctaaaattgtcacacgaatccccagtcttcttcttgtttcgttactgttacatgtcatgacttcttaggtcgcaatcacctgtgaatggtacagtaattgtcaatactataacaggataaactcggacccgttaaacatacggaaaacatgtgcaacgcaacgcgggaaccgtaaaaactgggacacttcatctttcatgtcaaccggtctggagatttcatatgcttctgcagtttagcatgatttcaggataaattcagacccgtacaggaattatgtacagtgcaacacagaaaccataaaactgaacagctcattcttcatgtcaactgggaggtttcatgtggaagtagcagtttagcatgcctgttcattatctcaggatttggcagcgatgttgagcccatatatatccttttaatcatttaccatgcatgcggtcttctgcaccgtggttgcttcaggttgcagtttcagcttcccagaggagtgcaggtaaaatgggcatcactagctaactattactacacaacattatgcaacgtgagcagcagagctttagttacattcaacactgcatttccagccactacatgcagttcttctactacaacaaaacaactcaggacacatcctgaattacccaacttttattgctaacacaataatgcaatcgttataacttacttagaggcttcacctatttgcatacaccactttaggtacagtttttaactttagtccacagctgccaaacacaattgtacagggaaaaacccaattatctgcagtccatcaaaatgagcgtctaacctcgtcacaggcacacatgaccattttgttactcccgtggcctagcaagccacagcgaactcaaagcacgcaagcgtgaaaagtaatcgtgtatggcaagaagagcacgcgaggcttgccggatcgtcagaattcgttgcatttgatgcaatgtctgctgtcgcaggttgtccgcctgacaaaaatgaaaccaaaagaatagtcaaaatctaagctttaatcactgcaaaggcgacatctgacacgaatcaccagttaataaatccatgttgtcaggcagaagaacgatgacacttagaaggtgaagatacttgcctggcaaaggaaattctcgagcgttcctagtttacccatggccattgccatctgacccatgtagttcgccacattcccagaagaccctgatgaaccgagagatccagccaaagtatctgccagagattgctgcagtgcttccataccttgtgaaagtgcatcctccgcctgctgagaagattcctggaggttgtttaatcccagcaactgctgctcggttaaaggttcgaggtgatttgctaggagctgaaattttgtaccatatggtgaaatcagtataaattacaggaccagaaaggggcatcagacaaataagaaaatattgagatttaatctgcggtcacctttagaagctcagatggacggaaaccaccaagccacaggaagcatctttctgcgggtgtcttccacatgcctgaaagtatatgaaacacatcggcctttgcagctacacccttaaccttgaatacctcgtcataatgcgccattatgccatcaacaataagacgaaggtcactgtcacttgcatgagcattcactgctgtcctcaactcatttatctgcttattttgctcctcgagccatctagtgtattctaagtcaaaagtcaatgcccctgcaaaacacaagcttaatgttttagaaagcatgcagcaaacagttaatataaactgttaaaaagataaaacaatgtaagtacacaagacacaaaatgttaatgggtaccaagcgatgaaaatatgacaaattaccatttccactcatggcatgggtctggtctccagagctagagatgaagattccctgcaattgaatatccaagaattctctgaggacagaaggtagtatttttcaaaactattttttgatgatccagcatgcaaccataaagattttacctgctgacgagctttctgaagttcctgctctagctgtgcaagcttcagcttactgctctctagttgttgcacatatgccttaaatgttcaaagagaaaatacatgtcatggtggatcaaaactaactatcactaaaaactgcaattaaacaattaaacttgattcatatttgacttaagcccttgccatcccatataaaagagataacaactgcgacaattcaaattagatagacctagtttgcacaggtaagttcacagaattaatcctatgcttttccaaacaaggcttttttattcagagcaaaagcgaacataagagcaaatctgcagtagtacctttttcctcagccgactttttcttgctgcctcacgattttgagcaagccgccgaattgtctattgcatgccaaaatacaatatgaaattaatcacacaagattaagtgacattgtatacgaaaagaaacggaactaaaatgtcaccttttggtccataagtttgtcagatctgtcagatctatctgaagagttagaagccatgactgcaccactatgtccgttttctaactgcaagtttgagcaactgagcatatttagagcactatttggcagtggattcatagtatcaatatgttatcagggtgctacagcaaaacatgacattgcgaatcagtaaataaaatagattaaaagtatgagtgcttcagtgtcagtagatgaaacagcacaagaattgcaaggtttaaacggtcaattacatttgattcttcttactactgtcatagtcagtggtatctccattctccagaagactattggttgagtatctctcaattatccaactcatagcaagtagaaaacgagaaaagaagttactaccctaacagcaccagctctattcttgagctctagcagtcaatttgatggcatcttaacgtgtaaaggaaagatgacaacctcaaaaaggattacctggtggtttttgtcgtcgttgtctacaacaatcgatgtgtcagtccttgaactagcatctgccattactgggcctcaacaggccacaatcaacaggagacagcaaatcactttgctctctcctttctgccagaaaggttgcaagcacagccctatgaaccgccagattgatcgatggctgaaatctacagatcattttttttttaaaaaaaagaagggaaatctttgacgacttagtag

SEQ ID NO: 67505 - DNA, 8070 bp, Oryza sativa
caatagcgggcgcacactagcataagagaatttggtggtaatactaatacccggcctgatacatactacttgataatcgaaaccaactcaaaaacgaaggggagcgagagcatgcatacagtgaacgatcgtcggtggcggttgggggaaatctcggcaaggcaccggcggcgcacgaccatgatcagccctctgccctccctcgccgccggggaaacggcacagactcactcaaggtggggggaaaacaaaaaaatccaatcaacgcccacgttactcctccttccgtgaggccgtcggagctggcgggggcgagggacctccgggagctaggggctctgcggcggcggcgtcgccgtggtggatttgggaggaggaggaggagcggaaggggtttgggggggaggaagcttcgagaaggtctcgtggtggtgggagagtggaggaggtggagagagggaaggcgccaaagtggggggagggcggggtggactcggtgcatggggtggggtgaggatgacaggtgggcccagcaacagttggctcgtcgcgtgacgcaactttgtggataggcaggcggcgctggtggggcccgccgcttagcctccgctcaccaactcctcctcctcttgctaatctccgtctttgacttgcccacttcaactcaagggaaaacgccgggacaccaaaggaggaacgcctggtgagcaagccgtcgccggcggccggcggcgcagacagaggaggaggaggcgacggcgacatggtgcaaatcatctcacaaaaatatggtgtatttacatataattagtaagtgagagttcaacgaatagcacaaatgggggtgtagctcatatggtagagcgctcgcttcgcatgcgagaggcacggggttcgattccccgcacctccacttcctttttttaagttagcatgtcttgtcagaaattcagaatgaaactgataaaatcacaaagtttttttttcaatgatcaaagcatgtttgatcagaaaattcagaatgaaactttggtcatgagacccaatactggatcagtactcccgcgagttcctcccaggtatctcttctattcgggctgacaaaatggtaacctccgtatagaatttcagcgtttcccaataatcaaagcactttttttttgtaaataaaatgatcaaagcatgtttgatcagaaattcagaatgaaatttaggccatgagcctggatcagtcccacaagttcctcccaggtatttcccttgtattcaaactaataaaagtgatatatcctccatataaaatttcaagagaactgctagtacatgacagcagcatgagaacgacaaaacttaactctgaatttctggtaccgatattccgtacaaaatcatcgtggaaaatcctatcattctatactaagcatgcttttggtttggcctgaaaaacgaacacgtagaaaaggctctgacgttgcattggtgatcatggagatgtctagtaagttgggatggaagaatcggctttaacggcataagcgtgaatcccacccgcaacattgtaaacttttctgaacccctgcaaaacaatggaacttcatgtgaggatgccgttccactactcagttgctctgcattgcacatccaccatagagtgcgactacactttgcaagaactatgcgagtacttcaattacctgtgattgcagccatttagctacctgcattgagcgcataccatggtggcactgggggcaaatatgaaaggacaagtgttagaatgaataataataacacattgatgcaaatgtgtgtaccaatgatgtgtgcatattacttccttccgcaatcaccggatcaactcaaaatcacaatatgtaggaggtactggtgctctctttttcatttgacaggtacttggcctttatggatgcacactggcagcaagtttcattagaggagtaaccaacttaccagaacataagtgtccttctgaggatcaaattcatctgtcataactggtccccaagttccaaactgtcgaagaggtagaactttaaacccttcaagagaagctttatctctgccatgcaagaagtaaaactcaacataagcttcatgcgaataggcgaacaataacagtaactgtactgaactaggtaaccacaacatcatggatatggagataaatacttcatgtttgatcatcttaacagtttttctttactcctgataatgtgtattttgaaaaccacaacgaagatgtcgtaacagttattcactggaatatagtttagaaaagtacaaaatgtcaaaatgaagctcattttctgtgtgaggatggcaatataaggacagctcttaaaagaaatggacaggtcctagtagtactattttggttaaacatgtctatcatttcactgatgcgtaattatgagtattattctagcaatcaggacacaggtaaatcttacacttcatcaggctcccgaacatcaatcaactgagcttcttcaagaaagttaggatcttgcatttttgcatgaagctcctctggtggaatgtcttccactacgcattgttctctgaagttaggtggaaaagaaatcaataaatattgtttgtatacatagaacataattttgttacaagtatctacctctcagcaagcacttgcaacaaatgccatccaaattttgtcttacaccgtacaaccttgttcaaaggagcaccgaaagctgcttcctcaaattctggaacctgctcagttcaagtaaaaatgttcaaactccattgaagacattgttaatgccttcacggtgcttacagaaaagagaaaaggaaaaaaaaacacacacaaaattggtggagcttcacacatcaagctagcaagtgattgtcacacttgaatttaatggttgtgagaagagagctagcatagagtagaataaggggcagatggatttaggtgtgtatgtcataaaggcctgaaattaattagataaagtacatacatcagtatcaatgcgcttaataagaaaagacaaaacttgtggcatgaattcacagcagttagtttccaaggcaagcaaccaagtaccaataccaaaacaattaattctacatttttctagttcgccaattggtgaggttgggaactcctaacaaattggaaccatcataaagaagtaagttgaccaacgaaagtcaagccaaattttagtggtaaagtaaaaatttatactgccaagcataaggtttccaactgcatcttgtatggagtatggaccttatcagcaccaccaagcatagtcagagaaactggatggttccatagtacattttaggcatgtgattagctcatttgtagttttgatcagccctttgatcaattaacaatatgtaaagtcctagatgaaaagtcgctactaccatgccagaaaagcatgtaaatggagtaccatctgtcctcttcgaacccaccccagcattccaccattttctttcgatgggcataaagagtactcgacagctaaatcgctcaagtctgcacctgaaacacacacaaaaaagctagatgctgagcaatatccttttaattagtctccatgtttatgtgaaagtgtatatcagcatccacatgaatactagtactagtacctcctgtaatgatgttcttttcaagatcgaccaaaagcctgacatcctgttcgccgacgagcagatgctggacaagcaactccttgccctccctgggagcagtagcagccgcagagcagaaaactaacaaacaggtgttcatgtcaattacttgatgaaaccatgtggcaccatgcaagaagcacacaaatgcaaacaacactagtactaactagtaaccggatagtatagtaggaaataaaatgaagcaaaacctagtattgatacggatggcacatgcgagaatagctagatatctggtggacatacgatacatatacagcagcagagtagaggtaaatgagtagcacgaggactcacccctggtggttggcctggacctggagagggcgccggagacgggacgcatgggagggtccctatccctcctgacggcggaagcggaggagaaggagaaggagggcggcagaggcgagagggccgcggaggcgaggagcgggaggcggcgcgcgaagccggaaaacgagggcgtgggggtgggagcgacggcggcggaagcgtacgggagctgcgccgccctggctcccctcagaccaagcatggccgcgcgagggcgaggctccgatggcggtgggcgctgctgcaggagaggagaggagaggagggaggaggaagaaggattggaagacgagtgaagccaagagaaagatcccctcacctccgcatcattcgttcgttcgtcaacaaggccggagtcgctgtatgggctcacttcaacttgggcctgacatgtcatccgacggcccattttacttactattgggccttcctgtcctccttccacctgcttccctaccaagaatgaggcccgcttagaatgcggccaccatttccgttactcgaacaaatcaccgaacttctccctctaaaaaaattcagcaaaccagcatcaccgaacatatggtgatccggaccctacctttaatcgtgcatcggtctcttatcactggtaatactagtattcgtacagtactggtaatatatattgcgaggaattaattgaaagcccatatatgaacaatgagattctctctcatcgttctgccttttactggcggtagctacgtgaaagggatagacattgactgtagtactagtatctatatgtatcttgactgcaaacagcagctattagtacgtataccggtctagaatgtaccataaaagtactcaagctatatggtcaataatcactcaattggactagtatctgatcctggatatgcgtttgcttaattagtcaattatgaatcgacaatgcatgcatctggattcctgattgcttttgtcctcgatcagcaatcgatcgattgatctagtctaggcatgcattaggcacataagtatgatctgcatctgcatgctagctacctgggaattttatcgatcaccaaaaactatatatcctgatcagtcgcacgcgcgtgcgcacggatgttgaaatgtacgagcgccttgggtccgtgtgaatgagacaatttatcgatcgatctcaaggaatataattaatcgatcggcaggtcaaactcaaaacgaatggatgattttctagctctgaatttctcaagtctttaaaaaatagtagcaggctagcacacccaccttcttcaattcgtcgtcgagcggttgcgatgccatcgtcgatgacggtcatcactgacgatcaatgctgcgctggatgattttgctttcaaagaatccaaatataatatatatactcgaaaacgacttcattttttgactgaagagaataacttgtgtttacctgctagccaattggctagagactgactggagagagcgaatagccgtgagacagctagctagctagcaatctggttttaccgttcatctttttacctagataacttcttgtttgtagatagatgaaacacatcctatgaatctggactttgaatgggttatctcagttaattccaacctatcctttgggtaagagtacttgactgggtgacctccctctaactcgaaccaacaagtctcttgtcttgtcttccttccttccatgcgtgaatttttctatggttaaaattaataactacagtagctagctggtacaaatctccaactaaattttataggcaggattttttcaaggtagcatagcatactagctcagattctgaacttaactacaaatgtgtgataaggataaaagatttatacatactgcatgttggaatttgaagtccattaatgtagatattggcttaactttggatgaaagtttacacataggattgaataagatttctccttttgttgttcgaacttactctctcatcatctttggtcattacgttcaaaattttgtaataagtggtttctatcttaattgaagaaaatgccagttcttttttttttaaaaaaaaggccagaatattcatcatataaaaaaaaacttaactggcacaataatatctactcctgtctctcaccccagccgcccaatgaaaatgctctgatccaattctcccaaaatttccactgtttcgtctgttactgcagaaaattaccactgtttcgtctgttactgcaggatatcgttccgaaacagggctactgtttctataaaggcacgcacattgcacgtacggctgcacaccacgctcacaaaaagctctagataacatgctcggggtgcagcagcatggccggcagcggcacggcatctcgaagccaccgccggcgaagaaggggaaggcggcggcgaggaagtacaagccgccgcaatgccctggcgccgtgagggtggtgtacatagccagccccatgaagctgacggcgagccccgaggagttccgcgccgtcgtgcaggagctcaccggccgccactccaacatcgccgaccgtcactacgttgactccaccattgatctcccgccgccgccgccgccgcctccagcatactgtgccagttatgctgcgtcggccacggcggcggcgcctcccgtcgcagctgtaccaccgccggtgctgactccgccgttgccgccgcaaacatttcagtcgtatgatcacggcggacaagggcaccgctggtagacaacactattactcctaattagtagatgaataataatgtatatatatggaggttaaattatattattatctaggaaatcaattgaattcactcatagtgaaataattaagttttgtctagttgaaactgcagggctgtaaaattattgtatatgaaggtttgcaaattattatattagtattattttttcggtcaggccggtgtgaagaaaagccccaaccaattttatgaaaaaaaacacttatgagaggtttttaaattatcaattagaattcaaattatattatccatttccactctattttattagctggttttgtatgagaaaccaacatccaccttttcatttattcttatgcttatttgtaccgcttatattagtaaaactagcatgtggctagcatcattatattctttctcatataatagcatatatgttttctcattatattattaaaatatattacaatgacaacataattttaaattttgcaataactttaagaaactactaatgtgtaatattcatattgtattttatatacgtgttagttattaattatttttaatatcaaattttagttatttgtaaattatatatattcctatatggactctagactcgtcttttaatatttctttttttaattctgaatttttattatttctaattgtacttgtatgtggactctaaacttatctttcaatattctttaatttttaatttcaaatttctattacttctaaattgtattcctatattgactttaaactcttcttctcgtgtttttcttaatttcgaattttagttatttgtaaattgtatttttatacggactctaaacactatttttcattttattatgtttattctgaattttagttagttttaaattcttatatggactctatactctacttctaatattccttattttttaattctgaatttctattttttttcttaattgtatttctatatggactctatactctacttctaatattcgttatttttaattccgaatttttattatttcttaattgtatttctatatggattctatactctacttctaatatttcttatttttaattctaaatttcagtaatttcctaattgtatttctatatggactctagtctcctcttctaatattccttattttttacttccgaacttcaactatccctaaattgtatttctatgtggactctagtcgcctcttctaatattccttattttgtaattccgaatttcagctatttctaaattgtatttctat

SEQ ID NO: 67506 - DNA, 6712 bp, Oryza sativa
ttcagctatttctaaattgtatttctatataaactcatatttcaatattctttaatttttaatttcaaatttcagttacttctaaattgtattcctatattgactttaaactcttcttcccatgtttttcttaattttgaattttagttacttgtaaattgtatttttatacagactctaaactctacttttaattttattacatttattccaaattttagttagttttaaattcctatatgtactctatactctgcttctaatattccttattttttaattccgaatttctattatttcctaatggtatttatatatggattctagctcctcttctaatattccttattttttaattccgaatttcagttatttcctaattgtatttctatatgggctctagtctcctcttctaatatttcttattttttaattccgaattttaactatttctaaattgcatttctatatgaactctagtcttctcttctaatattccttattttttaattctgaatttcaactatttctaaattgtatttttatatggactctgcgttttcttttcttccgattaatgtgagaatttctaggtcatgggagagaacgtggaggctcctttttattccgaattttagttagttttaaattcctatatggactctatactctacttctaatattccttactttttaattccgaatttctattttttcttaattgtatttctatatggactctagtctcctcttctaatattccttattttttaattccaaatttcagctattactaaattgtatttctatatggactctgctttttctttttctccgattaatgtgagaatttctagaccatgagagcgaacgtggaggctcctttttttaattccaaatttcagctattactaaattgtatttctatgtggactttgctttttctttttctccgattaatgtgagaatttctagaccatgagagcgaacgtggaagctcctttttttattcctttaataatataatagataataatttataggtaaaattttatatgtgttcttagtgataaaaacaaatattattaaattaaccacgattaaaaaacataaaatcagtttaagttttaaaatgtaaatcttgacttataaagaccaacaagcttcctcaagcccaaactgcagagccacattttcggcccaacagatatttgggcccataagtgaaaaaatgggcttaggcccattcctctcctcctcttccgcgtgtgtgtatataatcttggtaaggtggtgcggcgccggtggccggagatgggcaacgcgagcggcaggctggacgacatcgccgacgccgaaatggatgacggcggcggaggcggcaaccgcgccggcgctggggactactcctcctcgctgcgccccatggaccgtgctggcctcccgccgtacggcggcgccgggggaagcggcggactggtgcggcccccgtcgtcggcagcggggtactccggcggcggagggtcgtcgtccccgccggggacccccccgcggccgcactccccgcgcatgttcgtgccgcaggtcagatcacgctaaactcaattcgatctcgatttcaattccacccatccatgtgcaatatacatcctcttgatcgatcagtgcatgtgacgcgcgtcgcacttgtaatgtgcatgccacaatttcatcggcgttgcattttggggactcctcgctgattctatgatttattttggttgctaacaatttgttttttttaaaaaaacatgatctgaaatatatgttctttagaaagttcataatatgaaatatattcgttacaactttgacaattaaaattgtagaataatgtactgttgttttatcagatttatctagaataatactccctcctttttcctttttagtatatgatgttgttgactgtttgagatacatttaaccattcgtcttataaaaaattaatataattatcatttattatgttgtgacttgatttatcagttccttagacatgattttttatatatatttgaaaaaaataagacgtctcatgtattaaacagaggtagtacaggcatacaactttgctcagttgctctactagcgaacatgtttaatcttacggtcgcttcagatgatctaattaccttgtttcttgccaagtcagtctacctcttcccaaatgtcattgttctaagttttgtgtttttaatgcactgatataaatgtactgcagagtcctgtaactccattgcatagagctgtagatggacctcctccagtatttaaccagatattaacgagtgaacaagaggaggatcacgatggtccccctgacaagctgattcctactctgcttgtgtggactcttggagggaagaatgtctatatagaaggatcatgggataactggaaatcaaagtacatttttattttttggagagatagcatatagtatttcccttttgtttctagtacctaaactgaagcttaaggatagaactgattttgttctgacattgttagtgtgtatcacaggcaactcgtccataaatgtggaaaggatcactgcgtcatgttagggcttgcatctggagtttaccgttatagattcattgttgatggagaaagaagatttcagcctgatcgtccccgtgaagctgacattatgggcaccatttcaaatcttattgatgttcatgtgagtatttttttttcattcaacttttttccccgttgcacgtacgattgtttgtgcgaacttgatcagcaaaacttactcttgaccatgattatttaaacccaagaaaatgtgctagggagattcccactcaagtacttgatgatgattaagaaagggaccaagctcagatatctgaaaattatatttctcgcctagtaagaatcaattgaatgatgcaaataatcgttgcactagtataaccaattgtccccttgtttcgttataatcaataaaattatgttcttcattgtgtcttgcaagagtctaacttggaggcacatatatatgagagaaacaattctaatgtaattaggattagactacaactcaaagcaccaaagaaggagcacaaagcctgggcattgcacagatcattcccacacatcatgatttatctgctagcatttgaaacacacactacgaatgcatcacctatctctgcttcttgaaaattcagtgtttgcgtattgcctgaatgtataactggtgtgcatatgcttgcaggattatgtcccggatagcgtggacagtgtgtcagagctgatggctcctccatcgccggactccagctacggtttcctggctcctgacgacaaggagttcaccaaggagcctcccgctctgccgccgcagctccacctgggcgtgctcaactcgcgaggaggctccggcgggaaggagggagagtgcgccatgcccaagcacaacgtcctcggccatgtcttcatcggcaagggcaccccacccatggtcgctgccctcggcaccaccttcaggttccagtccaagtttgtcaccaaagtcctctacaaggccatccaaagagaggacagatagctttattagctggcaatgctagaacaaattagtcatgcattctgttcattcattgttttggaatagtaataataatggtaatcttgagggcgtggaccgtgatgatttcatcagtgttaggaacaaaaacagacccattgatgtgcttttcagtcaccaatttgtttgctgacgccatattaaggatctaccagaagaataaagatggtgatcgatactctttcatacatttttgtgtgtgtgtgtgtcagggttggtcagttttgtagttgtgttcgtttgctcacatctcttatcttgttgcgttccaagatttgttatccctttgttatatttcggtttctctaatatgtatattttgtagggagaaagaggatttctaatcaaagggcataccaatcccttttcagtttgtcatgatacgatgatatcagaaagcttaaattgagcccacataaaggcgatgggcccaaagcccagtacgagcatccaaccaggaaaaaggcccaagttgtagtaacacgtttcatatggcccacaaggccataacacgaaagcttggaaagtcgggggactttactgataaaatgcactccgcgtccaaaccgcgtcgagggtacatacgtcattctgctcatttaaaaatgtcaagaaagcatccatcatcggaaaattccaccgttttacaggcccacatgccgtaaagtcacagaggcttgtccttgacggaacattcaagattacacaaatgccctcacacacatgctgtactttgacgtttgggatgagttttacgtaaattctgaaagaataaaactgtttttatgtgaaaatcctgtagaatttgcttttgtgcatacatagagaatcaatggaacatgtacaatagtacttcctctattttaaataaaaagatagttgctctctccgtctcattttaaggctctgttcgtttgggcaggtttccaacttctattcctcgttttccgcgcacacgtttttcaaactgctaaacgatgcgttttttgcaaaaagtttctatacgaaagttgcttaaaaatcaaattaatctatttttgaaaaaaagcaaatacttaattaatcacacactaatggattgctccgttttccgtgcaggggagttgggttccgaactgcctgaaacgaacagagcctaagtgcagacatgatttttcgtgcccaacttgatcatctgtctcatttgaaaaaataaagaatttaaaaacataagtcacgggtaaagtactattcatattttatcatctcataacaacaaaaaatactaattataaaaaattttcaaataagacggacggttaaaattagacgcgaaaactcatggttacacttaaaatgggacagaggaagtatatttttaagcgaaaggactgagggaatagctaggtagaatcccgccaatccagggactgatttttttttatcctaccaattgagggattggctcaaagcaaactcatgccaccacaaatataggatgatttggacattgacaagctaaagaaaatgcaactttaccaaataagtaagtaaattttactttggaccattttatcttcttatatactatatattttagatcatttcaactctcttctgaaacatatgagagcgattttgagtatgtcggttccttaataaactatcatgattatatgttttttgacatatgacaatttaggtgtagatggataaaagagttcggggtggtttaaagtgtaaaaaaatgttaataaaaatatgatcctgtaataaaatgaaactattttcatgtctatgttttgaaaaacattatacccattactaatgaggaggggtagtttgggaaaagcaggtggtcgaaggtaaagcggaggtgacggaagacgcggtataaatcgggggtgggaaacttccaccggacgccacgccacacaagtctctcctcctcccatctccgcttcccttcttcttcttcttcgttgatccactcacccgccgcgcgcagaggaggccatggcggatcagctcaccgacgaccagatcgccgagttcaaggaggccttcagcctcttcgacaaggacggcgatggtaacaacaacaaccaccaccaccaccttgttctctctttctccatctctatctgttcgttggatcgatctctctcgtttgcacacgctggccgtctcgcgcctgtggcattgcctccaccgcgcgggtgcccttccttcctcgcgtcgtcgggtggcagatccgatccgggcacggatctggacggaaaccggtcgctgtcatcgtcctgtgtgtccagtggcgaattgtccgacatggacgcaacgcttatctgctgtgctgacttgaccatttcctgactgcgccacctccctcgacttcactatcgcaatcgtgtctcgctgcctgtttggttcgggaacacttactctacatcataataacttttcaacttatattaggccctgtttgattcagctagtttgcttagttactccctcatttttctttttcgtgcaaaaacttcggatatataattttctttttaaaaaattaattttcaagtttacagtagttaattaatcatgccgttaataagctcagcaaagaataatatactttcattacaatgatttttatgtacgaaaaggtttattacatagtcgaaaacagagaggagtgtatgtgttggatgtagcttagctatcaactgctccctttcgcatgcaactttggtcattttcttaggttagtgcatttggtagcttcaacctttttatggtgggctgtagttgtatcaataacttgatcgctactgaaagctgttcagtttaggtaattggattcctagcccttggaataccttctccgttagaaatttgtccacagggaaatcctgtataaatttcatgggggcacgttgaaaaaattatacagcaagtacatgcaaataattttgtggtttaccttggaccttgttaaagaccataaccctgcaattaccttggtggaaattgtcttcgactggtttctcgttaacctggtaatattttagctcactgattcactaagta

SEQ ID NO: 67507 - DNA, 3961 bp, Oryza sativa
caattagacgcatgttgacattattattagttattaggaagtgtagtgtgtgcctagtttttctgttagtatctagttataatgactacactgttcagcaattgattgtacaattggttgcttgtgaactttacaggttgcatcacaaccaaggagttgggaactgtcatgcgttcactagggcagaacccaacggaagctgagctccaggacatgatcaacgaggttgatgctgatggcaatggaaccattgattttcctgagtttctcaatctgatggctcgcaagatgaaggacactgattcagaggaagaactcaaggaggccttccgggtgtttgacaaggaccaaaatggcttcatctccgctgctgagctccgccatgtgatgacaaatcttggcgagaagctaactgacgaggaggtggatgagatgatccgtgaggctgatgttgatggtgatggtcagataaactatgaggagtttgtgaaggtcatgatggccaagtgagccatggaaccatactctaaggcagaggagattgtgtgttgcatagtcctagttaagatgcaacacttgttttatcaatttccagtgaagcatcctactagctgtagtcgctaaaaaggattttcctgctatgttcctctgaagtgtgttttcagatctcttgtgttttatgtgaaccagtaattcttgtccttggtatgtccagattgcagttgggcctgtatgtagttatatattttttcatcaatttatgctcgagtctagtatcaattggatatctggtattttttttattccattggtctcttcttcgatctacatatgttccttctgcttgtatgcagaagaatttgttcaattgcagagaaggatcttttggggtttgaattggatttgaattgagcaaatgggaaaggcaggcatgcctttcaaagagggttgcctggcaggttgcaacaactactagtaattataagtgttgaatgatagactgatagctgcgtgcagcctctgagagtatggcagtaggtagcaactaccacatgctcctggccttcttaaggcctttttctgaatgtattctgtgcttgtaagagtcatacacgattgcgcatggagctggacaagaaatttaaggtgctttgcctgcacggcttccggacaagtgggagttttctgaagaagcaaatcagcaaatggaatccttccatcttccaacaatttgacatggtactacgctggatccaaagatcaggtttttgtattgctttgttgattgtttacatgattttcctggttttcaggtcttccctgatggcatattcccagctggagggaaatcagagatagaaggcatatttcccccaccctactttgagtggtttcagttcaacaaggttaaatgcttcagatggaacccaaactgaaacaacacttgcaatagcgttgtcagatcttactttgtactatagtttcagttttgttgctatactatacagtgtgccttggctcaaaccaaagatagacaaacatttatttactgttgcatgttcctacacaggacttcactgaatacacaaatctggatgagtgcatttcatacctgtgtgattacatggtgaaaaatggaccttttgatggcctgcttggattctcccaggtaaaaatggaacctagctatgaaacgtatttgacccacttggtacttgagtgttattattatgtgcatgctagagatcttgggccaagaatttgcatatgaaattccagataagtgcattcaccattaaattgtcaacttttgaggtgctgtaatttatgagttcagttccgacacactgagcaacactagattatctgaagcttctgctgtatatagataatcactcactccttgcagtcgatctcttattttatttctatatccaagttgcaaaaactttcgcatttttttttacagaatcctgtgtactcacgtttttctattggaccagacactcacataggaaagccaaaagacatgggttgtggtcagacctttagattttttaatcagtactgacttactgaacaatatcataattcagttttgaccgaaatcccttactgtttgtttaacatcttgtttacaactgctcatgtccttcagctcatctgttaatttctttttcattccagggtgcaactctttctgctcttttgataggttaccaagcacaggtacacttgtactcttaattttgcagaaggtttcaattttggttgtagtttgaaggaacagagggcaataatgtgtgaatattcatgaaacgactgtgacatcaaggtcccatatttgaacctagcagtttccatgagctattcagttgttggtgatgtgttttggcttcaaattgttaaatgctagtacaaatataaagtcccactcctataggctatggtaaatactgaatagtatcgtttagctaggtgctagcttttgtaagctgcaccaacatttcattcactagaacatggacttgagcagggtacttcttttatgggataagtcctttatatgagagatgttattcaaagtctgcagtatctagttccatctggattcttacttaagctgaatgacttagggcaaagtactgaatgatcatccaccaatcaagttcatggtctcaatagctgggagcaagttcagggacccaagcatatgcaatgtagcctataaggatccgatcaaggtgaaatcagtgcatttcattggagagaaggattggctcaaagtgccttccgaggagctggccgctgcctttgaggaccctgtcatcataagacatccccagggccacactgtccctaggcttggtatgcatgcaccctacccagcacttgcattccatcttgtttttcttttcactcctcttaaaactgttcaccaacattgcttgcttgttaagtattaatgagtggaaattgttcattcacagatgaggcaagtgtgaagcagctttctgagtggagctcaagcatcctggaagacatcaagaatgcagatgatgttgccaaggcttcaattgtggagaagccatctgagggtaataccgtggcagagtccggtgaaaacctggtggagcaaattgcagcttgagtatggtaactgacagtcttgacactgtctggaggctggagctgattgctgcttcaaattaaaccggattagtccgtcatgaaactcgatctatccaaatgtttaagtctttaagagctttcttttttagcgaagatgtttaaaaactttgttaccacaaatatatttgcctgggtactgcttgtattctctgggggaactaattgaatcgactcataaccggaccaaatggattcagggattcatcactgtagctccagctacttgagagagtaattggtgtaaaatgtccacaaaacattctgagttcaaactgagatgattttcaattcagaggctgagtgaattccattatcagaaacaaaaacaaaaaaggcaaaaaaacaaaaacaaaagtgaaatgatttcaatcctgattctgccgcccatccaactttgggccgcgagttaagatccaagttgggcagtttggccacacgaacgatccaacttcagccgctagatccaatttaaacaggaaccaatcgaagcagaaaaggaggaaaagtatctggacgccgtgcgccggagacggagaaggtgagccacatctccgtcgagtggcggcggcttacggcgaagctgttctcgatgcaagcgcccaccatccatcctttgcttttggggataattttactatcctttagaaggtatctatatattttctagtataaaatttggtacatctaagcactaagtatcttaagatactaaattacctcaagctactttctcaaggaccataaaattcctcgcttctgacctgcattt

SEQ ID NO: 67508 - DNA, 4791 bp, Oryza sativa
gctctaaaaggaacaaatcaaatggtgagcagtgaagccgtgacctgctgttgcctaatcctgttgggtacttatatgaatctatccatacatgggtaacaaaaggatttactgcaactcggaaattttgatatgtacagagaaatctagcactaaactctgaaatctattctgcagcaaacctcattccgcttagctcatatcctcagccgcatcttctaattcccaaacaacatcttttagttgcgtcgagagcgtttggtagaactgttcatagtaataattttgctcagttactttgtcatttaaacaaaactgaaggtgatcaattgaccataataagagtaaccccattgatagacatataccttttgaaactccagggtatctcccttggcctttttgagctcaaccacatgtaaggatggtgccacttggaaaacctatacagcgggataatattttgatcaatcctcatgtttcttgtgacagatatcttctttaattttgtgttttctatacctcagttgcaatgtttagatgtccttttcttccttcctttatattctccattctcatctaaatagaacagtagaaaaaaacgagtgagatgcttgtcatggttcaggacgcagcgcaggggtgataaaggtaatctcacattgtgatattcaacttcttcatagtttgtacaaatgagctgaaagtggtactagtaagacaaacattacttgcaaggattcttagcataccctgtagtttctcttctgaatattaaatcctagtaagttagcagcttcttcgatcctattgatgatttctttcggagggcactgcgatgtaaatcttgtctctctcttgtacttctgtcatgtttaaataaaaaagtgagtccactgcaataattgcatagtttctgaagtaatttatgaaaaatgtttatgatacgtgcatatttgatcccactgcccactggctcattaaccatactgctgcaatcagaaaagatccttaccttatcagactcaaaaaaattgtctagattcagacccttatttagtgaaatcaactcaaaggcattcatcaaggttggctgctcttccatagcctctttcacatgtttttcctggcaaatttattagacggtatatttaagattatgaacatctgaagcacaaaaggataagtacccttgtagatataatactattgattaattaactcacttctgagtctccaaaagcatcataaacatcgtggaaataagggtaatatttgtcatcgaaaacaggggactcatagccttttttgaaccattgatcttgtagcacttgagaagtagttatccgctggttggcaacaaagaaaaccaagtaagaagaaacaagtaattttgggcactgattactgatccaaattgcaactttatctagtcagtacaatcagtgataaaaaataaaagatttaaagtttaaacaaacttcaaaatgtcacttctgtaagagcttctatccacattttgtaagtgtcaaaaaacttacagtagcaggatttggatccagaattctagcaatgagcctcttagcttcagcagaaaaccaagagggacaagtaaactgagctccagaaatctgtcatcagaatgacaaaaaaaaatgtatcataacctggtatattggtgttcaagatttggttaaatttctaaatttaccttgttataaagggagacaatattttcatcctcaaaaggaagatatcctgcaagcagcacaaaaagaattactccacatgaccaaaggtctgcaagagcaccatcgtagcccttatcttcaataacctacaaaacagaaagatatttattataggagaaactcatttctggataaagaaaaataagagaagttgtacaagcaaatgttacctcaggagcaacataattaggtgttccacatgtagtatgtagtaatccatcagcctgacagagttgaagttaattgacacacacacacagtaaaaaaggcaatcaatcgacatagaaacaatatagatgtgcaggaaccttttttttttaactttcgagtagttgtgtgatattaccttcacttgctcagatatagcacttaggccaaagtccgagactttgatgttcccggcagtatcaagcaacaaattctctaactgtcatgcataaaacatcaatttgtcaatttccaattgtttatgccagatcatagttataacttataaaccagagcaatggggttaacactagaccttcaggtctctgtggtatacacccctactgtggcagtaatctacggcgttgatcagttgctgaaagtatttccgtgcttcatcctccttcaaccttccacttgtggcctggttataatttatgaagttattgaaattcacttaattgtcatgcaaaaaaaaaagtaagtggagattacttcaattacagctactgcaaaggaaaaatgtcatacaggggatcagagcctcagaggtataatagtactaacaataatatcatggagctctcctcccatcacatattctagaacaatgaaaatccttgttttacttcccatcacctgttataaaacaccacaaaagtaatccaagttatcataaacagaaggcttgggtgtactactgcacaaagtttcaaactagcaacatggtaataatgaaagatatattcttgtctctcatgctttagatttacctcatgcaggtgaacaacattggggtgttgtatcaacttcattgtacaaatttcccgtctaatctgcaatagagtttagactttagagtggcatgagcacagctggcgcgtacacaggaatattttttttctagatacttttggctattttcgttgttgcaaaaaatctaggaaagtagaacaaaatattgtgagtaattatctgactctgaaaataacctgttcgactaatctggcttctgaaccttcgctttgtcaaggatcttaatagcaacatgatcaccggtctccatgttctttgcaaacctaacctttgcaaaagttccttgaccaattgcgcgtccaagctcatattttccaaggcagcgccttactttctgggcagcagtccttttagccttatacatcttccagaaaaaaaaaattctttcctcagtcaaaaaaaaaaaatccttccttcaaactagacttcaactgaatctgacagggaatattacaagatttattttcataaagcttgaccatttgatggtcagcacatagaaaaacagaagatattgcattatgttgaatctgaatggaaagctattaatcaaaaggagaaaacaataatccattgcagtagaaatacgaaatttcattgcaaatgaaaattccaactgagattgtatcaaatagtatgaaagaaaaatctaactgtaagctaatctgcaaggtgcaagcttttagtccctagaatctcctaaaaatttgcagaagtgcagaaattaaacgctgatggaatcgacctaatataaccagcaaaacaagaaaccaaagtattggctgtgtacatccatttcaggatgtagacgccggtttaaaaaaagaaaccaaaatctgaaggcactagctaacaaataataaaacatcatgttcattgttcatgtattaggaagaaaacacagagccatgttcaatcaaaacaagccatattcgaacccttgaaataggtcaaaatcgagtccttttatctttccatgtattccttgacagaatggaacgaaataccgaaagaatgctgcacatgcaagcagctggagacatagttaatcgcagtcaggagccaaatggaattcccttgcatctggaatgagaaacagcattcctctcctccggcgagtggcgtaactaatagaggtagaaggaacaggaactaatgctgaagaactggacatacctttgggagaagaagggtgatctatggagtccggagcattcaagaacagaagaactggtagaatgggagagggaggatggaggagaggaggccggaacagtggagaggagagagtgagaggtggagacgacaggggaagagacaggggcccgtagctgttttgtttggttttgtttttgcagcaaacgactcctctctcttgcccgcagaatttaatcaaggaattgaatatgtttaagttgaacagaagaatggttaatgatgcactgacatcaacttttagctgtccgtacttagatccgatcgtccagccatttgttcctccgttaaaaatatactccctccatcacagaatataagaatatttttaaattaaatatgagtattaagcaagtagataaaattaaatagaagaatattatgattagttgagaagtgaaggtagataagaaaattgaatggtggaagattataattggttgagacagaaaatatttatgaagaaattgtcatattttgggacaaacattaaatgttaggagttgttatatttttaaacgggtgaagtataaggattttaattctttcatttatccataaatttaaaagattttaaaatattgagtagaaaaaatgtatcacatcacctcttctcttttgtccattcaatatcttggcatttcatttttttatcatattcctgtcaaatactactccctttcttccaaaaagaaacccaattctaaatttaaatctagatatatgtaaaagaaaaactcaatgttgagtttggatctggacacatcactcatgattggattttttttctgtaaggagggaa

SEQ ID NO: 67509 - DNA, 20064 bp, Oryza sativa
ccctgagaattgagaagtgcaagtagaggcttcaggtcgcgtgatacatgcaactatggcaggttttatttaaccattgacagattattttctctctcttagctttgcaatacaagagaacaagatgatgatcgcccgtaggtacgaggaaattgaagacgcgaattgtttgggaatcaatataggctaacacaactgccttgacctgcagctagctagcttgtttaactccatttttttcgccgggctgtttaactccattttagcatgttacttcctccgtttcacaatgtaaattattctagcatcttccacatttatattgatgctaatgaatctagacatatatttcccacatttatattgatgctatgtttagattcattagcatcaatataaatataagaaatgctagaatgacttacattgtgaaacggatggagtagcttgatttttttcaggtcacatgaatcgatctcaaatgcattgatttttaggcatctgcagcatgcacatcagaacatgacgtcatgcttagcacgatgatgtgaaaaacttgagtaaactcagatgcgcgcacgtctgaattttaattggagcagtcaactgtggaggttaagcatatacaatttgccgttaattaatcttaagcatttctgcaggtcattaatttatacgtcatctatcatgtcagccacaagggaattaattaagcatatttttgtcagcggtcgccgatcagcagcctggttagctatcggtagttcaatcaatcaacgcactgcattgcaagctaagatgatgtattttccaggagatttcgccttcagtaagttaaatagcctgaactatatgggtgtctcgatcgaacaatacaataagtgcactttaggtgacgcgtatacagctatatatacaccaaacatctgaaaattgcatagcaatacaattgacaagtaatataccattatgttatagctttatgcgacctaataagccaaggaaattgccactgtaaggaatttaggaagcttcctagcactagcaggtggtgatggtatgcacgtatgtacatacttacatatgctgtgtgccagccaagatcccagatgcggtgcaacgtcagctaatctgaatttcattgaaacaacaattcttgagtcggatgactcaccctcacctggtaaatctctctattcttgggctgaatcgaataagaatattgatgggcatattatgttccatgcaatgcagttagcctgagcaatcaagccccccatcaacattcctttattctcttttcccctctttttgcaggctaataaatattcttaagactattactactacagtatatatctcctttcatatggtcgagtgcttgctcggttgcagcagcaggtcgaacgacgtgagggagtatggatccaccaacacgcccatctgctcattcgcgttgtccaccgggctcgacactggcgccacctacaacaatttcgtacacattcaatatagttactaccatctgttttgtttaatttacaggataggatacatgatcagctgtcagtcagtgtgtagtgtactaaccttttgtggctgctggaatgagttctcatcaagcggcccgctggaagtaagcacggtcttcttcgaccctgagctcttgatgccctcatccagcccagacacagatatgctgagattcacagcttggttgccaaagttcactagctgcaaaaaaaaaaaaagtttcgctttgtgctcacttggtcatttccaagctaaaccaatgcatagctcactctctctgaaacaaagagcagcttaacaaagttcgcacctttattttcaggtaagtgctcttgtctttgctattctgccaagtgatggcagatgcaaccagctggttgtagctggaaatctgaatgtttgatgggtggaacgttgcgccgcatgaatctttgaagaaatgtagcatccagtagtttgggcatccatagttctgccatgagttgaacacaattgcgtctggactccatctatggtatgcatcatttcattttatttttgagggttgtgaactcagtcagatatgacacaaagaaagcaatctgaaaaataagaattcctgagttgttggatccttacctgcgatcattgtcatttacaaagagcggtgcacagcttgccatctctaccacgtcgctgcaggaaaacaaggtacggaatgtttatctttgcaatgcaatcaaccagtgatgcagaaagcccagacatggtagcctgaaggggaagcatgttcgttcacactgccctttgatgcccaaagctttaatcttcaagcagtttcaaatctttggtatcatggaccaatttatggcagagcttacacagcagaaatccatgatggagagaaaataaaagtataaatattcctctaaaaaaagtatgattattaacctgtttctttctaatccaacgagaaatgctgcctctgctagtgcttctaccagtgttcctttgccagcatcctttccagtcacagcgtactcacttacaattgcctaaagagtcatagagctccccaagtcaatttctgagcatggaaagtggaagtatctatgtatatcagatgtagggataacatttgagcataccttcggtccactgcgcgtcgtattgtcaaacatactagttctggaaaacatatcactagatgaggtataaacctgtggtatagatgatgtttttgtcagccataaacgaaaccataatttggaaaaaacacgaaattgtgaaaacaaacaaggaaaggaacataatgaatagacattacatgaacatcatatagatcggcagggttggacggagaaatagtggatttatcacaacttgacacgacgttgatgtctggataggcagctttaatcgcggaatagaatttttggtaattgcctgttaattgaaagatcatataatatgagctctccctgcttacccacaagatataaaggtagatgaaattattttacaaattatcttatagaggactaaaacgctattaaaaattgatgtataagaaggaaaaggaaactcttggtctatcatctgcaagcacaaacatgacattattcgattaacaaaaatttccaacatgaagtacaggaatatgatgcattaagttcaaacatcaattcttggtatgaagttaggaaggacgtgcaactgaagagctacagacctctgtaatagagcatccagcattcttgattccctattgaaacatagtcaaggttaaagggttgtggatgacccatcgctgcacgaactgaaccccatgtagtcttgggccctcccctggcaaactcgatgccatcaaccacgtcctgaacattacaagaacgaaggaaatggggaacaaggtattgatgtactagattgatcgttttatcaaaggattgaatattttggaagaacaaaccttcactaatgatgcaattgttgcagtagatacctcttcattttggcttgctcctgcaatgttgaaaatagtttattgacacaacatgaaacagagtgttagttgtacctaataatccatggagatttgaactaccatcattgaccacccatactggcgaagcaccgaggtcttcagctagctgcagtatatgaatatcaatatgaacttatgaagtatattttaataaatattagttttgaagtcatggactacgttccaattacctgaaggaactcaaagaatccaagtccatcatcagtccagtatccccaggcatcattgaagtgaccgggtctttcctcccatggacccacagtttcactccatcgaaatgcatttcgcagataatttcccatggcatagttaccacctaagtttgatacatattatcaaaactatatgataatattgatatacctaacttcagaaaaaaaatatatgatgtaaagttggcaaacctggaaacttaagaaattgaggttttaaattggccaacatagaagcgagatctttcctaaaaccgtgtccctaaaatgaaaacataacaatgaataaaaggtgggaactgataagtataaaacacctgtaaatctgatggcaactcagtaggaatttcccttatagacccggcaaaaaaggaatttcccttataggatatgggccatccagtatagtgatgggtttgctcttaaaaaaatcatagttgtctactggcgtttactgatgaatagtctgcaaaactgtgcagctgaagcacgaaataagtaaagataatggtacaccaaaagaaataaaatgagacatgaataaagtataccatgtaggtatccgatggcataactgacacctggtcgagccaaatcaccccacttttgctggttgtaagctggagccttgaattagtattggtttggctagatttcagatgaaactctatctttgtccatttagcaaactgtttcttgctagccctggaagcaacatggaaattcaagcaattattagggaaaaaaatgcagcatcccagcgatattaatggaaacataaatattacgttatggtgtgagaggccagtttctgcagaccatcggagcttgtcaaggaaacagttaaggatactgcatctgaagatctaatgtgcaggcccaccttataaacccttcttctttcaatattctggaaaatgtgaagaaatactatatagtgtattccatgatgtttaatcagttaaatacacgccagatcaaatttaaactgtcaaataagattacggaaacttcaaaaaaaattgtagacggacagataaataaataagaaacacatcataccatgccccaataaccaggattgtagactcctacacctccagaagggcagttattggttcctttagaatcacaaagaacttccatccgaagtgccaccggatttttctcaaaacaggatgtcctatcagtcccaacaatgatacttgattcgttcccaattatcagccatgggtcaatgtttgaaggtgtattaggtccaccagcctcaaaacctggaaataaatttgagcactacaaacattaagcaaaagtacgatatcccaaccaccgctgttcctcctatcatcttacaagctcctctataacttctatcatcttgattaacacagatatgctttgccttacctctgttacttacaagctctgcccacaacccaccagccccagcatggttgatctcctacaagtagaaccacaaatatattcaagctcccagcatggaatagaagtcgaagcaacctcatttgatatgcaggtactatatataggaaaatgttgcaaatcaggagaaaataactgtgttccaaacagtgcatactttaattgtatgagattcagtaaataactagaaatgctatctgaacaatatggtctacaactaggaaaaatgtttgtgctggcaccaagtttatacaagtaattgtcccttttagttcgtataccggttagaacaaaaatgcttgttctattttctttttgagtgagaaaacaaatgttgttctaaacagataccaatatccagattcagtctcacctcgaaaaatataccgaacatcttatcagggatcttccttgcattctgcggcgaggcatcgacattcaactgcccggtttgacccgcaacaaaacccagtgagactgtccagcacatggcgtaaacaagaaccagctcacggagccaagaggcagcatctgttctctgcactgccattgtgctcaatgagctcgcagctcacaccaactcaatgcacggtccatatatatgcctgaaaggccgaaacgcactacaagatgagatagacgatcgaggcatgcatcatcaagttgtgcaaaagcagttgcatgagtggaagcaaagctaggcaagaaggagaaggggaggaactgagataagaaccgatagggacgtcatcagcattctgtttgaagcttacttctccatccactgctgcacgtcgcggggaagcaaaaccaggtgccgtcattttcctcgataagatggcgcacgaaaaactattctcagagtcggagaaaacaagaagaaaaatcaatggtgcttgattgcttggcttaattctgaaggaaatcagtctgaatctgattcaagatagttgcctatttgtttgtgcataggtttgccgtacctatactggaatgtccgccacgatggcgggtggggagcagccggccaacctcaccatctcaccgccaccgcctctcaagccgtggcgtccccgatacggctcgctgccgccgccgcggcactgccggtcgccgcagttgcttccctaggccttgttcttgggcatgaccgccacggtggcggacgccgagtaggtggccaagccgcatctcgccaccaccttctctctagccgccgctccccaataccgatacgcctcgccgtggccgtcgccagcgccggcgccgctgccgccggactcgaggagtgacgggagtgattccgtgggccagtccatgatggcctaagaaaagcccaataggcccggcgaaaatgcaaagcccagtccgtctatgcaaactgcctaatgggctcgtttttgcaattaggcctctctgtaatccattgggcctaaattgatcgaatctctactcaagatcaattgtcctcctttcagtgatcatacagagttaagttcagtggtcttgttcactgaacattatatttattactcgtaatgatgccctaacagagtcgccgatttaaattaactgtcttttttccttataatgcactgaattaactctctacctcttcgctatgccatattgtctaggggaaaaaaaagaagcggatcctcttttgatctacaaaagaagcttcgtattccatatgtcaaaaaaaaaaacaacttctatagacaacgttcaaatatatttctaaaagttaattatttttaggatgaagggtgtatgttattgcaggaagtgattgtcattttagtcaacatacggcgcgcaatcatgatgaaatggatgactctagtcaaatagtcaatatatcaccaagttcgtgtgtgaatactatcttttgaaacttgagtgtgtgaatacgtactgtcctttgaaagtataaagtgtgtggataccatctatatatatgcgagatcatgaccagtttaacaaagttagacagatatcgtaatagtggtgttaatcagttcttgctttctgaaagcgcgaagatgcgaaattaggcacggttaaaagtgaggcagcaaatccgaatattattactgattgtcgtctgatttatgctgtatgactaggctaattgtgtgtagcgtgcacgtcttgagcgctgactgaaccattttgaagctgctaattactccacatatgaaggagaagcgtctgttataaaaccggctcaccaaacacggaagaaacatcataggatatctaaacacaataacgataccgagatatgatatttgttaacgaggttcagccgaagcctatatcttcggggtactgattacaggcgctcctccccgatccagcatattatagcgcttatcaaagttacaagttacaacggctcacagccggccgtcaccggcagctattctctctcgttatgctaagtcgatatgaggttacaacaggtccgtctctctatttaaaagagattataggatagattctgactcttactctattcatatacctagtacaactccaattactgaactataaccgactctgtacacatattcgataaaaactctaacagcgtccgtaattaatcaattgaagttcaacagattggcatgagcaaacaaagccttcatttgatggtaaaaggaaatgaaagcaagaacatagtgtcaaaacaaatcacaaatcctcaatcgtctctatactgatgatgcacacaaatgcatggaatttctgaacctagctataataatattatctacttaatttgcagctagcaatatataattcacaattttcacacagcaatgatatatatctcctacctaactaattacaaactaggtagctagatgttcatcgattcttttgtctgtatagacaccacatgctactatgctagcatgaaattgacaaacaaataatactggagtaattgagagatgacgaagtaattaattaacaagacgcctagctagctagctcgctagcgcttggaatggcctcgacctgtgcgccggcgccgaggtcgacgaggaggatggcttggtgttctgctgcagcaggcgcagctgcggcagcacgtcgtcgggcatggcggggcggagcttggggtcgtggtggaggcagcggagcgcgagcgccgccatgtcctgcgcctgcttcttgggatactggccgccgagcctggtgtccatgatgcggttgaccttccggcgatcgccgaggtggggcctcgcccagtcgacgagcatctcggcggtggcgccgcgggcggcgtcgagcgcgcggcgccccgtgaggagctcgagcagcacgacgccgaagctgtagacgtcgctcttgacggagaggtggcccgtggcgacgtactccggcgcggcgtagcccctggtgccgacgacgcgggtggacacgtggctcttgtcgccggtgggcccgttccgcgccagcccgaagtccgacagcttggcccggtagtcgccggcgaggaggacgttggacgacttgaggtcccggaagatgatggggttctccagcccgtgcaagaaggacagccccctcgccacgtccaccgcgatgttcacccgcatcgcccacgacagcggctgcgtccctcctgcatgcatcatacagtatgcaacatccattacattcacttctgaattgaagaatcgattcgatttgatcagtgtacagtgtactatatactactcacttctgaagaggtggttctcgaggctgcctctgagcatgtactcgtagacgagcagcttgttgctgtcggaatccgagcagtagcccaccagcttcaccaggttctcatggtggagctgccccaagtaggtcacctctgcctgcaagtgatcgaaggttaattaatcaatgaaaagttgaaatgattagtaagtgtagttagttaattaattaattaccagccactccttgtgaccctggaagctctccttcttgagcttcttgatggcgaccatcttgccgacgccgggcttggtaggggcgagggtgagctcgtcgatccaacccttgtacacgcacccgaacccgccctctcccaggaacgagttggaaccgaagttcttggtcgccgcgcggaggtcgcccatgttgaacgacttgagggacgacagcgacggcgccgccgacgactcgtcggagctggctcgcgagaactgccccgacgagaacgccgacgagctgcgctgcgatgccttggaggtgttgtccgtcgtcgtcgtcgagttgctgcttctcgtaacctctgaataattttcaaaccatattacatagatcagcatggatactgctaattgtctatttgattgcttcttcctcatcatgtttcttggctaatcaaaccacgaacagaaatatgatgtatatatcagagtagcatcttacttgattcaagtggagccgatgcactggcgcacttggatgagcccatgcagttccccattttggatgaacctcttaatccttgatcacctgcaactgcaatcccagatgagcagttgctgcgaactccaaaatggagtatggtcttaggttgtgatgggaggcatggaagaatatatggacaggaaggcaaagaattcaagggatagagatgactgatcaaactgtcagttgactgactacgagtacatgtctagtactagatgcctacttggaggcttcctccagttttgtcagtcaaccaaagtgctgataaattaattacctctaattagatgtagccttccctgttaattaaacaccatcaattaatttgatgcaggcaaggcattcaccattaataaaactaatggttcataatgggaactgcattaggtgcaagtctttgacagcttctaactttgaacatgttgggtagaagaaaaaaaatacatatgttggcagaaaaagatagtttctttggtttcggagagaaactttattgcttagcagctactagtagcatcatacagcactaacactgaaacaggtggcaaaatttgctactttgtcaactgcagagtacagtgctggaagaaacaaaaggtgtgattcagtaacagctcaaactagtgctcacaaaggacaagaacagaacaatcagtagtcctctagtagctatccacattagtgtgaaaaaggttagtaatgtgcactatcacatcattttcagttgttgaagatctgtctgcttgtagccggtaactagcacaaaatagctcctgtcctgcagttagttttaccaagacaggattattgcttttcagttttgacacattcaaactgatagatactggctcacatcttctacagattgttgggctttgaccgtagaatgcaggattcagggcatggatctcacaaggttcaataaaatatattatcaatagtctgcatttctgtgttcgagagaaagaagaaactacatttttgcaagctcaaagtcagatgcatgtgcatcaacatgagctcctgctcatctttcttgacctgatcagcaaatattatttctaattgacattttctttcttttatgttggtctatcctccaagcaggagtaaccaaaaacataaaaacaaccttttcttttgtgttggcctctcctccaagtaggagtaaccaaaaacataaaacaaatttttagtcgaactggaatggaaccaaaaacataaaaacattttttagtcgaactgggaagaaaccaaaaacatagaaacaaatttttagtcaaactagaatgagttttaatgggtgtcatagattggcatctgcaagcactgtacgctcggatcctcgtatcttcgctgcgtcaaacaattggagtcaaaggagagcgatctggcggttttatttatgtacatgcaactggtgaccaggtagatcaagattaagattataatcttttttttcaaggtacggatcaggattaacacggcatacatgagatatgcgacataatcatagtctgcgagacggtgaacattgactatattactcagagaatttgaggcagacgagatcttgaatattttgttgttacatctgctagctttgcatgcaacatgatgtgtttgggttgattacgatcgagccggtcaaagaagcgataaacagggggcggcggcggcggacttttgcgttgcaaagcggccatctccaatttgtcgtccaagactcgcaggtctcatcaccctggagagaatgtagtacatgccaaaactagtttcaacgcgaagctgctgcgaacaccagataagtctcttcaatcttgaaacgcaaactgttttgctatcctgcgttccaacaggcgcattatccttggagtgggcctggaattgcagccggtaaccactaaccacgtgttaaacttctcagaagagatgtttcctggaaggaggacaggcagaagattgccgtcatcatagtgacatagagcagcccagcataggcaaaatcatattctgatcatctccagcaggtcttctacgctaaggtaagaagattatccatcagaccttttgctacctaagattttcatagcttggcttgcatttacatgttgcagtccttgttgcctcaggcaactgtcattctccttggcattcttgagcacttccaacaggtatcgtgcatctgtctttctcatggctaacagcctcagggaatcacttatgaatggaaaaaaggcttcaggtcttaaacagaagggcctaaagatgtggagaagggccttcgtatcgactcttagctgtacaactccttggtcagagaatgtcaactccccccatcgtatgctgctgtagatgaagtagtcgaggccttctgctatactcctccacagatcaaggaaatccttcgaattaagatgtagcatcagtttggtggttctgtctctcacaacttctagagaggcaacaaatccaggagatactccgagattttcttcatccaggacctcatcaactggatggatctgctcattgggcaatccaatgttttggacatagtcccaggatagatcttcaaactcgagcagaacggaagacataatctgttccagataatcggtccccaatttagccaagaaggcgatttcatcgccaaagaaagaacatggatgttgggcactgtgtttgtggccttgtccctggccttcatcaacatgtttcctatgggcacccatctccaggaaaactatgtcgtcatcccattcccgaagaacatattcacaatatcgagcagcattaattgcaaatgaagcttttagtaaagaatcatcttctaaagctgtatttgtcagttgtagggcttcacatcgttcacgtaagacaagaaagaaatcactcaggaactggactgaagaggatctgttatactgaatccttaatcccctatttggcagagcatggcctctttcaatcatagcagatgcagttttgaccacaaattcagaaattgttggagctttgtaatcttctcttgtagacagaagaaaattactagtgatctcttgtagaccaagctctttaatactatatgaccaatttatctcatcctccatctcagatttgagcttatgttgtgcagaattaagctctacaccagcccacatgtgaagccaatcagaatgctcgctatatatggaaaagacagataaggacctggacaggccttcagaaattgaagctatcttctgtattcctgaatctgcaagcaactgcattcttttatcaaaagtaatcatcaggtcattcaagtgcatccatgaggaatgtacttcaaatttgtcatcagtagcctgataagatgtgacaaggactgggaaaatttgcctctcaaggtaacctagaagcattttcaccattccagttacccaagactctttagcactcaatcccacaagtcttgctcgatcaatcaaaggctgcaatatatcatccacaccacccataaaatctcttgctattttgtaaacaagggcaaaaatgaactccggctgttcagaccatttagcaaaatgatattccaacctggaagcaataggctgaaccaactcatcaattgcccaaagtccattatcaaagcatgcagcagttttatcaaagtactttgaatctgacatgctagcacttgctcctttcgcttggcattgacgcgcttcacagttggcttgcgcatgttgcagagcacacagtgctagaaaactttgtgaatacttctctttatttgcctcattcattaagatgagggggtttggaatttccgagtacttattatttgctgcatctggtgaagacaaggaaggtggccagccaagtgctgcaagtagagctcgataatctgttagtgctttaggtctcaaaattgctagggttttgtccactctagaatcaacagccatgataagattggtccattgtggcctattcgtgctgatccgtagcaactctagttcaatatccctcatggcatcaacagcctggagcaacttttcttgcttccattgcatttcctacatttggagagagaaaaaaaagcgtgattaacatatcaaacaaacatactgctaacagacgtcatatcggcatgaccaataattgtaggttgtacctaaaataacaattaaggaagaaaaaggaaagagaaggtttctcagcttctcacattagatgctggcctaaataccgaggacaagttcaactttgaggcctgtctaacgatggaaaacgttgcatcttctaggttaccaacaaaagcttccaactgtagagcagcttctggaatgtcagcatagaaaagttacagaaggtactacaaattcctacatcatgccggatatgatggaggagacataatataatttgcagcaccaaacaaattctttagcgcaaatggcatgttcccatggagatcactggcaggtaatccgcgttaatcagtttaaaggtcatggtcaacattgcactgtatgcaggggcggagccacgtgtggggcagcttgggcttgggccccacacgtggcaaaaattttcaatggagaaacactgaaatttacgtagaatttgcacaaaaaatttatagctatatggttcagctagctaaaatgctgcctccgcccctgactctatgtaacaattgttgagaaaaaaactcgatgttgataatagctttgtttaacacagatattctccattgacatcatcaagttacagtagtttgagattgagtggtgggtgggccgtgggcacgtgaagtgcattgccaggttattgtagctagtgccttatttcagggaagtacttagtgtctagtgaagtatgaagaaacaattcatcaagagatccatattgcaatgcatagataagttactcaatgctcaagcatacaggctaatatggtagtaggtaacaactacatctaccaaactaatttgcaaatttaatattgtaactagtccaagattgggacattccagttactcgacacaagcgtaacttgctattgcccaactcagaactgatttggcaggtaaaacaccactgaaattctaagagcttttttttttctaaaatcggagtgaccccataatccaaattaacttgcaaaagttagcactgtaactatccaatatcggaattttcaagttaataggaaagcacgaagagacgaaggaaggctgacccgcatagagtcgaatggcgtcgatccgatggatctcctgcacaagcgccggcagctccgcgctccgcagcgtctcctcgccatcatcctcctccactccgaatcccccgcctaccaccgataaaatccgttgaaacccgagcggaatccccgaagcaataatactgtaacagtgagcgtccctacaaatccagaacgaaacaaaagggggacaaaaaccgtactagggttcagagaagcgaacctcgggagcggatgcggcggagagatgcgcgagcgccggcggagcgcgcgagccaggaggcggatacggacgcgagctgcgcctcgaggcggcggagggatgcatccaggcccacgcactcgcggcgcaggagctcagcgagcgccggtgcggaggcgaggtcctcgggggaggcgaagtgcgcgtccaggaagctccgcaggctcgccggcggcggccgcggggacgccatggctgcccaagagagagaaacgcgaaccttttttctttttcttttttttctttttcgcccagaaaataaaatcagttctgggaagtggtcaagtggactggagacagcttcgccgatgggctaaattggcgggagcccaaaaaggttttgggcttcctatttgtgggccttctcagtggtaatgtgcagactttttcatctcggtgtgaaggggattgctatttagcgcgattgtgtttccaggctcccaggtcccagcgcattcttttttctttaaactttcgtctcgaatacttttgttcaaaaaatgttcacacgaaaacttttatgaatggaaaaaaaatgagttaagaactctgctgcactaaatagcaattccggtgtaaagcggtcgtttgatggaattatcatgggccggggccgtgttgttcggcgagaggtaaaagagtaaatttaaaagtacaagtacttcaaacaaactattgcaaaactatatatatttaaggaatcgtatcccaaagttatatatttagtgatgaaattatgaaagaactaccgatattagagtttataaccatagccctattaaagttataaaagttgtagctttgtaacagaaatgagtttaatcttcatttttttatacaatgctataatctacaattttatgaaaaatatggtgttaaatctgtacttttaggctgattaaagtttgcagatttaagaacttgtttcacaaaactatagattcagtgtctttgtttattacaaaactacaggtactttgcacaatatatcacaaaagtacagattcaagaacttgtttcacaaaactacagatttaatatcttcatttatcacaaaagtacaggtttattgtcttcattatcacaaaactacaggttaaaacatgtagttttgtgataatggagacacaaaatatgtagttttgtgataaatcaagacactaaatgtgtagttctatgataaacaaatacactaaatctatagttttgtgaaacaagttcttaaatatgttcttttgtgatagattgtacaaaatacatatagttttgtgataaatagagacactaaatctataattttgtgaaacaagctcttaaatctgtagttttatgataaatagtgtaaaatacatgaagttttgtgataaatagtgcaaaattcctttttagttagtatgggcccacatatattatcgatgagaaaagcctagtacaggcggcaagagactgaatgggcctggcccaaacccctcggccttccatctccactcgatcggatcatatacatgatccgtctgtcgatgacgaagcagcagcatccatggtgcgaccaggtcaattccaccgacccacgacgtgctcatttcaattatcaaaaaggcggcaatattaattgagtacgctcgtttaccgtatattttattctttaacagatctctctcgatctttcattcttgcgactaataataattaattaacctgcagatatatagcttaaatccaaaatgatgtccagatcgtgggtttggaagctagctgcaactacctccaacacgcaggtcttgcgagccaatgaattactccagcacggagcaagtcgttgtctatgcatgtgattcctccgtttcaggttaggattgcttatatttatatttatatagatattaataaatttagacatatataaatatctagatttattaacatatatataaatattgataatactagaaagttttgtaatatgaaacgaaagtagtacgatggttagcatgcattctagaattcaccagattaattgcgagagaaactgatgttttactgctgactaattagctttgacatacacgtagtacaaattaaattaactgagatcagctatagacagctactactgcataaaatgtgggcatatatagcagccacactccgtttgaccgacggacgacgacatgacatgcataatgcgctagctgtacaataatactagtagtaacaccctacagtaactcaacaacttaacctgatcaagcgagcatcatcgatacgatcttggctccaacgacaaactaatcaagtaagaaatggtagtggattgatcgatcgatgtagagctagctaggccggccactgcgatcgagagcaagaaatctactagctatgtcgtcgtcgtcggcggcggcgtcctaattaactagtgttggcactgcagtgcagcagcagcagctgggaatgaaggaatgctcagaggaggtcgctgccatcgtacatgacggcgctccacgacgagtccagcgtggggaagcacggctgctgctgaagcgccgccgcttgctcggcttgcagcagcgggttggcggcggcgaaggtgtcgagcatgtggaggccggaggaggcgtcgaacggcgcagtggtggtggtggtgggaaggatgccggcggcgccgtcggcgagggaggcggggtcggcctggacgccggtgacgtgctgcaccatgaggcggaagttggccgggtcggtgctgatgtaggtggtcggcgcgcgcttcgacgcccgcgaccgccgcttcccggcgcgcccacccgcggggcccagccccagctgctgctgctggtgccgccgcgcaggcccggccggcgacgggcgcgcgctgtcggccacgagaacggactcgcaggtgatcgccggcatcgtcggtggcggcgccgacaccacgaaccctcctccggcgccaccaccgcagaagtcggcgaggaaggccgcggaggaggatgaggagggtgaggaggaggtgtcgggcatggaggaggagaagtggagcgcgcgcgtgatgtcggcgtcggtgaaggccgcgcacggcagcagcgcggcgtgcggcgccaggcaggagagagcgtccatggcagatcagctagcttcgatgagaggaggaagtggaggtggaaggtgggaataggaggaggcggggatgggccgagtatatagagagaggccatggcccatgggacccagtggaaaacgcgtcggggtgtcggcgtgtgcgggtgagggtgaggtgaggctttttgtctgggtgtcggaggccaccgccaaccgcgccgcgccgtatcgcgtggtggcgctgtcgacgcgcgacggtggcatgtggcatatgccatccatcgcctattggatatcgcttggtggtttggtttgggagcccatgctgatgctgtgccatttcgcgatttcaggtaactcaactgcatgcatgtggagtactagttgctgattaattgattaattgccaagtgtttcgtactaactgtagcgagcatggaataggtataactcgctcgatccctgtgctgctggccaagcgagcaagccagcaacagtctcttctcttcgccatgcacgacctttcaactgtctgtcggccgcaatatgcttgccaacgtctcacctatgcatccacttaatattatttttttttctgtgaacgcgtaaaagattacacgttaatatattaagtttaattacacaacgcaatcgactaaacaggcctatgccgggatgggggaaggacgaaaaaccaagaggctactatgaaacaaaggatactccaaacaaacgagagataggaggcggagccacgctacactcacagcaatcccctaaaagttgttataccagcggaataccgcatacgaccttctgagtggacagacactacaagcacgcacaaagaccgaggagacggctgagtcgaaaactctgtagccccatcgttcacttatcgggggataagcgaaacaacatatttgcaaacgaaaaataatttgtgaaatacaacttttatatacatattcttaacgatctaaaagtaaaggttgacaaataaacttcgatgaaaaaaaaaccctcaaaatcaactccaaaattgaagttaaaaattcaaattttggctgataaacataagtataagcgaaaagatgaggctgcagaagttccgcttcttccacaactgccaagagaccagaaggaacagggagtcgaatccactaatactacacaatttatttcaaactttttttattttcttccatccttttcatcgagcagcaatcagcagcatatgtaagtaacaaacaaaggcagcagtagcacacattatatgtgcaaattatccatgagagatcgagcatccattcccggctaatcagcagtacaatcgcgggaatagcggggggtagagggggtgggctccttgtcgctctcaccagattttctttctttttctcccttacccacccaaacatcaaagatctctctctacactccaccttagcttagcttgccttagctagcccctacacccctctcgatcaacctcgctcatcaaaaatggccaaatttgccctacccagaatcacaatccacctgtccatcacactctgcatccattcatccatctatccacctccgatcgatgctagctctagcacctaaaccacactccctccgtttcgaaatatttgacaccgttgactttttagcacatgtttgaccgttcgtcttatttaaaaacttttgtgaaatatgtaaaattatatgcctacataaaaat

SEQ ID NO: 67510 - DNA, 11972 bp, Oryza sativa
tatgctaaaaagtcaacggcgtcaaacattttgaaacggatggagtattacctaattaaagatttcctctttcttctttcagagaaaaagtttaaagatctcttctttatattggctgccgtaacgtcaccaaacaaaaccgcatgagatatattattactcactactgcaccagattattattctgccaagatctagaggagatcggtcgttctgtccatggtgcggtgccaactttacctgaaagcgtttctctgaatattcgtttcttccttggttttcttttctgacggtgattctatgcgtccactgtaaatcagtgtaaatgagtgagcttgcagttttcacctatccagtgaaaaggaccaccggccaacgatttgaatgattccacgatgcctatatggagtatctccagctctagctctttaatactataatcttcagtttcagaaaaagaaaaatgttgtattctgtaactgtgtctgtccaccgaataaaaaacaatagtaataatcaaaccctgcaactgtatggaatcggtctcgtgaggcgacgacgacattgagctcaaaccaaattgcgtaatcctcatcgatgctgtaccattcgttgacctctgcacaagtccaaatgtgtgttcaaaatgcgactgcacatcttccatgccccttcttcaataaccaccactgtgctctgctgtcatgtgcatatttgcgtaaggctgtaaatcaatcaggaaattattagatgagtaatcaggaaagggcaatttggtaatgcttctgacagccttattcgttttctgaacactgtgattcagactacggaaatcagtctgaacactcaaacaaggcgtggacagatgttctctgaacaaactgcatcgccattcgtcaggtttctgagaatgcgatagtagctgaccagcagcatatggcagcacacagggacgagaggcgcacaggatgaacaggcgagctgacagcatggacggaggcttatagattactcctacacaaaactgaacaagtttgacggtttccggcagttgtcagcgttgaaaacagttcagcagccacccactccaattaatctcgaacccacaagctagcagtcaacactactacaaatccacaagttgcagcagctttgcaccgatcgagaggtaggagcatggctaaattagtttaatcaagacatcccatgaggcattcccttgtgattgagtgctttcgaagactttgtgtgtgtcattgggtccatcaaacacttgattacttccactagctcgtagtattacctcactaatcagcacatcttgcataggtcagtttcaactgcaaagctgaaaacctactttgacatcggagatgtattttacttgttcaatgatctacgtaatccaagtcatccagaatgcgatccgttgttgaatgctgatcaagcagaaaagggagaaaattacggtatgattgttctgacttgaaccgttttcagagacagcctgaaactctcatcagtcctcttcattttcatcagcaaaagataaaatgtgtggcaattagattggaaaagaaatgacataagtagtgagggcatgatgagatcaccatgctgtggccatccactgtgcattatttaaaggattccatgcacatcatcagagagctctcttcatgtgatgatacactaggctgttttgacttatcacacctgctcctcatccacttgttccttgtaatagcatcagtcgtacatgtttcagaatatactgaactaacaccttcagattaacaaagattgctagctaggagtatatataagatatataatcatctgtacacaaaaactaaaataactgtacctaaccatgccggattccctaggaattataaagcaattaagcttggaccatctccttgtcgcataattccctttgacatgtaatgtatttgctgcgagaacgtccctatccctaggtcaatgcctcatcagaaaaattcagaacatggaaagctgctgggtacggcccagagctttgttttttgcatggttgttgcttgtacctttctaaacccctgcctctctcctgcattatgctattaaaacactggcattattaaattaagcaacagcatgacatctcctaatccattttctcatatgctgaaaaaaaataaatattgggaacagcaaacagtagaccagtattcttttgttttcagtttgagcagctaggggactcgacaatcaagctgcctgtttgtatatatgagaaacaaagggaaggaacactgcatctgcatcatggtgagtgcaaatggcttttgactttggccatggatcagcttggctttgtcctttctcgagggtaaacaggcaggaatctgctcgacctgtttgttcgtttcctagaggtcagatgcatggtctgattcccttcccgtattataatgagaaagcagcaatctgcatcacagttgaatgccactctagttaggcatccgtgtgctctgtcaggcaagttgaatgtttcaggctttcagctcacatcacttgcccagctgggtgctggggcattggaacaggtacccagtatttgacagaaataactttttccctacatggatgatgatggtatcatctaaaatatgcatcaagaggacttgttctttcataaaggcttcatactgatcatttgtacttcgtcaaattcatgagattggagacttagctttcaacgctacattgacaaatcactgaactgttctggaaaaatggtgcatacatcatgttcatatcagtatcttacagcgtattgtcctctcatgtttctaacttaactgtagccccatactcccaccagagactacacaaaacatttacaactgacaaaacgactcgatacacaatatcatcacaaccaggaatttacatatggaacattttactcatccaactcaaggggggccatattactaagagctcacttgagctacttgcaatcgtactttaatcttctctcgaaaacctatcctttgcctcgtcgatgtttttctgcagatcaatatacttctgcagtgaaactgctgaaaaggcttcaagcttctctaagaatgccatcagacttgactgtacatcagcaggggcattatttctcaggatttctcctcctgtttcaccatttagcacctgctcttggtgcggaaaggaacggccgacatctgcaacgagattttcaatggctttcaccaactcattggtcagtaaatcgtcaattaatttaatccagatttcgcaagttgtaaatatgggtgcaacagcacattctgttagagaaacatcaacaacattttgcttcctggagcccttcctcttcttcagcggtttcatgcacttgtgcagccataagttaaggctagacaggtaaaccttgtgtgatgccacccagttttggaagtctgaacataatttaattagcttagctgagaggagaagggcatcttggcattcagactctgactgaaatgataattttacactccgtttgctggatactagcttcatgattgcaagttgaagatgatggcactcaagcattgtttcccacatcctagttaaactacagtaaagacaggcagacactgtcagatttatatagctgtcagtttaatgcaaactgcatactgtgattggtgcattctgttaaaacagtctgagaaaatcctgaaacaatgcatgacactcaagcacacaatactctcttcttgtgcacatcaaactacaaattattctataaaaactgaatcggcaaatataccttctgattagttcatccaactgtggttgaagctctttatctcttatgtcttctatgttcttagaaatgaagtctattttctgaatagccactagaattctggaatgcaaatcctttacagtagcgcgggtaaaatcaacaagaatttgatttttccctctcgactcctggtctctcagttgcttgcatttctcatcatatctcctgcatatggcactgttgacctgaaagcagaatcatgataatcatttggtgtgaaacttcagaagaattatcagattttatttgaacattcttgacaaaaaatcactaccactagtcataaactgcataaactctgactaatacaatatctgaaacctctatgattaaagaagcaagtaatctatctatgaattctagcgatcaatgtagggagttccagctaagggattaatcagaagaatcaatgtatattcgatggtttctgaaaggcggggaaaagaaagtcatgttgtgacaagcaatcagacatgtggaacataaatcaaaatggattaaactgtcagccaaaattaaaagatttaggtatttcacatagagtagccacaaaaaagctaattaccttgacttcatcataaagcttttcctcccatgcatacagtttatctagtgttgaggtatgcatgacagtaatagccccaggaggatttctagacagcgacaactgtgaagacactgacctatgccaggtaaggtattttacctcagcttgagaaggagctgcattataccatggtacattaaattcattgtacagtgggaacacacaggtattacagtttacacaggaaaatagaacactaaagaaacagcaaggtcaaattacgacggacaatcttgactctaagatatgactatatgagacaccatttgttacaatataaggaaaatgcaatagctgagagattaaaaaaaacaaaactaaatgagatcaatagcagagtatgatatcatctattacaatagaggagtatgacaataagaacaattacacagaaacattacaagttccatgtgatatgtcatatgtctataaaaaaaaggagtacatagggctgagcagtgcaggaaatagaatttcatactaataaatggaaaaaaaagcttactttcaggaagagggacatcctccctgcagcaggcaaacaatgttgacagaaaactagatgatgctgatccacgcgctgccagaaattattgtgcacctcaaattacaagagaagatatgaaaagaaatagtgcaacagaaaaaagcattgcaagatatctaacctgtttcttgtggtagtagggcgcgaaactgtaatttatcttcatcgagaacccttgtgacttcttttcccgaatcacaagctctggaaaataatctctcaatctctaccatgcctgtatataggcccttcacagatatgcttaaataaggatacggttcctttgagaccataggaaaggcagcacctgaaggtggtacgacattaactggggacacagcagaattgctataattttcatttgtgtgaatgtcagtcattctcctctcattttgggggttatcattttggcaaccagtatttggtaaagcaatatcttttgatgccacacttccatgaccatgatgctcaggtgccttgtctgttgaactatttttatcagacacgtcgttgctgtttgacactggcacaaacgtttcaatggatggactgaggaaagcatcatttgattcagagaaattctcttcctcatttgcaaaatcatcttttgattctgcaaaaccatcctcctcattcgaaggagttctctccccttcctcttcgagctctgggattccctcctctaggaagggtctaggatcatccaccttgtccaaacattggccagatctatccttttctttaggtgaaaactggttgtcacctgggtgaatttggtcaaaatggtccaatggtgaagtaccagtaggatcttgagatgaggcactgaccatagtcactgtcacaggagttgccaccttctccagataagttctaatggaattcatggcagctttcatatgactggcctgaaaagaagacggcgatttattatttggtatcgattcttcagatgcttcatgttcaaaacatttccttagcagaaagccagtgtctctcagtgaccgaatataatcacagtgagcagctgcaagtgcgcatcttccgtcgattgcttctctgacgaaacgcttcctctcctggcataacacgagggccctatcatcctcaatcttagaaggcgccacccccattttgaagggcagcagcagcactgaaagctgtgcagagattactagggcatgaaaatttgagaccaatcaccacaggttggtggtaggatcaccttctgcatgattttgtaactgccatagttaattcatgtgctagaattgaagtcgacaagagactatatacatattgtcaagcaaactccccccaaaagaaagggtttggagggatcaggaagaagccaaccagttctcatccattctgctagcagattactccaatataaacaagaaaatctgaaaaagaaaagaaagaacctgtctggatagcgtccggatggctggacttggacggcgaaggaatccagcgtcgccgcctcgccggtgaaaaatttgcgcggcacggccgtccgtcttggatgcagtactgtgtctgtgtgagttgcggcgactggagaagggtacgcgggggtgtagagaaaaccggaaggaggtggcggctcggggagggcggaggaggagtggaggagggcgccattgccgtcgcctatcagccagccacagcaacagcagcagctcagcaatggcgacggcgaagaggagtgagtaactgcagatgtgcgtgtgtgtggcgcgtcgccacgggcccacttgccgagtcgctcacgacgcggaataagttcatcgtaggaccctcaacttaacagcgagattttttggaggtccctcaaccacaaaaccagaaatattcgcccataaattcattcaaaccgttcacccgagctccttggcagtatttttgcccagttttgctgacgtgacatcctagacagaaaaaaaaaaaaaatttcgtggaaaccacatgtcaccttcacatatcttttttctcctcttcacttttctcttcaccggcggagcggcggtgggcgagcgcggcagtggagcggcggccagctacgggcggagcgggcggcggacagagcatcggtgggcgggctgcgggcgaagcggacggcgaacgagcacggagccacggcccacgggtcacgagaggttcggctgccggcggggccggccagcgacgcaagagaaggggagggtgtcgtcggcggcgggagctggccggaggaggaggtcgccggcgagcgcgctcctgctcctgctcctgctctggctgctactgcgcaggcgcggcggcggtggcgccgatgcagccgagctcggccgagcgacggcggcgccgatgcggctaggcgcggctggcggccgctcggcgcgagcgtggcgccggccctggcgcaagtcgcggcctcggcggtgcggccggcgtcgtcgtcatccctccctcctgcggccaccgcatccagttcaagctctacgtcctcgacgacgaggtgcacctcggcaacaaggcaagtcgatcgaacaatcttttagcgattatctttgctgtttaaggattaattaactgtgattgattcttgattgcttacaggtgatcaaggataagctgatggacgccatcgaggggcatgtgctgggagaagccaagctcatggccgtcttctaagacacgaactctctgcattttgacatccccagcggacggcgatacctcccgtgacgacgaccaacgacgagcccctatatcggcgatacctcccggccgcatcaacagccagagcaggaccaggagcgcgctcgccgacgacctcctcctccggccacctcccgccgccgccgacgccctccccttctcttgcgtcgctggtcggcgccgccagcagccgaacctctcgcccaccgctgctccgccggtgaagagaaaagtgaagaggagaagaagactgaagaggagaaaaagagatatgtgaagctgacatgtgagccgtatgattttttttaatttttttgctgactagtatgtcacgtcaggaaaaccgggcaaaaatactgccaaaggacctccggtggtgaacggtttgactgaatttaggggcagaaggttttgtggttgatggacctcgaaaaatctcgctgtgaagttgagggacctctggtgaacttattccctctcgacgcatcattactccgctacggcccatctaaccaattaagcccacagaagcgattcggctcggcctggcccatttaagacgctcctcttcttcctcttcctcttcccgtcccgctcccacctcgacttgaaaaccctttttcccttttccttttcccccggattcgcgtctccatcgttaaatcgcaatcaatgcgtatgatttgctttgatttttccccaaatttcttgaccgttggtagggcaaagccaccacgctcctccacttccctttcgtctccctccgccgcgagaggttcgcctcctctcccttcctgcgacttcgtttcgttttgggttcgtttttggtgtctcgggtgctttgcgaatctcaattctggggtttggatttggtgttgcgtccgggatcaagcgccaaatcaaggggttggtgcttctgaattctggggttaggtttgtctcctgtggcttgttgatgctttgctggcgtgttttggtttcatttagccttgcgtgtcacctgctcgatcaatttcctggcccaaactagtttgatgtgtggtttagttgcagagttccctgcaaaaggatacgtggaattgcttgaaacttcatttagatatcgcttttcctgcttggttcgttactcctgtttaattattattattggctattcctccctcgcacaagggtttgctattgtatatttgcagatcatctggtgtcattcagtagttgctacaagatttattctcgttgctacttctttgctgatcaagattcgctccttgtagggactgattcaattgtggggatctgcggatgttctgaacatttgtaagatgagaaggttctttttctttggatcatccaccgcaagcactgggaatggtggtaaaacaccaagtgacgatgatagcaggattaagaagaaggcattggacggaggtgacagcaatggcagctccagttccgcttccaattcccctgtcacaaaagtgtgtagatcaaagagccggcgtcgaaatctgaacaatgaggaaccatctaatccgaagcagctcaggaggtctatgtccttctcatcaccagccggcaacagtttcttgaaggatcggagcttcagcttctcgggtgatgtcccatcttctctgtttaatgaatctgatgcacccgatcatgttgctaagtaagtgattggtttacattttgattaccatcaacagttcaatagtgcattgaaacctaggatgtttttgccatcatcaaaccaatacatggtagcaacaccctattcccttttttatccatattagtagaaacaagaaaaggagaagtattgtgcacttgcaaactttactcatttcagcttatcagctataattgttaaatgcttaattatacggtggtgattgccctccttataaattgttcagccaatgcactcagagctttctttaggcatttcagttacttgtaaatcccattttcccaatgtaattcttcactcatttcaactagaatagttttagatggacctgcaatcctcactcattaagtgaattatgtgcaattgtgactctaccatttcctttcatctgagtgatgataataaagtgtgtattttttttgctggtcctaacagtgcgtactgacttgcagctgctatgcatggtcaccaaaaaggcgtccagccccaagagaatacacaataaaggatccaaaagcacattcagtcctgcaaagtgactctcctggttcgagatgctattcatgctcaacagggcactctcctgttagttctcccattgccattcgatgcaggtcaacaagactaaccaatttattgaacaagaatgaagttctagatcgatacattgatggagagcaggaagccaccatccttggtgagagacagaagcaaaactctcccaccagatctgcggtttcgaatttgggaaggccgcctcgaccgcagtctacagtaccatctttgccaagactaacaaaagagatccttgagacttacccatatgaggatgtaaaggatgaacatctccaccaactagctcaagaggatacaagagacacatgcaagattacaacactgtgcaatgcaagtagaaaccatgcaggtctgctagatgcttctgagagattttcacatttagaagattacaaatcggaaagtgttacttctgttgaagatatctatgaggatttgcaagactttaatcatccctccatcgatcctacttcaggtatcaactcaagatgctatattaccatactcttctatatatgattgcccaacaatttttctgatattggcttgtattttgcaacagaggatgtagaaactgatgacaagttgctccaaagggcaaaagaggttgaggcaaagttcatggtctcttctgaaaaaaaatatgagcttaacatgtccaaaaacaagaggctaagcgcaaatgacatgttccagatgatccaatgtttgactgaagataggaaacaactagcatatgaattgtcttcacagatcaaggcacgccttacagaaaggtttgctgccaaagagcaatgcaaaaatttgaagaaagagttggacatcagaactagaaggctagagaaggaaaagatggaagtgcaaactactttggagaaagagatggatagaagatcagacgattggtcaatcagactatcaagatttcagtgcgaggaagagagattacgtgatcgggtgagagaactgcagagcagaatgtctcctttcagcgagaggttacttttcttgaagcagaaaaggttgatgcttctaataaggttgcttgtttggaaatgggaaacaaaaaactaattgatgagctagagaaagtcagaaacaattgtgacaatctccagaattcatctgtagagttacatgattgttttactaaggctgtggaggaaaaagatcatctcaggaaattcttggaagataaggatggtgaggctaaagcattgcataaagtgatttcaaggctacaaaccatatgcaatgaacaagaaagaacaatcagtggcttaagacagggatacagtactgaattagataagaaatctgttgagtgcagtgtcaagataaagaagagaatgcaaatggaacttattagactgacaggagttgagcagaagttaacaggtgaagttcaatcttgtcatcttgaatcagagtccctaaggcaagagaacattgcacttttaaatcgtatacaaagtactggaaatggaccgcgcttgtcctcaattcgtcttgaccaggagctactagccagagtggataacttgcagatacatggcttgtcattgcttgataagactagccaactgtgcatcaaattgttggaactaatgaaatgcaaaaggcatgaaaatgaagctggcaatggcatagctgcattaactgtcactgactacactttggagttccagagcatcaaaggacgaatccagagtctgaagcaaagtttggggattattagttctgtcctcactgaaaaggaaaatataaagggaagttctggagagactgtagttggatctagtccttccagggagcacacagatgagttacctctggtatgagcacctattatgttttactgtaaatctttttctgttcaatcaagttttttttcctttttggttggaataagaaaagacaggggagcactcagctggaaaaataattagtgtagtataatatgtgttataagttcagcaggtgc

SEQ ID NO: 67511 - DNA, 780 bp, Oryza sativa
tgtgagtcgcacccatggcaattaaggaccggttcacgggaaaccctagaagacttacagcgcttgccacaagcgggagtgggtaactgcttgatctgaagtatagctcgaccctttcctaggcaccggtggcgagggtgggcgtgatggagttgggtaggccggggtgtccggttgtccagctgccggattcgccacggcacaagaggggaccacccactaccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtatagttgtgcacctctggccagagtaaaactattcgaatagccgtgcccgcagttatgggcgatcgaccagattcaccgtgaatagtctcacacttaataaatcgagtcaatgcactgtagtacaggtgggttggttgggcctgttcaacgtggtgtagcgttgatcagtggagatctaatttacctttattattcaacagttttactgtttgctaaataaaatgttttacaaccgcctttatgcaaatagccacaaaccgtccttgtatccctttgcacgtttgcatcattggtgtggcttgctgagtacggtggttgtactcagccttgctattatttccccttttcagaagtgtagtgcttctaagctgaagacgaagttggaagaccaaggctcagaccct

SEQ ID NO: 67512 - DNA, 1134 bp, Oryza sativa
cggggctcgccacccagaggcagcaacagtccatgttggtgaggaaccacttgtgcgggttcatgctcaccgagtcggcgagctcggcgccgtcgaggtagccctggactctgggcagatcgccgcgctgccggcgtacgtggcgtcgacgtggagccacatgccgtggcggcgcgccacctcgccgagctcgcggacggggtcgacggcgccgatccccgtggtgcccacagtggcgcacaggtacagcgggaccagcccgcgcgccatgtcgccctccaccgcggcgcgcacggcggcgcccgtcagcgcgtaccccgacgccgccgccgtcgggacgacgcggaagttcgccggcgtgatgccgaccagccgcgcgcccttctggaacgtggcgtgcgtctggtcggaggcgtacacccccagcttcacgatgccctcgtgcccaatcctccccagcgcgcggtcccgcgcggcggcgagcgtgcacaccacggcctcgcaggtgctcccctgcagaacaccaccgccaccgccgccgcgccgccgccggagccggagaagaggaagcgatcaggcaagcccaccagcctagccatccagtccaccacgacggcctccagctccacggcagccggcgacgcaacccacatgaacggcacgacgttgagccccacggagagcatctcgccggcgaacccggcggcgctggcgttcatcgggaagtaggcgaagaagctggggctctgccagtgcgtgagccccgggagcacgtcgcggcgcacgtcagcgaggtccgctccgccggctccccgaactccggcgcggcctccgggaggagcctgcggaggcggccaggctcgaggtcggcggcgcggacggggtacttgtcgacgtcgcggtagtagccggcgaggaagtcgacgacggcggaggagtcggcggcgaaggtgtccgggtccagtggctggagcgcgtcgagtggcaagctacccatggcaaggtcacgtagcttgggcgagagtgagagacagctcaaatgttttgtgtggattttgtacttgagcaagacgcgcgggttcgggagctttatatagcgccaaaatttgctactacgagccataattcaatcag

SEQ ID NO: 67513 - DNA, 2788 bp, Oryza sativa
ctcttagtaacactgatgtctagattttctttaacttccatctagttaaatcaaacagttgagatcattgtttgtaagagttttgcttgatctaaactgaactattcatttgcccattatttgccattgatgtcacaacgacatgtgagctatatgttagtttgttttagataaggccataagggaagtgacaagctcccagcctttgcatcatctaaggatgcacacagccattacatcaccaaatgctaagcaattatataagttagtgaaataatgagtctcgaagggattgggcaaattcaatgctatacagtatgggaaagcgtaataaaatacagtgttctttgcaatgaacaatttgtcgatttcacttattaagcagttcaaccattccaagcaaattcaggggaaaactcataccatatcaaaaaggcccgtagtaacagcacaaaaattcaagggaacggaaatgttcgcatggtctgtgcatattgtacaggaataaccccacataccaaatgctcgtcagggatcaggaccataggagccgcaaagtacagcaccggtgaatctaatctactctctccgtttcaggttataagacgttttgactttggtcaaagtcaaattgttttaagtttgactaagcttgtagaaaaaaataatagcatttttaacccaaaacaaatttattatgaaaatatattcaaatattgatttaataaaactaatttggtattgtaaacattactatatttgtctataaacctagtcaaacttaaattaatttgactttgaccaaaatcaaaacgttttataacctaatttcagagagagtaactaccagtagattgcactagaaaattatgcacgcattgggcatttgggccacagcaactcagtaaactaaaattcaagttaccagtggctagtcggttactcgggtgggcgctctccacaaaccgcaaatcataattctgcaactacttcagtactttcaaactacagttgcctacacagccgcacagaatgctatcacgaagcgaatgaaagcaaaagcactaaccgtccagcgcaaggctgtggtaggcgccggatgcgacggccacgaacatgggccgcggcctcccgccgccggcgaccacggtgggcacgtgctcgtcggcctcgcgcccggtcccgagacggccgaacatgccccgtccccacgagtacacctcaccgtcacttgcaacgcacgcacgcccagcaaaacccacaaaagccacgctctcagatcccgaatcccgccgatgcctcgataattcgccccgggagcaaagcgagcgccgttaccggtgagggcgagcgtgtgggcctcgccggcggccacggcgaccaccttgggcggcatctgcggcggcagcggggagcagcggtggagtggacgagagggcagatgaggaggagtgggaggaagaggagggcacgagtacaactggaggcattaccgcgagagcaaggcagtaaaatgagcagcggaagcgaaggcgataaggactcgagcgagtcggtgtgcagcacggcaagtcaccgcttgcggaggagctcgtcgacgtcgacattgacttcatcccgcttttcccccaagaatgatccgggagatggctttgggacgcgtgtcgcggcgctgcatcaccggaaaaagaggtggttggaacttagaattggcaggtgtgctgctgatggtgcgagtcgctagtgagatttggacaagtttggggagtacattactcctgtggatgtagagttgtagacactggcaaccaattcagatatctgatgaactactacacattctgcatctaggaaatgttgtgcattgcagcgagaggggattcctttgtacaagcagcaaacgtcatatgttctactaagttctaacacattttgggttcagttgattatctcacatacccacggtgcaagtacatacagcaccctgcaccctgatggttccacaaaggaaaagaattacgaccttctcaaactctcacatatttgacagccagatgacatcgatcacagcagatgccgcaaggaagatgcaactgagaaaggcacacgcgatggaggccgctgacaagtcgcagaaacgtggcagtggcttgcagaagttggggagcgccgtgtgccggatgccggtgcggttcagattcgcgactgccgccgctgctgatccagcactcatcattgcatatgcgaagatctgcacgcgaatgaaaaacagcagaagttagatgttaatcttgcattccacgggaaatgtcaggccaaagccaaatgttcagctgctatttgttgaactaaagaaagttgtggggttgcaatgggaatggaaagtaaagcagcttaatgacaaagagtttttaatcaactttccatcggatgatgtgagaagtaaaatatccacttgcaagagctttgattttgagacctctctaatcaaggctagtgtggtggagacaggtatgacagaagaggctgttgatgagctagttgctgtttgggtcaaagtatatggcataccaaagattgctaggaatgaggatgctattaagtccattgctgagttggtgggggaatttgaagctctagatggtgctagtatcagaagagatggtccaatcagagtgagagttgcttgtaaggaccctagggaattacacttcgggatgcatgtctatatcaacaaagtgggatacttaatcagatgggagccagaagggtattcgtctattgagaa

SEQ ID NO: 67514 - DNA, 3195 bp, Oryza sativa
cggtccggcgaggcagccgcgcgtgcggcagcgagcgccgtagcggctccacctcggctggctggggggcgcacccaagggcggcgccaagccgtgtgctacggcgtcggcggtccggcgaggcggcgcactagcgacggcaagcgtctatgcggccggacctcgtcagcgggggtgcggagcccgaaggcagccgccaagccgacgcttcccgtccccggtgagggacggtggagagacaagctccaaggcggcgcgcgcacggcggtcaaccggcgcggccccgaggagaccggagagctccggcaagcttagggggtctaaatccggtaattaacccgaactcaaacctaattttgacttgaatttggatttaattctggtatttgtgacttagggttcttccccccaaaaattagggttcctcatttggggattttaggccgattggatccggcttattggggattccgggaaatttcaatcttgtttattcccttttgcttaacagtggggaatttcaatctagtttatcccctgttttccccaatttacttcttaatccactgttcttatatgataagaacctagggtttatgagttgggaacaatgagagtttcaatctggtttatctcattcgttctccgcttagtaaaattcgagagaaaaaaaaatctctctctgattgaatttctccttcccttactgatttctagccgaagctatgatttacttaagcatgaaccctaattcgatctaattaacttaaatatgacataatgctcaacacaaagcaactttaagaactaataaacagaataaggggcttaacagattaatcatggcatcatgccgggcttaacagattagggttcatcacttcattggcacagtgccttcaatcagggatgatgggatcaagtggctaagattagtatctgataccacaatgttggaatttaatccaattaattaattgaatcttagcctaaacatgatcaccttctgctcatgcagaaattaattgatctaactgacctgagatgaagccattgcttttcttttttcttcttctgttgtgagatacctcacgaaccccttccagtgtctaatcgatcgggcgattgatttagagtttagggttggagagaattgagtcgtcacgcagcctccatccttctctttctttatatagcgacactggtggggctcggggtttatctcaatctaaaattcgaatctattttttaccgatcacacaaaacagatttatctcttagtttgtttcttgttaggttagaaaaatcggtcgaattttaaccttatcctaactaaccggcattagccgataaaatcaaccaacaggatgcaagactattttccaattcttgcaagaactgaattggtcaatgtgaacatactataatgctctctttgctgtgaattactcgttctttttgcttttttttttgcacagcacccaatatttagcgtcaaagccggacgtaaaactggacatctatactgcagcgttccaaagtgtactctgttttggttttgttactgaacctggcgttgccacctctctctgttctaaataaacagtgacgaaataattacattcacataggatattactgatacattccggaaggtgtatagtagtagtactatctgcaactgtgattaagatcaagtggtcagaggctgcattatatagtccatttggcagagtaaccatttccctccaggctctagcaatgtgtgcaatcagaggcttacagatccatggacgacgacttgtaagattcctactttccagagttccagtggccagtgtttggaactttggatcgagtgaaccagatggcctagatttcaacgtcttaaaaaatttgcaaaatttgcaagcggacaaatcatacaagtttgaacagagaaccaatggagaaaccaccaatgctacactgacaacaagcgatcgaaacatcacagccgcgctacctctcaaactagaactgaacgtacacacacagtctcgctacctagtcgctactgcaagtggaacaccatgacacacgttgacaatacgtatgtctagttgcctactttaattattccttccttgatcgatcgatcgatcccgcgcagtcacgcacctcggcgcgcgtgccgcatgcccggtcgccggcgtaacggccggccatgagctgccggagtagctagagccagctggttagccggaggggcactggccggcgttggcggggccgtagaagaggacgctggtggggcagtagatggcctgcaggccgacgggcgggacggtcctggtctccttgaggagcgagaggccgatccacttgtttggcgggtagacgggcttgtcgcacagcgacgtcggcgacgagcccaggaacaccttgcaggtgcgcgggttgaagttgcgcaggtcgtagaacatcaccaggaagtagccgttcgcgtccgtcaccgtccccgtcacgttcaccaccttcttcccgtagcacaccagctgcgccgtcgcgcctgcaccgcaccacgacacggtcagaaaaaaagaaaagaaatgtgtagcaatgggggacagagggagaagaggatcctggatgcgcacctgggagaggtgacgcgtccatgtcgctgctgtagcccctcgacttgcacgttttgcagtagaccacgccctccacgatgatgaacggcagcggcggcggggccaccggctctacggccgtgtcgttggaggacgacggggccggcgccatggccgtgtcggtgtagggcgacggtgccggcgccgtggccgtagcagcggacggcgaagatgacggcgccctggccgtgttgtctctgctcgagacgacgtcctcggccatcgcatggtgcgctgggagcagcaatgcagcggcaagcacgagcagtgccgagcagactacggctgtgtggctcctcatctttgctgaactccttgactttcttttgcttggcgctaattttagttaagttgcagtgtgtgatcagcgttgctccggcaccggctaatttatagggcgatctgggtctcgacttggccttttactaatttgcagtttgaccaaacaaacagcccggctaaatcagattccgttcacagttaatgcgtttcccgtctacgagagtagcctggggag

SEQ ID NO: 67515 - DNA, 2374 bp, Oryza sativa
agtgtcgcgttctcggtgaagcgagatcgacccgttcgtgaggatgcgcgcggttacgtggttttgagcggggggcgcgacctggtttgacttcacgggtaatgatgactgcgccttacaccggcggcagcctcgcgtcccggccgattgtttagtcgcgggcgataaatgcaccattagtccaggtaatatgaaatcctgcctgtatggggagctggggttaatctgccgcaacttgctgcatcagattccggtttactgcgtcaggtgatatgtgctattgctaccgatcggatctgcggcggacgagaggcctcaccatcgatcgcggcgctgaccgtttcacggcgcgtactgagatgccctctgcttgtcacttgtcagtctgagtctgacgccggagaactgagcgatagaaggtcttccgcggcagagagccagagatgttccagctgcgtgcagccactctgtatgcagcgtgggaaaatacatttgacaactctcaaactctgcagcttcgcgttttgcctccaccgacaaaggagcgcaacgggattttgcatccagtgcggtgcaggtgcagccgtgcaggtagcgatcatgcgttgcctgccttgtccacatgtagcgcacaccaggaaaggagaccaaattacagaccgaccgtgattaccactcgaccgggagattacggactgataatgcacttcactcttatctcccttccactttcgtactaaacttttccccctcacgtggttaaagaaaaaaagtataattgacaatgcatataacaatatcagagtgcattaacgtctgatggtgcatataaataaatgtacgtttgtacgcacgctatgaaaatgcatgccaataataaaatctaggggttatctattccttggtacaaattcattctttttagagactttttacgatcagattacaccatgagtcatgatcatacaataacattttatcctcttcttccctgtgacacccgctcgcactgtcacactctaacccgatcaccgacttatgctagcggcaccaccaagacctgctcaaactggccttcgccatgcccattttctccccgtcccctgtcacgagtgctcatattccctccggtttgataatactagtcgttttggacaagaacacggttttcaaaaaacaactttgactactatttttcattataatacgtataaaactgttaacaaatatatgattttattaaagtactttttgagactaatctatacatgtagtcaccatatttgaaagataaatattttaaaaatgatcaacccgaagggagtacttgtctaaatggcaacaagatgctcttgctctcatagttatttgcgtacgtcttcaccaatgacgccatcattatccccgcctcctaacccctcacagtaatgcatctctaccagtgacgccgcttactggctttctccaaccccatagctttagtggtgccgcaaccgcctttccagttgccacccttccatgtttgctgccccaccgttggtttgtcatctctcagtcatccatctaagctcaaaccctcggtactagtgttcaaccctagtgttaatgctcacagcgaaatcctaactattagccctagggcccaaacactagtattgtttggtctcaacttgttgcattgaacaagttgaaaacaaccgccaatcagaaatagcccaaaataaccccaaaacatcaacttggtatgcaacctcagcctatctggaatcaggagagtactggttttcggcccgtcaaagatttaaagtttttcagaggaataagttcatcggaggtccctcaacttaacagtgagattttgagccgtgcactcaaggtcctattgtagtatatatgggtggtttcgctgacatggcatcctagtcagaattttttttaaaaaagtatgtggggcccacatgtcagctacaaattttttttcttctcttttctctcttttctattctcttcttcagtgagagagccgtcgctcgcccgccgtggcgtccttgctatcgccgccgccgccgtagtcaaagtggtggctcaggtagagcgtcactggagagacggagacgatggtgcgagcaaggcggtggtcgggccgcgtcttccgctccgcgtggtgctggcgttaatggtgagcaccggcaaatccgggccgtcggcaccgacagtgctcctgacctccacgatccgtcccccatctccctctgcccagggatctcgagcgcggcggcgtacgacgcctgccccctcagccgtcaccgctcccgagggcagggaagccacctccacctccagattgcccgatgcgaagggcgggcggtgcctg

SEQ ID NO: 67516 - DNA, 9190 bp, Oryza sativa
agatggctgcagaagttgggctgcggcgcggtgggaggagcatcctcgtggtagtcggacgagctgtcggaggaagccgatagggacggcgacgtggaggacgcaggcgccggtgtgatcctcttctcacccccaccaccggctatggccgcggcaatgttgttgttgttgttgtgatccccctcgtcggacggagcataggcagcggctccgggcacgggaggagcagaggggcggggtagtgtggcgggcgagcaccggctccctcacttaagaagagaagaaagaaaagagaagagaaggagaagaaaagagaagaaaaaaagaagaccagggtgtcacgtcaacgaaaccacccatatatactgtcatagaaccttaagtgtatggtttgtgtgagtttagggatacacatttattttttggttaagggacctaaaaaagctcgctgttaaattgagggacctctggtgaacttattcctttttcagaggaagccactgaggcctagatttggctattgaagatgggcttggcccagttaaggcttggtgcaaggatacgaaatcttgtccatcaacggttgatcagacggtcatcgattcagcggcctagggttttcgccccgccgtttgtaggattgcggctcttaaaagcccgggggcgactagtgaatccggaagggcattgcgcagcctccccattctctcccgtcgttgtggcgttttttttgtttcctccttttgctttgggatggctctattgcttagcgtgattttacctctcttgccgttttttcagattgatttgcaacgatttggagcaatgatgagatttgagtatgatctctgtgatgtgatttataatctctatatcgctacgtcttgctgagctcctcgttgctgttatcgttttgtttgtcgttgcttctttgagtctgtggagacgagcaattttctgctgagatctctcactgattttccttcggtctggattttttttgttctttttccttttctttttgtctaaagtgaaaacaagattgacgaaggtaatattcagtagtttccgatgtgatgctaatattcgcctaatacatgacgccgtgcagagagttcccatgagatcaggaaacaaaagatgagctcttgccgcaaacacttctagatattgcttaaccccggaaaagttcagcataatctttcataatagaacactggctctaagcagcaataaaggaaatctgaacgtcaagcgtccatctgtttctagttgaaccctgcataataccgaggtttgtaaggtacaaatacaatcggatcacccaattcatacataaggtacatgattcagtcgtatgactaacccagtttaaggtccaagccattgcttagtgaggtggatccacattccacatccttcagagtctgtgcatgagcaatctgtgcaggaaaattacagagcaacatctaaaatactgaagcatttcaaaatctcagaaagaaacaaaaaggagggtttgagaaatcaaacaaaaagttttggtcactttctctacccacgtaacccaatagtaagctactagcggccactgtaggtaggcttcatgagctaccctgcatagtttcatgtaggttgatgcagttgctttcacgaactgaaagctattccacttccatggtaaaggggttccatgaaagggtctatatgttctaggttagtatactttgtgtctctttatgccttgtaatggagcattgctcttgtctagcatcggtctactgtgcctgtgtatgtagtaccatgagtagggcatgcacgcttcctctgaatggtgcttctatagtcctatacttgcgtctatctttatactgtatcctatagtctgaaaaaaagaaccaaatatccaggcacagcaacaaaaggggaataaatttaaaacaaatctaccatggtttttcgatctattttctgtcttatttttatttttggagggaaagctatgtatcttgatccgtcaactaaaataaaccaatgatttctcagctaaccattcttataggctagtatttgcttatttatctctaatttagagatgaattaagatctgaaggcaaaactacaggaccaagaacaccaaagaacttagctacctgtttggatcaatgtctttctttgcacttgtgggttcaatacttatatgaaattgctgccaagtgctatgtttctcacgagtgtttgcctatcatctgtcaacatttgcctatgaagaacatttacacaagatttctttttgaccatttgaaagggaaaattgatgatgacgatgataatgaactgactaacaaacgaagatagtacaacttgataaatagccagaatgattatattctttaccttgtcgcacagcccgtaccgctcctcttgtcgccccctaatctgcacgcagataatcgaaaaacacatgtatattactagtgatgtttggtctcggttcacaacgcaatctgtaaatctgtacaagtgtcctgacggcacaggtatgaatcgtatcagaagtgggccgtgtttacgaaagacgtacaatgttctggaggtagcagatctcgcctccgatcttgcggtccttctccgagcgcaccttgcgcatggcggacttcatattgtgctggagcgcctccagcgacggcaccgaggactcctcgccgtcgtccaccgtcatgaacctgccaaaaacacaaaagcacacacgatatcatgacgagtgacatcgatcagctcgcatcgagttgcttacctcagctgtttctccaggaggtcgcacatgctgcccaccttctccagctcggcgcgcctctcctacatgcatgcgcggtgccaaggaagagaaaaaaaaaacggcgcacgtttatttactggtgagaaaacgctcaaacaactgattactacgcgcgttgcgttgtactacgtgctacgtacctgcctgatatctgcccaaaccttggtgtgcgtggtggcctcgtacctctcgacaaactccctcacgctgcgccaagaaagaagcagcaacgaaacgtggattaaccaacaatgtcaggagacagcgcgcgcgcatatacatacgtgacggatcgacaagcggatgtgtggcagggcagcttacgaggggacggtgggggagaggaagtggtagagcttgccggaggcggagaagaggaggaggaggaggtcggcgtcgcagaggacggcgagctccctggccttcttgaacaggccgtccctgcgcttgtagaaggtggactgccgctgcgtggggttctctatcctctttatctcgctgcgccccctccccattctggccgatcgaatcctccctctcctccccgcgactccggccgccttcccgaactcgcaaccgcggcgcggagcaggcgctgcccgttaccgaggcgttgcgagaataaggaaaggttcgccgctgtagtgtatgtatgggagagattttgcccaggggatgcacggttatttttactgttttaaagaggcagatggaggaagaggagaggagggggtgcgggaaatgaacaagatggtctagtcctgttacatgtcaggcgccgcgtgcgtggcttttgcttcgctgcaggggtggtagggagcatggctgagagcctgagacggtaatatgtacgtgacatttgccaaagcgacggagacgcgtcgagggcacaggcacagtgggttgcagggggggagtctgttgctcccgcttacgttgtactactactgtactcctgcggggcagcacgtcgcgactatagctcgagagtacttctactgcattttgttggtttcgaaactatctatcggctcaaagcccctcaagcgcgctgaagagccatcccagtatggccttgtttaggcaccgtttagttttcaaaaacttttcacaaaaacatcacatcgaatttttggatacatgtatgaagcattaaaaatagataaaaaaaaactaaatgcacggtttgcatgtaaatcgtgagacgaatcttttgagcataattagtccatgattagccataagtgctacagtaacccatatgtgctaatgacagcttaattaggctcaaaagattcgtctcgcggtttccaggcgagttatgaaattactttttttattcgtgtccgaaaacccctttcaacatccgatcaaacgtctgatgtgacatccaaaagttttaattgaggaaaattttaagtttgtttgtcacatcaaacatacggacacacatttaaaatattaaatttagtctaataataaaataaattacggatttcgccagattacggatttcgccagaaaactgcgagatgaatttattaagcctaattaatccatcattaacaaatatttactgtagtaccacattttcaaatcatggcgcaagtaagcgtaaaaaattcatcttgcaattttacacgcaatctatgtaattggtttttttttctaaatttaatactatatgcatgtgtccaaacattcgatgtgacaacgtgaaaatttttattttggtaactaaacagagctatgccactgtacgtgtagaccgttacattttcacatagaacataaatacgtttttcagttcctaagcacactcagtattaagtatagtcgtatactatttgctatactccgtttcggtaggtctgagggggtgaataattgagcacacctgggtgcaaaattgataagagcatcctcaacagctcatctaaattccatcttctatactcttatttagatagtcatccaaaaagattcctactctatattacttttcactccaacagatcatccatattacatactatattttactaatttttacaactaccacatatgtatcaccactctaacaaaatttcccacctttatctcttcactccccacctttctctcttctccaccgctgatctccccgcctttctctcttctctaccgccggcgccgagaggacggggaggacgagggccgaccggaggggcggccggcgggtccatctccctcctcctcccgccgatggcccgtcgccaccaccacccagtctctgtgaaggggcggcgcgagcggcggaggggtggcggccggcggggcagaggggcggcagggtcagaggagtggtgcgggcagcggaggggcaacagaggagcggtggggcagaggggcagtggggtcagaagagcggcagcgccggcggagaccctgagcgacggggacggcggcgacctcactaccagatctgctgcctctccacctctactctggtgatctccacctccaaatccggtatgcacctcctctctcctacggtatgcagtccatatggtggcgcgaggtcggcagttgaggatggcgtgaggggagagaacctccatatttagcttgggaaggacgcggtttggaggtcctctaaaaatggcgtgtgtgatggaaggtctgctggagcgttgtttttcacctccatgcgccaaaaaggggatggaggaccggatagaggagctgctggggatgctctaaaggacagatatccgcgcgcactgcccccacgcggctcagccgcatgacacgcgtggaaaggggacggcggaagggcgcggggaaagagggcacgtggcggtttttcctcttttttctccttttttttagtatttttcgtttttacacattaaaaggtatagacacacacgtataaaaaaacatatttttgtctactgttagtattataataccaatattattaagtgtaaattagtaatttactaatacaatgattagaagttaatttgttatttatgtttttttctaactaaatcgatctacgatcatccattacattgggatctctcaatattcatcgaaaaagcaaaaaaaaaagagaaaagaagatttagttactgttaaatgatgattatactctctgcacctattttgacagtaatatccctccacatttctattaccgttaattagtgtgataatataaactagctgggtgacccgcgcaattgcgcggctagtagccaaacaaaatcatataattttcagtatgattttacttaagatttattaaatagctatcctcgtatttctaattatataatttttaaaagtcacaccagctgctaccccttacttctctcatatccttctttatttatttgctcggtctatcactatttctattcattctcctttaaacctctaaaaattggatcttatatatagttttttgagtttattatctcgttgagtttcgtttttataatttctagaagtcccgtcaaacgctgccattatactcctttacatcctgtctactctcttttctctttattgtcattgggattttataaattgaacataattattgttcgggtaccatcagcggctttaccattgtaatcctttatggctcgtccgttgcctcccttctttattatcattgagattttaaagtcgatcatgattatcattgtcttttttactttttagaagttccgaacctttaaaaattggaccttgtagtttttagagtttattgtattgttgggtttcatttttttataatttttagaagacccatcaaacaatgccactatacacctctacggcccatccaccacctatttttcattgggattctaaaaatcgaacataactatcgttgtaatttattttgtattttatacaagtcccgtcaaccgtcggtgcctctgcaactgtactcctatacaccccacacgctgcttcttctttttattctcattgagattttaaaaatcaaatatgattatcaatgggttttttttttactttctaggagtcccggcaaccgtcttgctatttggtgttttaatcatcattaggattctatttggtgttttactaacagtttttatatgtcgtatcaattgctaccactctaatcttttataggcctgttacttaatttatctcgtcacgtgttttagatggtctttttttaatagtctttattttttatcatcattttttttatttataaattatattcctaattgaaatcttttttcctttttctaatttcagaatttatttttttttcaaattttaattaataccgtatagtgttcttttaatattttgtttttttttattttttgaattttagttgtttcaaaattatattcctactttaacttttcttttctttttgctaatttcggtttttttatttttattccgaacattaactaatcttgtattgggttcttatatggactcttctctcaatattccttatttttaattccgaatttcagctatttgtaaattgtattcctacttgaactcttcttttattttctaatttcagattttattttatttttattttgaatttgtattaatctcgtattgggttcttatatggaaacttctttcaatatagcttatttttaattccgaattttagctatttttagattgtatttctacttggactcaccttttctttttttttctttttctccgattaatgtgggaatttctagcccccacagcgaacgtggtgcctcctttcaaagctgttttaatactataactagctgggtggcccgcgcaattgcgcggctagcacccaaacaaaatcatatcttttagtacgattttacttaaaatttatcattgttttttttttactttttagaagttctaaacctttaaaaattggacttatagtttcatttttttataatttttagaagtgccatcaaatgatgccactatgcccctctacaacccatctgtcacctactctttattgtcattgtgattctaaaaatcgaacataactatcgttggaattcattttttattttcaagaagtccctcaaccgccggcggctctacaactatactcttatacaccccgcccgctgcttctcctttttattgtcattgagattttaaaaatcgaatatgattatcaatgggtttttttttttactttgtagaagtcccagtaactgtcttacttgtttgcttcacggtctgcctgaagtccccccttttaatcgtcattaggattctatttggtgttttattaacaacttttatatgttgtatcaaccgccaccactctacttctttataggcatgttacttaatttatctcgttatgcattttagatggtcttttctttcaatagtctttatttttattataaattttagttatttataaattgtattcctaattgaaatattatttttctttttctattttcagaatttattttttaaaaaaaatagttaataccgtattgtgttcttttaatgttttaattttttattttcaatttcagttgtttcaaaattgtatttctacttgaactctctttttatttttctaattttcgatattactttatttttttgatttttctaatttttgatattattttattttatttatctcgtattgggttcttatatggattcttctttccatattgcttatttttaattccgaatttcaggtaattttaaattgtattcctacttgagctcttcttttattttcttttgctaattttggatttatttttatttttattccgaattttaattaatctcgtattgggtttttatatggactcttcttttaatattcctttttttttaattccgaatttcaggtatttttaaattgtattcctacttggactctcctttccttttctaattttggattttattttatttttatttcgaattttgattaatctcgtattgagttcttatatggaaacttctttcaatattgcttatttttaattctgaatttcagctatttttaaattgtattacgctctaatgtgggaatttctaacccccacaacaaacgtgatgcctccttttggcccgcgcaattgcgcggctagcacccaaacaaaatcatatatttttcagtatgattttacttaagatttattaaatagctatcctcgtatgtctaattatatagttttgaaaagtcacaccagctgctaccccttacttctgtcatatccttcttttgtttcctcggtctaccactatttctattcattctccttgaaacctcttaaaattagatcttatagc

SEQ ID NO: 67517 - DNA, 6993 bp, Oryza sativa
ttccgctgatcaacgccccccacgggtgtctttccatgggattttgtaggattcggccgggttacccgggcatgggtggtgagtactgagtagtaccggtgagaagccagccagaagcggcgtcatggtgggctggtggctcctttcctcacaggctagctacctactgtagcttcctgccgtggcccttgctagcactagctttacaggggaaagaccggaagacgacgacgagtcgagctctctcagctgtgcaggtgcagcactggttctggctagctcctagctcccggccactactgtgactgatggcgacgcgaggactgcacctgacacgacctatcctccctgcatcttgtggacggacggctccggctcatctctatcccaggctctcagcccataacgtcggactaggataactagctactcaaggatcatggttctggtccggggggcactgtagagcgtagagttgtagacatcgtcacctacgtggaataattgagttgttttctgatagcggtgtagcggagtagtagtagtgttcatctgtctcaaaatattattatcaggataggatgtcacttattctaagacaactagtctgcagggtggatccggtaaaatatagtagtggaggcggaacaaaatacgcagcaatccaacataaatcaaaacatgtatcacgtgtaaattggctaaatacctagtttaaagatcacatacattgaattaatgatacgtcgataattttgtccataccaaaccaatgtcgattagatgacatgtcatgcccaatcgcctattattcttcatgagtagtaatctatacaaagaaaaaggcaaattaatgaatgattgaaacagacttattttcaattcaaataatttagactaaactctgcccgaggtctctttggttgaattaaacactcgttactaggtgcaggatcactgacttttttgttgcttgaactagaattagaataactagctgggtggcccgtgcaattgcgcggctagcacccatacaaaattatctattttaatatgattttacttataatttattcaatagatatttcattgtcttaagactttgaaagaccaaaccatatcatccccgtatttctaatgttgtaacttttataaaagtcacatcagttgttaccccttactttttttttgtcaccctttctttatttgtttgttcgatctaccatggcttatattcattatccttttaacctttaaaaattggatcttatagtttttttagtttattgtctcattgggtttcatttttttatttttagaagtcccgttaaaagctgccaatatacttctctatggctcatccgctgcttcctctctttattgtcattgggattttaataatcgaacataattattgtttgagtttaatttttactttctagagtcccaccaaaccgtttgtactcttctacggctcgcccgcttcttcccactatttattatatttgagattttaaaatcgaatgtgattatcattgaggtttattttttaattttttggaaatcccgccaaccgtcgtgaccattctgcttaacggcatgtccgtcgtcactccttttaattgtcattgggattctatatgggattttgttaatagtttttagatgtctcatcaactgtcaccactctactcctttacaaccctttacaaccatgttacttcttcgatatttattatcatttatcatcgttgtgttctagatgatttttttttgaaatttccatatttttcgttccgatagattttatttataaattatattcctagttgttttactctattttcagaatttattctattaattatttggaattttaattaatctcgttatgtattctagatggtgtattctttaaatagtctttattttttattacgaatttcagttccttttaaattgcattccaagttgaactcttctttttattttcttatttctaatttcggattttattttattttttattttaaattttaattaatctcgtattgggttcttatatatggacttgtatgaaatgagggcactgtattttttttctactgctgcagcctaagcgtgctggcctggtatttccaccctatatatgtgcgggaatgtatgttggtttagaactctataatgtatagttctgcaattgatttttctaaacggacaaggactcctagtacggatggtatgatccataattagattaatatgattatcttttgtacagtaaatctatttagtaattttaaatttgtattcctactcgaactctctttttttcttttcttctaatttcagaaatttatttatttattattctgaattttaattaatcacgtattgggttcttatatggactcctctttcaatattgcttatttttaattccgaatttcagttattttttagattgtatttctacttggactctttttttttctccgattaatgtgggaatttctagcctccacagcgaacgtggtgccttcttttcgagctgtcttaataatataatagatacgcgagtaatgttctttttgacatgttagacaatctaaagatgtatagatatagaaaacaattataagtatcaatcacaacctcattgaacttgaactattgagacacaatcttatacttgtcttttagtattagagtttcaatcacaatcacaaccagtttttggcttgctgcctgcctgccttgccaccttgcgccctcgcagcgcctcgttggagagcggcacgccacctccccggcagcgtggcagcgcaggcgctggaccaccgcgtctcaaggcccccccgggcgccctccaatccgcccctgctagtctggatgcactgtccagatttattatttagtatgaacaaaatcctatcctaaacaacaaaattttgggaggtagtactacgaagccactgccagcaatttctccaaataaaactagctgggtgccattgacacggctagtgtgtgaatgacaaatgggtcccataaatatttattttaattctaatattatataagcgccacgtgggatgaagactaggtcaacgccaccacgtcatccaaacagtcctccaaaatctccgagggagttaaattgtactggtttcaatagttcagggagtcatcctttccaattttgtggttgagagtcatggattagattcccgtcactttaagggagttgaagtggacttatttctatattctatagtactccaatatcgcatttgggctacttggttgggctcgttgctacgttgcatttgggccgtgggagtacgttttgcattgggccggtgagttccttcttctcggcgtgtgtattcgatttgggcgatatgattcgtttcgtggacaggtttggcgctctttttggttgtggatattagggcatgtataatggtgtttaatagtaggccctctttgttatcacgtaagtaaatttggtgacgtgaaagaaaaagagagaagaaaggagaaacatcgttgctacgcatgacaacggctcagaatcgactcttagcatttattaacggaaaatttattgcatgaaggtggagaaaagaaaagaaatataataaaaaatatttatgcattaatggtttagaaatcttattgtctctactattgtaggaggatactccctccggttttattttaattgacgctttggacaatgacacgctctacaagatatatctttgaccttatttttctattacaatatatacaataaataaatgcatgtttacttttattatagtgttttgaaagacaaatatatatatatatatatatatatatatatatatatatatatatatatatatatatatgtttttctagtttctttaaactaaatatttttaaagttattgatgggcaaagttataaaagtttaatctcaaccttgttcaaaacgtcaattaatatagaatcagagggagtagtctctagtggcattaattaatatagagagctcatattaggttctacctttttgtacgtgcgtttaaccggcatgattgtgtttaccattgatgactatagtagtctcatttattaacctgttcaagactgtctaatcgtggttcttgaacaatcgctatgtgagacatgacgagtatttgaggactgtaagcaacagcgtactgctgaaactgaaagtatgaaagagcggtgcagtttgaagcacaattctttgtacaggactggatttaaccatcgtcagtactgttttgtattttacagtgtggtaattctacatcttttcacctggtatatcggttcttgtatcctgaagtttcggggtatattaaatttctttcgtgtgatcaatctggatagagtattgacaatgccgactaactgacacatgttaatatagcgaccaagctagtagcaaaaatacaatcaggtcagtaggtcagcaagtatttcagggaaaaaaaactttgttacccaatgaaataccaactggcctgagagcatcaccaacagattatctataatctttcctcaaaaaattgtttttggtttcctaaactgaaaaaaggaagggaaaaaactcctccctccaatagatagcctaaattcattccctaaaacttaaaagtttttttcttccacgcgcagaaagatcgctatcttccacgcgcaggaacgggaggagagagaggcgggagtgcgagattgggagcgactttcgcgagaatgcacgcccgcatataaacggagtgaggaatcgagagaagggaactccaaaactcgggtagaagattaggggatttgttagagcagttttttagactaaaatcccttaaaatcagttttaggaatcagatatgtagactgttggtgatgctctcaagtcaagtagcggacgatatgcgattttttttaaaaggaaaattggaaactctaccaatcagttaagaaggaaattaagtgaagtacatgtccacaagatcggtccaccggccaggtcgagcaaatatatactatataatatatacactacatattatggggtacaagaatggatactttcgggaaacaacctctgcgcaacgatcataaatttctaccacaacttgaaatcttgaataatggccagtagccaagtacattgtcggtgtctgccgtctgcgtggcatggcactgctgaacgacgcgtggtcgatccaggtacatgccattcctatgtatgcgaattatgagagcagaccaatggtaggtgaaacaaagaatgcatgaactatagcagatatgaactcagcagatatgaactcacgagccatgacccatgagtgtgttgaagacgagagcctgtacatgtatcggagaagaccaaagcaatgttgctgttcatttaagggaggaagcaggtgaggaaacaacattaacaccactgagcacacactgcgcgtagcaaaaatgagcccatcaccacgtcccagcgtcccgctccgctcttcgcggcgatgggcagcgccgtgccgacacgacgccccgagatggctacctagctgacacgcaacgccggcctccggatcgatcagtaaagagagtgcagtgcagtgcagcctcgtgtcgtcatgcacctggaaggaaaaggttactgtatttctgcttgtgtgcgcgattttcgctgctagctggcaatcgtgggatttgcagcgtactgtgcaggcccagtgtaactcgacgccacgccggcccatcgtatttaatgagctgagtgtaagcaggtacacaggccgcccaactaacctccttcacggcgcatttacgcttgggcatggccggtgtaaccgtgcaagcatcgtagtgccatcgatcgctgctgtaagtttgtaacatgtgcgtgtcctgcggagagttgtgtgccgttgtgcatggaatggaaggcaaagcataacatgggagcttttcatataaaggccaccagcacgcgggctgccacttcaagcttcagctcgtgatcccatcagatcagcaagcagtcgcgaaatggtgccgatggctaaggctctcgcggtcgtgtccgctttctgccttcttgtggcgccggccgccgcggcgcgtagcctcgtcgacgtcatcggcggggcgttcggtggccggaaggactactacacgcccggtcctactggccagcaccactcttctagtcccagtcgttcgtacattacccagtctcttccatatcttatcttgctactgctcggttacgtcaactggtcaaacgtacgacgtaatgttcgtgcgtgtacgtgtttcccatgcagattcgcacaaggctccgccctgcgcgccgacgccgccacagggaggtggtggaggctacaacccaccctcgccgtccattggaacctctccgacaacgccgggaggaggtggaggctacacgccgacgccgagcgacacgccaccctctccgtccagtgacacctcgccgagcactccgggtggcggctgctcgtcctcacccacgccgtgcgacgcaccgccctcaccgtccagtgacacgtccccgacaacgccggggggaggtggaggctactcgccgacaccgagtgacactccgccctcgccgtccagtgacacctctccgacaacgccgggtggaggtggaggctacacgccgacgccgagcgacgcgccgccctcgccttctagtgacacctctccgacaacgccaggtggaggtggaggctacacgccgacgccgagcgacgcgccgccttcgccgtccagtgacacctctccgacaacgccgggtggaggtggaggctacacgccgacgccgagcgacacgccgccctcgccgtccagtggcagctccccgacaacgccgggtggaggtggaggctacacgccgacaccgagcgacacgccgccctcgccgtccagtggcagctctcg

SEQ ID NO: 67518 - DNA, 2696 bp, Oryza sativa
ccagcgacacctctccgaccacaccgggcggaggctccccgtccacgccatgcgacacgccgccctcgccgtccagtggcacgtccccgaccacgccaggtggaggctactacccgcccacgccatccgtcggcgacgtgcctccctcgccggccagtggcacctccccatccacgccaggtagtggaggctactctccgtccacgccatgcagtgcgccgccgtcgccttcaagtggcacctccccaaccacgccgggtggaggctattctccttccacgccgtgcaatgcgccgccctccccttcaagtgacacctccccgacaacacctggtggcggcaactacccgcccgcgcccaccattggcaacgtcccgccatcgccatccagcggcacctccccgagcacaccgggtggtggctgctcatcctcacccacgccatgcgacgcgccgccctcgccatccagtgacacttccccgacaacaccgggtggagggtactacccgcccacgccgtccatcggcacctcgccatccacaccgggcaccggcggaggctactaccctccctccccttccaccggcggctacacgccgactccggacgttccgatcagcaccccgtcgagcccctactccccgctggtgcccacgccgccgtcgagcaccaccccgatgcccttcgaccccaacacggcacccttcccgtgctcgtacgttacttcgtcaaccttagcgccgcgcatatccacacgtacgtcgtgcataatatggagtatatcaggtgcatttactaatctaacgcacgtgtcgtgtgcgttctgtctgattgcagatactggctgtcgcacccgggcgtgatatggggcctgttcgggttctggtgcccgatggcgcggctgttcgggccgaccgccgcggcgccgttcggacacgacctgaccgtgccggaggcgctggcgaacacgcgcgccgacggcgtgggcgagctctaccgcgagggcacggcgtcgcttctcaactccatggtgaacagcaggttccccttcaccacgcagcaggtgaaggacgcgttcagcgccgcgctcagctcaggaggcgaccacgccgccgcggctcaggcgcagctcttcaagaaggccaacgaaggccacgtcatgcgttaggctaggcggcctctcgatcctctgtacttgaacgtactcgccacgtgaggcggattcgatgcgatgtacacgcgagcatgcgtgcaggttcatgtcggggtggggtttggagtaatccggcgtgtttgcaactttgcattatgtttgatctagagcggatggcctctggaataactataggagagttaagtacgtatgttttgttatccttttagagtccatggccgcacggaatgactacaggagtgttctctgtggccttttaattcagtatgtacttgtggcgttaagcatcagacgtgttctagtatttctagttctatgaactactggcatctttcaatttactcagctcttccataggattcaatactcgaaaccatatgcattgagatttgaatactcgaaactatgtagagaatgttgagaatgagcagttatgtgcatttgagcaactcctaaccacatgatcacaatctaacggtttagattacatcgctacactaccaaaagagtttggttgtttagggtgtgtttagattcagaggtgaaaatttttggcgtgtcacatcggatacaccaacacacatttaaagtattaaacgtaggctaataataaaataaattacataatccgcatgtaaactgcgagacgaatttattaagcctcattaattcgtcattagcaaatgtttactgtagcaccatattgtcaaatcatggcgtaattagacttaaaagattcgtctcgtaatttacacgtaaactatgtaattggttttttccgtccacatttaatactacatgcatacgtctaaacgttcgatgtggcagggtaaaaattttttggtgggatttaaaccgggcctagttcccaacttttcctttaaacttccaacttttccatcacatcaaaactttcttacacacacaaacttccaacttttccatcacatcgtttcaattttaatcaaacttttaattttgacgtgaactaaacacacacaaaatctctgtattgacaggaattgtactactgtgccatgcagtagttactgtagcagactcataatgccgttcacacaggatcagctctgtcctgtgctgcaaatgatcaacatccgagaggagacggtgaaaagtgagaacttgtaacggcgatgtcttctgcaagcctcggtaggcttccttcatattaggattgaggtttcaaggctagagacggtgaaaagactaccatagaacacggaacgagatcctacgtcagagggacgtccaatacgggatcactgttcgtagcgcatctgacggcaccaatcgttcgtagcgccagttcgttctccatcttcgacccagaagaccattcagtcgtcgtcgccgccgccgcctccgcctgcttggtcttatcgccgaggacgccgcctgccaagtccaacaaccacaccatgctagtcactcttcaacatggtcggcaagaaagtgtagtttccaccattgatgttggtgagctacacacctatgcagggaa

SEQ ID NO: 67519 - DNA, 6684 bp, Oryza sativa
atattaaatcgaccataatttgtaagctacatttctagaatacttatatgccttttaaaccagtggaatcattatttctaacagttagatctatcttatataagaaaaaccagatgtgtatatatggtacatcacatttcaaaaatattattgtgcaattatatttcgatttcacattagcttgcatggaacttctgacccactctacatgaaatgttcatacatggatcggctctcaaattacattaatcatattagcctatataaatccatatatttaatggagcatcatgtcccacccaattaatcgttgaataaactatgataatatatatgcaattaaaaatgaaaaatagcttagttttactttacacttacttttcgttgacatgttttctaaagaaaataagtctaccttcttttcaagtgatgtagaagattataaataattgcttatagatattacttaaatatgatataatataaaactaataggttagaaaattataaaagaaattaatgtcgacaaaaacaatttatggaaaaatcgtggtagatgttcaccggttaatattttgctcttataagtgtctcaaacttagcatatgacacatgcccgcgcattcgcgcgggctaccttcctagttctttatagaactcaaacttctattatggcgcactactaaaaagccataatataggacttgtaggactagtcgggcaccttaatagagaaggtgccctttctactgtacagtgccccttcgtttgatggatttacacatttccagattgtagattgctgccatctctaccagctgcagggtgcgatgcaaacctttccatggagacgtctcttaaatatggtattgtctttagcatcagtatgtaggaaggcgtgataaagatggttgttccaacagctgcccagaccgacgacatacccttgaaacaaatgattacaagaacaatatacactgccaatattatcaccatgctaattttctgcaaaaacaaatatcaaccagaaaaaggttagtaagtggaaataagttcagcgggtgaaaaaaatgatattatggtgtaatggctggattcaatagctgtttgtagtggataaacaaaaaaaaccaatacatttgatttgttttgtagaaataaggctgagtagttgagtgacatgaaagtaaagttctatgtatacctaggaatttgctgcattggtggtgaaaattttcagcatggtgagcaataagacatcggtaactaagactcaaaattgggttgatttatacaaaataggtttctgaaacaaacctagacagaatcagtggttccgttatggtaatactgattgacttctgtcagatacgaatacaaatattatatactatagaagcacgacactggcacactgctaaaacaaaatagctatttggtttgatgtccaaacgagaccaaatttggcttgtttctctatttgaaatggccaaaacttagcagatcttgccgcatggatttggcaatgcaaagttcagcttgaattttatgtgattattagtttggaaaataagaaaggtccaaattttaaccgactgttggaaagattgctcggtgccaaactgcccgcagtcagtttgtattgaatcgaacagttttaccagatagggacaccaaaaaattcgtgctgggtgagacacatcagacagggattgaaataaaaagcgggccgtagccttcgatccaaaaacatcagtcagggaggcaggattacagctagaaattaggaagggggatctgaagcttgacttacactgagcacgttcgccaatatttgattcttggtgtcagtttccccctgcttcgtctcgcatccatcaatatcctggcctttctcaagatcgacgaattcggttggttttgtttctccccctttctcaaaatcgacgggcttgggaagctccatctaatccttgtgagattgcctagagattccctgtcttgctctcctaggtaaggcggcgagagcttcttgcagatcttacaaatgcgcgctacggcggcttcgttggggaatatgtgagatggagaactctccgattccgaacactaacgaagaattacgcgcacgcctctccgattccaagtctgtctccaacaccttcacggattcacttacgaagcgcgggttcaaggtgaccgcgtagaatcacattccctcctctgctcccgtcgccgctgctcccggagtagctgaccatggagtggctggcgtctcgctggcgtacgccgacgtcagctcctcggactcctcccctcccatcgccgctgctcccgccgtagcggaccatggattggccgcgcgccgtcgtgctgtcggacgccggagggtcccagcaatgctctggtctccatcgattcgcgcctgagatgctaaaaatgctgtgataaaccctagtgtccgacagtccgaggtacggtggcggcggcggcggaggagctaataagctctatcagccttcccccgttccccgtcgtccggtggacaggttagtgaacaatggatgtcggatcaatgcaaatgtcacataatcctcttgataagggctcttttggaataaaagatttttaaaggattgaattcctataaaaaaaactttaaagctttcttgaaaaatcattaggattgtaccaaatagagattttagagaaaacttagcaagagttccaacctcttaaaaaaatttatgaatctatctcttgaaaaaaaatattatgcaatactctaatatttgtttgaatcaaataaataccatgtatttaaacaagtaaacaaacaaacaatactaataagaaatatttttctatctatgacaaatcgttatatattttcttttacctatagcagagcatgggtattttactgtgtagtagtaggtagtgtgatataattaacggcaaacatagctagcatgtcgactattccaattttctaaaaaagatttcaagtaaaaaaatatagataattttatatcatacttcctccgtttaatattacaagatgttttgcctttttttatagtcaaatttctttatattcgatcaaatctatagaaaacatagtaacatttcaaacacaaaataaacatactatagaaacatatttaatggaactagttttttgtggatgttgttttttttctatagatttgattgagtaaacttgtccaatttaatagtgggatcaatatatttttataaatgatacgaattagattacacctacatttcgagggaataaaagtggacttattatgcatgagtttacgcgggcctgtgtagcccaaacccaattccactcttgggctggttagctttctagcccaatattacacgatgcagcaaagtgccgcgcgtgcagccagtaagaatgtactccatccattcacttcagctagatttcttgacagccactttggttgacgccttgacggtaccaaactgttgaaccggccaggcgcactactagagttctcatacaggtcatatccatctttgatctttattgaagcccaacggccagagatgtaaatctccttcctgccaaacattgtttttcctccgggcctcctgccaaacaattaggccattcgtgcatgcgtgcgacttaaggggaaaactagcacgtagtttagtgtttaccatatcaaaatgcatccgtcagtagtgaaagtttacaagttgcaacagccaatggttcgattgaagactatacgtagtccccattcagcttacaggcgtcgtagttgggttgcggtggcaattcaatacggctatacggccggccggtgcgagagccctcgcgcaacaaccgtataaatcgtctgcatttattcgtcagaagctcaagctcagctcagatatggatcgcacgcatttgtgtccccctggtttgacattcggttgattcacgacctcgaatgaaagagcccacttgctggactggatgtacgacgcactgaaaatctgaggcatccttgtttctcatcgatctgttggcaattcgttcccattagctttgacaaaagcttctcctttcgcagctcaggacagttcagagagcgggaccatagacgtactgtacctcctatagtccatagatcgacacttccgagttcagactttggaggaaggctagagattgaggtacggctaatgagctaagataatgaaacaaccaaaaaaattataggtaattttttatatgtatttgaattgtttgtggcttaataactaaatatagctagtaatgaaaaatacactaatactctcaaggttccagaataattttatttttggtcctcctatttatcctaaaacaagttgacttttaaataatcctagattattatattctgaaatggagagagtaatactaatgtaggcatagattagacttttactagtactacaaatctaaatatggagttgattcattgaactatggctgtgtttagtttcaaagtttggggagaagtttggtagtttggaaaaaaagttaggagtttatgtgaataggaaagttttggatgtgatgtgatctgatggaaagtttagagattgggggaagtttggtgtgaactaaacagggcatatggcatgtctaatactccatccgtcccataatatgataagggtttggaggaatgtgacacagtactatgaatcgatatgttatatttgggacagagggcgtatgtgactagattattatattttaggacggagagggtaatttcatcgggattgataaagtggtgatattctagtttttttaatgtgtacgatatgtgaaaaataaattatttaagacaaagagaatataactctaaacttaaatttaaaaaattatttttttctacggctacaagcaggcgataattcaaaaatcaagtgttacagatgcaactgacctgcagacagaaccagctgaggttcaaaagaaaagacaagtgtcaaccgacgagctgcatcctgtattgggttttccctgttcgaaagaactgaagaatgtactactagcgtcattacaaaccagtcgtccccttgtagtttgttgctcacgcaatcatcaatgcgcgcaagcgcaaccatcgaaaagctccggtgccgaatcagatcagtggatgattttttacttggatttccttttggcaaattgacccccatcagaatgtcaaaccgtggttgttatcttttgatgtactccacctgtattgcgcgcatgcatgcgttgtcaccgccggcccatttcatgggcgcgccacgacaacatctgctgcaggtttgtggagctctggcctcactctcgtacaagtgcggtgaggtaacagatcaccaagtaatgtgcacgccaaagtcatcgtttgaggtgtcgaaaaaggagcgattcatgaattcaatacagtactactgtactagtatcaatttattacaggaacagactctgtttgtgagctacgtgtactcatcatcttaaattacgggagtacagactacagagctccgcacttccgctacaaaaaagccacagatatcctttacatctgctccatcctttccttcatcacggcataagtttgcggatgctgtcaaggagtatatggtactcctaggtactcctactaacacaactacacaagcgaggatgtttaggtgttaggacattaggtgcactgttaaaagtggagaaaagtaccgagtcctgcttgaagtactagcaagctgaaacgacatgactactagagcaaagtcaataatgcagctaacaacggacggtaaaacggcccatgtcagatagtgcagctaatactaaaagctcagtttttactagatcagtccatcatgtgattgggtggtgttaggttggccccacaaaatgtgtgaaaagctacgctgtaaccggacagtaaaataagcgttggcttatttctctctcctaagttctctctcctccatatagaaattaaatgatgtgtcatattttgaagcctgactagtcagcttattgtacctgctctactgatcttcccatcagctgttattcactgttgacgctggccccggctagtgatgtccacactccacagatcgtcaccgttatccattgatatcggtgggggcagtttggtaacaggctaggctagatgcacgggtacgcttggcagcattttgcccacattggtccctggtacggtaaaaatccaagttcagtctccattaaatcctacaggaccagcaacggagcctatagttacatacacacgaaccacactcttagctactatctctatcttaaaataagtttatttttagcttctttcaaaaaaaaaaaaactaaatatcacctactgtatcataataagtttattttttagcttattttatttgttccaaaatatgttttaaaataactattgtatcaatgttcgtgaaagtaaaaaaacagtagtattaagagtagataaagcaaaaaatatttgcattagtatttgataaagtaggtggattatagttttttttttgtttttattgttatgtgtgagataggtgaaatttttttaagggaaaacaacactagaatagtttactgaaaataatttgtactccctccgtttcaaaatg

SEQ ID NO: 67520 - DNA, 8336 bp, Oryza sativa
  unsure (1)..(8336): unsure at all n locations
tcgtcttattaaaaaaaattgtgaaatatgtaaaactatatgtgtacataaaagtatatttaataatgaatcaagttatatgaaaagaataaataattacttaaattttatgaataagacgaatggtcaaacacgtactaaaaagtcaacggtgtcaaacattttgaaacggagggagtagtattttagaacggaggtaacgtagcaaacattttaggacaggtgaagtaagttacatcatgtagtggcattagacaatttaatagtttactgacactagcaatacggtagggaggggacaaaaattgagttgctgctgcgaggtgcaaagagcagcgatgtgcggcgccatttcgcgttgaatcttcagtactattattcactaatccgattaagcagacgaccctagtacagtacaggtatgggtaggagtttacgcgcggttacgccgtgcaagtgcgaaagctcagcggtgggcgatcgctgccaagtcggttgataccagcagaagtgctcgtcccaggagccaatgataagagccaaaaccgacgggctcattctccagcttaactctcacaggtggtactaactgctggcctctggcataactccgactggccgcctgccaccacccccacgcttagtagcattcaaacaagatgcacgccatgcctgggtcagccagcatccaaatccaactcactcgagcgcgagctagcccagccgtcacatgggagatatcgtgcgtacgcttaactaacgagacaaagggccacataattatgcgggggctcatgaccaattaattaacggtgttttgcatgcgagtgcgacgccgcagcgctgcactgcactccactccactccacggcagtctgcagacgcggataagcgtttcgaccgatcgggccgcggcgcgagggaggggatcggtgcgcgcgtcgcagtcacgcccgtgtcggtggtctccctccccctcgcgagcgattcaggtcgctttccgtggtcgaacccggcaaatcccatcgtcccattcattcgctcactcatcgacccgccctccccctccgccgctgccagattcgccgcgccccctaccaggctaccacctttgccacaccctcccagacctcgcatcgcacactgatgcggtgatgcccgcaccgtgccatctctctctcttttttacttctcgggctttccttagtttccttcgttttcccacacgcccacgcgcggacgccgcgtacttagctagcaaggctagctagaagctcccatacttgcacgtacgctttcccattctcttttgcttaaaccgagctagagctttgctagctcagttcgtccatgagagcagcagcggcgggtcggcagcctcgcttgtagctagcgataatgaaggtctacatcacgtcggcggcgccgctggctggcgaggcaacgaaggcgatggcgtcgccgccgtcgccgccgccgcaccagcaccagcaagcggcaacaaggcgcgggtgccggtcggctgtcgtgacggggctcctcgccggcgtgctcctcttccgcgccgcgctctcaccatcgaggccggcgcatccctctgcccttccaccaccggtaagttttcacttcgcacgcaccgaggccaccggcggctgcttggtgaattgcccattttcgtttgcgatatgatcatctctgacgcgattggccaatgctccaggatgcttggactggagggccggtctcggggactggctgtacggcggcagcggcgacgcgatggaggtgagtctttactggtcactggtggtgtgctagtgttaggccggcgcgtgcactgactgcaccttcgatcgtgcgactaacacagtcagagtgcgttaggaaacaggggtgacttttatgcgccggggttttgacatttgttttactacttttgcgcgcggcggggcaaagctgtagtacgggacgaaacacgccgttgggcacggagctcctcacgcggttggggcgatttttttttccgcatggttcggctcgctagcagtaagcgccattcacgggaaggggaatggaatgtcagggccgcgtcggcaacacgtcgcggcgttcctaccacgtgccccgcggccgcccacgctgacaggtggggccagtcgatccgatccagagtgctgcatgctctggattctcaattttttgttaaccactgtcacagtcggccgttgtcagctctcgcctctcggtcattggtcaatccattccgcccccagctacggctcaccggctgaattcaaatgcagaccagtaagccaagtaccacccactagtgttgttttgctcttggagaagtaccccaagttgaattacacaaaaaaatcgtgaaattagtagtactccagtacctttctcagtcaacttgtaccagaaaaacggcctaatccgacgaggagttatctatgcactggttggcgatttgcgcgacccttgccattggcatcattcctcgagggccctaccatagttggtggcggcttgggatattgtgttgccagccgctacggtgcccggcacttgtgacgtgctcgtgaggattctctcgcgctggtggcctgcgctccagctaggacatgctcgtaaagatggcgcccttgcgtttggagctacgtggccttttcagttccgactatacagcggcccttttggcccgtgaccgtgagcctgagccactagctattcatgaacgcgtacggtaggcataacccctgtggtttttagtgctctcgtgtcacattgtacatggactggacgcctaatgtacgggatccaatcaacgatgagctaatcagtactctagtactaatgaccattttaagcaagaccatgtactgtgacagtttgtgtttttcttcactgggtgtgactagttatatactatatccatgtttttctttttctttttttgagaacatactatatccatcttgattgagtttatgaatataagaatgctgattttcgatcgatgcgtggaatggtcaggaattcatgaaggagtggaggagaggtcgcagggaggccagcctgttggatcccgtggtggtggaggcggcaccggattcgctggacggcctcatggcggagatggacaccatgctggcgtcctacgatcggctggacatggaagccgtggtgctcaagattatggccatggtataaaacttatcagcccatattccgacgcgctttctctattacgaactttgctaatctttactgaactttttattagtcttgtatcatgcttgcatgttactggcacctttgctgaaacgagtgctttccacgcctaaagaccacacatcatatggtccatgtgtcttgcatcctgccttgaaattagagaagcggaacgtatggtcatgcatgctctccactaaatctccggttaaacatgcaaacgtcacttttttaggcgtgtccagttgaaatgactgcaacttgaagcgttctttggctgtgtttacttcctgaaattagaaagaagtttggggaaaattgttagtttggaaaaaaagttaagagtttatatgtgtaggaaagttttggatgtgatgtgatataatggaaagttgggggttggggggaagtttggtgtgaactaaacagggtctcatttgtaggagtaggattagattcttttgtagctagggttaggattagaccgtgttgacacttgacactacaatccaaaaatgaattatcgagctttgatccattaatagtactcctatattgcaagttgcaacaactatattcgtcgattttttattggggataatcttgaagcagctgctgaaaatggatcggaaggttaagtcgtccaggatcagagccctgttcaaccggcacctggcctcgctgggcatcccaaagagcatgcactgcctcacactgcggcttgccgaggagttcgcggtgaactccgcggcccgctcgccggtgccgctgccggagcacgcgcctcgcctggccgacgcctcgtacctccacgtcaccatcgtgacagacaacgtgctcgccgccgccgtcgccgtggcttccgccgtcaggagctcggccgagccagcgaggctggtgttccacgtcgtcaccgacaagaagagctacgtgccgatgcactcgtggttcgcgctgcacccggtttccccggcggtggtcgaggtcaagggcctccaccagttcgactggcgcgacggcggtgccatcgcctctgtcatgaggacgatcgaagaggttcagaggagctcaatggagtatcaccagtgtgacgcgtcagttgtcagggaatacaggaggctcgaagcctccaagccaagcacgttctctcttctcaactacctcaagatccacctcccagaggtataaatcaaggcaacaattggacaaagatcacgcctacatgcctacatttgcctgacattaatttgacgtctggagatatatctgatgcgttttgcttgagcagttcttcccggagctcgggagggtgatacttcttgacgacgacgtcgtggtgcgaaaggacctgaccgggctgtgggagcagcacctcggcgagaacatcataggcgccgtcggcgggcacaaccccggcgaagacggggtcgtctgcatcgagaagacgctcggtgatcacctgaatttcactgaccccgaagtgtcaaacgtactcgaaagtgcgagatgcgcgtggtcgtggggtgtcaacgtcgtcaacctcgacgcatggcgaagaacaaatgtcaccgacacgtaccagctctggctagagaaggcaattagctctctgattctcttgaacatggatgccgttttcttggttacagtactaatgacaaaacatttttttcccctgtgactgtcgcgtgcaatgcagaaccgggagtcgggattcaggctgtggaagatgggctcgctgccgccggcgctgatagcgttcgacggccgggtgcaggcggtggagccgcggtggcatctgcggggcctcggctggcacacgccggacggcgagcagctgcagcgctcagccgtgctgcatttcagcgggccgaggaagccctggctggaggtcgcgttcccggagctccgggaactatggctcggccacctcaacagatcagacagctttctacaaggatgcggcgtagtcgagtaacacagtaaacgacacagcagcaattgagctgggaaagagtatataagtatagacgatttggttcgagatctccatgtggcgcagagctgggttcatgtcttcatgaggagagggaagtaggtgctgccttcagtctctcctcgctctggctctacgtgcaacatgttcagtgacacagtgtagaattgtatagtgacgatgtatataagggctgttatctatttcttggttatagaactaaatgaaaaactagatgcaaccacacgcatttatagaataactatgtcactgaatgaaaaactaaatgaaaaatgatgctagacatggtagaataactatgctaaacatattagaacaatactaaaattgaatatcaagcacagtgtagtgctggtgcatttgtttggtaacttagcagatgtacaatatgaatgtgctagtatatgattagtgattacactgtaatataaaactacttttctgagaacaaaacacaatcaattaatcacgctctctcagaaagactccacttgagtagtagaatagatcattcttaatattttccgatacggtcagacatatataattatggggaaaaaaggcttgaaatttacagccaaatgttaagaactgacagaaaaaatggtagctttggaaccttgatcgattgctactccatccgcttgagattataagtcgttgtgactttgatcaaagtcaaactacgcaaagtttgacttacacaaagtttatagacaaatatagtaatatttacaacaccaaattagtttcgtcaaatcaataatctattatattattaaaggaatagaaaaagaagcctccacgttcactctaatggcctagaaattctcacattaatcgcagaaaaagaaacaaacagagtccatataggaatacaatttaataatagctgaaattcggaattaagaataagaaataggaaggtaagactagagtccatatcggtatacaatagaactaatagaaattcggaattaaaaaataagaaaaaataaatgtagaggttagagtccatctagaaatataatttagaaattaaaaaattcaaaatttaaaaaatattggatgaagactatagagttcagatagaaatagaatttaaaaataattaaaattcggaatttaaaaatattgaaagataagtttagaatccatatatagaaatataatttagaaataataaaaattaggaattaaaataaggaatattggaagaagagtatagaatccatacaagaatttaaaattcagaataaaactaataaaattaaagtagaatttggagtactaaaattagaaatttaaaaaaggaatattggaagttcgctctcatgagacacgcaaaattatgttgtcattttaatatatttgaataatacattgagaaaacatatatattattataagacagaaaatataatatgatgtgtcggtgacatgggaccgggagtatcatgacttagagacttgaggcagacacgatcacccacgtggcctaaccccctcggggggtcgggcccgagggtgatacggccgcccttctctttgtctccccgaggggtcggaccgctcccgtctcggccccgagggccgaggcgccccgaccccttgtggattttgcgcngngnatatggnnangnnagnnnancngcgctcacctaaccgcatttattgcggtttggacgagcgcgtcacgccgcatgtaacgcagtgcagcgcgctcgttcgtccggtctgtgatcagtcacagaccggtcagatcgtgggctaggtggcgacaggcggtctgacgcacgcctcgccccatcccgtcaggacgagagcctccaagcactcgtccctagccggagccggcgtgttagctcctggagatggcacgttggttccggtcagatatatgccaggcttcatcctaaccattacaggcaagatattgtatgaagaagagcgaacatgcagattgttaaactgacacgtggtggacaagaatgaccgatttgtgactggtctgacaatggtcatgtcgtcagcagacagccatgttcccacgtcgcgcctgcttccggcggaagtggaggtaggtatgtgccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagagaaagggaggagaggagaaacgatcccagaacgatcgggggctggctcgcactttgtagcttcttcatacacagatccaccaaaacacaggagtagggttttacgcttctcagcggcccgaacctgtatacatcgcccgtgtcttgtgctttttccattctcgcgaaccttccacacacagactaggagcttagaatctcacccagggcccccggccgaaccggcaaaggggggcctgcgcggtctcccggtgaggagccccacgctccgtcatgatgctagccacgcaatctgcgcgggccaccatgctaattaaatatattttaacaatatagttgtcttggattaaaaatgttactacctttttttacaagctcaattaaacttagagcagtttgactttgattaaagttaaaatgacttataatctgaaatggagggagtacttcttagaatcagtagcacaagtaaggttgatgtagcaggaaaaaaaatgactgtttgagttgctgaataatgccacatgattcttgtattttacctgttaagataaattgttttaacaggtaaaatacaaataagttcctgatgttagctccaacggccgagatagcaaaatattagagaatatactttctgcattctagtatcacatggcaaaccaaatgttggcatgttgccaaataattgaagtgatggtggtaatactgaaaaagaagttgtatcatctgattcaacgtattagctcatcgcaggatattttttagataaaatttgctataagacattcaaagattatggtctttgctatgagac

SEQ ID NO: 67521 - DNA, 3425 bp, Oryza sativa
aaaaggcaactttgccctggggtcaatagtgtttagcccgctgtagttggtttgaacagacccattccccattcagtctgatgatcccctatcctccaaaccctagggttaggtgcggcggcgatctgcggcaacggcggcgagctccggtgactacggtggcagattgaggtggccggcgagctgggccgctagcagattcgagcagagaagtacgatggaggggagcagcggtggaagcggtggaatcgagcggttgattcgagcagcaggggaagaatcaagaagcgagatggatcaatcattgtacatgggctcatcgtcaacgcgtaacccagtcacaggcgaggccgcggaggcagatgcagcaacgtgaggatgggcggcggcggtggaggccgcgggctgtgcctacgtctgctcaggctccggtggctccgccgcgctgtggcgctgtgtggcggctcgcggagctctgcgtcgtggcgctgtctggcccgctcgtggccggggcggcggcggcgcccgacgcgccagtaccgtgcgccgtcgtcgccgttgatcctacgccttcgccgcgccgttcgtcccggccgtgctgctgaagcgcgcgagaaaaggctactaattacacaacgcctaagtacatatacgtgacagtttattaacaccaattatatgaaagctatgaacgctataaattctgtccaattctgtacttctgtgtgtatacaagccagccgattgttgatccatcattgaaccgatttggtgcctgaaagttgtgacgttaaatcatgtcgaccagcgtttacaagcaaatcggcgcagggggcattttggtactttcatcattctttctctctccgcttcagccaaaaataataaaataatgagaggagtgtccagcagctaattatcacatttttatagtgtcaacggaaagattcacgttcttcgggtgtctcacagcaaagaccacaatctttaagtgtcctgtagcaaattttgcctatttcttatactgaggctaagccaaaacttgaagttttttttaatagctactcctctcctctctcccaccgccgcaccgcgtgctgctcctctcggccactgagcttgcgcgctccatggccgacaacagccttggtgcgactatcattgccggatccgacagagaactcgatagctcttcttctttgcacgtggagagggaaaaaggtggcggggggcagtggccaacccttctcgccatcgaggggagtgggaagggaggaggcagggaggctggcgagcgggcggaaaagaaatgaggccagcgagtggggcatggagggcgggagacgaggagaccggactaccccgcgaccgtcgccttcagacatcgatcttggcgagcaggcatcagggaagcccggaagggcacggggatcgtcgtcgggccaaaggtggtcgtcgcagcagcaggggaggttgggctcgttgtacttcggcgggagcggctcggacgactgtggcaacaacggggatgactccgatgactctcctggcctcgccgcctccttcctctccacacgctcgtctagttttgactcaccgaccattgcccttctccctctccgtttctccgtgtgctctcgcacgtggagatagagaggagagtgggacccactaacatgtgggtcctatttttatttttccttttgtctggctggcatgtgggcccatattttaaaaataatttatactcctactttatattttgcttacaatgccacatcacagccaccacgtaggataatgaccaagtcaaaccagctatgtagatgccacgtcagtcagaaccgccatccaaaccgccgagattgctcatccacaccggtttatctgtattgcagttaagggatgaaaattgaactcgcgtcaagtaaagggcccacggggatttcggcccgcccgaaatgaacaagccctcggcgtcggcgctctcctcctcctcgtgagttcgcccgccgcctgcgccgatccccatccatcccgtgagctagcagaggcgccgtcgtggtcgccgtcgttcgtcctgctgcttccgccgcatcccggtgagcatccatcagttacgcgcatcctcttgctcatctctccctacccacgcgctttttcctccaatttgaacaccctttgtttctcttctagacctggaagctcttctcttaatttgccttaaacctcaatactaatagcagtttgtttgttcccccagatccgccactgctgaacggggtgctttcgccatgtcgaggctgcgggcgctgtggcaagcctccgttaacgccaccaggcgaggtagctgcctgccgcaaacctaattttgccgcgctagtcgtatgctgggtttatttcctcaaacgaaactcctttacctgcgtttgctcatttttaaggccatttgaaatgtttactggaaaggccatatgagatcctcaaatgatgaataactatggcataaggattttagacacgggatgggaattcaagtgtgtaacagctcagtactagttatgttgatgtttattcagacagttggaggtttcttctagcattttgatttatttaaaatggatgctgctggatcgcaagttggcttcagttgttagctatgacattctaagatgcttttaatcttcatttagagtaataactcattatgtttgtctatgtcataattctttcatcctacatacgaaatttgcagccattgtgtggaattcagaagacctaatcccaccaagtgaaaagtacatcttcaattttaattcaaaagatgagctgaaaaggtggcacttgtattcagattccgagtatggaggtaatgcctcactttcaagtttttctttgcacgaatattagttttcgtgattgtcctgaataactgaacggtagaatagactaacttatattgtatatgttgtgattgtgaggtactcatggaatattcatgttctaagactttgcctggcactggaaatgttcctttgtttttattctcagaatacatgggaaaaatatgcaaattcccaagggctcaatttttatatgtatatgttacgattcaaagtttcattgtgattctaattctatgcatagaacaaaaatgaataaagctaggaaagttctctttcagagaacatcagaaaaaaaagttttctcttgaattcttgtagctcttgcagctttctaacatagttcctggatattctgacatagttactggattagtcgatcacttttagctccattcttgtcaagaggcttcactgtatacttctctcagacgatacatttcactatttcagtgtaaatattgcatgccaataactcattgatttaatgagttttcccttcgtttttcacctacatttggt

SEQ ID NO: 67522 - DNA, 10597 bp, Oryza sativa
ggtggtgctggtggggatacttcatcaactggtactctgatgttttgacgtcccctttttcagggtttccttagagtgcattttcagtacaaagagggaaaactggaaaatagtttatttatctgctgttatatatagcttatgagtacaaattaacctgttgaactatggagtgtcttctagtgttgttattctcatgaatctcatatgtccttgccaacttaccagataataccagcttgctgtcttggcttttgtaattggaaagaaagcggcctttttttcatggttttgttagatttcatgcctgattcacttaatttaatttttataagctttgacagttttgcaactatttttccaacatatgcattctggaaggtctcttttctggcaatctctctttggatatgtctgagggatcaacatggaagataaggcgtagtggtttctgtggaatgagatcaaagaaggtaaagtgatattgacttggtcattgctcaatatctgtagatgctattatgctgataaacccttatttctttctccgtttcagtttaatggtttcattgatcttgatgcatatgatactatagcgatgaaactcagaggggatggaagatgctacatatctactgtatgtatcctcatcctgagacagtattgaatgtgcgatatcaagttaatacgttgctatataatctgaatcttaattaaacagatatacacagagaactgggtgaattcacctggacaacaggaagataattcgtggcaagcctttgtgtacttaccccaggacagatggcaaatcatgaaggtaatttcaattcgaagttgaaagatatggtttttgatgatacgacagcacttgtcctttctttcagatccctcttgattcgtatctacccacatggagaggaaatgtgatcgaagcaaagatggaaatgaaccctgctcgtgttgtgggaatgtctctatccgtaaatgctgagggcggtgtacctggtgcaaagactggaccaggtgattttaggctagaggttgattggatcaaggcattgaggacactctgaatttgtggtttccacaaatcggtctttttgtaggatttctcagggctggaaatttcttaccggcactttttcatgtgataattgctgaatatcacgaggcatggagatgcgtcatgcagtttgtattactcctagtcaatacaatgggacatcgaaaggaggcaactgttcagcgcagatgaataatgaggtctcttttgcttttgggggaaatgaatatacaaatgtatcacctgtttcttatggctgtctgaacatacgttacttccttgctactgtgtccgatgaatttttatccattccgcatcaactgatacctgcaggagacggtttgtacttggcttcccattttgcggtggaactggcgagctcgtgcttggtggcggctttgcccgcctgctaaatttgcacgttttggtcaaacaacacatgcattcattttcaggtttccgtagcagcaaaaacaccatgataaattggcagtgcacagccgcaacggaaacttctcagtgcaatcgtgcgtggataaacaaacaacggtggatatttcaaaaacgatctttcaaacaaaaaggtcgatatttcaaaatgcattttcaggaactgtacacaagacacacttgaattagtccataatcagaatcctaactcaggcacacatggcgaagcttcctttcctacaagagcaatatttgctcatggaccacacgtccacaccatgacaccgcaactaattaaggggaacgaacaaaaatgggagcacccagtgcaagccgagaggacgacggacgggtgtttggcgaccagtcgtcgtccactcctctgcatgcatgtgtgcacaaacgacgggtcagccgtgccgggtcatccttcaatgaacccggtcatccgcagcacggagttgcgcaggtggctgaggtcgcggcgcgcccgcccggtccccgtccgcagcgagaacgcctgatccccctcctccgtcgaccgcctccgcgacaccatcacgtggggcggcaccatcgtccccccgccgcagtcgtcgccctggtcgccgccgctccaccgctgcgcggccctgggaatgtccaccggccgagagctcgccgtggagcagtggcgcgtgatctgctgctggccccgccgagccggcgtcggcgcggtcgccgtcgccgtcgccgtcggcgggacgacgtcgtgtggcgactggtgatccggccacagcacgtcggactcgtacagctcctctcccatcgtcgccatgcgcgcgcacgcacgcacaaaccaagctacctgtgaagcgtcgatgcgtttggggtttggacgtttgggccttggtagtttggtttagcttttctctctgtgcgacgacgagcgcccgcggggcgtatatataggcgtggtgcggctgggccacctacgtgtcgagtagcttgcgacgtacgactagccgcccgccgagccgcgcgaggaaggaagagatgcgcccacggaaagggatccgggttctatcgggtccggtcgttcggatcggatcagatgacgaattcaattacggagtcaacaaaaggctcgtgtcggtcaatacaaccaaaataaacgtggctcgtctctttgccagagcggccgcctccttcttttactgcccgacatgatgatgaaacggaaattggtcgtacgtgcatgcgaggtaaggaaggtgcatgcttgccacctgcactgtacagctagtacataacacagcgggcacgggcaatgtgcttattactcgtgtgggtaagttctgacgggattaaagatttcatttgtgattacagacttgaacccaggttaaatcgaagactaacctcgggtgcctcagggtcatcatcgcggagcgtccacgcgtcctctgccacgcatgtactcctactcgcgtaatctcttgcatgccttccgctgggaagcaagaggaatctaggggttagcattcttaattccagctttacctttctcttaagcatctatatcaccgctaaatattgcaaatttattcgtggttccttgctagcaacgcacgatcgcgatctctgtttcgtcgtttgcgtgcggccaccgagtccgcacgcaccacacgcggatatgcgtacgcggcgcccggacggaagaagcatcaggctacaggctgggaaggcttccacgtacgctgcactcaacgcgtcctgtgccgaattttttatttataatactaagtaatatttaaattaaataattagtaattctctaggaggattaaccaaaataggatggacgatcattcaaacagcgtccagacatggatgctactataaacaacgtccacctttctggtgcagtcagaccatcactacgccaccaatacgctaagagaagtatctatctatctatcttctattatatactaaaagtccattaaactttctacaaaagctctcaagccgccacgtggcgctcctacaaacgctcctagatcagcacgaggagcttaaacatccaaccatcggttttcatttaatctggtggacccattatttttaaccactagatttttattttaagaaaaaaacaaatcaatctatctaaaaaaaatcccacgttactcggccgtgtcccggatctgtacgtccgtatgtccgatgtacgtacatatcccctctatgtccttttctttttctttcttatatacttagattagatgaaaaaataaaaagttcatgttaaccatatattttaagttgtaaaaatatatgttattttaagttttattctaaataacgcatctcattgaaacatccataaaaaatattaataattaacattatagactatatgattgtatatcacaattaaattggacttataattaaaaaacaatttaaattttgagtagcattttaaaaatttactcactccctattgtgtaatactgatatatccaaataacattattaaatttatcaagaatgtattttcatatattctatgtttctgtattcatattttttttggaaaattaacaaccatatatattttttacaccatgtggatgcccttttatctcttaagcttcattcggtctatctcattggataagcttatttaggacacgcgaaacaaagcatgccatcagcgtaagattaattaagtatcaaatattgcatatcctgtgcttatctaagaaaaaatatatagaaaaatggttctatacacccaggagtacgtactgtatatatataagggtcatcctatatataaaaaataaaatctagctacttatttatacataacccgtggatatattattttcaaccattattttatatctatatctacgcaagagatgtcataaaggaaaaaaaagaagaatgtgtacaagatcagctccatcgagtagttttttctttctttctttgtggctctgagattttcctcaaattgtgcatatgagtagcaaccacccttggcgagtttgtcaaagaattcacgcggccgcagcaccgcttcacgccatctcgctaaattttttggaagtatttttttactaatgatttataaggcaatcacgtttccttaaaaaaagcaatcacgagcgcatatataaacgtgtgctcacccatcatataaatacacatacacacacctaccctaagagaaaaaatatttgtctccaaaaaagggaaaaagtatgtgcttagtatttgctagaaaaaaacatatacacatatcatcgaaaatgctgcatagaaccacattatatctttttaattatgtcattctcatctatataatgttaataattaggacaaataattttgacaatatagattattccatcgtatattacccatgaacatacataggtaaatcagatgtataataaaagaaaaaacaaaacaaaaaatatattagtttatatgtttgcgaatgatggtgagagatcagattatatataaccgggacaattcgtaccgttcttattatttaagggtgtaatttagactttttccttaaaagtcttccacataaggatttataataaaaaaaattaatcaacactaaacttcctacaaacgcttttaagcctccacgtggcatcctataaatattcctaagccgccacgtggcatcctataaattagagaaattcttaaaaggacacaacgtataaccgttgatttttattaaattttgtagaccattatttgtaaccattagatttattagaaaaaacatacttatccctaggcccacctcggccttggcaattgcatgtacgtacttacgtacgtctgctcaaccccccccccccccctaattctttcaccccttttttcacctattttttctcctatttttaatcttttagaaaagaaaaaattgtatgccaaataattaagcaaatgcagcatctaaattataatgctaatatttgatctgcttatgtctttagatattttatattttaaaactcatgtcctctttaattcaactgtaaagagataaatgtcatattaattggggctacattttctgacttttgcgtgtcatttaagcaattttaaaactaaaaaaattaatgatatatatttttgtcatcgtatataacttgataataattaaattatatctaataaaagtaaaatgaacagatctatgagtaatattaaaaaaatagcccccgccccaacgttgtaacacagtaaaaagtacacatcttataattacttctaagatattatgtctttctcttaaatcagagaaaatacactcttaagatattacgtcgttcttttaaataagagaaaatcgtaaaaattctgacaagaaaacaaaacattcgaccatcagcttcgacttaaacatctgacacataattttagtttgttagattaatcatttagaaaaagaacatccgaaatctcccttcctccctgctcgcgtacaacgtgcgccattcttttctctctattttttatctccttatcaactgaaattaaaattatctatatgtaaaaaagacacaaatagacctccatctattacttgtatcttgtcaggcgtctaacgactttctactaacttaattaatttctcttaacatgcctatgagggctatgtacctatacaaattgaccttgatacttttaaaacgatcttattaggagataaataaatatttataagaaagatgatcatagcatcccaattacacatatgatctatgaagtcactaatcataataggtattcatctagcaatatagacaataggttaaaaataaatgtgtggccagttgaacatcataccaataagtatgtgggttacacctaggaatcttaacagtgaaacaaccttgaggcggcctttacaattggaaattgagcaaatgttgctagatttaaaacccactgtaaatagaaaaattcaaacattttctgagttctgtttgaatgaaaaaatatataaaataaaatacaatcaatcaaaaaattgatattattggatttttttgggttgtaagatatcctactggggagttaaatgtcctgaattttcttataggaaccacctcctttgtttcgacacaatattttctcatcaattgaaaaccgcatgttctcaagtaattttattttagaatttaaatgttacaagggtaattataagaaaataatcagcgctcaaatcacacaaaatacatttaactttataatataataaaaaatattttaataaaaaacacccacacttaaatattcataataaaatttcactcatcatataagaaggtgcccgcgcatgtgtgcgggctatctttctagttgaaacaaaagttgttcaacctagctagggtcagggatcaccggtgtcgtcgtattcgccttcgatcggggggccgtattccgtacgcttcaccctgcaaaccacgtcgccactgttactgtccttgttgacgccggcgccttggatttgtccattactcagcgccatcaatccagccacggcgtcttgagcggcaagttcgttggctgctcgccggcaacaggtgaactgcaagacatgcatgtatttcacattgatctacttatgtctttcggtgggaggcaacaggtgcccatgcatacgttagctaattaccattgatcagctgctgtatacattgtgttcatatgtactttatcaggataatggaattcaacggtctcccaggagtcgagcagatagcagcagcagcctccggggaggacaacaaccttcggcctccccaattgaaagccgccaatggcagcctcctctggaatcgatgcgggcggtcgtgagggcctcccgggggcgggcgtctgctacagcctctcgatgttgaggcaaacggtggaaggaggcaacggcggcggcggcaacctaccctagcgccgctgtaatttttcttccttttttttctttcgcttggttcgctgcatttgaagtggctacaccggtctggacgtcgtttggattagcgtccatccgcggacgctgtttacaggagcgtcctgatgcggaagctgtttagaatagcgtccttcttatttggtaaatactcacaaggaattactaattatttaatttaaatattattaattattataaataaaaaattcggcgtcctgtgacaaggaaaggggaaaaagggggacaaaaactaaacgagaagaaagcaaaagctattagctgtgcgagacatggccaaatgggagggtttaacttagcgtacgtgaggcttggagagtagccagatgtccagatagacgctctctatcaggcattttaattctccagtttccgtttcccttgaagcaatggttttgctctgcacttcggtagtggagtagtactttcagtttcagattctaaagatgatgaattgatgaattacgatatatgatggatggtgttcaatgctgatgcaggtcaagttatgaagttaatgttttacatttatctttaagctagacatgcgccagagtctgatggagcaaagcatttcagattttcagtaacaacttgggttttcttcagtcgcatttccaagccgaaaatggagatggttgacagtgacaccataaaagaaaaagaggtacttcatccgttttttaataaataataacactgttgacattttaacacatgtttgaccattcatcttattcaaaattttttatataaatatacaaggtataaatcatacttaaagtattttaaatgataaaataactcataaaaataaattataatatattatatactaaaagtccattaaacttactgtaaacgctctcaaaccgccacgtggtactactacaaatgctcctgggttgccatgtggctatctaataaattggtggatccactattttaaactattagatttatcttaataaacttttaaaacctcacgatccatctctctcctttccctaatcggccgatgtctacgtacgtaggtttttctccggttctatgccggtggacccaaaaggaaaagggccgggaaaaaaaaacggaaagaacagatttgtacgtacatacccggggagccaaaaacaagcaccactattcgatgggaaaaaaaaacgtgcataggcaccaacgatcgagtaaaacaaacgatcaataatttcaataaatcagtgaacccactatttttaccccaacaaaacaagtacactattcgttatttgacaaaaacaacacgaagaagaattgtacgtacacatgcgtatactatctggaataacaacgatcaatccaactatatgactatttaaaacatggcatatttattttatctataataaagaaaaatatatattacatcacttctacaaacacacctaaactatcacgtgacactctaataaattagataaaccttacaaattctgagaaaaaaatccaatcatcgatttttatttaagaaaaaaggaaataaaacgtaattatgatttagagaaggattagccctgccacagtcccacctaattgctacgagagaaacgtactgttcaccaaaaaaaaatgaaaaatacgtacatactacgcactgtctttccctacttgaatctttatgcatgcaagtaacatccaattgtccctaataaacttatctaaattagatgtgtatagtgaaaaatattatgactatatttgatattaactatatttcaatttaaaaattatcacatggaagcatatttagctctttgtccattaaacatcctataaacgctctcaagccgccacgtaatacttctacaaacgctcgtacaccactacttggcattttaataaattagaaaaataaaaaattatgagaataaacaaaacatctcgcagtcaattttcactaatatacggtggacccattgtgcttacgtacctccccacgtatttcctttctctcctattttcctctcttaattagatggaaaaaatattttacgataaagaattttaaacaactatattatctaaatcatatatagctaactttttaattagtgtacaccattatattatctactataaaacttaaaattgaagatccaagttaactatattattataaaaaaattcattacttcgagtcatatatattctgtggactagctattgttcaccgatccatacatttttaagaaaaatcaaataaatttttaaaccttctgattaataacatacacttaaattagaacaatttaaaacattttaagtagtttaattaaaatacaatacccaaagtattttctaatagatctaagataaatgtatttataaaaatagaaagctcaaaactatgacatattcaatctatcttaaaaacaataatctcctcccatcctcctgctttacttacacctctaccctccccctatgactctcacatcctctcctctccaattccattatctctatttctattttttttaactaacataatgcagaaatagtcataactattgttttatttataactaaataataaatcaagatcacactagctatattttactatataaaagttaaaatacatcatttgagggtagaccctaccatttaccttacaaataaataacaacaaaaattaattgaacatatgtattatgttatactaaatcactgtacataataaaaatcaattaaatgcccccaaagcgctcataaaacacaatatattatgtcttaagattctaagaaaaaccaaataaattgacgtatccattattttaactattagatctatttttaaaagaagtcttaagtcgccatgtgtcacgtcatataaaaaacagaaaaaccttagaaattcttagaaaaaaatgaaacaccctttcatcggctttcacttaaatcatttaggaaaattagaaaaataaaatctcctacaccccctccttgccttcgcacgcacacaacattgtccgtcccctccctattttttatctattaaattaaaagagaaacgatca

SEQ ID NO: 67523 - DNA, 3845 bp, Oryza sativa
attgtattcatgtgaggttgcgtagaacctcttacccactctacataaaatgttcatagatagaccacctctcaaactacatcaatcatactaggctatatagaatttagtggagcttcatgtctgacccaatttatcctctaataaaccatgataatatatatgcatttagaaaaaaaaaccttacttttactttatgcttacttttactttcggtgacatattttctaaagaaaattagtctaccttcttttcaatgaagaagattataaataattgcttatagatattacttatgtaaataaaaagctaataggttagaaaattataaaagcaattaatgccaatgaaaaagacggagaaatcatggcatatgttctcctgttaatatttcgctcttataagtatctcaaacttagtgtacgatgcatgcccgcgcattcgcgcgggctaacttcctagttatgtaaatttttgaataaaacgaatgaacgtgtaaaaaagagccaacaacatcatctaggtaatagtactaattttcaagctccaatgtactcttgctaattcaatccgactgcattatccatcgtcttgccacgcaagacagttgtggttgttgcgttttggatgaagacacaatcgacgcttccggtaagtcaacgatcaattgatgagttgtttagtacagcacactactgccactgaaaaggatatgaggacacaaggatgaacaggcggattgcaagctgaaagaaaaataatgcatatttttcctcaaccttgccattctaagcaagaaacgtcaaacatcacgcttacgctgctcacattccgattgggcccaggaaaccaatggggataatcagtgcactgaagtaagccacaggttaatgtgaatatgtgatgttcacatctcacaagatgccaatgaatcaacaggcacttgtacaggatgaattgcatgtaggcacctgtaccgatctgcatctgtggatgggtaagacagtaggccgtgtgggatacttcagatggaggtaggagagaaatgtcgaccaattattgcgtgcaggaagaagataaggttttatatgacagtccaattgtatgttaatttgggaggacgtaatttaatccatagttacttatgcataggtatatacacgtccttaacagctgtaaatcttatcaagagtgttcacaatgaaactttccaagatgtcttgaaaatatattatagtaaatttaacaaaactacagatattttgataaaattagcatagaggtacatatttaagctatagtatcataagactatagatttagaaatgattttattacaagactacatatttaagccattgtgtctcaaaagtttagatttaatattgcattttcacaaaactatatatttttaagatatgctatccctacacgtctcatcatggtaaatttttaaaatgtatagttttgcaagaaaatcgatcatccatctgtagttttgtgaaaaaaaacatgacatcaaatttgtagttttgagatataatgatttaaatctataattttttgataaatatattcttaaatttgtagtttagtgataattttatcaaagtatatgtagttttgcaaaatttactcaatatattaattccttgttgatgcataagttactactcttaactttttgacagaagggattttaaccctacttagttttggtactaaaattgtactggtaatttttcaaacttctactctttttttatgttggtcttcgtgtccataaccaacaccaacagagaaactttcttggatgaccttctcttatttttgtatgaaattctcacggacattaaccaacaactgacttcaaaatagatgacgtgaatatttatatgagcgtcagtctttgcttttgtaccaaacttatgaaaaataaaattaaactaaataacttttctgaggaggaagggaggggccacataaacttatttacaaaaatatactactacacgtttatatctcattaccttcacagaaaaaaaaatactactacacgtttatatctcaaggagagatgtaaacagatactctgttttaagcaaatacgacgatcataagggattttacttaatagaacacaacgatgacaaatgacagtgaagagcggagaagcaataggcctgtaaaggagtagagtgctggcggttgatggaatatctaaaaactataaacaaaaccccaaatagaatcccaatgctgatcaagaggagtgacgacaggcatgccgttaagtaacatggtcacgacggttggcgggacttatggagagtaaaaataaactctaataataattatgttcgatttttaaaatttcaatgacaatatggaggtgaggcagcaggcgggctgtagaggagtatagtgtcaaagccactaacgatttggcgagacttatagaaagtaaaaaagaacacaaacaatagttatgtacttatgttcgatttctaaaatctcaatgataataaagagatgtggtagcggacatgccgtagagtagtaaattggagatgtttgatgatacttctaaaaattatgaaaacgaaacccaacaaaacaatgaactctaaaagctataagacctaatttttaaagttctagagaggatgaatagaaataatggtagatcgagtaagcaaataaaaagtaacaaaggagtaaggggtagcgactgacgtggcttttaaaaactataaaattattagaatcatgggaatgataattttaaataaaatcatgtgtaaaaaatagataattttaaattgatactagctgcgcaattgcgcgggccgcccactaggtgatatatctaaaccattgatatatctatctatctattatattattaaaatagccttgaaagaagacatcacgttcgtggaggctagaaattcccaccttaatcgaaaaaagaaaagagagtacataaaggaatacaatttagaaatatctaaaattcggaattaaaaataagcaatatcgaaagaagagtccagataagaaccaaatacgagattaattaaaattctgaataaaaataaaataaattctgaaattataaaaaaagaaaagaaaagttcaagtaaaaattcaatttaaaaataactgaaattcgaaattaaaataagcaatattgaaagtataagaacacaatacgatattaaaaaaattcggaataaaaaataaaataaaatccaaaactagaaatataaaaaagagagttcaaataagtatgcaattttgaaacaactgaaattagaaataaaaaataataaatattaaaagaataatcatataaaacacaatacgagattaattaaaattcaaaataaaaaataaaatgaattctgaaattataaaagaaaaataagagttcaacaaggaatacaatttataaatagcgaaaattcgtaatagaaaataaagactaataaaagaaacgaccatctagaacgcatgacgagattaaaaatagataattttatatgaatactagccgcgcaattactcgggccacccagctagttaacctgaaagtatacctacttaatagaattatagcatgatatgttaggaacagaaacagctggcttcaaaatatttatatgagcatcagtctttgttttccgtaccaaacttatgaaaaaataaaattgaactaaacaacttttctgaggaggaaggtaggggccacgtgaacttatttacaaaaatatactactccacgtttaagaggaaacttagattcaggcgcccgatggtttgggggaaaaatcgggcgctga

SEQ ID NO: 67524 - DNA, 13242 bp, Oryza sativa
cattttcaaaaatatgtgggtgatttgttacaaaagaatgtttcaattcactacaacattagatctataaatagtgaaacattatgaatacactaggtgaaatattttttgtggaacaaaaaatgaaacgaattcccttaatagagggtttctaaaatatatgggtgatttgttgcaaaagaatgtttcaattcactacaaacattagatctatacatagtgaaacatttttttgtgaagacacgtggcaggtgggggcagagaccatggtggggcccaggcgtcacgtgtcacgcgcgtgggggggggagcgctcgattttttctccccccaccggtccaccgatcgctggcattctcccttttaaaacctctcatcgcaaggaacggaacggaacgggctcgcaccgcacgcacgcacgctcgctcgatcgtcgatgggaaacgagtgatgcgtgaggaaggggcgtcgcaccaacggaaacggaaaagaagggggcctaaatttactggaggcagaggcaatagaagaaggatggtagcggatatgagtggttaaaattaggatcccagaggattgtgggaggcaacttagaatcggtcgcccgatggggagggggaaaaatcgagcgctgatattagcatgacgcatgcgtgcaaaaacacttttaactatttttttctcttaaattatttatccaaatcatgatccgattacaccattaaattcattgcaattaaatcttcaaaacaagactacacatggatatattccgacgaattttttagcttattattgaattatttttaaatgttgcacgatgttccaccaagtatatcggaattgtttcactaagtagatcgaaaatgtttcaatcgtttaaatcgggcgttgtttcaccttatataaaaacaatgtttcagcaaatagagaaataatgtttcagttcactgcaacattagatctctctacatagtgaaacattgtaagtgcactaggtgaaatatttttggtggaaaaaaatgaaatgtattcccttagtatagggtttctaaaatatgtgggtgatttgttgcaaaagaatattttggttcactgtaacattagatctatacatagtgaaacattatgagtgcactagatgaaacattttttatagaataaaaaataaaacgaattcccttaatatagagtttccaaaatatgtgggtgatttgttgcaacggcgtatatgctaaggtgaggcggcgtgtgagctggaggcgacggcatgcgagtgaggcgcgggcgcccgaggcggccgattttttctactggtgtcgggcgcccatatattcttaaatttgtagtttcgtgataatttttatcaaagtatgtgtagatttgcaaaatttactcaatatattaattccttgttgatgcataagttagtactcttttaactttttgagagaagagatttcaaccctacttgttcttggtagttttggtacttaaattgtactggtaatttttcaagcatttactcttttttttatgttggtcttcgtgtccgtaaccaacagagaaactttcttggatgtaactttgtcatatttttatataaaattctcacggacattaacctgaaagtacacctacttaatagaattataacacgataatgttaggaacagaaacagccggcttcaaaatagatgacttcaaaatatttatatgagcgtcaatattttgctttctgtactaaacttatgcaaaaataaaattgaactaaacaacttttctaaggaggaaggtagggaccacataaacttatttacaaaaatatactactccacgtttatatctcattaacttcacagaaatgagataaaaggaaagatgtaagcagatactctgttttaagcaaatacgacgataaaagggatttttcagttttttgcaatacgacgatcaaattagaacggtgggagtagatttgaatacgtcatacaatgttaattaagctctttgcttaaaagcaccacaaatcctgaagcaataatccaagcggagcgatgcttttggaattcatttaacttttgaattaataggatgagtccaaaaagaatttgcaaaagaaaccaggaaaaatagctgatctgaactgcattttacagcacggaaaaaactgcgttttcaccttcatcgctcgttcttcctctgcaatgttcagtcactatttgacaatggatacatgcatcacggaaagaacaaacattacactaacttggttgcacccacgtgaattcatcaattcaaacaaaacgaactcaaaaactgttcagagcgaaacgaacatttccctcaaaattttcagcactactcacgcatcaccatcttcctcgccctccccttcggcacgacgagcatcatcatcgccttctctctcttggccctccggtgatcaacgatgacatgcggcggcacgaagacatgactgccaacgaagaagcttccgccaccggcgccggcgagggtctggccgaatttgctgaatcccgccggtgctctcgcgcctttcgcaccggcagagctgaccttccgggcggggatgtcgataggggaagaagctttctgccggttgccatgctgcttcacggagcggtgctcgtcgtcgtcctcgtcggcgtcgacgagagagtagtacatctggggaaaatccaggtcttgtgctgcatctggccataggatatctgcctcttggaattcctctttgtccagctgctgctgctcaatgcgtagcatcttcttgcttggggtgtaactagaattaggagaggataagcacgtattaagtagtactagtaatatgtacacacagctcgagtgagtgagcgaccagtcatatattttgcgtgtcgtgatttaataatagttggggagggctagaagttattactgcccaagtgcccatagatatcttggctgtctgaatgcgtcattcctgaactacatcatgcgagtcacagttactgaatcagcagcaagtcagcaacgtgtacacgtacgcgggtacaaattaccccgtaattaaccacaacttgcattatattttttgacaatcattcgttagtctcatcgatacgtttgcagccatcaacagacatatatatattcacctcacatttcgaaccaattttacaaaatgtcatcgaggaaaatgtctcgcagatatgacataataaaccaactaattaatctggtcgcgtgaccatttcggccaggccaagtctcgcgcgcgcgcgcatggccgcccgccgcccgcgcggcgcgctagctctcgatgaagccggtcatgcggaggacggagtcgcgcacgcggcggaggtcccggcccttgagcgtccgcccctgccccgagcacatcgagaacgccgccctgcgccgcgccagcagcacgtgcggcggcaccacctcgccgccgcagccgctgccgctgccgccgtagtcaccctccccgtactccgtgtcctcccgcctcgccgtcgccgcgcccgagggcgccgggatctcgatcgggtccgtgaacggacgccgctcctccgcccaagacgcggcggcgcatttcgccgacacggccacgctccgctgcgacgccgccatatcgctcgccgatcgatcactccgcggttacaagcagctagtatcagcgctatgagcaggagcggaaacagatgcgacaaactatcgcacgcgcgcctgtcgaaatctctagccaacctttcgccgcagctggtgcggcgaggcgagagatttataggagacggcgcgagagcgagctggcgcggcgagcggggcaaccaagctatcctgcccataggcgccctaggtaggcaggtgccgtgtggagctgcaccgctttgtgtgacagagaagtatgcggctttgagctttgacggggaagggaaggaataattccattgatcaggctggagagattaacccctaactcagcttagatcaaatgcctttgcgctaattcatcgccaactaatgcgaatcattttgctttctgaaccaaaaactattgcaaaaagtagccgattggcattggctttcggtacggttcaggttcagacgctcttagttttttatcgcttcgtcgcctctattgtttggttgcataacggcgcaagtttactgaaccgcgcgtgctaccaaggtgcttaattaattgaaagataaatcaataatctcgtgtgccttgttgagatcccatgtgtttgtcgtaacgcaaagaaagccagtacactcctgctcccgcgatgttagctgatgattggtttagtgatctgatccgaagtgtttgatttcgtgattacaccgtattcccacgtgtatatatatgcatctgcgctgcatatgcacgttatgatgatgcacactgatgcagacgcctcgagagaaggatttgcacgcgcggcactgcgtggtgcgtgcacaactacacactcccatattggcccccccaaagaaaatgtcatgtgttgcactcaaccgccaaaactgtgacctaactggtattctttagatgcgcggattggttagaggaagctaggtatcccttgtttggaaaattgcacatggctataagcctattcgatgtctggcacgagtgtactgtgcacggttttcatgccaaagttcacttcaccgaccgaaatgagagcttttgctagcgtggtgctttcagtctttcagctatggcctagggtcgatcgatatgtatagcttataactgacaaagggaccggtattgaaagggaaaaaaaatctacagctgaaatcgtctcatctccattattaatgtgttaaactctccttagaataagggaggcaaaattgtttatttactatttatatgcaacctaataaaatgatttcagtggcgtgtcatacggacgtacaacgacagttaattatgagtaaccaagcaacaggcgccagctgcaggtcagataggttgcataacacagctagatctataactgctacttgtagcatgccaaacacgcaactttctaatgagcagtttgattatgacaagaaccatcaaccatacagttcacactcgcctgcccataacgaacttaacgtacataaacgggtttaagttagggatgggagctaaacacgtcgatgtctcagactgaaaagcaaaagcaaaagtgttgtgtcacgttgcttgactcgatgggccggtgtcgagatttttaagcttctgcacgtacgttaataggcttatccgtcagggcatacgtgcatccatagatcgacacacggaagtgcatgcttctgctgaaaatgcttttgtttgattatcctctcttgcatgacacgcccctccatttcgtggttacattgtataaccctgttcatgaattcagattgtgtcagatcatttgatcagtactgatccctagtgatcatctggtcttgtgggaacgactgaaattaaaagatctgataatggggcatatgcagggagcatactaattaagtctggcgatcaatgttcagcaaaccactgatcaagggaactgtaggttctggataaacatgtcaaacaaatcctctgtcattaacgcaaacgcgaaacgtgcatgcatcacgcgtgccgtcgttttcgagtactttatgtagacaagaaccaagttacaccaaagcagccgatgaattttcagcgtcttattactcgcgaacggacaaacctagctacccgacggtccgtacagatgaactcatcgatcgaatatcctgcgatcctgttctgtaagtagctacgtgtcccgcgtcgacgggattctaccgtggcagcgattcaacgcgcacggtgtcgtgatggcctacgctaccgccgtggatcatacacctgtaacgcttgttgcagcttggacgaggggacagggcaaatggcggattggcgcgctcagcctgtggtaatctgcacgccacaggcaccgagcgaggaatgagacggtattactgcgttttggataaggatatgggtaaggattgacgttgaatgattgttagacaacaatgttatgtcaaatttggagcggattagttttacaaggattttgtgggacatggaattttgctctgaacacttaagtttgcactttgcagacaacgacacaacgtatactacggatcctatcaaagagggaagaatatatataagtcgtgttcgctttcttttcgctgaatttatctgccacaacatggttccagccttccaggctttcggctagatttcacttctttcaagcaatgcatcctaagcagtaaagagtaatcaatctaacctaagaatgaatcacgcgacaagaacgacaagagggctcgtcacaacatggacaccgtcgctccacgtatacgatcccgccacgaactgcccgtttacacgccaaccgcctctccctttggtggcctcgatctttatcctgaacgacttcttctcgccggtgcgcgcgaagctgaggctcctcggagacaccttcaccgagacccccatcggctcgaccacggcgacgctgtagcgggcgctgccctggccgacgttggtcaccgtccgctgcacggtgacggatccgttgaggccgtggatggccagggacgggtggttgagctggtacggcggcggcggggtcgccgggcaggggagggagtggtcgagctgcgcgccgccgctggcgcacgcgaagaggaggtagtcctggtacgacgcgtcgtagacgaggcccgggtccagcgcgtgcttgggcctgatgtggcccgagccgtagtcaatgggccccgcgaccgtcccgtccgcatccatcattgggccgccctccgcgttgctcgttgtggctgcgaatcgaatcgatacatatgtacgtgcaaatgggttataacgccggtgagcgatgaacggggaaagttgaattgtactagtcaggacgagacgtcaccggtggtcatgatggccgatcggatcgcggcggagctccagcccgggtgggcggacttgaggaggacggcggtggcggagacgtgcgggcacgacatggatgtccccgacatgatgttgtacttgacgacgcggttgtcgccgtcgagcttcgtcggcgacgatgcctcgctccacgccgccaggatgttcagccccggggccgtaacgtcaggctgcgtaatacacaggctagcatcagctcatagtcaatgtttgccgtaatccgacacgggcattgaaacgatcgagatgcaccttgagaatgttgggctcattcacgttggggccgcgcgacgagaactgcgccatcaccggcgacggcttgacgtccacgacggtcctcgagggatccagcaccgctgtcgggctcgagctggagttgatgtagcggatgatggcgttaacgtcgaccgaggagactgcggtgcccgggagcacatgcgcgtcgacggggacctcgcctccgaacgccggcgggttgccgaggataatggccgcgccgcccgccagcttcacctccaggcccttctccaccctcaagccagtacccctcaagcacacgacgatcttgccccgcaccttctccggcgccagcgatttcggcaggcattggctgcaaccatatcgtagaaaacagtaagatcacattggatttcagaaaatgtgttactaattcagttggttgtgagttgctgtacttggaaacgttagcgggagtgccggggacaacggcgtctgctgcataaaccaacggatacggcttgttgcctggtagctggtacggcgtcacagtttgaccctgacacgcacgtacaacaaaaagaacaagtcaggacagatgaacaagacaaatatttgttggtggacgtgccacgaatagtacggtcgatgttgcgtttagcaggtaaggaaatttgtagcgtggtgtttattaccatgatcaccatgccgttgccgagcttgatcggcgagatgaacgcgcggtcgatgctgctcgcggcgaccgtgagcatccacggggcgaggttcgacacggtggccggcttggggccggagttcccgccgctgcacacgagcaccacgccgcgcatcgcggcgtgcagcgcgcccaccgcgatgccgtcctccgcgaacggcagcggcttccccgtggacccgatggagacgctcatcacgtcgacgccgtcgccgaccgcgtcgtcgatggcggcgagcatgtcggcctcaaagcaggtgttctcgatgttggggttgggccccgggatgggccagcacaccttgtagacggccacgcgggccagcggcgccccgcccgaggccgtgcccggcgcgaacccgccgagcgccgccacgccgggcaccgtgcgccccgcgacggtggacgcggtgtgcgtgccgtggccgtcgtggtcgcgcggcgagcggtacgcgttcgtggtgttcaccgcgccgtacctggcctcgtacgccttgacgtagtacctcgcaccgatgatcttcctgcgtacacacgcatgtacagtacgtacgttggcgccaatcagaatcaggtcgttttaccacatctacattgtctaacctacggattagtattaggcgaagtttagttccaattctttaaactttcaacttttctatcacatcaaaatttttctacacacctaaacttccaatttttctatcacatcgttttaattttatctgaacttctaattttgatgtgaactaaacatacccttagtttgattaaacaaatgtgaactgcgcatgaatcttaggtcgatctgcagagctcgctgatgccgagggaggaacatttgacagggatctcgtttggggcacggtgctaggaaggtgtcacggggtcaccacctaccatgttctgattcgtgcagttgcttcagaggaaaacctactctgctgcagaggtttgtacgtatgctaaggtcacgtctcggtgccgtcccgttgtttgtctcgttgcatgcatgggtaggggtcaatgacaatctgcagtgactcgagaagatgccaagctggagacttgctcctgcgtggcccacacagccttgggttttcgtttggaagtgtatgctggtcctggatggctggatcacagcatgatttatcttgtttttccaaacattttgaaataggaatcagtggtcgaagttgtattcgatcgtatcgatataaagataacatgtttagggatcggattggattatgtttaatctttttttttgtattttaaagacggaatcgatgaaaacaataatactactatgttttagctagctgacctgttgcaggaagagggagagaaggaatcccctccttggcacacccctttccaccgagccggcactggtcctaaaccttcgtcgccgaagctcctcgactccggccaaatccctgtaaaaaaaaaatcacttttcatgcacatccatatcaatgttacccaatgatagcctccttttcttatgcatgtccccccatgttaatagaaaagcaatgcaagatgtagtaagagcacccgtaatgataaagtaaggtgttctctataaaatatgtacatctcagcaatagactagattaatagtaaatcacctcaatagtatgtctatatgggtatctatagctttctaatctattgtctcgtttttctatatagactatctccaggttaatagatagatttgctctctctcttcatttaatctcttccaagtaggaaaatatgctgacatgaatctcttgtagagagcctataaataaccattgcggatgccctaacacacagcaaacaatttttttatatttttttagagaatggtatttttacccggtctctatatctaaccggatatatgctttatcatattagtcaaatcgacgaaatatgtatgatttaattgatagatagacatacatcggactactcaccggagtccaacacgcccacgatgacatcctcgccgccggctttgtcgccgggcggcagccggccggtgtcgtccggacctcgcaccccttcctccaaccccacaaactcccaagacctcgtggtgtgcgggctccatctcccgttactcggaaaggcagacaccacctctgtcctcgctgcacacacagcactaatcaagcatgagtacgagcacaaagatacaatctatcacttgcaggccacatgtaattgattgttttagccactcctgaataaaacacaaagcattcatttcatcatttgtactattactgtattacatacatgtacagtcagcattcgaattgttctcatcatctctgcgtgtcactgtgcgtgtgacatgtacgtacctgacagcgctgtggcctcttcctcggagagaagggccgcgaagccattcaggctgtgcttgtagctgtacaacagcgacgcccgtgcctcctcctcactgttcgatggacagagagcgtgttgcatgattagtttagttactgacttttaatcgaagcaagtataatccgtcaatctcacatcagacagctgatggagctacaggaaagcgcataattagatgtcaatgatggtttttgtataattgatttattgcattattgtttacctgcccttgacggagagcaggaggccatggtgaccggcgaggatttcttcctctaccttcgctccggcatgctcgcccaggtacaccacgtacacctattggcaatggcgagatgaaagaggagttcgtctattcagttcatggaaagtaggaggccggagactggagactacggcgccatcatagccggaccggagaaatgaactgacgatcgattacctggcgtggcttggtgaaggcagctgaggctgtggagaaggaagaggaacaaggaggaacagaaggctcgacgtggccattgaccctcccatcgtcttcttctgaagatgcccgtatcctgctctgtaatttggctgataggccgcttggttaggacttaggagtaggacttcaggtgtttatatagtacacaaagcaagtgctgccgattacagtaggtgtttatatagtagtacattgcaagtgctgccgattaggtgatagataatatatcgaaaagatatgttacatagtatgtatagacggggaagcagagaaatcagaaatggacagtggaatctgaatgactgatcctccggggctgacatgatacgagagtatctttcattttctaaaccttttttttacccgcgtttctagtgctccctatctcgttcattgcttgcaacttggagtagtggtgaacctatacttgggaaaatctctaaggctggattggaccaagcatacactactacagttttctgacactgcaacgcacacatgtattcaccatccactagtttgatgcctgcgtgacagcgtgagtgttctcatcagaaggactgaaagagcgaagagaatcatcatcaggcatgcagtgccttgttcgaaggggaactgagtaccgattgatgctgtgacgattggttgcatcggccgtattggaatacgaatacgatggctcgacgccgagcacgtacgtctcggcgtctcctattgcacatacttctctttgggcgtccacatcgccctttttgtccagcgtcaggcacgccgcacgctcgcaaagctacgatcggagacggtttggtttggctgatcggtgtttggatagatggaaaccgaccggttcgtcgtctccttctatatgtgccatactggcatgcgtgtctatgtatagttgacccgatacgaaggctctctatctattatccgggctgatcaccgggcattgttcagtggatatagacatgcaggagtcactcagagtgatatggccgctggtccctcgtcacttagcagtgcctatcacctatctttgacaagaaggttgtcaaacgtagatggagttgtgcagataaatctaggaggtgtcaggccaatatatggtaagcacgccttgctcgaagtcacttgcatacgctccgtgcaatccttttcaaaacagacaatacacatcgtgaaactactcgctttgtagttgagagtccgagatcaaaacgaccttggtttcatagggaatttcttactaggtcgtaactatggacatgtgccacatccaacctataaatagtccagtttaacagagcagcagagtttgacaacaaatcaaagcatatgcttggcaaacagtagtgttatcttttttttttaaggaaaccgaagtgtttgtatgtatacagaaacacatattttgtacgggttaacacttaatgaatgggatatataggtcagaagtcctaaaatgcttagcattcttgtgaggaataagttcactttgactcccataattagcgaccgaatctgatttgtatccttaaccataataccggatatctcgatcctccaactattaaaatcattgcaatttgacttccttagcggttttggaggatggttttgctgacgtgacgtctacgtggcactgttgatctagtctgcaatatgtgggacctatttgtcattcacacaaaaagagccctactgacatgtggggcccacatttccatcccctatctcattcctcctccctctctctcccttctctctctttatgtttctcggtcatctccagggggatccagagcggcggtggcgggcgggcgagagccggagcagcggtgtcggcgtgagcatgggagctggagcgcggcggtagcaacggcctcatggctcgtcaagtcatgcatcccagccgaccccactggccatatcgccatccccattctttgcccccaccccgcaaccactgcgtcgtccctcgtcactagctacgttacctggatacggcttctaggccgcgtatccgtttcagatacgtgacggatacgggatacgtatcggatacgtccggatacgtatcccgtacatatcagtgattcgatgcagagccgccgtctcgttgtctcccatcccgatgcagtgattcgatgtcgccaccacacgttgggtagcaactgcgtcgtcgccgcacccggcagcacagcacctgctctgcaacacatgcacagccgcacagcatctccgccacgagtttgaggccgggtggcagccggccagggccgtcaccgcccaaggcaagacagcaccagctgcatcgaagcacccatg

SEQ ID NO: 67525 - DNA, 2534 bp, Oryza sativa
gctgctaatgttgatgcacatccatcaagagcaactgtgttgattgaactattaatttgcgctttgtatgctatttgtagtcttgcgctttattacacacaaatttttttttggggggagccttaaatcgcttcgtcaactatagcagagttggagaggatggccatggaatggactgcaactgcactaatactagtattatattgctattttcttaaaaaaatccttaatattttgtatttctaatatatataaaaatatataagcgtatccccgtatccttgttttttgaaaatgccgtatccctgtatcgacgtatcgcgtatccgtatccgtatcaccgtatcgaggtaacataggtcactagccctaatctccacccttcccaacgtcgagtgccttgcccgtgtcccccccgcctccctccctccgctccccgcggtctaccacagtccacagctttgccatgccccacctctgtcgcgcccacgcctacctccaccccctccctcctcgctctctccatcttcgaggacggttgcatcgtgcaagcactgctctaattcgacgcctccgtgcccatgatcgaggtcgccatgctgctgttgcccctgaccccgctgcattgcgacggcttctgttcatgcatgcccgcgcagtgtgataggccaggatgtcttcctcatcggccgcggggccgacgcgctcaccggcgtgactcgagagtgcgtgcccaccggagccggaagctgacgcgtggcacgtggtcggcgaggcgctgcggcggagggacgggtgcaccggtgcaagtgtgggaggggtgttgtacgtcgctaggggcatcgtggtgtctggcctagagatggccgagaaagagagagaagggagagagagagagagaggaggaagaaggagagagtgggccctacatttttttttgtgtgtataaatgacaaatgggtttcacatatatgttttcaatcctagcgccacgtcaacatcacatattaggtcacacactgtcatgtagatgtcacgttagcaaaactgtcctccaaaatcgtcaaggtagtcaaattgtaccggttgtaatagttgagggatcgagatatccgatattgtgatttaaggatacgaatcagattcgatcactagttaagggagtcaagatgaacttattccttcttcagatccacttacgaaggcggtaaggcccatgaaaagaatgggctagtagcttaacttccataattcttttctccagcccaaaacctccccttcggctcttcgcccctcgctacctccgatttccaatggccctagccggagcccctcgccgccggcgagctacacgttcgcgtctcccccccactctcctcctcatcgtcctcctcctcctcggcggggctcctcgtgcttccgcgctccgcgtcccgcttcgcgaggtcgccaccctcctcaacctctcccgctccctcctcaaccgcgtcgccgcagcccgcgcggccagtggagacgactttgcggcgtcccgcgcgcgcaggatcgcctcccatctctccctcttctcatcccgcggcgcgtgggcactctcttgggactacctccgccactacgccttctcgtcggctgccgggtgcggcctctcatgcgccaccgccgctgctcgcctcctcgctgctgctgcggaggtctcgcgcctgcattccgccaccgacgccgcccagtggctgcgccgcaattacggggacgtccgcgacgcggccgcgcagctcctcaacggtctccttgttgccttctccgagcaggtatatgacttgacttggtactcgtgattcatgaatcattggcatccaaattgcagcaatgttcagtttatggagatctgtgttgtggtttaggggcctttacgagaggtggtgatggatgtgaagtgggaagtggaggaaggggagctgctgaaggattgcctcaaggtgggagctaaggacttggaggggttgcttgtcattgccaaagatctcttatttggggccacaaggacttcttcgcgccacaacgaactttgaggtttggtacattggagactcgctgtgctcctgttctttcatttgaactaatgaaattaaacttaagttcagtattagaaatccagaacttcggttaacattacatcctgcagaccacctagtaactaccggtgtgatattatacccagcgtttcatacccgagaaaatttttgtgtgaagatgcatagttgaaatatactccctccgtcccaaaatacttgtcgttttgagtttttgtttgtaacgtttgacgactagtcgtattcaaaagattatggaattattatttattttgtttgtgacttgctttattattaaaagtactttaagtatgacatttttttttaatatttgcactaattttttaaataagacgaatggtcaaacgttgcaagcaaaaagtcaaaacaacatctaatttgggacggaggtagtatcttctagtggttagggctgcaggaatt

SEQ ID NO: 67526 - DNA, 823 bp, Oryza sativa
taagcgagaggacacacggccatgcatgcacgttactgcaattcaatgcacgctcaagaacaaaaaaaaaaaaagctagagtatcacaagctatggcactaccacttgtactagctggagtagtccagacttacagtttactggtagctagcctccaatgcatgcatgcacaattgtgcgccccggtcctgcaaaagttagccgccggtagccctgccttgcacctatataaactcctgcgtgactcgcgctcctcagggttattcgagtgatcgtgcccacatatctcccccttcttcctcggctgtgtgctctgcaagtgtagctgctgctagctagagcagagcagcaatggagttggggcggttggtgacggtggtgatggcggcggcggtgagctcggcgctggtgatggtggcgaggtgcgacccgcaggtgccgtgctacttcatcttcggcgactcgctcgtcgacaacggcaacaacaactacatcgtttcgctggcgcgcgccaactacccgccctacggcatcgacttcgccggcggcccgtccggccggttcaccaacggcctcaccaccgtcgacgtcatcggtaagacaccaacgttgtgctatctgctgctgctgctgcagcggcagctacgtgtaaagtgtatagtcatgcagattttagctagctgatctccaggggtttatggccgtcatggtgatgcacgtgctgagctcgttgaacgagcgatcgatcagctgatgtggaatagaaaattctgagcagatgttagttaggagaatggggagatggtagcttgttgctgtggta

SEQ ID NO: 67527 - DNA, 1413 bp, Oryza sativa
cgcgccacccctcaaatacgcagtcctcgtcacaccacgcgcgagcagccggcggatggggacggcggcggcagcggtggaagcaacaacaacaatgggaagttgaaggggaaggagaaggtggtgccggagtacggcaagaaccggcacggcatgcctgtcggtttctacttcgtccccatggacctagagcttttcgccatcctcatgtgcaagctcgtccgaggtgaggtccccggcgccctcaataacgtctttgagcatatcaggatacttgaattccaccccgccctcctccgtggtacgcccgcttcgccgccaccgtcactctacccctctcttgttgtttccttcgtcattagtattttaaatagtgggataagacatttagcggttgggtttctcaaacagcaatacctatagtgggttaaatggagttattacagttaaattatacataaaagcaaatagttggacccttcttttaacatttataaccgaagaatagcagcagctataactgaggatttaaaaccatgttcatcattgtcttcttcttctccggcgatggcgtgtgcagagacgtatatcgagaacatggaggacagatgcatctacttctttagcaggaggctattcgcagcgaaggctaggaacaagaggcagccgatgagggtggcaaacggtgggacgtggaaggcatctggtgggagcaagacggtgaggagcaagaaggttggcggcatcgatgttggtcagaagctcccatggtgttctacgagcgtaggttcgagggcgaccaaaaccctgtcaagaccaactgggccatgcacgagtacaccaagatcattcctagctccaaaaaccaggtagtacttggtaatttatatttaaattcaaatcagtccgcaaatacattacattacgatctatatctaaatagggtgtagctatatttatggcgtcatactttttataaaaaaatagtcggcatgtatttatattgtaagttcataaattacatatgtaattttagtgtatttacaatgtaagtctcaaaattacatatgtaagtactaaaattacatatgtaaattcgaaaattacatactaattgcatatgtaagtggggtgtaaatgaggtgtaactactgtgtaagtggctgaaaaaaatcgactatatttctagcaactccgtctaaatattgtgttttgtcttgtaattaacattccattatacggcctccattacatattataagtcgatttgactttttcatagttaaacttcaagtttatagacaaatataataacatctaaaacatcaaactagtttcattaaatctaacattaaatatattttgataatatatatatttttgaaatactaccatattttttctataaattta

SEQ ID NO: 67528 - DNA, 1535 bp, Oryza sativa
  unsure (1)..(1535): unsure at all n locations
tctccttggcatatagacaaaggctctctcccttattcccttgttgttttccggaccatggtttgaaatttcagtaattttggcccccaccggcaagcacaaatctccccaaaattttcggttttttgtcaaatatttataactttggtcaaattttgttcaaactcagtaaaaaaatatgttaaaaattcaaacaattttggtcaaaagaacctgaaaatcacgaaattttcaaattttaggcaaccaccaaaattgcaaaccctgttccggagcccagttgtgtttcttagttagcctagtgtgctctcccccgtctcacctctaacccccccatgaccagcttcagcgggctgtagttgtaaaaactcttttttttttccttgctaatatatcaatgcgtaaggctttttcgcgttcaggaaaaaagaaagaaagaaagataaattgaggtggcacttagataactaatgcactttatctaaaaagaagtaaactaatgcaaaacttgcaattgaactcctgacaattcaactgcgactatcatattaacgctgaccttgtgagacgtttagacctgacaatatgggaaacgatacaagtgtgaaagagcttgcatcatcatccataatttctgctgccattgcatatattatattcatgataaaaaatggatattgctggctgctgaaagtagagagagagagagagagagagagagagagagagagagagagaccaaagagttctgtaacttccagaagcttcaacacatatggtacttgaagtttaagagaagcgttacctgcatgcagaaatgtgacttccgcatagccatctcatgtgacaacaggcatttatattcttgccaccacagtccgatttttccataagctgatatatgtaaggtgtaacctcctacagttcaacattgatacaaggcccattaagaaagaggaaagggataatgcacagtttgaattctgtacctggaagcatatgaagtctgggttgtgaagttgaataagatctccaagagccgcccagccttctgtgcagttcnatatcctctctgatccagacattgtatgtcatgattttaaggtcttcttgtttaaattattctcaaatttttctgcatgacaagatttgtattttagtgtggccatagcgaagaagaagaataaagtacagctttgaaggaaaaataaacttctaattatctagatagataacataatcacacacatatgtaaaattaactaccagatttggtcatatgagaactgcggcaactccaagatatagatgcaaaatacccgagcaatttgcatatcaactagatcttacacaattgctcaaacaattaataggaagaagcaccgaaagaaaaatattgcatgcttatggcaatttagtagaaaacaaatgacagaatgaaccaggtgaatagtattctgtatcaagagaatattaaattcagatcacatagagcaaacaaagtatttgtctcatcatacatccatcaatactgc

SEQ ID NO: 67529 - DNA, 6032 bp, Oryza sativa
cggtacaaaatagattcgaattttagattgagataaacccccgagccccaccagtgtcgctatataaagaaagagaaggatggaggctgcgtgacgactcaactctctccaaccctaaaccctaaatcaatcgcccgatcgattagacactggaagggattcgtaacagaagaagaaaaaaagaaaagcaatggcttcatctcaggtcagctatatcaattaatttccacatgagcagaaggtgatcatgtttaggctaagattcaattaattaattgaattaaattccaacacataccaaatgaggtcgaatactctacttaagcatgcattttgtgacgactgactagtaagtatattcggaattttccagcacctttatgctccgtctgcattttggcctgtttactatagccactaatcactcttcagaatacaagagtcagagccgcccttggatgttgagatacagagtactgagagtagcgtgaatagttaataagtactaccaccctcccatgaacagtaccgtgtctagatttattaatatctatataaatataaataaatgctaaaaagtcttataatctgaaacggagggagtaataattaaatcgtcttagtattctctcaccattaaacaaaagagtttcactgataagtgataacagagcacttagggccaagtagttgctaacttgctgatgtccttgtccatggctttgatgggccatggacaagggcaggaggcgtgggaactgggccactggacggacggtttgctttggtcttgtcattaccggcccaagcaaacgcccatcacagcccaagaaaaccaagaaagcagtttcgaactttggcagaacggttatgcaacgtgaatcttcaggaatggaacatgccggtgttttgttggttaatcctttccatccatgacaaactgttggccggcagggatacgcgcgcacacatgacgaagtttccgtgtatacgatgtcgcgcgcggctgaaattgtttgggttttgacctgcgttgcgtgcgtgcgtgtgtcgtggggcggcgatcgatgatagatgtaccgtgaggacgccatccatcaaacaaatcaagaagaagaaagacatccctttgcatgcaaattaaagtatccgcgccccttttatgctagctggagcaaaagcggaagcgaattcatcatgcgtgcatgatgaaccgtagctgcgttgctagatgccgtgcctgccgattttgtgctctaggtggttctctgatgtttaagcatcagcttgaattctgaacaaacaaatccgtgcggagttcaagaaatgacttaattagaaaacctctttggagcacccagattttttttaaagaagctagtctagatttattgcattgacatagatagcatgcatggcttctcctagcttgcttaattgcagtggttcactcaacattttattttttcgaacgaacgttcactcaacacttaatgttacgataatctgttacttgtatggggctcaaactgttctcattttgtcaaaagaaaaaaaaaactcttttgtttggtctgttcatgcatggttaatttgcaggctgcaaatttgcctggtaattaatttgtcgaaaatggttaatgcatcatgttccacaccacttgatgcatcggccaatcgatcgaccaggtcgtactaaccagtccacaacatgattaacctgggccggcctctagattatgctaacattttgaacaagtggatgtactctgtgcctatcaaaacaagtaattcgatcaacattatccattttaacgagtgcaagcggcgctacccggaatccggatgcgcgcaggtagcttgcaacaccgaaaaggccacgtacatgcacgtgatgagctccgtttcccccatataagcgatacacgcatcatcatcatcatcatcatcatccgtacaaaacggtatctagcctagctagctgatcggcccacctacaaagcctataaattgcgccatctttgctcatcctttccattatcattgcgacgtactaatttaatataagtatagagcttcatcatttgacaaacaacaatggctaggttcgcgggatcccttcagctgtactgcctctccgtcctgctcgtgatcctcacccagcttggaggaggctctgccatggggctcccccggccgccacccaacgtgaacttcaccatcggcgtcgagggcgctgtctggtgcaagacctgccgctacgccggctacgtcaagtccaaggacgcctcgcccctcccaagtatagtactcgtaccaccaccaccaccaccacccacctgcgctcgatggcctcgttttggccgctgaaaaataacgtgtgctttttgctgcgtgcgtgcgcagatgcggcggcgctgctgcggtgcaggcgggggaagtgggcgctgtcggtgtggggcgcgacgacgcgcgcggctacttcctgatccagacggggacgcaggtggcggcgttcacgagcaaggactgcagggtgtacgtgccgcggtcgccgtcgcgtgcggcgtgcggcgtggcgctccagcctgggcggaagacgggttcgccgctcaagttccgcaggttcgtggcgctccccgacgggctgcaagggcgctactccgccggcaacttcgtcttcggcccgcgagaccccaagaaatgctgactttctgattagcggtaacgtgtttgggactttggggctgggggtggtgtggctgtgcacttcgaattctacacttggtcacagtttgtgtgtggcgtgtgcccggtggatcgacgtggacgtgcatttccgcatccagcaaataatgatgataaaaaagtgttggacgtagccccagacctagtgtgttgtgtttagttcctttcaaactttcaaaaatttcatcgtatcaaatgtttcaatatatgcagggaacattaaatgtgtacgaaaataaccaatgtggttcttaaaaagaaataagggaaacgatcaattgaaagggcactaaaagttcatatttcaaaacaagaatagcaatgactgaagcttggattgattgcctatataagtatacctcaaaccaatgatgtacaaaacccctcttggatcccctgcgtcacaaatactttccctatttatgctacgttttctatctaatcctatgctaactctggtacagctaccactctgtcctatcaacctcctaactccaactctaataaagttacatcgcgccctatagacctctctgcatttgaaggcaaacttccaatgcactatgctagccccgggcacgcgcattcccttgggtgtcaagtcagttcatttctattggaaactggacgcgcacaagctgcccatttgtgcacggtcagtccatttctaagattttaatgttcccgctggaattagcagaaagaagcgttgaggactgccctctccaacacacgcatgaaatgaactgtgatggatcgtcaatctcctggcctgatattgggtctgtgacactgaatttatatgccaagactggcattggaaatgctttgtggtagacaaaaacctgaagtaaaacgagatggaaaggaaagttagatatttgaattaatattaaaccccaagcaagaatatacaggcacgtatggtataaaaaataatttctatgcctatgttttcaataccaaatttcatcttacggcacaaaataccttgcgcactaaggtaagtgagccaaaatattccttcacatgaattcggcaaacattaattcaactgttacatagaaaatgcaggttacaaaacaaaaaaaaaaatcattttccatgacgctctcatcttaatacctgatttctttcatctcaatattggtttctgagagatgcatggattgaaatttaagcacaaaggcatgcaaagaaatggccaaactatctatcaataataaacagcagcatgcttgcaacaaagtttactgcattagggcaactccaatgattagctttgcacaaaagctggtgtcgctgtatgacattgaaattaaccttcaaatagtcggcagagaatttggtggaaacttagaaaacatacctcatttgtctctgagccagtagcaatgtaaccatcagatatagaaagtccaacaaaattctgttcaacaggttcaagaaataactaaattaagcataaaacaaagtattcttttgcctgaaagcaactaaaggaatatgaagaaagggctatactagaatcttaatctcgaaaatcaagtgtcattctcaaaaaagcaggcaagtggccttaatcatatctttctagccagcccagacagtgtttaggtgctcggtgaacccgcccgcctaaccatttggccacttatcaatgattaggcactagaggatgccctgctgctccctcaactaccacctagtaccttggtaaacacattttgcttggggtactaccacctataaggcatgttgaaatttttaatactaccgaagttggagagcaaattttgtgcaggtgcacaagaactaattagggattacactgaagctttatgacatgtaattcaaagactgaacatatataacaacaacatgctgagggaaaaaggtggtaactaggtgcacagaaaactgacaaaatgaataacaatttagggttgtgcaaaagctacatttacacaggatgattgttatattagataaaaaagaaccatatccagaacaataccccgagaaaggtttatgcaccgtaacaaaaaaggtatgcaggatattctaaccttagtgtttgtatgacctgtaaatgtccgaagcggactgtcaattatccttgcctgactcatggacaagtcccagagcttcaaggagttgtcagtagatgcggacactatagttgatgcatccacatacttaacatagctaactgtttttgtgtggccaactaacgtacaataaggagctcgtatgtttcgaagatcatagcagtaaattttgtgatctgctgatccaattgcaatggaacgagcagaatcaggttgaaactgcacagagcatacatttgctcttgttctgatagtgccaacactcccagcctgcaaagttcatgaaaaagtgttaccatagcagaggcaagttagtctactattgcagacataagctcgataaccatgttatcggtagttcaaaagctgacatacaccaggtgcaagaataaaattgcctgattcatattccacagcttcactgaaccatcatcactcccgctaaccaattttgttgggtccgcaagtgagaagtccaccgaccacacacgcctctcatgttccctcatttcaacaaaaacttggctcctagtaacatcccaaacctgaaaaaagggggatatttaataatggccatttcatcaaatgcaaatctgaaaaatgttccttagaagtgagcatacctgtacaataccttcaaagtcgctagatgctatatggctcttcatgtagctgttccagcaaatacaacttaattttgatctattagacatctcaaccacaggatagtgaatatcacaatgttcatttacaatcatattatattcaaacacttttatcttcttatttacaccagcagttgcaaagaactctttatcccggtcgaagcctacagagcatactaagtttgatgagttcagcagatcacattgcttcagttctgccttaactttcaacttactgaacgataagtaactacacaatccctcaagaaaagagttcatccaacctctttgccttgtaccataatgcccttccaaagcaaaatcatctattgaacttccctcagtcacaacaggtgacccagtagtccttttcacgacttgatggcaactgcttacaggattcccaacttgctttgccaacttggatcttgtgagaaagtatgctgtttcaagttttttgaagttcttcatcagtctggagcttttagacaacacactttcctggatc

SEQ ID NO: 67530 - DNA, 1331 bp, Oryza sativa
aaaaagaagaagggctttttatggttttcataattaacctaccagtccacaacttaactaaatgttgtcgcgttcttaaaacaaatcctaacttaaattcagcaaaagaaagggagtatcaagaaacatgacatattgacatgaatggcaattggcaattagtggcacttcttttgttacttcagaaaattagtggtgtcgtgtgcaaaaaaaaaaaatccaaacaaatgaatacattgcatatataaaaagagggacagaaccatgcaggcacatacttcaattgtaacaaagctaatttcttttatgtaattaaaaatgaagtacaagtacccatgaagctatgattcttgagtatttaaaattggattaacatgttcagatcgtgcaatcgcatgcgtgcttggctagttattttatccttttctattattacataagttttcacatgcattaccaatctagacttgatctaatgacagtgctagtgaatattacagagcattgcatctgctgagatatatacttagtcatttacagataaccttccctagctccttgccagcagtaatggcctaatccttattccctttttatcagaccaaaatatcataatagttttatcatgcagtgtacgatcttaagctatcttcactagtaggaaacaaatgcagtgccaacttgtcggagaagtatactagtaggaataataaagtactacttcctgctgcccaaaacgagaaacatacagcttctagttctagtgttaattttatcgcgcatatgggcagatgacacacgcacctcatcttcggtcgggtctccggcacagggtgcatcaacaactgacagaatgatgcttccttgggccacttgagcagcagctgtggaggcaagacgcggtgccgtaggttcgccattgctcgcatcttctcctccatcgtctcgaacgtacagaacaactgaaacaacagccgtagacataaaatcagcgatgagctgagccgatgacaagcagtgcatgcggagaactaacagcgcatttgatctcaagcacccgcacctcgaacaagagcactcctaacctatacacgtcggaggcgaaagtagcgccgccgcggtcgtcggcctcctcggggctggtgtaccaggtgagctccatcgccagcacgctcctcagcgggaacgtcttcccgccgcggtcctccccaccgctggcgccgtcccgtcgccgccgaggaggcgagggttccggtcggcctcctccgagccgtcggagccggagcaggagcccgagacgtcggagccggaggcggactcgatgaacgcga

SEQ ID NO: 67531 - DNA, 2393 bp, Oryza sativa
ccaactggagatcatatggccttaatataatacaacacaataccaaatgacaaaccaaattaaatcacattaattaatctccttcagacacatgactggtttcttagaatattgtcccatgtacccaacacgtgatgttctctcggactgaatcatgtattttgtcgatcggtttcaaattattttaggtttattttaaattaaatgtatctacttttagtcattaaattttaaaaatcggtatatagtttaataacatgtgaattatatgttatagaagtatttctaaaagtgaatcaaaatataaattttatgatactacactatataagttagtagaattaatagtcaaatattaaagtgtttgagacttaggacaaacttaggaaaattaaagtaatgtaaacgctggacacgtacgtctcaactgtctgtcattttctcgtgggctggtcggtcggcgggatcgtgatctacttaattggttctttcttggtaagaagtaattcacttttgctaatcagttctcgttaattaaatcgtgccctcttttcagctacggaaacacgaaagtttagacatcgacacgatctttaaatggcaactttggcccaacgatatgtattgtggtagttgtaggatcgacaacaactaagccaaccagagagggggtgaattgttagtatacctaaaaaccgaaaacttttagcggaaataaaagtttaccctcaaattcgacggattacggtttgaccgaagtttattgccggtctgaccacctgaagaacgtcggtctgaccgagatcaaactctggtcgaaccgctgatatcacctgctgtcgcctgcctgtcaccgccgtgtccccaccggtctgactgccgcgatgccgctggtctgaccgccggtgcgccgccggttagaccgccgaaacccggtgaaatacatatagaatcttcaccaaccacgtgtattgaactctagccttagtatcccgcatgatctctgactaccatggacgtcgtctcttatccccaagccgactcccgatccatcaccgcaaatactctcccgaggcatcgagtcacctacacatgaaataaacaaagaaacatattccgagaccaagctatctccaacttgactcattagtagcaaacaatagtattacatacgtatagtattcatctagaagtcataatcatgaaataatcacagatatccaaacaaacaacccgaaaccgaaaccgacacagtgtcggccggtcagaccgcgttctggccggtccgactgctcgatcaccgccggtctgaccggctaccagagcccggtctgaccggtcacatgaaataatgaatcctgcaatcacctgtaaatccaatcatctccaaaaccacttcgtaaataaattccaaataacaaaaccagtaatctccaatgcccaattgttcatcacagaataataataaaaaaacacctttgattttacataaacgacttaggccctgtttagttcccaaacaaaaatttttcaccctatcacattaaatatttggacatattcatggagtattaatatagacaaaaaaactaattacacagattccatgtaaattgcgagtcgaatcttttaagcctaattgcgtcatgatttgacaatgtggtgctacagtaaacatttgttaatgatggatcaattaggcttaacaaattcacgttgcagtttccaggtgtaatctgtaatttgttttgttattaatctatgtttaatactttaaatgtgtgtccgtatatccgatgtgatacggttaaaattttcgtttgcgaactaaacaggcccttataatatgaaacagagggagtacatataaagccatttggatgggcgtagattcttattgcttacttcctttattcctaaattcttctatcaccagacgctatttatatttaaaacttgaccaaatgaatttttataaaatatacttcctctgtcattttatgtttaacgttagttagttcaaaccgtcaaatatttgtggaagaaggtagaatatatataaaaagttaaaagaaattgtattatcaaagtgtgttttcaccctaaacagcattaaacttttatcaaagtgtgttgcatcctaaacataagcattatgcttttattcattgtagtctaaccatttaaaatgctttatattagtagtcaaagttgaaacaacatcgatcgatagtgatagtatttggaacagatggagtatgatctctgaagcccaaaccatcgtatcgggtgacttaatagtgacaaatattttggctaggccggcgtaaggtaagcccaacgcaaactaacagcctgagcttgttaagatgtcaaagaggaataagtttgct

SEQ ID NO: 67532 - DNA, 1371 bp, Oryza sativa
agatagacctaaagtgaactttatttctcaaacaagaaggtgcgaataaaggccccccatcttttagcccaataacaacggggtcatcttttttcttatgggccgtgcaaagtttcagcccatgatgcccgtgggcccggtaaactcccgtttccgtgcatgccaagaagcctctccccctataaaaaaaaaacgcccccgacaaagagggggacccaaacgagtcacctctcgcaccaccaccgcgtcagtatacaaacggcggcgaccaaccaaattccggcgagtcgtcgtcgtcgtcgccgtcgtcgagagagagtcaaaccccccacacgcaaagagagcgaaaccccacccccctcctcttcctcatccaccccacgcacgcctcgtcgcggccgcgcgaggtgagctggagcgaacggcggcgatggcggcggcgaaggaggcggtggtgccggtggaggggcggaggaacgtgctggtgacgagcgcgctgccgtacgtgaacaacgtgccgcacctggggaacatcatcggctgcgtgctctccgcgagccttcgcgcgctactgccgcctccgggggcaaacgtgctctacgtctgcggcaccgacgagtacggcaccgccaccgagaccaaggccatggaggaaggctgctcccccagggagatctgcgacaagtcagcctctctctctctcctgcttgttcttgttgaggttttggttgctcttcttcttttcaagtgaaccactctgctccgattatttgatcgattgagcaaaattgtggcatggcatgaattttcccctaaattttgaggcgatttcatatcgaatattaggaacagacgagttgtgtaattttgtaatggggatccagttcgggttaggaacgaagggaattgtcagcttcagctgtcttatccttttggaagcaaattgtcaaattgcgcaactctcaattggtccaagtccccaacgaaacaaaaatcttcctgtcccactagttaatccttttttaaaaaaatttggattagcgcttactagtacagctttaacaactgagtcctctctcatgccatgtgcgtaatgaaggtaccatgccatccacaaggaagtgtacgagtggttcgacatcagcttcgacatcttcggtagaacatcgtcgccgcaacagaccgaggtctgccaagacatcttcctcaagctactggacaacaattggctgtcagagaacacaatgcagcaggtaaagttatagtgtcagtgcagggattattactttattggcatcttgtttcaatagaagttttaatttccattgtttcttctgtgatgtttttttgctaacaaagggctgcaggaat

SEQ ID NO: 67533 - DNA, 3259 bp, Oryza sativa
gcatggaagagtctatggtgagcaacctagcaccaaagtgttttgcaagtgccttaaccagatattgttggtagatatcggttcctgtaaaaacatatgttaccacactttacacatagtaaaattaaattaatcattggaaaaaaatagtagcattatacaatacaataacaccaagcctacagaatgcatacagtatgtacctgccggaccagacagcagtactcgctgactaagagaagaaatatcttttgtgaacttgatatagtccttgcagtgcaaatttacatatgctgatgactggagagcagatttggtgttctcactacataaacaaaagagttattagaatatagttcatgacaactatgcgttcaccgtttagaaaagaaatggcttgaggaactagaaggaaagtatttttttaaaaaaaaaatagaaggaacataaaatagttgatatagcccaacgtccccaaggcctatgtgtgtctactactctactgtagcccatagtgctgcaagggcagcgaggagtcaactcaatagtatagatttattcatactgggagaccatttggaataaagaagtgattctatggaagcatagataacataaatctaatgattttattcagtcactaaatccatatattgctggactaattgtatgtcagaatttacaaaaagaaattacaaaagaaacatttgagaataaattggaaggaacaaggaaaaaaactaatatcaagcatttacatctgctgcaaattacagatagaagaataagacttcctagaagaaataacagcaccatatgtctgcaaactaatatcatttagatgagtgtggaatacaatgatgaagcttatcaagagttccaaactaagatgcacagagaccacagaacttaccaaccatggcatttcaaggccaaagaacaaatactcaatctcataagtattaacaaaatttattacaacagtttacagagatatcctaagaacaaaaatagcagaattataagccatgagacaggcagctaagtacagtttaccttagataatatggacagctatcaaatgtctcggagatttcactaggatcaatagttgcatttttcaaatcctcctccaataattgacaccaagcaaatggtgtgttttcttcagagttaaactggtcctccattgttttacatagactactgaccagatctggatccgatgatgatcctgcaataatgcttacattagcatctttttctatcaggtaaagtgcaatttcaaatgaaatacattaccaacaggcatcaaaggaggtcgactctttccaaagtaaaaggatgttactttggcctccttagatgaaaaaatatccttaaaatctttgataagcgaatgctgccccggctgaacactacaccaagtagaggaaaatggcgatgtgcttgatttctcctctggaagttgctcaaatatctaacatcgcattaaggactttcaaaggcaaaatatttaattgtctaatcattgcttatcacttaattgaaaatcttattatgcacaagtgtccagtaaaaatcaaatcctgttggtgctagcctcaaacagagccagtaaggaacccactggataaggcgtaggcaataaaaaggatacataagcatgcctcacaggtgtattgaaaacaacttcatcccctccacataacgtaactttattagtcttgtcaaaagactttccatttacacgaacaactttggactcgtagatttcaagaagagcacctcgctgatacatgaaataaagataagacagggtacataagacgtgaaatgtgtataacacaggaacttctaaaacaccacgttaccttagcatgcttcaatctacaaacaagtgagttggtatatgacccttccagtctcaagttatggtgagctccataaccaacagtaaaatgcgaggcattaataggaatggaaggattctgcacattaagaaagaaatgcagtaaatcaaatgaagagcagagagtgtattatgaatttgctagaagtattacgtagctactaactaatgttggcaaaatatatgcaatagcaaaaataacaatagcgctgtttcataattatacatgcttgcgatagaattgttatgtaattcgttgtgtagtaatacaattcctgcacattgcaatacctattgatggcccaactgaaatagcagtgaaggtttagttagaggaaaaggatttatgactgcaagatacataacacatttaacacttagtggattcataacatatttaacagttagtaacttagtggatacaagcatatttaacaatgtgtctttaatttaggcattcctggagaacactaccaggttcttaatggcataatatacgaattttagttgtttgtgaacattatgttatagaataaattgtatttatatatgaaattaaactgttcgctgataagctccaaaaacatagtacaatttcttattaaagattggaggagcaggactattctgaactaagaagttttacgaaaatgtagtatgcagtaagctgatgagtagaaatgatgttgttgacaagtaacaaaagtgttcatgagtctaatttatcatctaagcataaaaaataaaaaatatattaacaatgagcaaatcgagttcacggttttattgacccaaacaacatcaagaacaaaccgcgcagccagaccttagcatgttgagatattaatctgcaccagggctcctggcgcctgttggccaccgggggcagccgctttttggccacgccatccgccaaatccttcacttccttcaactttgcttgtaaatccttagcaagagcactgcgcttatggcctgcagcgacgattcatcagaccccgagggccaatccaaaacccccgtagtcttacccaccagagaggaagaaaccgtaccggccgaattcgataccgcctcgccgggcctcaggatggcctccagcctatccaccgcgccggtcagagcctgcagcccagccgtgtcaagcggcggcaccgccgcgcccccgcctccgacgaccacaggcgtagcatccgccgccgacgccacccccgacgccgacgccgcctcctcatcctccttcccgctatccacctccaccgccacggcctacaacacaacacaatccaacagccaccacagatcagaaccccccgaaacagacgcccgccaccgccgcgcacggaa

SEQ ID NO: 67534 - DNA, 2630 bp, Oryza sativa
cgagcggcgcgcgcgacaggttaggctgcgctgtctcgatgagggtcgagggccgaggcgatttggggaagtttttttaatttcctttctttcttttcaggggattttgctgcttctgctgccctcttgcggatgaggattattcgggtgtttgagtggcgtggggctggggattgggtactgtcgtgctgactgtggtgtgggagtagcagagagtttgggccgtcgtcgtttggcggttcggccgtccgtcagtccggactccggaggcggaggaactttattcaaaaacggggagaggatttttaacggtggattttgtgcgtgttttgcgaatgtatgaactttaaccgtataaggattaatatgttatcgtaccaacattaatctggatgcctagtttagtttgtgtactaatcagttctctatgttttgatggtagatactccctctgtaccaaaataaatcaacttctaacatcactaaacctatgttctaacttcgaaaacaggtcttctcggcctttttttctcaatacacgtatcctcatatacgtaactccgatggcaacatcgctaactgttcctaataacgggactaacctctttacaaccgtaaccgccgtgctttcctttactccgataagtactccctccccaaggaagtacttatctcacttccacaaaaatagcaaacactaatatttctttgctccgaggaatcctaccttccccaaaggtagaatccctctcacttaaaaacactagacattagggtactaaaaaaacgcatggtttccgggctcgcctctttgaggggccttcgctcggggacaacctcgctctgggtcttacccaccctcgagtttaatctcgggtgggcgcttaggcataccctattcactggaccggatccgcatcctaatccaaacaaaatacatactagatcctagacttcacaaacctggtgatcggcatactgcatacctacacgtccagtcattgggatcgagtgaaaagcacaagtgtatgacacactcaaatgtcatatttcactgtgttcagaaactcattcattcacttccaagaaacttttcatctagtttacttgaacccctttcaactaaaataaaccaatttctaccttcttacctatcatcggtccacaaatcgaaaagttttatctcttcaatacccctcgcctacccacccatcagtatattaattagcggtattttggtcatttgtctctccccttgagagtaagtttaatagtataacctatcgttggctccaaaaatctccacatcagcaatagagctagagggtgtttagatctaggggtgtaaagttttggcgtgtcacatcgggtattatacagtgtgtcgcatggggtgtttggcgctaataaaaaaataattacaatatctgtcagtaaaccacgagacaaatttattaagcataattaatcagtcattagcacatgtttattgttgcgccacattgttaaaccatgaagcaaataggcttaaaagattcgtctcacaaagtagtcgcaatatgtgcaattagttattttttaccctatatttaatacttcatgcaagtgttcgaacgttcgatgtaacagggtgtaaaattttggggtgtgatctaaacaggcccctagtgaataagagcagtatgtgtacaaataagtatcccctccgtctaaaaaaaagtccaatcctgaggatgtatttgaacatacatgttgtctagatacatccttagaatttatttttttttgacagggtagcagtagatgttaaatcatctacacccaaatagaatacatctattcttaatttcttaatctaaccttttcacgtctgccaatatccttttgctctctatccaatcattctctccgtgagaaaagaactactccttcgtaaaaaaacaatctatgagaggatataaccctcctagtacaacgaatatagacaatgtctatattcaccttggaactaataggagatatggtagcatagatagttttcaccttggagcgtgtgagcagttgacgcttatttattcgctcgctttcactctctgtccactcatttagtcattcacactctaactcatcaatttttctgacatggatgcagtatagccaacaaaaaatgatctattgtacctgctctaaatccaccatgtgaaatcaggattggagttcttgtgggatagaaagagtagtctattatgttttgatggtagatataggactatgttttcatggtagatagaggatttagcattgcggaagtttagtggcgttagcgttaaactgaatagtatagcattaagattttgatgatgtatcggattttggttagaatttattaataccaagtgttggtaaactctttagccaaaaaaattaaaatatgcctttacggtttttacgcgtctgtgtccatcattaactcctccgtttctatccaaaaaaaatatattctttatggttgacatggtttcttttcctcccatgcttatatctatatctatttatatctctactcattctaatcgggtattcctaaacaattctgaagttagtctctactattataaaaattgatgttt

SEQ ID NO: 67535 - DNA, 5419 bp, Oryza sativa
aaaaaaaacatctatcgtaaaaaaacgaccgactcgaagtccgactcctccagtggaaaaaaaaaggagaaaaataacttctatcataaaaaacaaaaatgctgtactccgggcgaccggcgtggggggaactggatcggacgctcccccgcgcacccctcccccacctgtatatctgctatctgctagacccatctacttctccctccattttttacacaaaagatatttcatctagtatatttacaatgtttcactatttatagatctaatgttgcagtgaattaaaatattcttttgcaacaaaaaacccacatattttggaaactctctattaaggaatttggtttattttttgttccacagaaaatgtttcacctaatgtactcacaatgtttcactatatatagatctaatgttgcaacgaacgaaacattccattaaaaaaaaccaacatattttggaaaccccctattaagggagtttagtttattttttgttccaccgaaaaatgtttcacataatgtactcacaatgtttcactatatatagatctaatgttgcaatgaactgaaacattctttcactatttactaaaacattgtttttatatagggtgaaacaacacctgatttaaacgagtgaaacattttcgatctacttagtaaaacaattccgatatacctggtggaacatagtgcaatatttaaaaataattcaataataagttaattttttttcatcgaaatatatccatgtgtggtcttgttttgaagatttaattgcaacgaatttaatcgtgcaatcggatcatgatttggataagtttggataagtaatttaagagataaatcagtttaaagtaattttgcacataaatcaagcgctgacgtcatgctgacgtcagcgcccgattttaccccctcccgaccgggcgcccgaccgggagtcatctccgtaaaaaaaaacgtccgactccttttaagaaaagtccgagtctgctgtggagaaaaaaaaaggcgagaaaaataaaaaaatgaaaaaaaaacttctacagtataaaaaagaaataaaaacgtcgtctcctttaaaaaaaagtccgactccaaaaaaggacttcttgcccgtaatcttctctgaaaaatatataaaacttgaagatgtttttactgatactttggtacgtcatacgtgtatgggtcggtttttaaattcgtttgcttttagaaatacaaattcgtatttgagttggtttttaagttcgttcgcttttggaaatacagaagaaatcgtataaaaaaatctttgttaaaaaactcgtatgctaatttgagacggtcggactcctaattacagctcttgattttctaacaaaacatatatccaagcaaatttaacacagtgaattttattttaactaaaccatataacaaataatattaaaatagccttcacccgttgcaacacacgggcattttttctagtcaaagaaaatatcacatgttgatggtatgctaactccaatattgattaaggaaactaaatgtataactatccgtttactaacactacttacacatttaacctattactaggtagagctgagtaatgttgggtgtaaacagtaagttaagttatatacgactcatatacattacatgacgagtaacaataaagatttagtcagtgtgccacgtaagcaaaatcaagttagattgttatttatacttggtttaggagtcaaagggttgaataccttaatttaggatttttttttcttgtgcaaaacatgttaaaataggttggatatcttaaattgttgtagaagatgcgagtaaacaattgcaactataatattgatcattttttataggtgcaagagcgaataaacgagtaccaatgtaatagccaaataggtcagtaacttagaccatataaatccggcaccatcgattcgatcattgataacctgatagagaagctaccgatagataagcttcttaaattaggatgttgaatataccagcgatatagacaaataaagcaacagcaaatatgttgtacatcccacatgccaaaaaaaaaagttgaggaatatgcgtctagatttcaactgaaacaataatggtcatatacaagtactatgcagaattgaagattgactttaaattaagacatacagttagaccatactccattagttgggagagtgtctgacgtcgccaggtgagccgttcgtataggctgcaaccaccagacctggagagcaaagagatctggtcaaccgttcatcagttgaaggcgcacgctcacagttagcaccaccgttattgcgacaaacaaaaacactccgaaagaaacccctgcagcgtcaagcgcttcagccggcaacataggccttgtttagttcgcgaaaatttttttttcttttgtcacatcgaacgtttgaccgaatgtcgaaagaggttttcggacacgaatgaaaaactaatttcataactcgcctggaaaccgcgagacgaatttattaaacataattaatccgtcattaacacatatgggttactgtagcacttatatctaatcatggattaattaggctcaaaagattcgtctcgtgattttcatacaaagtatcatgatttttatacaaactgtgcaattagttttttattttatctatatttaatgctctatacatatatccaaagatttgatatgacattttttaggaaaaatattttggaacctaaacaagaccatagccattatagtggagtagtatacgtatagtttaagctaagcgccgtccgctgacggcgcgcgcagccgcaggcgccgcggaaaaaaaaaggcagagcagcagcaaagcataacatcgtcgcgttgcctgagccacaagccatcaatcacggtccacatccaagcatccgacgcagctgcagctacagaggctaaacgagacccaacatgcagcgatgccaccaccaccactaaacaaatactccacggaatatttcaccgcgtcatgtgccggtgcgtgcccgggtggtggccgcactctcaagccaggtctctgcgaaaactcgtactacacatgcaagtatccaacctgcaggttcagctcaactccaagcagctcggcgctttcggccggcctgcacagagaaaggcagccgccgacgacgagccgcctgcgtcaaaaaacgcttgccgacagcagcaagaaaggtctgacgctgcacccgccgtgacatgtctcttttgccgagagaagagcactcacccaactacatatacatcctcctaccaaaaataggttcattttcatatgtaaatctagacatagattcatcaattcctgttactactacgtacaccctccgtctaaaaataaaaaaaaatccattttatactgattcacatgtataaaagtgaacttattgttttaagatggagtgtataccgagcacgaaaatacaatgatggcatgaatacctggatataggcatccccttcattctaaaataaacaaattttgtgtatggagggagtagagcctcgtcagattgcaactgttattattataagccgaagctgtaggtgcactgggtgatgggtcaacaccagagaatcaagcataaagaaactgaacatgtggatgatcgagaattacagcagccacagtatcccagaagtccataacatcaggatataacgaccaatgttatctctcggacaccatcctgttcgtgctgataatgtttggacctcagttgataccgcgtcaaggtttactaacaaatgtgtaaactaccaaactatataccagcaatgtctaccaaaatctgacgtggaaatgatgcgaggaatatcaattgctccagaaaatgcataaccttgctagctctgattcagacatcatgcagagtaccttgatggttcctgctttaatctagcttatcagtaaataagaacttcgctgagcttttaccacctataatgaacagcggaggggtattcttgttggatgacagctgctttcacatcccacaacttaaccgcctaatctgcacatcataaaagtatcaaaccaaatatatgaataaatgttcataattccaaacatcaatctacagaacaacggaggatatcttacctaatttaaaatttcaatgtacaacatcacataatatcagggcgtctgactccagcaactttgtcccattcctctggggagagcatgtcagccatgtacttctcttgaccacgccaaaggatctgtaactcacacaagttaacaaattcaacatcttgcagagtgaaatgtgttcaaatacacaggcaatacaatttagcaagctaccattggagtacaacaaaaaagatcatgagtttcatgactgcattgtgcaacgaacagatttatatggctgactaaacaatagaaaactagtacggcttgaacttcagatatgccgaaaacagcaaaacaatagaggtttgatgaacggagaaacaacaataccttgtcaatgacaccaaactcctttgccttcaaggaatccatataaaatggtcctctcatcaccttgtctattttctctggtggctgataaaagataaatttatgttctaatgacaacaaggcaccaagtagttcaagaaatatattaaaaatatacacatacattccccgtgtgccttgctaaaagtctcactaaggtgttcctgttgtgcacaacctacaagaagcaaaagaaggtaactgtgactgattatgcaacataaaaacgggaagatgaacaaaggagaactaagatctcctgcatgccctgataaaactctcaccatagcagaaaatactaagaactaaaatcacagatcatacctctttcgcccgaataacaacatcagatgcttgcatcattccatatgaagggatacgaggttgctgaatcatagctggcatgatagaatcttttcatcataaaaaggaaacaatcaaggaaagaaagtactcctggcatattaatacctttggcatgagggaacatatagcgttttcctttctttcctgctgcaagtacaagacaggcatgacctgccgcagctcctatacaaagtgtatggatctgcaaatcaaaaggtaacttcattatcagaaaatgaaaaccagtaaaccacatgaacaaactcatgttcaacaacacaccctaattttctgaaaagataaacaacaggttttgacagttcaaagcatcagtgctcaaacacatggcaagtttgaagttacagtcatttttttattgaataaatccataaagaaactagggcaagactattatctttgaaagatttcatccagcaaacaagcaaatagcatccaccaataactcctaacaaacataggaataag

SEQ ID NO: 67536 - DNA, 6297 bp, Oryza sativa
tttcaaaataaaacgatgattagggggtgggtaaagggcttaatatctcaaacattggtagtttgacaggctaagtaaataatttaaccttgtcaaagcctttaaaccaccctaacccaagaggttaagattatgttaacccccccccccccccccccaaaaaaaaaaggtggaataagctaactgaccacaattgatcctcaagagtctgttgtactgctaagtgctactactaccccacctttaaaccaccctaacccaagaggttaagattatgttagcccatagaaaggtggcataagctaactgaccacaattagtcctcaagagttctatctgttgtactgctaagtgctactgctaccccatctaatctagccaaaacggtaattcaggttatccatgttaattgacaaacgtaatttttggaattaagcttagctaacttggttatcttatcccctaaatcaaagtcagtctaagaacaattcggcaattatgatgataattaatgacaaaaggctacttaatactatcaaaacggtagagaatagttgactgcgagccatgaaccgaacaagataagcatgcttactggttcaccatcatcacgagctgttcctgtggagttgatgtatatgtaaacaggttctttactattcatccactcaaggtacatcaactgcgcaacgacaagctctgtaactgctggcaccaactacatagcaagaaaaaacaatcttatgaggctataacagctgcatgaataaccgatttaatagatatttacaaaaaaaaaaagaggagaaaagacattggtagtccaagacatcttaaataatgcagagtatataagaaagaatttgttatgacaggcgtataccgggaatagaagtcatccaaccttgtattcaagaattaggtcaacaacaattatattttgttgctaatataaacaatttttaacaccactgaaatgcaaaatgtcagtagccagtccctagtagtttcaacttttgatagctcaggatctaacattctcatgaaattgcttatccacgttggttgacctcaccaacattcttgtcatcatgttttacatccacatatgtaaatagtaagacttgaagaaaatatttcacatagagaacatggtgcaattcataccggcatgccaatgtaaacaattcggccatgaagaagcaatgatggcaagtcagggggaggccttctaggcctgtgctggctgtaagaactgctagatcgttccacctgccacagattataggtaatgaagtattaagtgaagcaacgttcagtatgaaaataaaggtgttctctgcacatacagatgattaagctgggtgcattacagttcaaatcagcagttcattgatcgaaatcttaacacaataggtatcaccatgtataagcgtgtaacattccaatcccaggtaatcttaatgtattgcttgaggagcgattgaggttgtattttacatgttactagttgagaatcttttagaattagtaataaatgctccctctgtttcatattactagtataatgcccatgcgttgcaatgatttttttctaattgtctaatatattatcattgtgctaattttactgccatttcacagagatggaaaatttcacaatattctatcgttacattttcctttcgacggggtctatggtatgtagggctgtcaaaaaagctctaggctcgcgagctgctcgagctcggctcgagctccagacgagccgagcccgagcctctccctaagctcgcgagctttgtcgagccgagctcgagcttccaacgagcctagttatatatgatttttgttgttatttaataaattaggagatcaaatatgttttgtatgtcttatattgacatcatatatttattttattcttttttactcttctactaatatgatgaactagaaattgattatttttttaaagattatctttgaaatatatattgtcttacttaaaaatcaagctcggtagtcgagctcgagccgagcctgtcagaaagctcgaacattttataggctcggctcgagcttgtatcgagctcgagcctaggcagacgagctcgctcgagctcggctcgttgacagccctaatggtatgtgggagctaggaaacaagaaaagtttttatctcacggttcatgagtcccgcatggtagttgggtgatggtaatgacaaagtcaccactaccaccactaccatcttttatattagtacagataaatcgctttgattttttttagtcaaatttcttgaaagtttgaccaagtttatagaaaaatagagcaacacttatagtaccaaattagtttcattacatctaacattgaacatattttgatagtttatttgttttgtgttgaaaatattattatatttttctatcaacttgatcaaatataaagaagtttgacttaaaaaaagtcaaaacgacttataatatgaaacggaggtagtaccaacctatgataggtgatgttgagcgctatgcactactttgatttgtgctggactatggatgattatagtcattctcaacctctcatgtttcggctaactcgcggaacgctatgttgctattgctatggactacggcatcagcatctcatgtttcggctaactctttcgcaggaaaatcacgggaaacccctcccccccaatcacctgcgcgggcgaggccatgagcttggcgttctggaagatctcgaggaacggcaggtggtcgtcgccgcggcgcccgccacctgccgccgcagcctggagctcctccggcgaggcggcggcgagggtggacaggaacgggtcggccctcgggttgaagagcgggttcgggctcccccccgacgccgcccgcgccaccagcgcggaggacgccgccgcgccaccccgcgcctggcggagcaaggtcggaggcagggagaggaacgaggaggaggccccggaggaaggtgcagtggagggcgtggggaggcggagcgacagggaggcggacgccatggcggcgggcggagctcggcggcggcagccgtgcgagctcgagctcggggtgtgggaggtgaagattggataattttggtcggggatttgggagaggagtgatttgagtggtgcagtttgttcgtcgtgggctttggatgtgggctcactgcgtaatgggccgtaggaaacggagatgggttattttgggccttacgggatactgacatgtgggtcccaatcgtcaatgggatggggacagcttttctcgcgaacgtgcaaaagaattgcacgtcaatatattagaagaaaagagttatagttgcacgatgcaatcagccaaaccggcttatgcaaagggaagggggaaaaaagcaaaaaagaaactggagcttaaaaaactacggcggctaaaaacaaactccaaatagcgggaaggggccgagccactctatactcccaacaagtctccaaaagcggcaatgccagctaaagaccacagatggccctctgagtggatggactccagaaccactgagatcgaagagagtgcatagtcgaaaaccctagagttttgttccttccacagctgccaagagaccaagagcaccagggatggggacaacttgcaacgggagatggagggctttctcaaacggaactagtttctctccgaatcagaaggctttcttaatcaatttagtttttcgtctagatactaagaaattgtagtcgtagaatccagaaaatggacaaaaaaatcacaagttgggaaacctaacttttttagattctcataatttgacttgataccaacagcttcttataatttcaagtttcccaaacaagcccgagtctcttgcgctttcgggcataagcaatgtgccaatgtatattgctcaactagtcattataggtggaaccatgagaagtgatcattagctattttcatttctcacaatggttaagtttagaagtgagttgtaaggtgggcccagataaataataaaggagtatattaaacaagattcctattttgtaggtgcgcgctatgaaataaaatcgtgaacagttttggcccagcttcactacggcgaaggctttaggtctagtagatccatgtggataacccattcctcattttcttttctttttttccagtacacattatcctcttaaatagatctattccacacctatcgctctgcttcacctcctcctaatgctcccacttctagttcgccattacttctcccaacctctatccaacctcgacgtgccacttttccttgccttcatctaacatcaacagcattggcaaagtccgctgctcctaattaactccctcttcctcttcctctccccccaagacaccaacgaggttaggatcaccttctcgcctcctcgatgtgctactccatcaatcgatgctctgctcgaatgagaagccggcgaactcaagacatcagcttacccttcttcatcctccacgtcctcaacaagacatcgacctcctcttcttccccttcctttggcgagtctcttgctactgacaagtttccaggttttgcgatttttggttgaaagttttaggtcttgaattgaaagttttcccatttgagttgaaagtttttcaattcaagttgaaagtttctaattcgagttgaaagtttttcaattcaagttaaaagtttcgtgttttgagttgaaagttttctaatttgagtcagaagtttcaatccataaatagaaagattaaatattctaaattttttattgttcttagttgaaagtttctttttttttaatttgaaagttttacaatctgatttgaagttttaaccatgaaccatggatagaaaacgctactccaatccactcgtcacggtagggggcttaatatctaagtcgaaattgaggggagcacgactttgattcctgacgtgtgcgcgcgtattaataacccctatattaaatatctcatatgcatagaaaaagagagtgtgaggagagaagagaaagattgtattgttgttttgttatattgttgttttgttccttatggctacccaaatgcatatggatagctcaagccatgtaccactgtaaagataatacacgatgtataagtagactatactaggcttatgacctctcccattctattggacacatatgcgttacaaatgattttttattcagtttaatggaaggatttagaccaatggattattcgtttttcctagtatggcctttttcttttttagaaatcggtatttcagggttgacggtttgtacggaaggaaagatgtttttacatggaggtggagtagtagagaaaatacggtataaatacatgcgctcacactcatttttatgagtgctcacacgctctcctcccctataaacatctttaaaagaatgtaccaacatatcttgacgtcttgaggttgacgaagttatcacaaatatctcgctgtcgactaatacatagcctaaaaaaagctataatttggagggataaattccaccgcaagttgtgctcggggaaaaaaaaattgcgttcgcaaattcctgccacatcctgattcctgccaatcaacttgctgggtttccattggaggggtgagaagcttcgtgtggtttttggtttggttgcgacgttgggtcaatcctattacagtttgtacctccccaggagattgaattgtcggcgcgattactcctctcaatacttctctctcttttttatttttccccgcgaagcaagctccttccgcgttccagttcaacaatgttttcatcagcacagaatcgagctatgcatgcagcaggaaatgcttgtctccgatcaatcgaagcatccattactttggtagctagctagattaccctcgtcaacatgacgatgcaagatgagtattgcaagtgcaatgtgcaaccacatgtcatgggaaaatgacaataacagcatagtagtagtaattgaacgcgctgtaaattaaatcaagcaggataaaaaaaaccctctcaagatcatggacatcgagacaggcagagtgaccagatggtccagattagaacaagagctcaggtggctacaggagatcaggttttatatcatctatcataatagcaccaccattataaacactaacagatagagtaataaaatggtgaggtccacatacgaataactgtatagtgacattgtggtagaggatcccctcggagatcggcgacaactaacaagggcaaagaaggagtgg

SEQ ID NO: 67537 - DNA, 9873 bp, Oryza sativa
tacatgttttacaatacccaactgtagtgttagtacaaattgttgaattctaagttttctaacacaaaagaaataagatcagatctacaatcattatactatgtgtaatttgtgaaacccggtacgaagtgcaaataatggtaactatatatggtgttaagtgaaaatataagtctaactctagtccaatgtgaaaatttggtaaataaaggttgaccaaagtgaaatttactcttttcttttaactccaaactgcaatttctttgttttacgttagcatatttttcaagatgttagatgatattttttttttcaaaaaatatgcatataaaggttttataaataaaaaaaaatctgattttttaaatttataataattaatacttaattaattatacgataataagccatcatgttttttcgtgttgttaaactacaactccaaaatagagtttagaacagggcagtaatagtgtttttacatgagggtaatgagtgaacttaactatgcctaaaatttactcctataaacagactgttaatgttaatccatccttgaacagtaatattttaccttgctaactactacatctgtccaaacatataaagagttttagagttaaacatgattattaaaaaaatatgttgaattaaatggtggaatattgtgattggttgagaattgaagatactatcagttaggaaatttgaatgatggagggttatgattgattgagaatgtaatgttgggggataagttgttatattttagagtaaattctaaaggttaactctttttccctaccgatagtctttctgagttcttgctaaccaatactccagggaaagaccaatgtatcagatcaatcaaagcattaaaaataaggtgataggattgagacatcaggctccatcaaagcagaacgcgcatggcaggatgccgatgcaagatgctcggaagaagcaaaactaccattagaaaaaggaagcagtttccatgccagatctcaaattacattttttttaaccatcttctatggtcaggtaaagtaaaagcatcatgttagtttaaccacattgctacatgcacagtagtaaacaaaccaaaagaccatacaaagcagatcatcacaagccatacaacgcatgagtggttcacagagattgagaaatattggaatatggaaacatatcactaaagaattcatgattcctcctaaactttgcagtaatgcaatgatgcaccctgcagcacatgcgtccgcatacacaaaggtttatgaagagatcacataaacaagctgatacctggttgcaccccccaaaacaccgggagtgtagaaatgttgtttatgaacaagggactatgcagctcgtatagattcaaacacaattattttccttacaaacaaaacaaggacaaacaggccacttgtgcaccatagaacaattcacattcaatatgtcataaaaaaaatctctgcactatgagaaatgccatagccacatcggatacaaacaagtcacattgttaaaaagattaacatattctgtgttaacttcaggcctgaaagaactaagagcaaagagaaaggtacttaactagtttctagtccattctctttgcatcgggctgatagcctgatatgtacctaaagtataaggatcagcatcgatccctagtccatgtagtgcggtgttgtttggacgaaaagctcctcatcttcgtcatcatcgtcatcttcatcagcacctacccaattgcttgggtgatgctgtgatcgaggattatcactgacaacatctacaacaaaataaagcaagttatttagatatattgtaatataaatgcatcagtaacagacgacttcaaaatatgatgtgttttatgttgtgatattaaccaggaggctcttccaagtgatccatttgcataggctgcattctgtagtacaaactagtcaaggaaatacattctggaagtaggaaagcagaaataactcgaaactcagacctcgtggatcctctttcattattaacaacatatggaaaactctacatgaacatcaactatcttgacataatacatcagttctgtgcagtaacaaatgctcaatactaggacctaattgccatattattccctataggattgtaatgctctgttctctccattgatgtaatgttttccttagtaactattccctatagaattgtatgcaagattttctatggacctcagggcctggcattgtgtctaagaaaaccacaatctatctccctctgacactgtatatatctatattcatgcagattagtcagatcaaatacagtatgactgattgactgtaagttgactcctaacactaaccttaacattatcactgaaagtgtcttatggttttaactagatgaattgcaataaatacatactccctccgtttcacattgtaagtcattctagcatttcccacattcatattgatgttaatgagtctagatagatatatgtctagattcattaacatcaatatgaatgtgaaaaatgctagaatgacttacattgtgaaacggaggaagtatttccatggggaatataggcaagtggacacaggttctgttctgtctattgatataatgttggaaggaagcattttgtgttgagggatgctgatctcacaatcccaactaaagaaaaattctcgcatgcagccttaatttctttggattgagagaaagacataagtatataataccataatgatatcataatccataatgatatcataatcccgattaaagaaatttattttttaagtccagacttaatttacttggacagagagaacagagttaaggactgctgttaatatgtctgatgtctgatgaacacattggaaggtcacagtcgtaagaaatatacaagatataaagctgcaactgcagaataggatgcagtagcaaataatacaagaggataaattagaaagaatgaattgaagtgatctataggatacgtatcgtttgcattatcagcgactggtggcttgtagcgagcatttacactatgcagcattgatgtgtcattcagtgcattagaattggcatttctctccttctgggtgtatttttctctgttaacttcaaaacttttgggagcactacctgtttaacaaaagctttcttatgtttgactagcatgatgatatatcaacaggataattctataatcagagagaaatgaagttctccagccaccagttagtttgatcacacacagtcatatggcgtacagtccaattatggccttccgaaagtagccaatatgcactgtacaggccctttggtcctgcgttgagtaccacacagaaagccctgcctggtgtgtgatcataccaatagttgacaggatccatttatcagaaatacacacctgatagctccgaccatattttagtatggtttgagacattttcagggactggtggtggtgtagcagcaacccttggttcttctgctcgctgtgcagaagtagttggctgttgggcaacactgctgtcagtaagttgtgatacaagcatagtggcaagaactagtgttgcatcaaaatcagaacttgatccatcgtcaagcccaaatttgggaaccaaaaggacaggcctgcaattcaaatgaagacttgtaaggtccaatccaaatggataataaaactaaaccagtatggctacttactcgccagccttctgaaagaataggaggatatcaacttcacatccttcacaaaatgttaagaaagcctgggttggaagagatagaaaagtaaatacaatatatgtagtctcatgccataaaaatacctgagcagggaactaagttgtttccttaagtttcagcagtaaagtttaaaaaacaatgaatattctataccaattactcagaatacaactagccataaagccacatccttctagtccagcaaggagacggaagaattaacaaaactacatcaaggaagcaacctacatgtattcgatggaaaagcaagagtattgacttgcaacttgtaagctctacatacattcagtactgtgcatgctgacacacggatacatattatttacgttattctttctataatgatcttaaagaaatattctctgattcaattaggtgaatgctaaataccaaattatttcccatttaaaggagccattctataattatcagaagttttttgtcctacatctattgaatgtaggttttcgaagaaacaaaatactgatagggctgatcatagatcaccttgagttctttcaccccgaatgtgacatccactgaatcaccggaatgtacatactccacgaactcctctgttgggtcaatccacagctgcgtgtgcagcctcgtatcgcagtcatctgcataaccgcaaagtgcaaagaaaattcacattcacaataccacaacccaatcatcacctcataatacaaaaaaggacagtttacaaacaccatgagatgccacctttcgtcgggtcaatgtagcttctgagctcgacagccttcccctcaatctcaccatccacgccgacgttggagagcccagcagcaggatcggtggcaataaccgtgagctcctgcagcgaggactggaaattggagagcaggcgcgccaggtcccgcggccggatggcgaggcggctggagaagttgctgcggtcgagcgccagcgtctgcacctcggactccgcgctgcacgcgatccagtacgtcttcttcacccctgaacagctcgaaattttgatgagaaattcaggagcactcgccaaaaacagcaaaaatggcggcaaaactaagaaaagcgcgccaacggcaagaaaaatgttgcgcgcaaaaatcccccacaaaattgcaaaaccctagaggacggagggggatcggcgagtaccgttgaggcagtggagggtgagctggagcttgggcgcgtcggggttggggagggaggcggcgatgcggtcgagcgcggcggtcggcgtgcggagcacggagaggacggacttgaggaggacgctgcactggagcggcgtcgacgacggcgccgagtcggcggcggcggcggcggagaggctgaactcgtcgaagaagtcccgcgccagcgagatggacgcgtacgccgaccgcgagctgttgagcgtgtgcagctcaagctgaaaaaggagaaaccaaatcacccccaaagaaaatgtcagaacagctcgccgccggcgaatggaggaggaaaccgcggcggagaggcaggcaggcggcggcggcgaccaccttggcggggtgggcctggaggacgaggtcggagccgacgcgcgcgaggcaggtgacgcaccgcgtgaacgtccgcagcgcgccgccgctcatagacagctccatcgccgcccgcccgcccgcccgccgccggtcgccgccgcaaccgcttccccgcgccgccgcgcttcgtctcagctcgcctcgactcggggggagggaaaccggtcgggggaagcgtgggctttctcggccgagtcgttttgggcctccccacgaacgtggcccaataacggtgggcccatggacgccgaagctagggtttttctctcccgaagccataatatatatcgccctcgctcctcgtgttcttcttcccccttcaaacgccgccgccgccgccgctctcttcggtctcgcttcccttctccgggagattcaggtgcgccccccgattcccgatctgcttcctgttctcccattcgcatgcgcggttgcttagcaggacgattcttctacgatcttctgattgcgattcgcgaggaatcggtgtgtgttagcattatcatgtcgagtagcatttttttgtttttgttggtcaagttccatgtctagcagatgaaatttagtacacgctttgcaactgtacggttaaattcgtggctagtttgtcgaattggatagaaggaagtgcttttatttttctcagatccggttacttctcgttgtcgaggtctagtgtaaggttaacatcctaattcttgggtacacatagatgatatgtcgcttatatcgtcccgtttgattgatatggagctagataaactaaaactgtatgcctagttctattgagtattttagttgaggggggataagttttggtgttccatgtatcttctcctaatctttgtgtgtattgttgctttgctttgcagtcgctgttgtggtgtttgcttcatccaccgccaccatgcagaacgaggagggtcagatggtggacctctacgtccccaggaagtggtatgtttctgtcattcctgatgagttgtttgtctaattcgattgattgttgagatgtacttaatgcttgtcgtgttggtttaccgcagctcggccacgaacaggatcatcaccgccaaggaccacgcctcggtccagatcaacattgggcatgtggatgagaatgggctgtacgatggccgcttcaccacctttgctctctctgggttcatccgtgctcaggtaatcattgcaatcctttgtttattgtaatgtgcctgtatttttctttgtgaactgtcagctgtattgctcacagcctatcagaattcagaatgtgttatttccttcatggtcatgaattttgcgtgacttcttgttgccggcagctgatcatgtcactgaactttagtgctgtaaatacacaagcagaaagtttgatatggctaacaattttgtggattgtttttatgaattcacttctcgtttttgttagcctgagcattttacataattatgtgatgcttctggtttatttcatttgatacctagttggtccacatctttgtttataagtttgcgtagtcattgatattgtggcaaatttacctgaatgacagcaatgtaaaaatcatacttgtacattgactcttttactatcatgatgtccaaaaccagatagctagcatttatctttttctaatgcgagtcccatcagttatttcttggtgccatcctggtagctaggacctagctgtttttcttgctcatatgctatgtacatgacttttgttgcaatgttgcctcctccggtcggttctcatctctttttattgacagggagatgctgacagtgctctggataggctgtggcagaagaggaaggctgaggtcaagcagcagtagatcttgctactagttttacctggaagaactcgtttcaatttcatgtctctctagctacttcatgcaatgcctgtgttatcagttcgtactccgaaaaaattcgtgtgacttgatcggtttatcctgataatgttttatccatgttgaagctttattacatctgtttcttgatgcatcgtgtggctgacatcattgcacttgtttcaaaagaatccatgtcgctatgcttatcagaagttcttttctaggctgacatatttatcgtggattcttcctctcgagtcctatatgtcgccatctaggatcacagattcatctgctaatgtttggatctcattcatctgctaatgtttcatagttcatatctgggtaccgcctgatcaataaaataatcaggacttctggtactgatcctgctcgataaattcttcgaattaaatttgaaaatatactatcatttgtttttttcttaaaaataattagggtttaattttttttttcacaaatataccatcggtatcgcataattgatacgcgagaatgacgtctcaacagggagagaccgcttgctctcgcggtgccggtgcaagaccgagcacaaaccaaagagcgagatcgagatcgtttttgaaaattaattagtggttattgattggtaataattagtgattaatcattctaatgacactatcattatatattgatgtgtgaggtaataggaggataggacccatttaccaattgtaggcatagctaattagacaccgtggttaatgcgaggtggctttttgaggaacattcgggcaatcctcccattagcgccctccgggtagaacccgccgggtacgtgctcatcgccagttagatagagtatcctaagcaactctgccggcgttcggctgtaggagagcgagtcgacgttggcggagaggatgttggtgcatatcttcccctcagcgccgagctgctctggcacgatgagcccctcgtccttcactccgcactgccctagcttgtttcgcagcgccgacacacggtcggtgagctctgccaccgtggcaccgtagggggacactgtctcgcggcggtgctcgaagaggaggccgcgcacgacggcgtcctggccagactcgacggcgagcaggccggcgacgaggcgcttggtggcgtagccgtcgatcagcgggttggtgcccgtgtagccgttgatgcccaggtaagggatgacgtagacggccaggaggaagttgaggctgttggcgtcggggtcgaagggcgggtctaggtggtagccgaccgcctcgtccattaccctggcgaagttgtgtgcgctcaggtctatcagcggccttgggatcccacccactgtcctctggattgccctgcatcgtcaattagttttaagtgcgatcatatatatatatcaccgccattttagaatccatattcttggtaacaactcatgaattttgatctatgaactgtgatctttccaattttgcataactacgtagagcctcatcgattggtctggcttattaaagaataaaaattaatttaggtcgtatttagttacacatttttttttcaaacttccaacttttccatcacatcaaaacttttctacacatataaattttcaacttttccgtcacatcgttccaatttcaaccaaatttctaattttggtgtgaactaaacatagccttataggtaaaacttttatatatttgttcataacgacttaaaagccaatgctaaaaataaattatgtcaaaaatatcttaaaatcaactttaaattcaagtttgaaaaatcgtatgtcaacacagggaatataggcaaaccaatgaggctcgtacacacatacgagacatgcccgttttagtagaactctacgaggttattagattcatatgtcaaacaggttttactcgcaggtgtgtaattacttttctaagttgaaatatgatcacacttaaaatatgtttcctggaagaagcgtccagatcaagaaaagttaaatcttagttttaaacttgtttttcctattgcaatgcacggacactttcctagccaaaaacaactatagttgaaatgtgaatttgaatttcaatcatattctttgttgtaacctcaggtggccgatctcctggtaggcgaactcggcgcagacgcgccacgtgagctcgtcgaggccggccttcctggcgcccaccggcggcgggccgcccagcgtcaggttgggggcgaggtggtccagccccacgccgaacgccgcgtgcaggaagaactccgcctcggcgaactccaggttcagcgcgaaccgcaccgggtccacgtcgtgcgcgaacacggccaccggcgtgtgcggcgccgccgcgctgcactgcgcctccccgccgccgccgccgccgacgccgccgtggaacagctccgcccccaccgccgccgaccacgccgccgggcaggccgggtggtcacctgcattgcacgaggaaaccaggagcagcacgagcagcgccgaacagcagattcgcggcgacgccatctctgactgcaggttgttcatcagttcatgggtagtgttcttctgcacatcagcttcctgtgaatttatagtgaaacagcagcagcacatggcactgaattatcttttcagagacgcagg

SEQ ID NO: 67538 - DNA, 3387 bp, Oryza sativa
ctgtttggttgtatagatgaaggtggattgttacttgttggagctggaacgcaagccatttcaagtcaagggtagtttgcagatgaatcattttcagcacagatgctgggggactgaaaaatggaaattggtagccagggattgcaccacaaaatcttccttcagtctatttttggctcatccttgtgcaggctgcaaagtgtgctagcacttgattaggtgagctggtgaggtgtaatagtgccttagatgaggttgtcaaatttacatattagtactgattgctacatatatcacttttattatctttcaactttaaaatggttgttaattactactcctacttgttagcaagatgtccaaaagattagattaatgcaatgtttactcatttgcagttctccgatgggattatatgctttcctttgtgggatttcttcaggtagcaggcaaccacttctgcacttgaggttgaggccacatgcatcacatcacccatccttctgagatcagattacacacaattcaatactattggatcataatattggtttagtaaatcaacgtgcccttgtgcaacttctttctactgcttattgaattgcttcagtctgaaaacgtgctgaaagtatgaaaaataattggtctacaaatgcagggtgaagaacaatgcatctatggtaatgggaacaaaaacttaaccatatcgtgatgctaattcactcacataattgatttagcatttatattaacattattgatttagtatttatattagtagaaatacatggtagaagcaaacaatatttttataaattaagggaaaggataattaggaagattattgaacaaatcataaacaaaagttgggaatcaatttataaattctttaaaattaattctttaaaattaaagaaaaggagaggtaggaggatcatcaaacaaattatttaaaaaaaacaagttgaaaaccaatttataaactctttaaactttgatatacatatatatattttaaaactgatgaattggtgtcctatcaaattaaggaaaagaaaaagtaagaagatcatcgaacaatttataaagaaaaacatggacatgttgggggaagccatgtataaactctttaaactttgatatgcatttgttttgataatgataaaaaaaagaatatgtgtataggacactcaatttgaagtgaactggaactggaaactgaacacatgtgttgtgatatgcgctcacaacactaaagaagaatatgatttaaagagttgacaagacactaaaatgatattagaaatgaatggagctagaacaaatctcatttcattatcattcctccatgttatgaatgtacatagatcaaatctcatttcgttgcattcctccatgtttcagtttgatccgaaatattatctcatcggtatttcagcccatttcagtttactccaaaatctcatctcatctcactgtctaaaatatattgtaaggagttggtgcattagacaatatgatgcacaattaggggctaagaacatatatagtgtggcgagaggaggaatagaaaaaaaaaaacttttggtgaacacgtgctaagtatgaatcaatcatgctggatgcctcaaggcctcgagggtgtataaatcatgagaggtactaataactaaatcgactgactgtaaggaaggcatcaagaatctcgcatgatatgcctgctgtttagctgctatagatataggaaagcagtcatgcaagcagtatgccaacaacaactgcagtgttcatattgagccgcagagaaatatttagcttctgttgataagtgaaataagcaaactcaaggtggcacactcaaaatgacgttgggtaacagatgcatgactgatgattttggctaaatgtcatgttgtttgcaggttctgaattatatatttttttttaatttacaatgcatggtttagcgtttgaagtttcaatagatactccttttgttcttataaaatcatttttggcatagatgttggacctgaaaattgaaatcagtagacgtacaggccgggattgcaccataaaatcttccttcagcttatttttggatcatccttactagtaatacttcgttaggtggaggtgtaatcgcgcctttatcattagatgccgtttgctaagacgaagttgtcaaacttacgtactactactgatgatgatggctatacatggctttatcatctttcaacttcgatgattacgttgttgtcaagatgcccagaagaaatgccatctctgcagttgtccaattagatcacactttcctctgttggattgatttcttcaggtgtttggcactggccacatgcatcaggataactgagattacacgcaaatatccaacaaccctcagatcattacggcgtgcccgtcatgtaaacctcttcgtactgacgcctttttgccttttggaaaaattgagttgcctactgaaactgtatgccacaaactatttcaagttgtcagcaaagtgagcaaaactatcgtaattaatgtaccttgtgcaattgggttcttcttacaaagtgaaaagttcttgcacgttttgcagataatacatataactagcaagaacatttatctaaaaataaaagatgaccactgcacatagcacactcgaaatgctttgttgaaagcttgaaattgtaaggatgcttgtcaactcagatacctgcttaatttgttgggggaaattagtaagctcatatgtgtgggctgcagctagttcaggaatttggagttctccaggagatccatccacagattgatctttcaagtgacggcccaagtaaccattttctttctttaattcctccaaaaatatctgcccctttttttttcatcttcagatgttcccagctcaacaagcaccagaagttcaatagtactacatgttagaacttagttgaacatcattttctgacactattggaaaaacagtagaacccatgattaacacaaaaatatgaactttgaagttactttgccagcttatacaaaatgtgtatgtggcactgtaagcgccagacatttctctcatctaatattttctttttcatagtaagcatgttgttagcagtgtacgtgtcaggcacttctctcatctaataatatttctattttcaaattaagcatgttttttttatcaaattcagaccattgatcttggtatcacatccttcagctcaaagggaaggaaatccctatcatccctaatactccttcatattgtatttttatttgccgccttatgtctatcgagaaactaatgcaaagataattactacctccgtcctaaaataaaataaattttggttggatgtaatatattct

SEQ ID NO: 67539 - DNA, 1566 bp, Oryza sativa
ctgaaacggaaggaataccaaatgtgacctagcaagagtatcaactactcactccatcctaaaatataatcattttttacttcgacacggtcttcgagatatcactttgaccaacaatatctataaaaataaaatgttttaaaaagagagttacatcaaacatcaacatttacatcatctttttcatttgtttgctattaatattcaaaatttaaaaagtttgacttagcactattctaaaaatacttatattttgggacggagggagtagaacaatgctaacccgcaatgtcatgatgattgtactggcaaactctttacactttataatagaggctaaaaccaattagtactatctgcaaaaggaaaagtagtggtgatgaatcgtatatgtgctttgagatttgtgctgctcaaacagagtattagatatattaacgggttaaacccgattagatctttccatttttagtgtacccgcatgatttgcatacatgcatatattgcaggagtgattgcctttccatataaacgtactcacatcgtttccatataagcaaacatgtacgtaataatttccttccgattgcatgataatttatttccatatatgatacatactttcctttttttgcacatgctcacatcgtttccctatgattgtgtgataatttatttccatatttgagatgacactgaatcagatccacaaattttcagtaattccactaattaagttgtaattgatttatttccatcaataccgattaatattttccactttttgtgtacatataaaatggtatgacatttcattttttacacactccactgtccagtccacgctattaccctgccggccggacgtcggcgagcttttcgtctctgtcggttgtctgcaaggtttcgttgccgttgtcagtcatctgttagcttcgtcaccgcgccgttacgcaccgccggtcgttcgcaaggttcgttgtcgccgccgcaggtcgcccgtgaggaggttcgtcgctactgtcatcgacggtcgccgcgcgtgtggttcgtgtgtaatttatttcaatttattcttatattttgaaaagtccctgttctaccgttttcgtagattgagtactgtaacaattttatttcgttgtcaagaccttaagatgggaatgcatcctactaataagtttttggttcatcttcctattgagccaaagactatacgtacgtatgttgccctgggatcatgcggagaagatggtcgtgggtagaagaaacaccagttggatgcacgcgctaagagctagtgtattaacacaagtttttttaaactgatgttcttgacagtgtattaacatgaaatttgcatgttgtaatcatgcaaattaatacagaatattttggtactatgtatatacctaccatcctactattccataaatatcaccacctacttaatctacatcggtagaatatacatagcacacgaggcttatatacctaaatctataaatggtttataggtatatagccaactagacttatatacttacatctacatgtatttaattg

SEQ ID NO: 67540 - DNA, 2776 bp, Oryza sativa
  unsure (1)..(2776): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcaattgcctaaattgctagtactattacatttttcacaaaatttcaaaattttgaccgctaggttaactggtcaaacttttttttagaaaaaaatatagcagaatttcaaaatattgacgaaatttttctcagtttcaacgatttcttttcacttgtggacactacttgtacctttttcataaaattttacaagatttcacgccatgtccatcgtaataataaaaaatgtagtagtagaacaagaagaagttcatcgctgaaaaacatgattttacaaatcaaactggaattaactaatgatttttggacaaatttatagttttgaatcttgcaaaattttcaaccaagggatatagcctgttttaaatgaatttttttaaaaaaagagacaatcgtgtcaaaaaaatcataaatttagagaaaaacattaattccaacatctattttttgtgcactgtaattgagtgcaagtgcactacaactcaatataagtacaatataactctgtaaccatgtgtaattaaaaagatatacaagatgcaagatcctatgaactaaaaagtgaaagacaagagcctaaaaatatgtcacaagtaaaatagcaaaaccgttcaaacttgtgtctgaaattaccacgagacttaacaatcatcgattggccatgaggtgattacaagctacacaaattattaggacaaaaacaatttaatttatattccctccgtctcataatataaggggttttagagggatatgacataacttagtactatgaatctagacgatgagcctatccagattcgttgtattaggttatagtatcacattactccaaaatctgacggagggagtatttactagaaaaatatgcccatgcaatgcaacggtaatcttattattgttattatggtttagttaaggtaaaattcactgtgggaattcacttggatatatatatttttagaaaaacatgacttatagttaggagtttgatcgtctcaagttagcatgcaagtttatttaaagagatttcttatatgtgttcttctatatttccaaaagcgaacgacattaaaaaccgactcatacataataacacaaaataacatacttatacacgaatgacgtaccaaagtaccggtaaaaaccttcaatttttataacagtagagatgagtcctaagcaacttaaaagccaatacaataaaatatatttcattgaaaacatcataaaattatctccaaagttaagttttaaatgttaaattttgccaatggttagagcctttgcccatattaactaataagccagaatgtcttattagagaataaaattaaaatatagataacttttttacgtatttattcgtagcgacttaaaaactaacgctaaaaagaaattacgttgaaaattactcaacaaacatagtatctcttaaaacaacacttctttcaaaacttattatcactagcaacaagatggttggagtcacacaaatgcactactccctccgtcccataatataagggattttgagtttttatctgtactctttgatcactcgtcttattcaaaaaattttagagttatttattttttttgtgacttgctttattatccaaagtactttaagcacaacttttcgttttttatatttgcacaaatttttttaataaggtgagtggtcaaacaggacaagcaaaaactcaaaatcccttatattatgggacggagggagtacttcgtaagctagttcatctgcaatggaaggagactagttctctttcgagaaaatgcacattcaccatgataaaacagtgccaatctccagaatacagattgctcactgtaacaagttcaacatgttaagcaaagttacttaataacagtcaacagatgtaaaatttctcccagaagcggcagaagaattagttgtatcaaagtgacagtctctaagcaacccagtaaatctcattctgacaatctaatgctaaataattgctccacgtttattctgtttacatgagctcagccgttagtcctagtccaattccaatatacaggtgagggcttatgctatctgataacaattagaatgtgtcattgtgttcctttcatatgacaccatgtaatacatgtacaattgctatatctaatttaaatggagtatctcagctgcatggtacattccgttgtttggtgactctagccaagttctcagaaaccgcctgagttagattctgatcctcgaatttaaggtctagattaaacctgagaaaatgcgaaggaaactgattataatttgtacgggtaaatagcaaagttgtcgagatgttatagttcaaagttttaataatttgatgacggtgctcaagatataattccaagctggcaggcaatgcataaagaaatgaacacaacaggtgaaactttctctaatactccaagaaataatccacttactt

SEQ ID NO: 67541 - DNA, 2317 bp, Oryza sativa
ccaattgaaccgtagactgaaacattttgaagaaaaaagagaagatttaactctccagtgagagagaatcaacaccatgtgcaattatcatgtgctccctaagcatcgatgcctcccagcatctattttctatctgtatttattcttttggtatgtctacatccaaatcactagataattaaacatatgattatatgaaaaccctgcattttttgttttttatagttcatttgcccaatttttaaccgccatagagattgtttacccaaatcgacattcacatcagcacattctttattcatagaagaaagcttttgaccatacagagaagggaagtatgagcacataattagtgtttggagtaccatggtaagaatttgatggagcaaaaattatgctttatccaaaatcttcacatatttaggttgcatattctaaatgatcacttacaaagcaaacaaaaatatttaaggacaataaaagggcaaatacgaggaacggaagaatcacacctggagatttttcacttggaatgggcagccagcaggaacaaatacagcctcaccgatatgttgttggaatgtccagggttcaattcctgtaacaagatccaaattaaggctctcacaaaaagtaacttagaaccacattaataagatagaactaaatttcaatagcctgagattatcctcataaatattattagcattctgcatggttcactaagcgcatgtactgtagcacgggaaatcagaaatcaggcagcaagcagatcctagcaaagcagactgcagcacttggttgcccttcaagcaaagaaccaatggagtcttattggttactggaaatttagacagctattgtctatttgctttggtattgcaatgaaatgttttctttggaatatggacacaaagtctgaggagtgagtgaagtaactacatgaaatgagatgctatggcatatcagtaatgataagttcacagctaaatcatctgccaatttagaagcgacaatcatccatgccgtactttgtgcttaccatattgatccttcagtatccttttatgatacttgttgagatatatagattgttcataaataggattcttaacctgcaacaaaaacagataatcatgaaatagctttctcaaggatatgtcaacaatatccgtcataaagaattgtgatgtcattacagagagcgctacctgactactagctgccagttcttcccagttagcagttaaatattcattcagctttgaaatatcctgcctgcggaacacatcccaaacagaaccagcctgacttctttctgaaccattaacttttggttcctctgaatgtgacgagcaagataactcagttgaagagccttcgaaaccacaattaagtttggcatctgaagacttctcttgtaatcgcaaggcagacgcatgcgctctttcatcaaactttgagcttacatggtcaggtgattgttcccccatatccacattcaaattttgaacaggtgcatgagcatttacatgcattgtcattccattggcaatcttttcagatcgctcaggttgtagcctctttggacatacgtcatgccctttggctgtatgcattagcatatgcacctacaagaggaataaatagcacatgtatcagatgacttttatttcatgcacttatctgtttagaattcaaatgttttttttctccctcaagcattctcctttctgaccattggataaatatccaacagatcagacaactccctaatccacttcctgcccatccgggcatcccctgatgccctttaactgccccaatctattcacgcttgtgttcttcgtttcccccaacctcgacccaacccactgctctcacccaaccggcacacagggcagtgccacacgccagcctggcttcctaccataacctcggagcaccctctctttcccctccccaaccttctctttcccctccccaccctttacctttactctggtgcttgacagcacgaatcttcgaacaggatctaaaagaaaatcgcatgttcttgcctcctccctttgcaacaaaatcacaagaaactcgaagtgaatctagaaagccctacttaccacatcagccatgttaatcattagatttgtcactgaatcacctttaccagcttcttgatgtcttccatatgcaattaacagcttcaagccaacttcaggttgtagggtgtctgggggcaatttagcagaaagatttaggagcccccacctggaatgtataaaatcaactaatggaaaattgacaataaattctggtc

SEQ ID NO: 67542 - DNA, 8336 bp, Oryza sativa
  unsure (1)..(8336): unsure at all n locations
caatccacagctttgacaatgacatcgtcatccacttcttcatccatgatttcctggattcctcgccaaatatttagtgggtcccagcttgatgacagagaaggctcaaacgcattcctgataactacaggttctccttttatccagtgtttacgaaaatgaataataccttcagatttcaagtcctctaatacaggagagaacacacagaaccgatcaataccaccattatttgaacatgttgagacaccaaagttacgatgaccagttaactctaatgttctgccatcattgcaggatgagcatccattctcaagaacatgtactttacaaccattgaccatttcctcagaattttttacaagcttactaatccagtttattttgaatattcgccttaacactaacttcgaggagccacaaccaccagcctcatgaggcccacaagtaatgcttccatcattattgactctccatgtagggaataaagatctaatgtcaatattttttatgtcccttcgttgtgggactgacttatcatttgcactttctgcagatggttccattcttgctcttttattcgaagtatctttacttctatctaccacacgaccttcagcatattctcctcttgcaacactggtcctagatcgccttatgtctcgacaacagtcaagacataagtcatacaaacaccttgggcagtgtcggtgataatcaaatactggcactttgcagaagtcactgcgaggataatttgaggtatcactacaagccaaagcatagaaataagaatcttcttgtgaaaaataagcaacagacagtaccagcacatttgctcatcaggattgaccttcgccctgattatatctgtcctaagtcctacacaaagaatatggtgcgctagtgttagaaatatgagattattcggatgaaaataacagaaaagaatgttaagaggggaactggaataccataagcttttgtatcaacaccaatttcgaaacattgatcagaataaatctgctttaatactggaaggacagatgccagaatgctatgaagatattccaacttatctacagcagatatctcctgaacccttgccttgtgatttaagagtgaaaataataaatttaagaaaaatcagtcagcataaaaataataaataaatatggcaacggagaagggaaaaactcttggtaaaggttaaatacctttattacattatctcctagtaagcaaactctgcagttacaaatgccacgacatgctggacaaacctttcgaacatcatcaattgggatatcagagtacctacagttcatggtaacattaaaaaagtgtaggacaacataatgcatgtaatgatccaaaagtatccagatggctagatatatgaaatctggccaaataatcacaaggatgtcctggtcaattttcaatagtttggcttcacacttccaacgaggacagtttttctgtgactggagggagtacttcatatgataggtctgtggtgtccggatagccattgcctttgcatttggtgattttgagtgagccgatggggaaaaattagcctttaaaagacaaggcgaagattgtacttctgaaattaataaggtaactagtaaaatatccatgtgctttggctgcatattggaatagaatgccctaaaacagttttttttttaaaaaaaaaaaacattgtatacacaagggttttctatgtgaacaataagatgatagtttgggaattaccattactaaccgcagtgtgatcacaaacattaattgtctagcaacaacttctgaggaataattctttcagtgtgatcatatactaatcataagctgcacacatagttgaagaagatgctagattctaataggtcggcaagggctctgcctagggcaaactcgaccagagaattccaagcaattagcaagcatattacataaaaatacacgatataacactaaagtagcagcagaatagcccccaaggcaggttagctgcataatccaccatctaatgcttaatcgcggtggctaccctgcacctagcagggacttttagaacacaaaaactgagtgctgaaaataaaattctctaataatagttacaaatggtcagtcctcaagcctgttctgaatctactcggaaatcatccttatggggaactaaaatttactctataacagcacaacatataccggagcataccatctcgagatgcagttggtgcagtacccccttctgtcgcagcttgtacaacaaatggtattagcgaccctccggcactgatggcaggttgcggccgctgccgcccccgccgccgagctgcaggcaaccagccccgccgagcccctcccgaccagctcctaccatcacaaggcacgacgaatcaatcagcaccaagcacaccgtggatttacccaaaactagaacgcgtcccggaacccaactcaccgccgcggtgcgcgcgccggcagcattgcccatgggcagcccgtggaccggctgcctcctccgtggcggcggccgcagcggcgngancaccagctccgcgacgtgcaccggctcccccgcgaccctgccggagatgggcctgccgaccgccatccgcgcaggcggggtcgtgccccgcgcggcggaggcggaggctgaggacctgcggagggaggcccggagcgcggaggaggcggcgcgcttcttggcctggacgtagtgcttctcgcagacggtcttgtcgggcatgagggcgcgctgcatcgccactgcttgccgtcggagcgcttgcaccgcagctcctccggcacggcggccgccgccgccgccgcctccatccccgtccccccaccgcggcgtcacaccccgccgccggcgccgccgcggcggaggaggggggtttctagggtttggggagatcgcgcggggaggggaagggggaggaggggagaggaaaccaggaaggggtaaaagcgtgggtgggcgccgcgtgatcgaatgagagtcgcgggtgggggtcaagtctcgggtggtggttgggctcctcgactcttctcctcgttgcgttgcggaggcagccgcgcgcgcggacggtggtggtgggctgcggctgcggctgcggtgcaagtaggaggagtagtagtctccatctcctctccgcttgctggttgctgctgctgctggcgcctggtttttggtgcggggagtagtaactccttccttccttttttttcccctctcctcgtcccccgctttcctttccctgcgtcacacaacctgtgctgtgctgcgcactgtgggggagagagagacacacaggcgaggcgaggcgaggcgcggcgcggcgcagcagcacgcgcgttgcgttgaggcggaggagaggaggaggaggcagggaggagttttaccggattgcccctgcgagatcacgcgggtggagtgagggatttgggcttttttggggtacggtacgagacgagtttgcagaggggccagcgcggtttgcgacaaggaaagggacgacgagatcgcctggtgcgatgcgacgacttggcacggccgtgggggttgggctcgccaggcagtactgcaggacagtcaatgcatctacaagcggcgtcagattgaaaatcgacgctcgtgggttctgttcgaagctgatgattcgtacaacaagaaaagcattaacgccctatgaattactaaaatttaattattacaaatggatttatttgatagtttagagcagtttctatatagaaagttttcatacaaaacacaccgttttagcggttttgaaataagtaccgatgaaaaccgagatagaaactacatcttaaccaaaaagaacagtatcactatcatttcgctcattgtcttatattttcttcatatcacaatgaaataaggaaaggggtagggaatagtgccaagagcaacggcaactattgatgtggcctctccctacaggttaagagggtccgtctcatcttgttgattgtagcactcatgtaccttcaggttgaacgatggcccctgcaattcaactatctaagacgacatgtggtcgagagggtgagggacgggcgatgcctctaatttggagaaaatttgatacgtaagaagaaaacaatccggcaaaaaaaaagaaccttttgttttcgaccagaagcacagaccaccagtttttatttgactcatagcacttccatgacaaccataaatatggtggagtgtttagccgtgagtcagcacttatttttagatatactaattttcccctggtcatgtatgtctagcatagcaatcatggttaggctgatgttcgttccatcatacttaggttgtgttctttctcatgggttcccaacccatttccctcattttccacatacacacttttcaaactgctaaacggtacacgttttgcaaaaagtttatacaagaaagttgctttaaaaaatcatattaatcaatttttaaagttttctatggctaatacttaattaatcgtgtgttaatctatcgctccgttttttatgaagagaggaggggttaccaacccctccaaaagaacagagccgtaatgtcgcacaccacggaagagaaagggcaatggcggcggttgcttgtaaggcattccacgttgggcaaagggcgacggtggtcacgccgctgatgatggcagctagcagcttgtttgacgacgacaactggcagcttgcttaacgatagcggcagttggtggcttgctcacgacggtggattaaagggagctacctgctaggtaaaggcatgagtagaacttatctagaacatggaataagatagaacttgtcttgtgtccagaataggatttaacatatatttctttttttcaagcgataatgcttagtagaacgaggagatggggaacgagaaagaggagatgaggaacaggaaagagatgagtgtatgtggtgtggaaaacgaatggcaaatgagactgaggataattttctctaccccgatctaacgtcgccacctcaaaatacaacagaagtgctataggttaaagaaaaactggtagtctatgcttttggtcgaagaaaaattcttatagtaccaagttatttttggtgctatacatcgaatgttcttttaaatctttttctcctgtcatcaaactcataaatctttttctcggtaacaaaccaccactggatttggctaatttggctaatttcaaccgggtgacaagttctgtcttcaccggattcacccgggaacaagaaggatgatatgaaattaagtcaatgtgtgacaacaacatgaacatggtgagaccagcgagaaaagaaatgaaacgaacgtcaaaatggctaatgcagttgttagaatgatactaatgctttcatgcaaacgtttggatttatgtgtgaatttagatcgatcgaatatgaacaatcctatgggatttacgtttagatttatgttaccatgaacggtaggtactctgatatcctatgggatcgtgtgaattttctatatgattgtttcaaaaggtcttgtatgattttaattttaatggacatttttttcctaaacggacctttgaaataaaggactgcacgctattggatcatatgaaatccatataagatgcctcaatccatacatcatgttttcatgaaaagttttctttgagtctttttctctcctcaccatcctatatttttcctgcagtctaaccaagccatcattcctatatttttatgcattttgcaattctctattttaaacctatttgatttgtaggaaaacataggaaattaaagaattttaatcctatgggaatttctagggagaccttcaaacaaagaattgaacaatcctatagaaaatttctaggaagacgtttgagttctatttgtatcattataatactctgttctgcacatatatttttgtcaaaatcatgtattttatacaataccatagcatggaagataccactcgataatcctttcactattcaaattgtatttcaatcataaattttgaacctgatcgcacaatgcttgctttcgaattcaatggaaaaaagtacaccgaaggtccctcaacttgtcatcgagttacaaaatcgtcacccaaccgtaaaaccggatacaacgtatcccccaacttacaaaaccagtgcaaactaggtccctcggcggttttgactccggttttatccgacatggcagtggactcagcgtgggatccacgtgggccccacgcatcagcctcttcttcacctcccctccctacctctattcctctctcctctcttcttcacgggctccagcgggggaacagctgcgcgggggagcagctgcatggcggcaggctggcgcaggcggacgacgtcgtcaccttgatgtgtcccaaaccagccgccgcgagcgcggcgtggacgtctccatggccgggacgaggagctgcatgtcggcgctggagacctcgttgcccacgacgacgaaccggaataacaccgtcgggtaggcctggatgttctcgcggatccaggcggccgtggcggctgtcctgccgtgcgccagggcggggaggtcgtagttgggcgcaccgacgacgacgcagatgcctgtgctgccgagcgccacgagagcggcgctgtccggcgtgtagaggcggacgacggtgaagccgttctctcggagcatctcggtgactttgctcgccggcggcaggttgtcgccgctcatgccccagcacactccaaccgctgtcgttcctgtctcagattccatctcttcttcggcattcatctgcgccgtggggaaggggaaggtgggcatggctttctcctcactgtccgaacgggctcaccggcccctcccttgaccaagcccagcgagcggtggcggcggcaaagctcggccggggccgagctcgacggctacctctccgcccctacgtccctggatccccatccctcctcaccgctgcctccgtatcctcggattctcatccgtccttgccgctgcccccgcgtcgccggccgccgcgccgcgctgccacggcacatggctgctgccgggcagcccacgccgaaaccgccgcccaggattcgcacgactgcgctgacgcggccatccttcgccagacagcgccgttgcacggccgctctgcccccgcgccagggtcgtcgcaccgctgaacgagctgccgtcctacaccatgccgtcgtgccgcagagaagtgagtgagatatgaggaagggagagaagagggaaagagagaggatgctgacgtggccacactgacatgtggggcccatgtgggtcccacgctaactcagccgatatgtaggataaaatcgaggtcaaagccaccgaaggatctgctgtgaccggttttgattagttaagggacaccggatatctggttttgcggttaggggacgattttgtaacttgatgacaagttgagggaccttcggtgtactttttctaattcaatgtactgtgtaaagctgggaaaaggccagatccattcagagtttcagacagagcccaacaaaaaggaatcaagaggtaagcccagaaactgaaggtttacacgatcaaagaggcccacccgatgatcatcgggcgtcatcgccattgacttatgggccttcatataaaattcgcatctcgatcgatgggcctcatactgtgcaacttaaatgagtgaggaattcgattcatcctcgacatatgtcatattgtcatggatgtgtgtttaatttggtggtgaggcattggcaacgagaaacgcaagttcttttgtatagatgtacacactttctttttgacagaatatgttatatgtatatctaactatcgtgtatctaacaattaccccctgctaatttagttgggataaaaatatgattttttttgacaaaaatattatcactttgtaaataaattaaaagaaaagttatttgccaaaccgatcgagtacgtgaataattacactgagtgaggttatcatgaactcataagagtaaagtccatcaccggtccctaaacttataccgctgtgtcatcccggtccctaaacttgcaaatcgaccgttcaggtcctcaagcttgttcgcctgtatcatcccggtccctaaacttgtagatgactcgtttaggtcctccaacttgttcagttgtgtcaccctggtccctaaacaagacggtctaaaaactttatatcaaaaaataattcataacttttttatgtgaactctaatgaagacaaactttgtatcaaaattgtaaccctcgacgtgacctgc

SEQ ID NO: 67543 - DNA, 4590 bp, Oryza sativa
gagtaaaatccatcactggtcactaaacaggtaccgaagtgtcatcccggtctctaaactcgctaaacgaccagtcaaggccccggacgagatagacggagacgtccgaggccctaaacgagtgatctgcaagtttagggaccaggatgacacagtcaaacaagtttgaggacatgaatggtcgatttgcgagtttagagaccgggatgatacatcggtacaagtttagagaccagtgatggattttactcaactcatagtccacttgagcatgcaccatgtaatgagtaacacatatgaattattaacggtattgctaaaattatgacgccacattttttcatcatctctttcctatgtcgtctatatgtaagtatccttctatgtcctattttcagttgataataaattacttttaattctaattctatatacatggtatattagaaaaaatataatgtaaatattaaaccttacaatataattacaatgaaataggtgataatttacatgtaaaaacgattttactatttttcattcaaaaaaatagatgccataaatataagctacactcgttaattaattagtgctttaactacttcttgagctattttggactgataaaagtatgcacaaccaattaattggcaacttcaataatagtcaggattaaaagcaatttttttaccaaaaatgtgatggccaaacatttgatttcttaccctaccatattattgtaagaaaccaaaattgcccgtacttcctcctagatgttgcacagtgttttgccaatttctatgcactgcttcacaatagtattaatcatctgcctgcacgtacggagagaatcaagagtacacctccgtgattaactattgcagattgaacttcctcacccgtgacctataaagctgtactgactagtgactactgagatactccaaattactgtggtactactgtttatgttttaggacgaatgcaaaatcaatcattccatgttttctgttttcttcgtcttgatttgaatcttgatggaaccgctaggactctctcgttccaaaatataaatattttttagctataaatttgaataactgtgtgtccagatttatagctaaagacgaaggtaaagatggaaacggaaagaactctatctgtgatctgtctatagttggatccttttcgatacttcccagaggcaacagggttaagatttggtttatttggaattcagctacgtggccagtggccattcacgcatgcccgatcgtttttctgtgcgacgcgcggtcaccggtgaccgatcgatttgtcaccaattcctgacaaatattgtgttaataatttcaccggactttatatatctactccttcgcttcgtactataaaacattttaactttttttttccaagtcatttgactatcagttcatagaaaaacataacaatattttcaatattaaataaacatattatcaaaatatatttaatgaaattaattttgtgttttaagagttactatatttttctataaacttagttaaaagtttaacttataaaaaggcaaaacatcttttcatatgaaacaaagggactagttgcaaattgatcaaggcataatttcaggcttacagctgcaattgttttttcaatgcacatatacagaaacaaatttcatactgctatggaacaagggaaaaaaaatgtcattaaccgtgtcaagagtctgatatggctcatgttttgaacgatagaaggaacaaggggtggcagaggggagatctatcttctccctctactctccccccctctctctctctacgcacaaaagattctgttattgaaatttggtatgggccatgcatgctcaatcttacctacaactctacaactgactgctttttaagaatcatcgttaaaaagttgtactgtagtacgttttgatctaactggaatttgtactattttctataaaatgctccactagcatgccactctttttagaaggtccgtcctaccaatggcatacaactctctcctctctgcgcggctaccctccttctctcaaatccggatgggggaggggaggcggcggcggcgacaacagaggctgcggcgcgggatgggaggaggatgccggtgctggtgcgggatgggcggaggctagataggtacgagtccagatccgccctctcctctcccaaatccgccatctccccccagatctgtggtggcggagaccggggaggggctcggcggcggcggcacggggtaggggctcggcagtggcaaggggacggcgctcagcggtgacgacgctcggcggcagcggatggcgcgtggtgggtctcggtggtgacgacgcgtgctggcagcggtgacggcgcgcggctctctcctctctgtgcctccaacctcccacctcccttcgcctttctccggctctccggctcgacagcgaccgcagcgacaggacggcgaccgcctctctccagatcgatttgcttcctgtaaaggatttgttgatgcatgctgactgctgtgaaatcgatttgcttcctgtgaaggatttgtttatgttaatttttttatgtgagtctgctgatttgttgaatatgttgatgtgaatctgctgatctatcgatgaatctgttgatgttgatgtgtttttttgttttgaaaatgatgttgaggtgtttttgttttgaaaatcatgatgaatatgtggatttaattcttttttgggaaaaatctcttcactggcagttgacctaatggtgccactagcgaaaatggtcatttttgctagcggctagcttaagacagctgccagcaaagatattttttcgctagctggcgtcactggcctttgctttgtggcggcttcaaattccaccagcaaaaacttaaaataaccgccacaaaagatggttttcgtagtagtgtcatctattccaaaagaggctataaatcgttagattattatgaactgtaaattattatgaaatggaagttacatgattatatctttcgtaacgtacttcggtactatatactagtatatatttaagatttcaaaacattatttatgagaaaatagtagttaaatcttaaatataaataatgcccggtagcaataatacagtaaaacatagataatctgcagcttgtttcttattgatgtgtcagggaaaggggaaggttaggcctcctcccatcacgccgccgcaacctttgccgcgccaccgcgtctgcatcacctctgctgtgtggggagagaagggaggagctcgggaggggagagaagggagtggagctcgcgagcagagaagaagagaatgggtaaagtggagaagaagagaatggcaaagtggagaagattaaataaggcgtatatttatttacaagcggtacatttagcctccgccagtgaaaatccaatttttgctggcgattgcttaagaggcccgcctcgaaaaattgagttgttttttatggcggatctcttagtgtgaccgccagtaaaaattgtttttcgatggtggtccgtagcccccccacccctcattatgttttcgctggctgtttcgtatttttctaccagcaaaaattatagggcaacgtcatgaaaaatcgttttttaatagtgtgatactccgtatgaggacattcctaacccaatgaataggatggtatccataacattaaataagctgccacataagatgaaaaatgatgtggcaagtgaataaatgaggaaagagaaggaaactatgtcttgcatgaaatatgttttctacacaacatctgagatatcatgtgagataagtagcattaaatttaagtatagaatagttgtgcttatattgaagagtagtgtctagtattggtttcttgataatgtggagtttatagaaactatgtctagtgtcttgggttgggaatggcctgataggcaaatttaggttatacgttttggggattgggttccccggcatataaatggagctgcagattagcgtattaattaagtactattaaaaatcaatataatatttaaagcaatattccaatatatatatttttaaaaaaggtttttttaagtagattaggaagcatgcgcagtgaaagctgggaaagtgtactcctgaacacactcttagagaataacaaaagggagaaggttcatatgaatctttttggatcacagatctggcgcgcaactacaattaaattctgttgaaatttacatggaatggagtagggggaggggttaaaaatggtgactgaaattgctaatcgaccatggtttcagtaaaagtggtacgtttccgattccagccatacaaaaaattatatttttctaaatcttttaagcattatattgcaaaccgacactaaatagttaaataaattgataaatatggctgattcttgaccaaccgagaaccgttcccgtagaggctaccattttctgaatgttttcatccccaattaatggctattttataaccctagctaggaaatttgaagggaaatcacaaaataaagccgattaccatttggtacgtactactccattaaaaa

SEQ ID NO: 67544 - DNA, 1770 bp, Oryza sativa
gcgccgccggcagccggagacggcagatccggcgccgtcgtgcgtggatctggccccctcgtggccagatcgggatggagcggcttcggccgcgtcgcatcgaggaggaggccgcgacgccggcggaggaggttgcgtaggtcgtcgctggcatcgtctccgccgctcgtctccctctccttctcgccgccgactcacacctctctccctcgccgctgccgctggcctctctctctccccctctctctcccgtcgccggcggccacgaggagtggaaggggaaatttttcggtaggaaaggtgtccacaggccacgctcgtgcccaacgcgcccccctcggctgtgttcccctgccaaaagcgagcgagggacacgtccccccaacagagggacgcgttccatcatgggagatgatgccacgataaagcaatcggcgacggacggagggggatagggggatgacctggggttacgcattggtgatggcctaatacagtgtagcaataattcatgcccggccgacccggtcccccccttatctgatggccttccgcttgtcagcgtcctctgtctgaaaaaacaaaaaaaaaaaacgcgcatgcatgcgatgatacagtcagtgggtcgagaaaacgaagatgatatgtccaggcgtacggacccatccatcgagcgcatgatgatataatgtattagttgcagcaattctagcgcggtggaatgaccgcggctgctgccgctggtcgctggccgctgaattgcttgattccttggggccaaaataagggcatgtttaattcgcgaaaagccgaaaataaaatttttgagtgtcacatcggatatttgaccggatattgaaagaggttttcggacacgaatgaaaaactaatttcataactcgcctggaaaccgcgagacgaatcttttgagcctaattaagccgtcattagcatatgtgaattaatgtagcacttatggctaattatagactaattagactaaaaagattcgtctcacgatttcctccctaactgtgcaattagtttttttaatctatatttaatgttctatgtatgtgtttaaatattcgatgtgatgttttttgaaaaaattttgggaaccaaacaggcctaatccgccccatcgatgtccacggagagaaaagctatagtgaacctgatgccgtcaaatatcatcacagaatatgtcccaagtctagctatagctcgagtatagccgggtcctctgcctcaattggtgtggactgtggagtggtggccctgtatgaccgtaggcgccgttgatcgagctggctgggctaactataagctagctacacgtgaatcgatcaaattaatggaaggatataccaatcaggaattcaggatgattggcatggttggtgcagtgggaaggtgatcagggaggggaggagggccagtggatgtgtataccgatgggtagttgggtacacatacatcctttccaagctgagcgatgcatgcattcctcttaccaactcacagcagctctacattcttttttccttttttttttttgggaaaactgcactggtagagaaaccatctttggtcggttgcccaaaatccataataattccggtttaaataaaaaccgggactaaaaatgatctttagtcccggttgaaaaagctgacgtcactttttgatctttagtcccggttggtaacactaaccgggactaaagatcatttttagtcccggttcgaaagaaggcaagatgtgtta

SEQ ID NO: 67545 - DNA, 11800 bp, Oryza sativa
  unsure (1)..(11800): unsure at all n locations
attggaaaaacgtcatcagacgtgtcattggagtggcatccctccaatattaaaaaaaccggtggtacacttccaattgcccctattttcattgggcacaggtcgcttggcgccacctttagccgtcggagaaaactcgatgtggccattagtagtgatggtctatcgatactttgcaatgagactgtcaccaaaaaatcatcggtagaaattgaaaaacattttcgctggcgcacatcattagctggacacgcgtgaagaatattttcgcaggtgactgggctatatttgtccagcaacgaaaacggtttcacccctgcggtcgattaccgccagcaaaacaaacgtattttcagtagacattggtcgcttggcgccacctttggccgtcagagaaacctcgatgcggtcattagagcaagtttaataagtttaatagtatagccaactactaactccaaatcatctatagccaatctaatagctcattcatacaatagttattacctactacctccgtcccatattacttgtctttttgagtttttgtttgtcaatgtttgatcattcgtcttatttaaaaaaatttggaattattatttattttgtttatcatttgctttattattaaaagtactttacatatgacttatctttttttatatttgcactaattttttaaaaaaacgaatggtcaaacgttacaaataaaaagtcaaaaacgtcatctattatgggacagagggagtataagtatatatatactacaacattgatatatatccaacctctcatacacacataatgtccgtgctgcattccttctctcttgttttccgttattgtactcgctattagtggtgatggttctatcgatattttgcaatgagactgtcataaaaatcatcatcagaggaagctgttgaagaacaaataatacaaccaccaccgccatgcatggcgcgccattgatgcgttcctctggactcctccgatcccctctgtttatccagctcaccccgtccgtaggaccccccccccccccccccacattgaattgacgggtcgccctccccgcacatgcatattccgttatctgtattatcctctcccggtgtccacgcgtgccattgcattgcatttcattcataattcatccattcattcggtcaaccggtcacacggtcccagaccctacctgcctgctgccgtgccactgaacctagctatgctttactgcagtcgcagccggcgatcgacagcagcgtcatcgtggtggtggtggtggcctatataaaccaaccacccccaccccagcaacgttatagcagtaaacaacatctctcacgaaaacatcgagaaaaaccgtgtgagttggatggcggggacgggggtgtgggtgttcaagagggacggggtgatgcagctggaggcggacgtggaggggggggacggggaggaggcaaaggaggctggtgtacgtgccggcgaacgagacgatggggtcgctgcatgcgctggagcggatgctggcggggctcgggtgggagcgctactacgaggaccagaccgtggtgcagctacaccgccgttacggcggcgccgacctcattttcctcccccgcgacttttgcccgcttccgctccacccacatgtacgacgtcgtcctcaagaaccgcgaccacttcaaggtccttgataactagctagctaatttaacatctgtcgtccatgatcactagtatgaattatgatgatccatagctatcagctgccagctgcgtccacttctactcatcgatcgggcacgtacgactgatttttagcatatataaagcgtgtgtgtacagtactgtatggctgtattatgcatgcacaagcaaaaaggttaatttgcttgattatattgatgagcttgcagttaacttaattaatatagtttggcttggttaagtttcttgtgtgacgcgtggagaacgaacacacacacacacacacacacacacacacatatatcagcatgcattattgtgtgctgtgtgtacgtgttcatgtacggccggactagtccggattaaattaatggccggggcattattaatgattgtgtggccgtgtaaccgtgttgtacactgttgttgcattagtgtgtctcaaaccctgctcaatgtgcgcctgcaaaggtgatgtaacacgaatatatatgtatacacacatttggccgatcgatttggcttaatttgctacactaattattactacaagtttttttgtgtttgcgagatattgtcagttgtcagctttaatttatatgtaaggatcgatgtcgcaaaaggttaagagagatcatactaataaagtataggccatgagctgctcaaaatatgcatggtatttacgcttggcacattactagctagctagccagtagctgatcgaggttctggactacatcgaacgatgtttaatcaagctgcataataataataataataataataataataataataataataataataataataataataataataataataataataataataataataataataaaatctcctctacgtaccctcgaaagaaaaaggaagttgcccccacaatatgttcaacatttaattccacagtttgcacgttctctgatgaattttgtatgcattgcccattgatacgttcaatcagctagcacaggtcggggatattaattaagggcaaaaagaaaaaggacagcctagaattaataaattttatatcgcacataataaatggttcacaatcgtgcgtattagctaggtactccatttatatattaagaaaggtgaatatatatgggttattaattattgggacaattgcttatatgatcccgttttgaaccctaactgctaatttgtctatatttttttaagtttgcttatttgaccctccttttccaaaatgaagcttccgtctgaccctgcttccactaacccgttaaattttgatttaaaatacaaaaagaatgtaactaatattcataatacccataataccccttaggaaacctatccatccactgaaccctatccacacatctctctctcgttcttgcgctagttgcggcggcggagtgtgtgtgcaccttttcttttcctttcatacacacgtcccagccaaaaaagaagactcattgattttctctttatacccggcccaaaaagggattgggattcggtgacattgctctggtgacataccctgtgacaatgagtcactgacgtgtgggacccatgtgggcccagcacatgtgggttccacatgtcagtgactcaaaatgtcacgggggaatgtcactgaatctgcgtcccccaaaaagaacatcctggcaataaaaaaagattgtttgttctctatccatttatttttcagggatggggtatggtaggcataaaatttggatagggagattatatagaagtataactttcttttgaaaatacgtaaatattttgtccgagacgtggaaagtttttttttttaaatataataaatgaactttcattcgtattagcttaaaacttccaaaacatttttgaaatgcaaacaatttttcaaatattcccggcctgctattcacaatgaaagtgcacaaaatttggcgcaaaaaagccatctttataggctttatttttttatttccctttggaattcaatcaattttatgaaaaaaaggctgagaaattatacttttctcatacgtcataaaaactatatttttatccatttgactagatttgcacacgctggcactattttaaaattgaaaaaaaaaatagttgccaatcaacaaacatgaggagtaaaacctcgtgcttagactcgtacttgtctgcagtatagaaagcaactgtttacaataggtttgcacaaagctgacgttgtaaaataaaaatatgctctattcgagtaatcaacaaacattcttgacttatatattttactaaatttaactagaattaaacaatacatgaaccatgaggtccaaaacatgtacagacttgaaaacatatgtccctttaataagaaaaaacctgggaaggaaaatgacttctattatataataagtctttgtccgccccctgtttgtacaaagaaaatggcatcatacattgctaagaaaaatgctttttatctataatcactgagctaccaatccctgagaaattgaaaacacagatgtaagacataaaattaggttaaaaaaatattgcctagctagaagcaaaactgacattttttttcatgatacctatggccgccgctattgtcgtgcttgcccctccccgccacgccagatgaggcaccactaccaccacctagtcatcaacggcgaatccgcccattatggcactggcactcactggtgcccatcagcaacgctctcctcccgcaggcctccaatggtggactgcccctcgcgttgccgcctgctggtcgctcccatcgtcggtcgtcaaggagagtcgatggatgagaggagagaaaatgggggagagggctatggagtagagaggagaggaaaagacttaacaggagaaagaaaagagatggagccggtcgggtgcaaatattcacaggcatgcctcttaagacgtccacctgtgaaaatggatttttataaacgggtctatattgggagtttttcgaatccttttacatatgggctttcttttagtccgcctaaaaaaggtgatgttttcacagaaatcgtttttcaatattgagttggtgaaaaggtaacacataacatgtttcgtcatgaaatataacaatctaatataaaattaaacaaatcttattatttgaaatctagacatataaacactaatgtactacacgcatgtagacatgatgtaaccaacaggaggcgaagacatcgatcatgtgaggtcacatcaacatatatagtgtaacaaattaacaatctacttccaaattcggtgtgaaaataaaaccctttatttcatcaagaagagggttatgcttgacacgagtgaacggatggccccccggcaagggcttgttgcacccggacgcggagatatgctgttgcctcaggcccaaacgcggaagaggcccccggctccaagctccacctaagttacagcccgacccagcaacagagtgcaggaaaaagtatacctgaggtcccttaccttgttaccgtcttaccgagttacaaaatcgtccctgaaccaaaaaaatcagataaaacgtatcctccaatttctaaaaccactgcaaacgagatcccttacctaagttacagcccgacccagcaacaagtgcaggcaaaagtatacctgaggtcccttaccttgttaccgagttacaaaatcgtccctgaatcaaaaaaaatcaaataaaacgtatcctccaatttctaaaaccactgcaaacgaggtctctcggtgttattgtcctcggttttgactgacgtggcgtttacgtggctcctttgactaggtcttcgttccacgtgacatatacatgacgcttacgtgacagtttgatccgaaaaagtaataaaataataaaaagttgggcccacggcttagatccccatcttcttccttttctctcttcttcctctctttcttgcaccatgtagggaggaagcgcagaggagagggcgtggctccgtcggctgtcggcgacctcgacggcggcgggaggtggccccggctgcggtggcgctaaggatcggagtggcagccggtggtaggtggctccaaggaacgtcgacggcctagcggcaacgggaagagtttgagggaagagagagagtggaggaagctctgtgccggtctccagcatcaccgctgccaacgaatcaatccctccaccgctttttggccgcacgactctccatctcgttggctcgctccatgggcgtcgccattgctgtgccgtcctccgccacctcggtaccttgctcgatgctatcaccacgctcgtgctccgccggtgccgctgctgcctagctcctctgcgccgcccttctccctgctagccactgcccgttgtcagggggcgcaggagcgacgcggggtaggaatggctgtcgaggccacagcgttggtcggcggagggagacgtggtagcggaggaggagcgataggagcggaggtccctggacctccccacagcattcgagctcggtgccgccgcccaccacctctccgccgatcgtcgcccttctcctagcggaggaagaggaagccatcgaggagagaggtggtggtggatgaactggtggcattacagcgaccgaagatgcagcgggagaggaagcccaggccagcgacaaggtcagcgaaggcgccgatgttcttaggcttgaggtcgtcaatgattgagaggctcttataggcatcaaggcccgagaggctgtcgatgtagctgtggaagggcttcttgggtccatagtagttgcggtgcttggtgtcgacgggagcgtgaagagcggccgaacggcattgtcaaataggctagcgcgaatctccgaagtgaactgcgggtagtgcgcatcgaaccaacagtgggttgtgagcgcatccatcacctgggcacgcacctccgctcaccgccttgtcctcggtgccgccgggtccacgccacgtcggagaagtcgatcctagttatgaagagaggattgagggacatgctgacatatggggcctacgtgtgtcccacgctgactcagccacgacgtcagacaagaccgggatcaatactacctaaggacccagagtaacccggttttgtatgtcgagggatttcatatatctagttttatgattgagggattattttgtaattggataacaagatgagggatctcatatatactttttccacattgccctcatatatactttttccacattgcgcatcctcgttttactagctaggccggcgcgcgggtgtttctagctggtgagaagatgggcttggatttacggcagacaaagatgggcttggattacgggaacgcgatattccgcggcccaacgaaacaacctagctggtgacaagcctcagctgagctccatcgtcgagccagcccacacgttgtggtatgtactgtaagatccatgttctagatcgaatcgcacgcgaaaaaaaaaacaaaacaaaacaaaaaaaaatctgatctttcgccacacacaccacgagatgccgcggtggtaactgggtatacgctcaaggatgcacagtaatttggcatttcgctcaccgatcgatcgagtcacctcaccccgtctctcttccttccacgcatggcaatgcaaacgccaatcgccggcgatgcgtctcgcctcgcgcggcggccgctccggcgcacgagcggacgcatcggcgcgtcgtaattctccacgtacgccgcgcgcgcgcgcggcgtcgcggttaattttgcacacgaggttaggttgcaccagcgaatcacgtacgtgttaggtcgacaacccatcggttcgagttaggtgtgttaggcgcgcgcgcgcgcacatgcttcggtcggatcgtcgatcgcctgcgtgcgtgcgtgctaccgtgcacaagcacacgtacgcccactggcaggagatgataattttttttataaacacggtgcaaacgcagatgtccacaatacgtgcatacttatcccctgtgaacacacacgcacacccttatgaagtaaatgtgagcatcctgtgaacacacatgcaaacccttctgaagtaaatgcgagcatccgtgtgtaaaatctaaaatttgaatctgggtggactgtctccaacacaaggaatctaatcggttgagctacgctcactttgcaatacgatgatgatttaatgttaaattcagtccctatttgccatagctccagattcataatggatttgaagtttgtatgctaaattgcatttaaaattttatatttcatctaaactaagaacaaaatgattcttgcaattattattaacgtaattgtaggtctatatctatatctatagatttgtggagccaggagtatctaactcaatgaaagcttggatatagagctatgccaaataaagccttattagtatttagtttagtcacctggagctcagatcagctaggcgagatgctcacaaacgatggttaattagattccaaacagaccaagtcctgcgatttcaattaatcatacacattagcttcaaaattgttcttcaaggcataaacgttgcgattaatcaaagcaccgagttgcttgcaggagctagctgcagcatatatactgtatgatgagagtgagagcgcccaaatgtccaatacgtcacagcacttttggaacccacggacagccatcaacggttgcaattggaatcattctctctgcatttcttttcccacgatcgaattaacattgacaaagactctccgacatgacacatccgctatctggacgaagaaaaaaaaacaaaaaaacagccgtgttaactaagacagcgctgttagctacaccatcagctcacctgatcagtcaccagctactttactcctagccatatagcccagattatatattggattattactcaacacctgacgtagctacagtgcaaggacgagtaccactgaattaatcaacctgatctcctcctcacatcgttaacactttgtttttctttcttgtcaaacccaaggataggcatgccattatttatgtatgctgcatgcgccaacaattacttatcctaaacaggtgatgagacccataagatacatgtgtttcgaaagcagacggcagagacgaatggggaggccaaatcctgatctcagtcaactgggacaccttttcgccaaactttcagaaaaaaaataaagaagtggcttgaaagggtcattacaatgtgctcaattaaaccagaaacagaaaagatgaaaccacccaaacgttgccaataatccaaccagtagtatacatctgtatgaccagcaggtgatcaacctgatcaattgatttttaaggatctgaccttcacacagtgacattaacaaaaggagtagtataaagttcagatgaagttctgttttcttctatgccccctgctgcaacttctaaccatccaatttaatttcccgtattgatgatcaggagaactacatatatcagctacatattgtcccgtatcgcaacggaattaacgcgcgtaatgatgattgatgagcaagtgagcaacgcaagcagtggctgcaagaaagaagcaaagcaaagcagccatagacttttttttttggccaaattcgtggcgagcaatgcaatcttctccttttctatctgcggctagcggttcagtttgtttctctgacgtagccatggaagcccaaacaatttcgcagtcgtttcagtctttcactaatgtcatacatgtaattcatatgtttgtctccacttcttaatttctttcagattacatctaggtttaggctactaggtctgctatattgctggcatcgttgcacacgttgcatgcaccgatatatgtgctgccaatttagttccgtgcctgatcaggaatgcttcatcattgataacatataataggctattatttcattcaaaagcttaaaacgataagaaaagacggnnnnnnnnnnnnnnnnnnnnncagctcttccgaacctcagatgtgcagatcacagtggctgtaactttaggccacagtgtgtaaatcaatctagctttaacattacattacacacgccgtgtgtggtctattctgaatctcgatgacaacgaaaaaataaaagtatttttggggttgtgttgcactgcgcatcggggaaagcaaagtcatcgtccgattcagcgaggggatgggggggagttggagttaactggtgagcggaggaaatccagacgtcgcccatgccgctgcatgtgtgtgctgactgcggccgctgctggacaggcatggcgatgatgcggcttgcggcgtcgacatggatggccttggccgctactctactcgcggaagctgtttggtttttttgttgttttagcgtgagatcatacgagatagaggacacgtacgtacgcgcatacaacaaatctctctcgcgcgatcgagcggcggcaacggaatttgtccgatgcatgtgtcatatgggtcgttacggactaggagtattatatgggatgaggaggatgcagatgaacgtacatgggtttttgtgcatgtgtcgtgtgctaagctttgagcctttgacgtctttggttttttttttttgaaatcacgtctttggtttggagtaacgatcaatgaaaacaatgagccaaaacaaccagctgtatggttcgtaaggttttcaacgttaaatttcttcgtgtttagacaaactaataaagttaattggatccatatcattataaatgtgtcattttaaaaaaataattactacttatttattactaacgattccatctgccttctttcctcttttgctggccggccaccccacatctctagcccccctctctctctctcccaccatagagcatatgacggtggcgcctagcaacgatagtggtggcgggtgcttcatacacgtagctctggctgcacaactccgatggcaatcccgagaaaccggcggctaaatcacccgtcgtacgtgcgccactaaatctcaggcattaagtttggggctccatatccttctgtcggcagccacaaagaaaatgacgcaatgaggatggcggagcttgtggtgacagggagagcatcaacctagatctagcgagaacagtcttcttcattgtcgggaggagctcggggcaagtggcagcaagctcaagcggggtgacgctaaattccctccatccttcgcaggccaacgggtgaacgggagctagtggttcgctgttgcctccccatttgcctctctctcgtcggcaccctcctcacaacccgatgttttcggctcaacaaggtgtagagagatggagaaggaaaaagagtaaaggaaggaggaagaagatggaatgtaggtcccacgtccatgggtgttttagtctatatgatgacataaaacgtgatgcgactgacatggttttagttatatgcatgttcgtataatatggatacatataaatgaataataatgttattttttaaaaacataatatatttgtaatgatttggatccaactaatctaattagagctttgtttctgtccagcgaaatgtaccgggtggtaccagatgaaatctagccgttgattacacggaggttacgatgggaatcggattatgttagcgagagagaaaagcttgtcgccctcatctgccgtcactagggagccactccaccgccgccagcgactccaccatcaccgttgcagcctccgccgtcgggaacgactccgtcgccaccggaaaacgaaattgatgcccaccaccttggccgcatcaccgtcgctgcggggggaacgactcggccatcagggagccactctgccgtcgccatcgactttgccaccgccgccgaagtcgggaaccctccaggaaacgacatcgaatcctattctagggttttctgcatgcctcttccgaccatggcacgcgaaaatacaatcttacccctccacccttctccaccgtgcggtacaaaatcaagggctgagttagtaccggtcagtcccgactaatatcagccgttagatcggccaggatcgaacggccagcaaacggtaccgtaacg

SEQ ID NO: 67546 - DNA, 8961 bp, Oryza sativa
tgcatgcatcgcgtctgggatgacgtccttgcttggatgatgagctgatgacccttggcaccgcaaggaggaggagttgtggagcagggcatgtttggtacagctacaacttctaaatttaacttcaggagttgagtctagagtgaagttctggagctgtctaaatccagtttcataactctagtacattttgtgagagagctctatccaattccactctcagttttagtggagctaaaactgcttggctaagtttcagctccagaagaggtggagttagagcctgagatgtgccaaacagacccgtaggaggactcgcttgggacgggggtcacggcctcacgggtccgcgcgcgtacggtccttgtggcgactccgatccgcaacgtggaaggtgcgtgccgcatgcggcgctctgtacacgggggccaggtgcgtgcatgcggacaaccagtcaaccagatcgatcgagatcaaactgcatccaggtgcatccggctgtgcgcctcctcctgatctgacactctctaggagcaactatagccaactacttcatcagtcctataaaaaaatcaacctagtacaggaggtgacacatactacaaatctagacgtatctctgtccatattcgttgtactaaaatatgtcacatccagtcctaaaattgttttttcaggatggatggactactcactccaaattatctataaccaatttatagattaattacttacaaacatatactacataattaatatctgatttctcacctatcatacacacatgtatcttgaaggagtccgtgctacaactggctactaaaatttgtatcccattactcttctctatactcttttatctcctcgaaatgtgttatagctaatttatagtctgttattgtacctactctaaggctgtggtcggaagctcttcttactcgtttttcacgtgcacgttttctaaactactgaatgtgtgatttttacaaaactctttttatacgaaagaagttttagaaaataatattaatatatttttttaaaaaaattaatacctaattaatcatgcgctaatgaattgctctgttttacgtgtgtaagatattagttttcaactcaaactaccgagcacaacgtctctattcctctacttgcttttaccccgcaagttagatttgtaagctacggtaggaaagagcttattagctcgcacgtaaaaaaaacgattaatatataattaataaagtattaattattaaaacttaagacaaatagatttttattttcaagtaacttctgtataaaatgttttcgtactaaatataatgtttagcaatttaaacgtgttaagaccttttcatcacacgagagactgcacggacagaccagtatagctgtgccctttaatactgtctctcctatctagaggatggtaatgatttgtatttaaaattgctgtcgaattgtgagcaccaggatttatgacaccaccaatatacactttgtctaataatgttcggtttatttatcgccatgagcccatgatactctacagtctgttggcccagttcaaacttgctacgtagattgtttatagtatgaaaggtcaaaaggaaaatggaaatggtacacacacatcttttcccgattgttcaatacttccatctttcggggatgactgcattctagtttgaattaattaaacctacattagcatcccctttaattggtgcgaaaaacatagtatatatatttggaggatttaatcctataaaaaagtttctaaaaaggtcttgaatataaaggattgaatcatataatttcctttagtatttgtatgaaatgaacaataatatagagattttggagaaaagttagcaagatcttgaaaaattctattttagtatctctcttgttatttttctgtttcacatagcctaagcaaacgataattcctgtattttcgtatgttttcgtatgttttgcacctacattcttattaaaataacgtatttttatatgcctctgtttttttaatcacgagttttgagggaaccataatagaatcgctagtaaaacatgtacggtttgtttcttttttgggtttaacatcttagtttgaaacatactgtttttttatatgcctccgtttttctaatcatgtgtttcgaaggaactataaaagaaccgttagtaaaccatgtacgattgttccatttttggggttgacatcctagttttaatttgaaacatactactccctttatccaaaaaaaatactttccataatgtatatatctcactttataagaataattattgttttaaggttatcttttttatacattgtggttgccctgaaccatgtctaaaatagttgcaccaaacaaagttattagagacgaatgtgttcttatcctagttttcatactcgattgtaatttttaccccacaccccaaacttttataaatttaggattttttcccctttttttatctaaagtttgtattcgttccaaagacttactcctacttttcatatatgtccttacatatttactcctacttttcaaagacttaatgatttcgcacatgttttgacatgaagcattcaggcataaatttcgaccctgttttaatatgaattgttgcttattcagataaaaaagggggcaggtataagcttgacatgaatttcaacaccataaaaaaacccccttaacgaagcgggataagcataagctttaatttttgttctttaaaaaataaatatatctttgttggcattctaaccacaacaaaacacaccttatatcacagagggtgtacaattaactaaacaaataatccatcgctcagttttctctacctatggcctttattatcgctagcagttaaccctcgagaacaagcaacatattatcctatgcatacaggtcctcatgtgtacatacgtgcatactaactaaaaaatatcaccaaaatatctagaaaaaatcatacacatactttcaattgtataacgtcaaattcattatattttagctgtaacaaaaaaaacaaaaaatctgaccagttttaaggttgcaattttgtcagaattttatctttttttgttattctctatgtagaatgaatttgaagatgcgactttgcacgtagatgtaatactattgaaagtacatgtatgaattttcctagaattttttatgataatttttagttggtgtacatggtgtgaacacgcgagagcctgtgtgtataggatacgctccccgagaacaagcttcaattattagcctcttggtgcactgtgtggcctgaaaagttaaatggtctaaccctttaaagtgggatcttttaatttgatcttcttagggtacccacaatggttatctataggctctctataagagatccatgtcagcatattttcctacttggaagagattaaatgaagagagagagcaaagctatctactaacctgtagatagtctatagagaaaaacgaggcaatgtattagagagctatagatacccatgtagacatactattgagatggtttactattaatctagtctattgctgagatgtacatgttttatagatagcaccttactttaccattgcgggtgctcttaggctgcgttctttccacaagtttcccaacccctttctctcgttttccgcgtgcacgctttttaaactgctaaatggtgtgtttttttcaaaaagtttctatacgaaagttgctttaaaaaaacaaattaatccatttttttaaaaaaattaactaatacttaattattcacacgctaatggaccgctccgttttccgtgcggtggagttgggttcccaaccccaagtatcaaacacagccttagtagcttgaacacgtctcttccctcccctctggaagtggcgatcgggttttagaggagcagaaaaaggcagaatcatcagaggctttcggcacatagaaatgtggcaacgtacgttaacagtagcggcccaatggcaagtgacaactggagttctttactaattaaaataaagactttatcataacttttattaacatattttttaaactgctaaaagatatattttgtgaaaaactttgtatataaaagttattttaaaatatcagataaatttacttttaaagtttatactaatcaaaactcaattaatcatacagcgattgttctcttgtttttttttaactctagtatcgttatatttttatcacataatatcatagatttttatattcttatatatttattattaagatatattaaaatggtaaaataattttaatttttttttactaacttgagcaatttaatcaatgtgattattttcaatcctatcattgattgtttgcctcggcggatcctagtaggtttcaccctttctcttagaggagatcagtgcatggcaatttgattgatcccctcttgcaaagtccaatcctggttgattattagtaaggttattcatactgtatgtattcttttaaaattttatttatttttatccaagttttcaaaaatttaaaattgtatttctagactctattttaaattatatttcttgttggactttccacattatttctcttttttttcctatttttcttgtccgtgttcactttttttttcggtttacaccacactcaatcatagtacccttcttttttttcttgttatttttccgtttacacaaaacccaatcctaatacccttctatctttcattcttcctcttctttcgcttaatgtgaaacttcctaggtcgtgagacggtgagagtaaacgcgagggattttttttagttattaagttactccctccgtttctaaatatttaacaccgttggttttttagcacatgttttataccatttatcttattaaaattttttgtgaaatgtgcaaaactatatgtatacatataagtatatttaacaatgaatcaaatgataggaaaagaatcaataaatacttaaattttttgaacaaaataaacggacaacatatttaaaagataaacggtaataaatatttagaaatggagagagtaatagattagacctctcgcgacggcggcaggcaacctagatccatcagcccccgcgggcttgtttaccccgaaccgatttctattttctccgctccgcggcggtaaatcaacgcgacgaaatgaaccacacacgcccctccatgcgtcgagatattgtcgacgctcactcgcctcctgcatgcgaccacgcgcgcccacgcacggcacatgcctcccccggtcatgcatgtggccccaatcggttaaaaaaatatgtttaattattgttttacattagagcgggtacaatatcaggctataagccagctataaacatattttaggggtgtttgggagagagggaattatgcttttgtgagagggactaaactttagtccctccttcccaaacaccacctttaaagagataaaagaagagagagaagagcagcgggctacagatctgtagccagctgcaacacggactgcaagacgtaatgtgtgtatgacaggtgggaccatatattaatagtatagtaagcaactattgtatgaattggctattatattggctatagatgatttggagttagtagtgggctatactattaaacttgctcttagggcacccgcaatagttatctataggctctctataagagatccatgtcagcatattttcttacttggaagagattaaatgaagagagagagcaaaggtatctactaacctggagatagtttatagagaaaaacgagacaatgtattagagagctatagatacccatatagatatactattaacatgatttactattaatctagtctattgctagatgtacatgtattatagatatcatcttactttattattgcgggtgctcttagatgttatatccgatcgaatttctgaagctttttactgtcaatgatgaaacttgaattaacctagacacttttaatttgaccaccacctgatttacccgatgtatacacgtactggtcctgcatgctgtcccgtgtgctagctagctgctcgatcggtcgtagtacgtgtacactcctcctcgactgtaaccaacaaattaaacacccctttaatttctatacggttgcattgtatacgtacgacgacacgcatgtcacgatccaggtccagtacttggtggtacacccttcataaattcagacccacacacacgaaaaataaaaactgaaacagagggagaggcgtgccgttctctctcgcccggccgctacagagagaaaactaaacaaaactccaatatgtaaatatatttcgatatttacgtataaatactaatacgtgctaatcatagtcgcaaccaagccaattagctgccgtctccgtcgacgctgaaagcgatcaggaaaaaagcgcaagttgaatgcgagaacggatgcatcagctaattaagctcggatatatatatatatagctgagagctgacgatgagtgtgtgacactcctaccataccacggctaaaccacaactaatgaacaccttgtactatattagtatctcggtctgcattattatgctgaccccattgttctgatcgaatcatgcagtgcagggcgcgcgtttgctccgcaaacataaacgaagacggaatcatcaacagacgacgatgaaacggacagtttatccgatcaaattcatcaagataatgcttcatattcgcagctgatttgcgactgctagaacaaattaaaccccagattttgtttgaagagcttctagcaactacaattttcttaataataaaaaagaaactagatctcttaactggtgtacctttttcatttagattttaagaaaacataactgtagaatctagaaaataaactgaaaacgttttctagctttttcggattttcaaaattggctgcttatcagaatttagggctcactgaacatgcccctgttctgcttctgctccaatgctgatcgctcgttctctcgctcgatgaggggggcaagcagaatgcaagttgagcaaactgcgtgtctctctgtgccaagaactcgaaaacgccatccgggtcaaggctgaccacggaaaccgggtctctcacgtacagccacgggtggcgcagctgcgcatgcaaaatttcgatagatttcagctttagctatagctattagctgacgaatgtgacggcaatggccagcagaaaggggcaaaaggacgcctatcaagttctcgattatgcatatccagcatctatccatatcttgcactggcaagtaacagcgcctgcgtactatagtacagagacggtgtacagtgtagtagagtcgtcggtagctagagccttatcgacatctcaggacccaagagaaaaagggagttatagtagctaggaggagtagaggaagaacaagaaaaagaaaagaaaaaaggaaaagaaaactatggctgttcttttctccttaatttttttttgagaaacacagtaaaaacgcagacgctcacaacgtgtgtacactcacccctatgaacgcacacatgcacaccctacccctatgatcacctgcggaagactgggccggcatgtcttgagattgacgaagtcaccataggcgcctcgctgtcgaggggtacgtcgcttactactgaaagaataattagccgtaaatacgagcatccgtgtcaaatctaggatttgaacccgggtgggctggttccaccacaaggaacctaaccagttgagctattctcacttcgcttttctccttaatggatgaatggatgaatacgttttttttaagataataaaatataacatcgcagcctttgcttaacgagttacagccaattatatatatgaatatgtatgcttcctaaactccattttgtaataactcttttatatatgactttcttacaatctattataaatccattttaaactttataataagttaattcatttacatgtacacttgaatactatctccctgcataatataaggtattgttttagtttttagagaggttaaggataaagagaaagaaaaactaagatgccctatttaatcagaattggttaagtgaagataatagaaagaaatccgaattgaagttgattaatgtgacaaccagcgcactaaaattacttatattgcgagacaagttacaacagataaaatcaattatattatattatagaacggatgtactagtgattagcatcaatcattcatcaattctgtcatttagccatttaacaaaaaaacaataattagtagtaatacgttgtagtgggagatgagatggatgatccattggggtggtgcagtccaccgtgtcatcatacaacgatccatcgtgcaggacaggaggggtcgccatttcgtgcgatgctcatgtcatcgagatcagacgaacgtggaccgtgggcccacccggcccatctggtgggccctcgagatatggtccctacgtcccagagctgatgtaaatcaacctagcagctgtattggctagtggaatgtgggtccctatattctttctccttttttttttctgattttcttatgtggggggtaagatgtgtctattacaaattaatctgtggctgtaatttttttttcgtaaatcataagtgttactacttaattgacttgcaaattgctccaatcattcagaatccaatcacaaggcatgccacggacactaatcatgccaagtcagccacactagttgcttatgcaagggtttattggttgtcaaactagttgcgttcggttggaatgttagagcatctccaacagcttcttcaaatctaactctccgaacatctgtatagccaactctctatttgatttggctagtcaaactaagctgttcactccaacagcct

SEQ ID NO: 67547 - DNA, 4185 bp, Oryza sativa
ttcttcaccaaaacaaattttgtaatagatctaacgattcaaaattacgtaaaacttaaatacaagtgacacgttagttacatgcaagttacagtgtaattacatacgagttacagtgtaattacactatgattgtattataattatatatgtcaaatttttagttagaaatttgtcgacaaatgtataggtagtcccgttcatttttagatacactccaattaatccattccattccaccgtttctcggatcaacgagaatttagcttgactccccaattcttaaaatcgaagagaatacaagagtcgagagcctaccaaacttctcgtggtatcaatatgacaaatggcgggggaggaggaagatataccatcaacttcagttaatagtgttgaaaaattatgagaccagatcgaggaagataagtccgtgagcacaatcttatcaagtgaatatatgtggaagatgaataccagatgcatgtcaaaccccctatctctgtccgcgtttctcctagaactcgtcttcgatgaaactaccacacattttcgtatacatggtaacaaaaatatccatgacctaaggctctgcttgacaaagctatcaaatttcatgcgtcttttcacgtcacatggaacatttccatgtgtgttttcccctaaagaaaaacagtaataatattaatattagtatcacacggaaaactcaattcaactcttaaggggatatccccttattttcatgtcacttaaaaagttacaaattttttttaaaaaaattagtagaatagactaatataagatatgtcacttcacaaacataaacatgtaaattcaaattcaacttatacaagtagaaacaaaaataacaaatttgactaaacgcgtaattcacggtcaaatttgctatttttgtttcgaacagtataagtctaattttaactcgcatgtttgcgaaaagatatatcatatattgatctatcttaatagttttttttataactttttaaacgagatgtacaaaacaagggagaaaaaaaatccacttccgtatcacactgttactgtcacagtgctccgcggtagactattcccccacacgcagccgccacagtctcccccgtccttaacaaccaccgccgctacagttgcaaaagaggagaagggcgggcgggggctgggccccacgtgtcagcgacacacgcagccgcaccgccaccgagtataagtacgagccccaccccgacgcggcctctccctccctccccccaacgccaccgaagaaaggctctcaccaatccaacggtgctcgatccatccatccatccaatccgcctcgctccatccatggcgtctgcggatgcggtctcgccggcgccggcgacgtccgccgcggcgcagcagcaggtgagcgtgcgacgccggccgatgtggatggttggagttggggttttgtaggtgttcgtccggtgctgacatggtggttgggtgattttgcagctgcggaccgtggtgctgagggtgtccatccactgcctcggatgcaagaagaaggtcaggaaggtgctcaggagcatcgaaggtacgtggcgcgcgtgcgtgcgtgcggcggcgcttcgccggcgacggcggcgggcattcggattcggggatgctgagatgatctttgttttttttttttttatgtttggtttcaggcgtgaaggatgtgaaggtggacgccgcgatgcacaaggtgacggtgaccggcacggtggacggcgacacgctcgtcaagaggctgtacaagtccgggaagcaggccgtgccgtggcagcacccgcacgtggcgccggcgccggaggcggtcaaggcgatagaggccgcgccgcagcagcctgaggctgcgccggccggggacgacgacggcggcaagggtagtgatgctgcggctgcggcggcgaaggaggccgcggcgcaggcagagagctcggaggagaagaagacggaggagaagcccgaggcggagaaggaagcagagaagaaagaggaggagcaggaggcgaagccaagcgacgaggcgaagaaggacgccggcggcgagagcgaggcggcgccggaggcgaaggcgaagggcgacgacgttggcgccgaacccgccaaagaagccgttcccgcggcggcggtgaaggacgctagcaatgacgacgaaggagcaaaggacgagaagagcaagcccaaggacgccggcgacgccgcgccacccgccgccgccacaacgacggagaggtccctgcacttctcgccgacgccggcggcgcacaagcagcacgaggagcactacccctacccgtagtacggcgcgccgcagccggtgatgagctaccacatggcgcagccgacgacgagcgtctcctactacgcgccgcggccggagccggcgtactccatgcagcagcacccaccgccgccggcgtactccgcgccgccgccgcagcagcagcaatacccgccgccgtcgccgtcgccgcagccgcaggcaatgcagcagcagtggtcgccgtcgtacctgtacatgccgtacccgcactcgtcgccggacacctactaccgcgactactacagcccgccggggacggcgcacgcgccgccgctgcaggacgagtaccgcatgttcgacgacgagaaccccaacgcctgcagcgtcatgtgaacgccacgcgccgccgccgccgccgccggctagcaggccaggccggccgggagaagtagtagttgaggagaggtagagtagcttgtttacactctcctccattggagaggtcaaagctctccttcaccgagcattttcttttttttttctttttccttttttttttcttcacttcctctcttactgttctaattaactagagcatgtaattgtaatgagacacgccaaattatatatgtttttctcttatcattttgtataaggcaaagacatatacatatatataacagattacataactactataagtactaattatttttctatggatagagaaggttctatcttttgtagagaatattcttgctacatctcttcgttttgtgagaagctatgaggattgaggatggctctctcatcatgctgcatctttctctaggacggcggactagggtgttagtttttataagcataacaacttacgtagattctataaggaacaattgaaattttaatgttttaaaacgatggatacgaatatactatatttttttctagtttaaagtttagtaactggctatattccactaagtgttaaggcattaatggttactataattttacaatagaaattgtgatgccttatgtgtctaaaatcggaatgcgtaaacacggacatagaaaaagactacgagctaattttcgcgcactaatagtgtttatttcccatttcttgtattggcttgtgctcccgtgctttaatttggttatcttattgttttattttgctccctttaaagagatgcgaaaagaaaaatcttatgttcacaaatgcatttttaaatataaaactagaatttaaaaggaccaatataagatctaagttttaagaaacactacatgcattccagaaatgctgaaaactgttactttcaagtctttaggccctaaggctttttacaggggaccatacccatagatttactttatccatacataatcttatgtattagtttaatcgttatgggttagtcatcttttttctcttctctgatgatgtttgcccgataatgatcattaataatcttaatgtgatagctcagcttatgaacttttagctggagtttagggtcaggccaagctggccggtttgtttgaaggcttttgaatataaagagttggccttgtccacatgtcaatgatttatgccggcatgctctgctcagctcagcttaggtgatggcaagattaaatacatgtaatttgttcactaatctaatcttgatttatatattgtggctgatggggacataatgggggagtggtggacatatcagtagggcaacttagctaatggatcttcaactgtaggagatttatttatagtaattagttcttaaaccaatgctttggctagttgttaattagccattggtgattaggacaattggatggaagtagggcatcctccactctaaggaatgtgcttaggt

SEQ ID NO: 67548 - DNA, 16312 bp, Oryza sativa
  unsure (1)..(16312): unsure at all n locations
acccgtcgacagcgagacgcccgcggtgacatcgtcaatctcaaaatgtgtcggctcagtcttttggaggtactcaaaagggtagggtgtgcgcgtgctgcgtttctaaaaaaaatccaatattattgattgtttctattttactttagtagctaagaaatagcaaggagacaacaaaacgtatttgatttttttcttaaaaatgtatagattagtgaataatagcttatccttagaatatatatgatccaaagtaatggattttttaataacgtagttaacttgatttttaatattaaattttatagtaaataatctaatttatctcctacttaggctacattctatctcatttgttgagcttatgtagggcatgaaaaacgatgtaggtcatctacgtaatattaattaagtattaaatattacaaacatgaaaatagatttttttttaaaaaatatagaaagtatttgcaaaaattcggagaacatactcaagataaatgagtcagagccaatctgataaacactttagagctcaaccttaaatttcttatgtacttttaaaaatatgtacaaatcaaaaagtatagattacttgagtcattaacggctaaaattctagctgtgttttgcaagaaaaaatgtggcatattttaaacaatacatttttttatttgtgtttcattatttgtgtttctgacaatatgtcccgagtaatattttaattactcattatttcatcttgaactatcaatgtaggcccattgatgcaaataaaatctatctaaactcaacaattgtagtatgaaatgatacgttttttatatttatattatattatagatctatttttgggtgtgtatgtgttatatgaagtaatatatttttcttatactaccaccttcactaaatatttgtncgttctcatcataaagaaaacaaaaatatccagaggaagtataatagaaaaatctagtttaaaattgttgttttcttttggtagtttcaccaaatatttaacgttggccttcatggaaaaaatacacaggaagtgaaaatccagtttaaaaggcaatgttttttttaactcgtaccatcgtacgtatatgccttcttggcctattccggccattatttttaggaaagtattatatgataaattaggagaaatatattactatttataatgaatctaatctgacggtgtaaattaatgggtccaccaacttaaatgaaaatcgaggctagattttttttctttttctcaaaatttctaatattttctctattttattaaagcgccatgtggcagcttgagagcgtttttagagcgccatgtggcggcatgagagcgtttatagaaagtttaatagacttttagtatataatagatagatagatagatagatagatgtcaagaacaacagggactcctctgctagcatgatgggagccatctaattgtgccaatgcttggaaccggtggttccttacatgcatagatacaaacatagtgcaaatctaatgattcatagtgcaaatctaattattcacctgccagctagttcatccgggcactcgagagttcctcgaataatggtgctacatatcatgttagggctccttttaaacgtagcgaaaatagaatacagaaacaacaaaaacataagattttaatataaatatattataaagacacaataaaaataaatagatagccatttgagtagactgcaaggaaaagaacaagaaattgagtagagatagatgtagactcgttaaaaccccatgagttcttacggtaacttttctctaaaatccccatatttcgagtcgttcgaaagaaattttatagaattctaaaaacctgaaccttgttctttgttccaaaggatcgaataggattcaaatcatgcaaaaactcatctacaaaattctttgttccaaaaggaggcctaagtgtatagctagcttatcacaactttagtttggtaatggcattgtacattttttgccaatttttcctcgaaaacaagacgtttgattcaattggatgatttagcacacatcgcgctcgcatcaccgcttcactaccaacagcgacagcattttcggtgtcactcgctcacttatcactagtgcttgatgaattgaaacctaattttggacgcagagtaagtggggcgccagagatacagatagagagagagagaggaagaaaaaaaaaaggataagatatggttggtgcaatagctctctgcacgatggatgttggatgcaattatttatcacgcatgttcctggtttttctttatctgatttacttgtttcacaaatttgtttctttctatataatttttgttccatcttttaattcttctctccccctttttttttggcacattttctttcacaggatcgagtagccatggaccaccgacatggaagcatcggctaagattttctctctagcagcatcagcaaatggcacacactctcacacagtcacacacttggtcgctttcattggtggacacaggattatatgtcaccaattcagattccttgtgaagaacagagctgcccatgaagctccaaaccatgcaagcccaaaagaaaaagaaaaatctttgtgtttatatggctttagtttggaagatcctaattaattgtcatcagccatggacagatgccggttcaggcgacctggtcttaattttcagttctgattttattttggaggagcatttggtgaactaatcactatcatatgacaattaagctaaaggaatggcagggatactcttgaggttctccacaagaaatggctttccttttttttccttgtcttaattaggttggtttcatgcatgatttggagatgcttagctggtggtgaccatcacatgctgcatctgcaaagtgaacttttgagtcattactcctttgctctcctctcatatgctgctgcatctttggtttaggttagcgtgatggagaggaatatgaagaatatgcaatgccggcctgcctgtctacctttagctagcttacaatcatcaaggttttagcagtttggcatggtctaactgctttggttccctgtataactaccttagatggctcatgccttttctgcatatccgtggctgtccagtcagaaaaaatttttagatttttgttttcaaatataagttaggtagcgtcgacctataagttaaacttatagttgtagtgaggcaaaaagctagatacctcattaattttgttgatcacctttttttttctgaaaaagctttgtgagaatctagctaggtatattgagtcatatagtagtaacacctagatcgaaaggtggtagcaagagtaacaatctttaaaaaaaaaatcctggctttcattgttttaaggtagcgtcaatttagaaacttataatttgtagcgaggcacactaaaaattaacaaagacctcattttgtcaaccacaattttggtttatgaaaaagttatttttgtgaatctagatacgtacaacgaatcatatagtaacacctagataaaacagtagtaacaacagtaatcgtcttagaaaaatgttacctttcgttgtttcatactccctccgttttaaaatgtaaattttttagctgttaaactagacatgcttatattttaggacgtaggtagtaggtagcatcaatatagaaacttgtagcgagaactaataagcacctcatttttatcaaccacgaatctagtttctggagaagttcttcatgaatgtcacaaatttagttttatttttgataaacagagtagatcaaaaggtagcagcaagagtaacagtcttaaaaaaaaaaatccgcatttcgatcttttatagatagagctgtcttacaccctgttgaactgaaaaaacactcaaaatatgactagaagaaaacgagtacatcggatgaaaagctacatctgaccaaacttgaaaataacttggattttggatcatgttggtctggtactagctgtcatggaagagaagaacaggatcaacaaggacggtattagtgcgtagggacgacatttgccagactgatttgccaaatacttcacctcttggcccctaccagtgtacatatgtacctgtctgcaagagctttagtagtactccctccatattattttaatatatgacgccgttgactttttttaatgtttgaccattcgtcttattcaaaaaatttatataactttattttattgtgacttgattcatcatcaaatattctttaagcatgacataaatattttcatattcgcacaaaaattttaaataaaacgaatggtcaagcgttggtcgaaaagtcaacgacgtcattaattaaaatatggagggagtactacttactaaagcgattttgcaaattctgcaaaatcgtgtcatccctttcttgtagaactcaatttgttctgtgtcttttgcatgtggagaataattttgtggcaatcggccaagggtgtagttttacgtagctttgctttctgaaatcgttcttgatgttgagaacacgtaccagtaggtaatatagtgcacttaaatttgccgacttgggaagtttatttcgttgagggaagaaacttgtgctgaagaggaagccaggagcttcttttaaaattttgcagaaaatggttgatgtgctgaattttctctggtcacctgatggtttgaagtttttgctagataggagtatttactgcaccgagtggccttcgaagaaatttagactggtgggtgactaaatttgagaatattagaggtgctgacgtggtgatcgatgtaccaaagttcaaagtcccactagctcctaaacaatgaaattttcggaaaataaaaactgttttaaattctcaactttctagtagtttatttatttgtttacatcctcaactagtgattaaaaaaatcattcagctatttaaaatagaaaacatttatgatatactatagctgcagtatatattgtaaaggttggtttgtccttccccctcatccttcaccgtggcgaggggctgccaaccactatgagtctacacatgcaacaccgcctctagccaccgcaagcatgccgtagtgccacctgtcaccacgagcacacgacacaccatgagtatgccgcgtcatcaaaaaccatggccagctgccatgacattgccgaagggagtggccgactcactcgggacgatgacaggacgattcgatgagtggctagggactaaagtacgaaattgctaaaaatgtcattttcaattttgtgacaaaattttaaagcatccttgttcgtactggaaatatatactgccagtaaattgtaccgtaaaagtcacaaccatcgtttaacgaggatgtctgaaactgtgaaaattcttggaggggagctgcaattaaagccagtaatagtattgacatttctattgcaagttgtgttctgaatcttctgatcgatgagcctctgtctacatctccacatctgggggctttcattgaactattcctactggaagatactgtcccctgttcgaaaccgattcttttgtttcaactgacgaaaatttttccaaggaaattaaagttccatgcatgccattggtttcagaaagaagtggccaatcaatctgaccaaccaaccaaagttgagagccagtagcaggtagcagcagatcatttgctgaattaaaaaaagaaagaaagttagtttgtgctgaaacagcacaggctgtaacctgttacctgtacctgtacccccctttggtaggagaagagaccgatcaggagatcctttcagagctgaatcggatcggatgggtgcttgtgccacattccgtaacaagaagtggtaggtgatgactttacactcgaaagatccacgaggctgacatggagctgcgtcggcagcgatggcaatcagcagcagcggaaggacgaactggttgacagtctgacaagcagccacgcaagcacattttcttgttttttcctttaattttcaccgccttttagctcatcttttgaatcatgtaaaccttaaaaacagtccgtaaaaggagcctttttggaaaggtgagatcttgcctggccattcttcagaagttcagtttttttttcaaaacgtttttttttctgagagctccatcgatcttgcattcttgccttttcccaggagtcttaaaccataagcaaagatcagggacgaaaagaggaagaacacgctgtgatcagtccaacctaatgatcatttcatccactgcaaaaaatgaaatatctaacgctgtgtttagttcacccccaactatccttaacttccaactttccatcacatcacatcacatccaaaactttcctacagatataaacttttaacttttttttctaaacttctaacttttttcaggaactaaacgcatcctgaatatcatatatccaccttaaccctatctagactctctgctgcactgcaagatacagcttttgatcagctgatcgtttactgattttttttgtcagctgatcgtgtgtttgtaagaaatagaggggacacttagttgcgtacacggctcgttgcaaactcgcacgcccattctgctgatgctgggatgcgtcagagtcagcggagatcaaagaagcagaagcctccaggatggccaaaaaccggcgacgattccagcagtaattaaaccgtacgtcgcagcagccggctgctgctgctgcggcggcggcgacatcgtcgttggcgtcaaagtctactactatgtcccagcgatgatatgcatggcagcaacagctaaattatcttaatggcttagtgtcagcaagtcggcacatgagataacgtagttaacacaggagttcgccaatggcgatgaggtttctttggggcaggattagtaggcgggccattaggttaaaaactccatgtgctttctctgcaagcctaattaagaccggacagcaacatctcgtactatgtactatactatactagtagtaagtactagtatagagtactctgcacatctcgctggatgaacaggtgatagattcaacttgggaatcagctgcatttagcttagcttagcagctttagcctagtggattaggacttgggaagagggggggaattagtagtgggggttaggatttgatcctggaaaatcaagtggagaaagtgatgcttgcacttgttgacactgagattatggcatgattttttttattttttattttttttaaaaaaagatgaaagaaaagacatgctttttgcagttgcatgtgtgtatcactactgtatcgtcagacagcagcaggttatgggcagtgcacaagtatgtggactgtagcactagtgttttggccctgatcttgtacaaaggacgtgcattgcttttggccctttgcttgcctacttaactttgtagtacattgatgatgctttgttgtcatcgtgtcatgtctgtactgaaatgagcttttgcttgtgaagtgaattatcatgtgttcaaatgtggagcagtaacttactaaaagcagatgtcctgaatctttatatgtgtttttcttactgttaaatcaaacgggttactgttaaaatcgtgtctctctgctattcatccattttcttaatcctggtttcaaataattcatgcagtgccgttgactgttggatcgacggcaacacaagagagacagttagtgcacttccactagacgcacaaaagttgccagctgaattagtgcgcatacatactgctcaaatggatgactagtacagcagaggtagtattaacgaaaaataagatcatcttgaattcttgactgaatattatacgtagtgcttgtcaagactgaaaaattgtgaaaatggtttcggagattcgtcagagccctgaaaaattgtcaaatggttttggattggagccgtcgttctcgccgcatttcctccccccatctccaataattcaacgttgccttcgcttgcaggaccatggcggcggcgcaggcgcaatccatcgatcgatcggcgtcgctgaaacttgaaacctgcaattttctcgcgtttttttcttcagacgaacgggggaggcacacgtcgatcgatcgaaatgtctgcctttgtttgatggacttggctgcttgttgttgtacgttgaaaaataaatgcatttcgctgtgaagtattaagtatcggtctcattttttatggctggcatgcttgtatcatacttttcaatgatttttttgctgtcgcttttgtgccgattaatactagctactgctactatactctctgtccggttacaaaggtatatgtcattctgacgtcaaaataatggtctccaaaatgcaagttcggtcacctagtagctattttctgctgaagtatgtttcttttattaaaaataaaaaataaaacatagtaaacatatggttctggctggatcagacgaccagtgctcattgagaaaggcccaataggtcaggatagtaacaagcgatccaaccaacttaaggctaaacgaaacaaaaggaaaataagtctatatttcctctcataactcttgctcttggttgaatcgcatccctcaactataaaacccagtataatgtctcctctatctatcaaaaccggtgcaaatcgcctcctttagtggtttggaggcggtttcgtccggcgtggcagctgactggctgaatcattcggtcggacccacttgtcaatggcttccatctcatcccatcttctccctcacctatcccttctctctttcatctcattctcctctctcacggtctcacctcccataagcaacagcgcccaggtggcggcaggcgcaagggaggatctcgttggaaggtcgcgcgtgggggaggagctcgctggccggctacccgcgtgctggggagggaactcgtcgaccagccgtgcgcgggggaggatctcgccgggaggccacgtgctaggagtcatcggtcggccgcacgcaaggggaggatcccaccgggaggccgcgcactagaaggaatcatcggccggccgcgtgcaaggggaggatcccgccgggaggccgcgcgctaggaggagtcatcggtcggccacatgcgggggaggagctcgccaagaggccacgcacagggggaggatctcatcgggaggccacgtgctagaagaaggagttggtcggcctcacgtggtagaggaactcactggccagccacgtgctggggagggagctcgccggccggccacgcacagagggaggagctcccggtgggccatgaccagtgaaatgagtcactagccagatgcacgcggggggaggagctcgtcgtccagccatgtgtgccggaggagtccacggcgccatcgtgggaaaggttcctcacgtactaggcattgcagttcctctcgttctccgccagcgactgtggtcttcctgccgaagccattccctcacctctcctttgcaccccttacatcgcccctcccacctccgcctttgcctctatccctagaggcggcaccgaaaccttctccaactagacctcctgctcctgaccacgttgccaccaaccggttgacacgtgggacccacaagctgactcagccaatcaataaggtcaaatatgccacgtaggacgaaaccgactcccaaaccactaaagcaagcgatttgcaccggttttgattcaaacatgagcaaaagttaagggaggtatagtagacttccaaacaaagaaaacatggccgaaaaaaggctgaaatccacgcaagatcggcccagatgaacgggcctttttgtttccgtgtggcatttgttcgaatttttttcgtttttagatttttttttaatatttacagaaataatctatcgaccaaaaaaattgcagaaatagcccctgccgccctaatggtgggcggcaagctgacatggcagacggtgggtcgaccacgccgtctgccgccgtcggccaaaattgcgattaggcccttgccgcccaaagagcttgcggccgtactttttcatctgggtccctacccagatgaaaaaagtacggccaaaagatttttctatgttatgttaataataaataaagaagtatttattggtaaaacttgttaatattgttataaaaatgtattaaagttggttgttgcgcaatttcatatgttaagtgaggtattattttgtaccttattcgacgtattagtactcggataatttatataggcctatcgcagtctgggtcgtagaaacattatatagacttaaacaaggagaattatgtaacatgaagaaatagtagtacaatttgaacatgatacgactatttgcattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctacacaacacggctaggtggagttagaacccttctggtgtctatccattctctgtattgacatctccttggtggttcctgggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctatgccagtttggatcctcaacaccccggcgtctagccattgacgaaagccggtcagatttgtaatgaagcaagtggggaagagagtactgaatgtgattgagttctgaaagattgtgaggcctcactcgttaaggcgacttatataggcgcaaaaaatcgagtgatacccctgacatgtgaacgtggtggggtatggtgggtacgcctgattggcgccgaaagatacatgcatgatcggcgccgaaagttacattggtcgtatgcgctaaatggcgggcaaatactcgtatcacacgcgaataaaggaggctgcatcggtgcggcagaaagtagtcgtgcatgcgccgaaaggtatcgtgcacatataacaacaacgtagtcattacacaagcatacagtactggaaagtgaagcaagtaaacaaagagaagactgctctactggccctgccccgcgctgcgaccacgcttggtcctccgggcctgtgctcgcacgtggtcctgggagtaggtgaaacgatccggtggcacagcacgggtagcacgagtgtcccgcggaggagtggcctgcgcctggtcctgcgtctgcaccggcggtgcgcctcccagctgtgaggggccaatgacgtcctctgtcgagcctgaagcgaagtcaaaatcagtgatgtcgaagagcaaggtggaaggcagcaagcggtccgacgaggtcccagcatggtccagtggtggaccctgactcgacgtgccggctgcctgtgacgaagtcccggtgtactgccagaactgcgctgagtgcgaggttgacacagctgcctgagacgctgaccctgcagcctgggagaagtgggcggccttcgtcatagcaaactgggcgaaacctacacatcgacaacgggacccttgtaagctaagacataaaatgtatgtaaattgattgttgaagtaatgttgtttttttaagtacctgtggggggcacaacagaaggcctagccgaggaaggcggggtgctgaacggtgcacgaaaccctgaagcaatcggcaagtgaaacggctcacttatatgtgcgaggcatgtacaaaaatagtaataaaaatacttacctctgtgcggagggggagtcggcctaggaacgtgcgcagctggacggggaccagtcggtacgggtggccgctgtacagctgcgtctgcccgagcaatgtcgtctgcacgacaggtgagcactcggagaatcgagcgcatcgactccaccatccgcgtgtacgtcgtcaggtgctcctctacgggtaccggaatccccgcgcctaaacgttggatcgtcgttgaaccgtcaacgacgacccggttgatgtcgtcgacctgcatgattaatttgttcgtaaatattcgtaaaatttgacgaagagaaagacatgaaaacataaaggaatggtgcgatgcagggtactcacagcacgagcgaagtcctggtcgcggtgcctggcatagaggtctctagtgctcgcaacgtggggctgctgctccaagggagcgaaggtgaccctagtacgggtgcgtggctggtaccagcgtaggtaggcctggtacgactcctcagtgtgtggctctccctcgtggtccacgacctcctcagttgcgagcaaccagtcctcaacaaaagttgccaacttggcgggccagtcaccagctgactgctgacccttgcgcgagtacctgcgaattaatgtgtaatattagtgtgaaacgacagatgttacaaattattgtgaacaggcagattttaatgcaacaacggaaagcgtagtgcaagatcttaccggtgaacagcagctgggacgatggtcggaaacagtactggaaagggctgacggaagccgaactgccgcatcacgcggaaaggggcgtgaggctcaacgcagatgtcgaagaccatcggaaccgtagtcatccagtacgcttggtccctggtgcagagtgtggacagacccaacggcgcacgagcctgggtagccgcggcactgtagggctcccacacgacgtcagtcggcagaaggcggtcgaactccataacaaactcaggatacgaccgcctaacttggacgtgagcccatcggcgctgcaatacgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcacggtacagagccgccaacaatgcggaaccccagctccactgagtcacctcgcctaccgcggcgtcggcgatgctcctggcgtagtgcacgagtcccttgtcgaccgcgtgcccgtgaccgccacagaacatcacccagccaaaaagccagagcaagtacgcctccaaacatcggctgtaggagtactcgtcggcctccgcctgtagctgctcaacctgcaagccgtcgataaaatgttaggcaccttaactgcggattaaatatgtaatacgattgtcatttcggtacaaaaacactcacggtgaactgaagcagccacctcttcgtaggtccggtgttgcggtggtgtgccaacggctcgagcaggaggtgcggtgcgcgctatactagtgcgaaacgtgccgtcagatcgtcctgccagtccacagccgtggtcactggcccaacagcgtctcccgcgagcggtagccccaacaagtacgatacgtcctgtagggtaggggctacctcaccgcacggcaagtgaaaagtgtgcgtctctggcctccatcgatcgaccaaagctgctaggagggacctgtccacagtccattgtctggccgggtccgcgtcgccggccgcagcctccaccagccgacacatcggtaggaggccggcctcacgtagcctgcaataacaaattaatatgtcattataaaaattattacagtgcaactaacttatagtaaaacactgttcgtacctctcgacaaaggagtcgtgaaccgtgagtagctcaccacacgtccgtgcccggaacgtcccaagctgagccccctgcaccgcagtaaggtgagaccggtgtcggtgatctatcgccgggtccaacaactgaggtgtatcctgacatgccatctctgaaaaatatagtgtttcgtgttagaacaattcaaaaaatagtaatgtaaaacaaaagataacttgcaaaattatgaaatagtaataaaatcatgagattaattatgtacaacaagagtacatgctatttaaatatagcaaacgttactaatggtacataacgatgacgtgcaatttaacatatatgtagagttcaataatataacataacattacgtgtcgaagtccgacaaacatcagcatacctaaagacgttaggcgccttagtccgacgttacatcacgagacctaaagacatgacatgccgaagtctgacattacacgacgaaacataaacacatcgataagttcgaaatgaattacaagcaaatccacatgccgacatagaacataagaactacaccacgtagccagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttgtaggtgtgcccatgttcatcgcatttgctgcaacgcttcaccttgctagcctccgtctcgtccatatcattgtggatgcgacgagtcctcctccttccagccttgcctcggagcttcgatgggtcaggaatattgagtacttcatcgttagtctctgtgaactccccagctatgccgaacccataaatcttgccgctccatgtatgatatattgcttgcttactgaagtactgtgacatatatactgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacatgtgctgttgggtaccttgcactacagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggtcgatggagccgctgcacgctgatcactacatttggctgtcaactcatctaatctcttccaaagctcattgaattttttctcctggttctgattgcacagcctcttgaacatgttcttgagctccttgttcttgaattgcttgaagaaattcgctcccatatgacgcatgcaccacctactctgtacatcttcccaaacaccggggtatcctcgttccatactcccaaactgcaactcttctatcgctcgcagaatgccagcgtgcctatcatgtatcaggcacacatttggcctcataccaacaacttttgttttaaccaatttcaggaac

SEQ ID NO: 67549 - DNA, 4076 bp, Oryza sativa
cacctggatccttcgggtgaacaaacggaaccaaagctagaggccacccgcgttgcaatgcattttccaaataccatctccacactcgagagttttgaactggcattagttcccaaaaaaaacctcagttgcctgacttactatacattgattgttatgtcacttgtctgtggatcaactctcaagcccctcattaaccatccttttatagaaggtacactcctctcagccagtctatcaattcctctttctgatacaataaaatctaacagatctaccccagttggcccgtaacggacgtttcctagtccatggtaaacttggaatatttgtttgttcgacatatctgtcaacgaaataactagatcatattactctttcatgcaataaacatctacaacgtaatatcttcttgtgtaagccaatgcaacggtaatgtattgattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcaggacttcgccccttcttctcttctcctcccctctcttatttttttttcactggaattgaggagagaagaatgagggctgggggctgggcagcaggccttttataggcagggaggcctgccgcccggccagagggcggcaaggggccgcctgcaaaatagccggccccgactggcttttttgcattcgggccccttgccgccccaccagagggcggcaagggttttcctgcaaaaaaccctccctccgtcactgcccgttcctcccccgtttgccacgtcagcttgccgccccagaggtgggcggcagggtatatttttgtaatttttttggccgatagattatttctgtaaatatttttttaaaaaaaaatctaaaaccaaaaaaaattccatttgttcagtgtaggggatatcaagaacaaagagcgtcaataattgagacctcaaatactaaaccaatgtcaatactacacatttagaaacgccaaacccagttcagaaccagcaaatacctcaattagccaaaatcaccaaccacccagttcccagatgccattttgagtgtgccacttcgggtttgcaattttcagttatcaatcaacagaaatatttccctgcaccactgaggttcattgttaaacactgcaattgttatggcatcctacttgcatgactatttccttatatctagtagataagcaacatgtatatcatgtgagtgttttcacgacttcctaactgttaatcggattaattatccgcaccgctcgtaatttatacaatcatccctatagaatgatagattcatacttaaacacaccttattcataaaactatttttttctcctcgaattgcttcccaaccctatttatatttcagtaaatactgtgtacaatgctgcatcttttttctcaatccctcttaaccgtgctttttgttgagctatgagattttggagaatactaaaacaagccaaaagaaaagtacaacttgtaagattgaagacgtcaatggttgtggtctaaccagttgtcggtgatatgggcccgggggtatcacgtctagagggaggaggccgccctcaaacccacgtggctccccgcgaggggggatcaagcccggggtggagcggtggctaccccctcccagctagagggaggaggccgccctcaaacccatgtggctctccccgaggggggtcgaacccggggtgttgtgcggctgccccctcccagcttggggtcgggccgcccccaaacccacgtggctccccccgaggggggtcgagcccggggtggcgcggcggctgcccccccaagctagagggaggagccgccctcgcttggggtcgagctgccccgaccccctccacgtatcagcccacgtgtatagggttaggtgggcgcgcctaacgcccacctaactgcatttaaagcggtctatgcaaccgcgccaatccgcatttaatgcggcgtgctgcgcatctgaccggtctgtgacggttgaatgaccgatgggacggcgactgtgtacccgcgccctatcagtgtgtcaggcggcgagtggcgtgctctgtcccgtcccatcataatgatgaggggcttcacagcctcttaccccggttagagctggtccaaccactctgaactgacccgagttccccttttttggtgtgaacgagaacccagaagtcctcatccattaaatagcgaatgacaaggatgccctgcatgatttgatgggccccgcgcagcaaccgatgtgtagatagcttctgggctaaggcacaagacatgtaattattatagagaatattttcccttctctctaggtagcactcgcagcacatgtggtatccccttagagtataaaaggaggaccatgcctagcaaggaagtgggatcggaccgaggatccctgagccaaagcttgtctaaccctagcttgcataccagggactttctaagcacagaagaatcatacacacatgagtagggtattacgcttcatagcggcccgaacctgtataaacctcttttgtctcatcgtcttggaggagcctccgagatcaagatcacacatagtttcgctcaccaaatcctcgaatctcacccgctgcccccggccgaactctcaaaggggggcctcacagcctcccgctagagagggtcacccctcgacaccagtgtagatgcaccggtcagatcggacggtcaaaccgctcgatgacatccgatctaactggtgcagtcactccggtctgaccgcccgatgcgcctgttgcagttgccggtcaaactggcgggcacggttagaccaccgtgtgcccgccagtttgacgccacgttgcagtcggtctaaccacaagtatcatgcatgttagaccgtcgtactcgagcaaacataaatcgaagattctcaaaatagattaaactttattacttatctctgtgtttacaaagtgtaacaatagcacttctcatgaaaatcttgactaaactcaaaaccctaacttttctcactctctaaaaaggataccgcaagacacaccctccctctctatttataactgaggtaggtagcctaaagtcacgaaccaaccttgtacaagaagtcctaatcatataggaaacctttccgaaaaagaaacaaactttacaaactccaaatgtaccaaatttggactccttccaaattcgactccgtatctcatacgcacacaatatctacatcgtatgccatatgaaatcttcaccaaccacgtgcaatgatgtttagccaaagtattccacatgatatcctgatcgttcgaatgtcttattttcccaagttgactcccgatccatcaccggcaacactctcttgaggcaagaccacctacacatgcatcaaccaagaaaccatatccgagcacaagttctcaccaacttgactcatttgttagcaaacaacagtattacatacgcatagtatccatctagaagttataaacataaattatccacgactcagcgtcggccagtaagaccgcgggctggtcggtttgaccgctcgcataacaccggtctgactagccttacccagccgatctgaccgcaaccgtcagacttgtcaatcctgtccatcacctgtaaatcaatcatctccaaaaccacttcgccaataatatctcaacatcaaaaccaataatctcatatgccaattattcatcacgaaacaataatcaaacacactttgattttacacacacacacatacatatatacatacatacatacatacatatatatatacatatatatatatatatatatacatatgtatatatacatatatatatataggatacccatatgggactccatggtgcccgggctccaaggtataaaacacacaaattctctcaaatttttaaaaatttacaaattgtaagtagtatctaggta

SEQ ID NO: 67550 - DNA, 983 bp, Oryza sativa
tgaaattggaaataatatcttgtaaatatggaaacttacttgcttcacgttggggtctgaataaatggtaacattattgtgaaaaatggaaactaagtatatggaaaaataaattaattttttggaaaaatggaaagtaagtatatgtgaaaatgggaactaagtatgtaacactaaatactgattgttggtttttggaaacatggaaacaaattagttggaaatttattatatatatcgcagcaaatttattatattcaaatgtatttggaaacatggtaatatcgcaacaaatttatatggtaatgtatccgtaccaaattattacattcatgactccattaatttagcaatttgagtaacaaaatatgcactacgagtcactttctatttttaggtacgaatgggtcgtatactcaaaaatttggtatgaaacggggaaaaaaatcccatgcaatgaaaaaatttcgattttagtctatgttaattttatggcaaaaaaaactaggtattagaagtacatttttttgtaattatatgatgtacggagatgatatatactcaaaaattaatcgtagtatgtgaaaaaaacttatgtacagttgtgcatcacgccgcctagcccttcgatttaatatatcttggatacttgaaaaatctagtatatactatctaaaatatcagcatataccggagaaaaaataagtacaatataaccggtaaacagaattgatttaggtatatacccattaaaaattgcatatttcggacacccatttttagttaggtatatacctatctaaatgggcgtgaaaaaaatttgactttcaagtagcttacattttttttcttgaactaaatttgaaactagccaggccttttagttaagttttttttatactctcgctaggtagctgaccagatgtaattaggtacatgtagatgtatgtatataagtctcgtgtgttgtgctttttaatttt

SEQ ID NO: 67551 - DNA, 793 bp, Oryza sativa
tctccgcccggttaatcatttcccaccatttcctttctctcccggcgccggtggatcgagctgcagtttctttttggttcttggcacctactaggctactaccattgttgctgttgtccggtgtacatccacaacttctttgcctgcctgctgttccttttagtttctccaagctcctgccaacagcagcacagcctgtgtgtcaccactcaccagggaggaggccccactcctcctgtcttgttgctcactcactctgctggcagcttcccctaggttgtcctttgcttgccctgggtttggttcttgggtccatccatcttcagagttttcctttttgctgaatcctttgatctcggatggatgatggccggttcttgataagccttgctgcaggttctcctcccgagaagatgtggtaacatttcttggcttcttgcgttttggattggaggcaagattgcttgtgaggatcttggttagcctgaaacttcgtttgctgttcagaattcggggggctttgttggttcttggcctcttgcctgttggttgggtttgaaggaggctgaagagagtttgccaatggagccaccaagtgggttctgggcctccctggggagcttcctcaagttcttgccctacttctgcggcctcctcatcctgggggtcatcaaaggtggcttgctggtcttctgtctctgtccattttggtaatttttgaactgattccatgtgtgttaagtctcatttgggaataattgtgtgtgtgtgttttgggggggggggggggggg

SEQ ID NO: 67552 - DNA, 1283 bp, Oryza sativa
ttccacgaaacaagtaacaacatctccggtgtgatctgatctgttcatttgatttgatcgtatacacgcacttgcatatcgcgtctccttgtgtgggggcgagtggcttaggaaggacgctgtccggcttgacacgtcggcgattttcctagctggctgaaggaggtaaaggtaaaagcacctttgagagaatgttcctcgttcgtgtcaaacagtcaggtacgcccctcaccacatgcacgaaagttgttaacaccacaactagcaagagcgacagatgcaaccaaaatatatgggggtgtgcctgattttgtgtttaggcggtgttcttccctcaccttttccaactatctctatcgtttttcacacacatatttaccaaactactgagggccgctttgaatcgcagaaatggaaaaacgcaggaatagaaaaaatacaggattctgataggaatgcagatgtaaaatagaggaaaatacaggaaaaacataagaatgaccgtttgattggaccacaggaaaaacgcaggaatcggatgagagagatagactcaaataaatttttccaagaggttggacctcttgctaactttcctccaaaatctctgtaggattacacattccataggaattttaaaagatagtataggattcaatcctaatcctttgtttcaaaggctttcataggaatttttttcatagaattgaagtccttcaaatttcctacatttttcttacaaattaaaggggccctaaacggtacgtattttataaaaagttatatcgaaaagttgattaaaatagcatattaatccatttcgtccgggccgtcagtaaagcctccctcttcctagtccatttcgtccttcgcatattctgaaaccgaacagaatatatgcacattttcacatgctctgcttgcacattttgaccgaccaaaaagtttgcattgttgttttgaattatcaacattgataactgatatgtgtatactgcactattattgttgttcaaagtgagatcacaactagtaaacggtacgtattttataaaaagttatattggaaagttgattaaaatattatattaatccatttcgtccaggccgtcgataaagcctccctcttcctagtccatttcgtccttcgcatattctgaaaccgaacagaatatatgcacattttcacatgatctgctcgcacattttgacccaccaaaaagtttgcattgttgttttgaattatcaacattgataactgatatgtgtatactgcactatta

SEQ ID NO: 67553 - DNA, 1992 bp, Oryza sativa
gctcgctttctcgcaaagaacaccatactttgtggagtctcagttgctctatattagcagaaggcaaagcctttttcccgcgctttattaaccaggccagatcgagttcgtgtcacatggtcttaaactcttcaatcttagtacatcaaaccagacacactgtttaaccatcagctcatcatcaccttactcatgagaagaactaatccagagatacggggtaaatcaaacgcccaatgtttcggaagctgcagaggagaagaagtagagagtactatcgctcagattctttggtgctggttcgtcactgcgtcttcttcctggcgtccttggccatgcccctcttgcggatgccgacggacatgttgaggaggagcctgtccacgatgggctccgggaacgcggagatgaggaaccacagcaccgcgtgcggccagtagggcgtgcacctcggctcgtacccgatgtagcgcacggcggcgcgggcgtacgtctccggcgacggcgcgaagaaggacgccttcttgatggacgccatcttcgtcgccgcgtacaggggtacctgattatgagttgcgcataaaaaaaaaaaccatccaagtcagtcggtgctcgtttctatgaaaattaacttagggcacccaaaaaaaaccattaacgcgtaattaattgaattgaagatggatttatatgatattttaaatcaacttatacatatagaaagttttcataaaatgcacaatagtttaaaaaacgttctaacaaaaactaagataaaatatgtatcttaattagaaaagaaagagacaaagattctgatgcggcagctaagacaatcttgataaacgccgaacagctgacacacataaatggtgccagataacgacgttcccaacagcgacagcgaggatgtaagtaatggaaaatgaaaaacaggtagaggtcggccaacagatttgttttaaatagggctatatggaattctcctatcctcctaatgcttcgctgcatgttatgcccattaattttccacatgcactgtttgcctgccttaggagcagttggaagaattgaaagcacggtagaagtgcatttagctttcagccatgaaggtttcagtttcttgttggggcgttatgtcatcatcgccatggccatccagcagatcgcggaagtacccaatgtagtacaagttttttttttttaggacagcatggcaaaaccatgttcatgttgaaaggacatttcttggattactgtataattcaggtgatcactgaccatataaaaacttctactccatagcccataaacaaaaatgtaatgattgcaataacggcttcgtgcaacatatgaaaaaaaaaatggatagcagacaaccgggaacaattagagaaattcatgcatcgtcaggaatggctatttcgtacctggcattgcacatcgatgcctttgttcttgtactcaacatagaggcatctcgagaattgatcaacatacctgaaaagattgaaaacagagttgcatgaatcacttaagcccacatatgaccctatgttgagttgaattcagttatatccagttgtagctggatgtcacacaattgtgctgcggaaaatatctatgcaaagattaaccaatgaccacatcacaaagcatgaattccacattccactagtgaaacatataaaaagcgtgcaagaaagagaaccttgtggatagctaaatatatgtgttgcttgccaaagtaaaacattaaacaacataaacatgctgtcgtatacattatcaaacacagagcaaatgatcaagcaactacgttttgagttcaattttcacaaaactgctggaatacttgaatatggccctgtttagttcccagaaactttttcccaaaaacatcacatcaaatctttggacacatgcatggagtattaaatataaataaattaaaaaactaattgcacacttaggggagaaatcgcgagacga

SEQ ID NO: 67554 - DNA, 1617 bp, Oryza sativa
ggcccaccccggccagcgccagcgcccacgccggctgcgcggacagcgcgtccatttctggagacggggcgggcagcggcggagaccgcggcgaaggcggcggcggcggcggcggcgaggagagtggcgagcgtgtgcgagttgcgatggaggcaagcgcgatccgttcaactgcagatataatagcgcgggcggggagagagagaggaggggacggatggggggcgggccgggctggcaagcggcctgcatcgccgggggagagttgggtggggttggcgtgccacctcggctggatgaacacgccaccgtggaacggctcaagaaaaatattttttaaaaaaaaaggtaaaaacgcataggcttcatcctaccgctatgaatttctctgaaagactttgccattaaggttcataaagtcattctatcgcatctctgaaaaactaagtcgatatatattaagattcacaaagttatatgaacgtctcgttgccaacaagtatgttgcctatcactaaaaaatagttagtcgtaaatacgagcacatatgttaagtctaagacttaaacccgtgtggaccacaaggaagctaaccaattgagttatgctcactttgtgactaaagaaaaatatgggtgagaaactgggaaccaaggaacttaaaaagtacaggcatggttgatagcaactgtgatagccgctcgtgaatcatggtaatggagttgatttccatttaaaagaaattaaattaagttaccatttcatctataacggttagattaatatgcttagtgatgaaaccatcggagaggggtttatttaataaatggtttttataaccctatggagaacatgcgaattcaattatattttttacactctccaatgattctataaccctacaatttttacagaggataaattcatttcgtacggaggagaacaactgcttgctctaaagtctaaactctgcagccatgagcaccttgcctcaccttcaccttgggtgcacgtaccgttcaatttcggtgccaacggcacattaggtgccatgaacacattaggttgcatgtatggttcaccggaggcgtggtgaaccgggaccagcaggggttgggccgttgggcggacaggtggtgcagttatggttgttgaggtttgatgagctgaagtaaatggtgtggtcaaagtcccacacagatgacgggcacggcaggatattaaaagcccccccgcctgatttctactcctctcctcgcacaccacacaatcaaccatcgcacatcgcagcgcacacaaaacgcaccgcacgcacgcgagctcagcttcttttcgtgcgaacaaaacgggagctcgctgttggtgaggtgaagcgcgtactcgcttcgttattgtggttagctgtcgctggacgatcggttgctcgcccaccaccacccgctcaccaccatcacggttgcatcacctcaccgcaggtagtatagtacccatcactggagcagtggcgccatgggccaccgtacaaaggtacaagatggacgtttcgacctaagaacagtagcacgagcgtatggggagaaaacttgatcgatatactctttttttttttctggaaca

SEQ ID NO: 67555 - DNA, 1681 bp, Oryza sativa
aaaagtgtgaatatgggaattagtgatatatggttttaattgttaactgtgtgtaacaaattatcagccaagagttcctctgagtaaacaaagtatatgtactttgtcggaacaacttcaaacaaatttagaacaaaaaaaatgttgattacaacatcaccattggagtcctttgagaatcagaaagaccgagcataacccgaatttgctctatccgagcacgcttctcttttcttcgcaagttcttacgttcaccctttattagcgatacagcagtggacatatcgacattcttctcggcatcttcatcagactatgaaaacagttttaggattacagattaataaccacacagtatgattgagaggaaatgaaagatacacaatagctataaatctcagaaggatgccatgagaaccatggacttcatattaacgtatacagtatccgtaatagaagatgaaccatcatgcagtattttggtcaaacaccaagattcaactagaaacaaacaggccagagacaggatgtttggtttgtggcagaattgtgggacacatcaagtcaacattatcttccccattttcttaaaaaacattttttgaaaatctgttctaatttgtagagaaaatgtaaacgtgcctaaatcagatataaagtcctcgcccacgcgaacttagaaagattctatctagtacagccattaatcatgaacttagcaagatataaatcccaaaaatgtgtgaccaaacctaaaataattttgcatacctcttcatcatcttcatcggtctgattagcgtcatcctcgctatcattctcattatcatcatcatcatcatcttcatcatcctcatcttcagaaatttctagccattcagattcagatgcctgcataagaaaggtgagtaaggcaagttcagaaaccaatgtgaatagtaaaaaatgataacagataattttctgttatctctgattgaaataaacaacactatcagttaaacaacaaaatggcaaaaagaaggggccaatctgcaactgaccggtatgatacacttccactcatctagtttgctaaggttaagtgaatacatatcatcaagagtaatttctctatctttcaattccatcattcctccatataaatagagtgtatctttccctacagccaagcatgcattgatccgaccaccgggtttcactgcctgtaagcagcaaatgctaatgagaaacaaaagatcattagaatgtaaatgtcaacatctaaaagaacagctgcaatacctctgggagtacttcttgtgttgtcgaatcagagagaatatcagagctattgcctgagccagctttatttaaggttagactcttggtcaagtgattcgaaaccccatggacttcggattgccctccagtagtttctgagtcctccatgatctcatcctcctcattaccaagattatcttccacattgttcgatggttcttttcttttgatgtcctttgtctacacatggcacccaaaaaaaaaaaaagaagcacaaactgcttttaagcaatgatccaaatattactatataatagtcaatgtgaatatgtcgacagatcgcatatgcttattaagaaaataacagtataatagtatatgagaatatgtacatatcgtatatgcttattaaaaagaa

SEQ ID NO: 67556 - DNA, 846 bp, Oryza sativa
agaacagctcccactacggcaaatggccagagaagaatagcaagacctgcgaacggcacacaagctgtctccagaaaaggtccctctctcccaatcatatcctgaatcagtcgtttccatcctttgaaaagcatcacagggcatttgtagatggcaatcagcgtgaacattataccatccagtatgagtccacatgcagcagataataaagcaccaggaatatcgagcaatctgtaagacaaatgttcctcattttatatatcataattcctcacacaacaaaaatattattcataaaaatgccacctacatgtatagcatcatgtttccctgaaaatggcatagcatttggggatactttcaccttaaaagcttagaggaatgtctgaaatgcttttttggctttgggaatgttatcttaagtcaagtagaaagagtgttacttgcatattaagcttaggtccataagataaggaggaaagaggaggaggaaagatgatccagaaaggttggcgattatgagttgtgatggtaaaatactaaacaagaaccggaagcataccttatctcatatggcttgttatcaggaggtgcctgaagacgaagatcgtccataatagaaaaataggagtggaaaagcaggtctttcacgtccctgactatcgtacagctcccagtgatagtactccacgttccatcctgcaatttgagataattagcacatgaaaaataaaagtttgtaaaaatgaacatggagaaagaaaaattctaccacaaaacaatgaacaaacggcttttcttttccttttccaaccgcaccaaatgttgccattatcggtgctagaa

SEQ ID NO: 67557 - DNA, 1119 bp, Oryza sativa
tgtaaaacaaaatctatacacatccacaccaaacactgtacctaaccaatcatcttcacatcctcaagttttcatctactcctcgtcgtctctaacgaacatgtatctcacatgggtctgtgaatcggtgagagtctgaacaccgcaccgcacgtacgcctcgcatgggatcggtcgaccagatgagcaggcaagatcgtcgccgcgcacatgcgacggggaatctcaatccaaggcgagggttttgcatgtgggttccgaggctgcgtggcaccgggagaggcaggcttaattagcttcagaaaaatggagagattcccaggcgatcaggacaagaggttaagcattctcccttagttatatcctgcacacgttcgtctagcatctgggtgaagttctccggagctaatcagggatcaggagatggtaacttcatgattagatgactcagcatctaatgtcggctagctaacttcataattaggacttgtcatcaatttgatgactcagcatggagtcttaattatctttaggatacagattggttatagttttatccttctctataaactgtttttctttttagatcggagtttggcacattaaccaaattaatccaaaaattttgctcatacattcaaatcagtaaatgtttcacatgtagtgaactaaattttttttttattagaaccaataattttgacaagttcggaattatttaatccataatcatgggcaaacatataaaatgtacttctgaaagagtagtaggtagatgaaatgttgtattggaaatttaagtttttctgaatgccccttgatttttttttccatttatatttctacttgaataagagcgagaaatattttctgtttatcaaatggtgatacatagtgcaatatggtcaaaacatggtgttgtattttttaatacaaatccctaggaaagaaaaggagtctaatccaccaatcattttacgctttttttatccaattagtttatatttgttctagaaaagaaaagtatggatagagatgattttctattgtgtgaaacactttgattaagcatattttcgtctcttttttggtgtcaatgactaattatggggtgcagga

SEQ ID NO: 67558 - DNA, 1709 bp, Oryza sativa
atactcctccgtttcaaaattagtacaattttacaccgtttgtctaatttaattttttttataattagtattttatttattattattattattagataataaaacatgattagtattttatatgattaatttttttatatataaatttttaaataagacggacgacacgtgtaaccacggctaggatggagatagtacttattaacacatggttcccacagatacatttttttcaagtgctacattaacgccatgtggtataaaaactcagtcaaacaaaacacttaggctgtgtttagtttagtgcaaagtttggattttggttgaaattaaagataatgtgactgaaaagttatgtgtgtatgacaagttgatgtgatggaaaaggactgaagtttggatccaaattttggatctaaacacagccttagacgtgttgttagcaacatctaaatcaatccgggttgcaccagtttaaagagatggacttgaatgtggcatttcggttcaagttcaaaagtcagactctgggtaaaatcgagggacgtaaaataaactgcattatctcatcatgtaggttgttaagctctactgaattgattattttgttggtgaaacgaaaatgtgatgttggtcaaagaaagtagagaatctgatgcagatcgacggagcatacgttgcaatgatacaaacaaatatgaagttaacgatggtcgaggttaaaatgtacaatgaaagagtgtagattctaagtacgaactatcttcgatggctgtgaagctatgtatctgtggagctttatatcgaaaacaactccaatcggcaatagcactatagcagaaaaggtgatttcgatggctagaaaaggtaggtttctagtccaatgtggcatgtgctgttcttgctatggacttctccttgccgcaaatgacctcactttctatttcaggccctgcaaaaacagttaatcagacatgaatatttaaggaagacattaaaatttctctattttgctatattcttgcttctaaagttttgtatggactagaatggatcgaaaaaggtagattaagcccaattactttgttttgtcatttacttcaagacccttcactgtacatagaaaacacataataccagggaccaccactgtacataattatggaccagcaagttcgtcactttcaggataatgtaggacaaatataacacagtaggaaaaacagaacaagaaaaaccttgaacagaactaagaaaacagtgacaaatgtgaagattaacggcacagtttttttgaaaaccagagctaattagagctaaaatgtgacatacaggtaaagcaacaatcatagaacatcaaaacagaagattcagcatgatataatcactagacactttaacagacctgtagtaggctgtaccaagttttccaccttccagtcctaccaggcctcccgccttgagagttctcttactgaccctataataccttgcatcaacttcttcatattgaaaatcctcatcagaaaagtcatcacacaacacatcaaaaacactatcaaccagcactccagaactgtactcaaactcatcatcggagctaaaattggtaaaatcatctaccattgctgcaaaagcggtaaaatgtggttaattttcatgcaaccgataataatgtgtaataaaaacagtgaccacattagatagcc

SEQ ID NO: 67559 - DNA, 3055 bp, Oryza sativa
caataagggattcaaatagttatggcttgagaccagggcaagatcatatcaatctcttgaaaaaaaaaggagaaacagcacaacgaatcaactatacgtcacatccacctaacaatacaagattcccccaattgtgtggcaggggatcagatccgaatagacaatcacatgatcaatagctgcacaacgaattaacaagtatacgccaaatccacctaacaacaagatacaccaatcatagcaggggatcagatccgcataggtaatcacttgatcaatagcagcacaacgaattaacaagtgaacgtcaaaacaacctaacaagaagaatcaccaggggatcagatccgaatagacgaagaaatggcaaaaatataacatacgaagggcgtgccgctggcgcaacaggtgagggcgcctctggagaaggagccgcaggtgagggcgccttggaagaaggagccgccgttgcggtcgccttgggagcgggaccagccggtgcagtcgccttgggagcgggacccgccgctgcgggcgccttgcgagcgggaccagccggtgcggtcgccttgggagcgggacccgccgcagcgggcgccttgggagcgggagccgccggcgactgagacatcacgccgatcggggaggtggccgtggcctaggcggtggcggtggcggcgcaagtgctcggcgaaatcgtgattttggcggagaagaagagatcggagaggctgtatcgctcatttataccagcgtgtcgaggataatgtgctgcggctaaatgttcgtgtttcgcaaggaaatccggcaccagcacgttgaggctaatggtctgtgtccaattgttcgtgttttggaacatccagtaatttttatggttctgatcgggctagtgggccagaaatgtgagaggtagaaataatcgaatttcatcaaaaaaaaggccatccgaatcacagaagtgagaaaaccaggagtactttttagctaaaacacagaggggaaatgcgccgtgagggatgtgtcgaaacaatactgctgctactaaatggtacggaagaatcgtaagagtaaaaagaattgaagaaaacgttcgaaaaaactaataggctggaagacattaaaacacaaatggaattaaccaaaggataaaacatcgacaaagaaaaacaaacataaacaaaaaaaaggtaagacaatgatgaaaatattttaccggttgttagatcccagatctgaagaaacgacccgtcacgaacccacggatccgacgggaccggacggatccaacggctggcggaccggatcaaatcaaacagcttgacaagaataccggggcgccgccagtggctggattggtagactcgggccttcgccgcacaagccaacccagccaggagaacgattgctgctacggccggcggcgtgggacacggccaccgttgatgcaggccacagatagcatgtcgccaagacacaccatgggaggtggccgccgtcgtaaatcaaccggtcacacatgcgcctgcctcagtcgtcgcagtcagaggccaggctcaagctggcaccatggaacggctgtagagaccaacaccgtccctcgactgtacaggccggccaaagagactcctccggcgaggccaggtacgaggccatatgtcagagacctcgccaagggctaaagccggcaacttgccggccggctgcagagaccaaggccagacgtccctccactatagaggacgggcacagagacatccctgccgagaccaaggccgtcctctgcagtcacagatacatcaccgccggcgaggcagggtgaggaggccataggtcggcagcaggcgccgaaaccaggccgccggcgaccggcgagagaagttcctgtatgagattgggtgggagacaaatgaatgagatggaaagaggcggccaggggtggagaggaaaccccccctcttgttatatagcggtgagatcccacgcgggcggagaaacctaggttcacacgaaaagcctgccactacctttacgcgtcaacaggaccctacctgtcatcctgcgtcagagtaaaaaacgggtggccattcaaacctttccaattttgcgccgtcgaaagaggtgcgatgctaaccgcaccgcccggtgacgggacgcctccgcaaccaccagtcgacacgcaattaactaccccaccacataacgcctcccccacacagggtcaccgtgcagtggggccacgagcgctaaagataaacgtggtggggcccgcttgggagggtggtggggaaagcgaaaacgagagatctgggaactctacaccacccacccgacacgggaatcccacctgcgtttatcttttcagttttttattagtagatttttatttatgtagtagtacttctctctgacgctctggtcctagctgtcaattgagagcaagtttaattcggaccactagcttcaaattatctatagtcaatttaataactaatttatacaatagttacatattacactattgataattagtctcaccagtcctacacacattacgtcttgaagtccatgctacagctgactataaatctgtagcctgatatttttctctctcctcttttatctctttaaaatatgtttattgctggtttatagcttgctactcttgctatggtagatgctgtgaaacatagtacttctacagtaataaaaaaaaaggagccccccgagactggctcacacagccagctgcagatggaccaatcagctgtagtagtaaaaaaaatttaactcgccgcggtgaaacggacgggtcggttgggttgtcacttgtcgcgccttttgaacctttgaaatggcctagcgcgacgtctcgtgtgctttgctggaaaagacggcaagggcggcagctttgccgggcacgcccgtcaccttcccctggatttttcacattttggtccttttaaaaaacttatttcgtaaatagatccctagaaaaacttatcccaaaaatggtcatttttggggcgccagagtggctggtgtcgtcggacgg

SEQ ID NO: 67560 - DNA, 2807 bp, Oryza sativa
attcctgcagcccccgtttgagtttattttttatacggttggttcctatgttctcctaagtgtgaaaaaaatatcaaaaaaataaaataaaaataaaaaaattgcatctctatgtactgtttaacttatatatgtcatttcatgtggttatattttgaattagattaagtaatttcatatagtggtagagtgcattatgtttaacatgctgatcaaagggttttactaaagaaattatggtctaattttagtgaaggtgcaaagtagactaagtggtatgctagctattttcagacttagctaagtggtagttcgagtttaaattttttttgtggttggttgtatcgtgatcctgagtgtgaaaaaaatccgaaaaaataaaataaaaatgacaccgttgcaactccatacagaaaaacagaaatggaggcggcagcgcagccatgctggcgccctcctcccttgggcggcgccagcatggctggcgccctcctcctgccacatcggttcgcgtgcgccacggtggcagaaggacggcgcctctcgttggatgacggcgccagccactctagcaccccaaaaagaaccatttctgggataagttttttcaggagtctatttgcgaaataaatttttcaaaatgaccaaaatgtgaaaaatccagtcaccttccccactttgaaaaaagaggagtagtagcttgctgattggtgttttacatttaggtaaaaaaaataaaaatcgttgattatgccgatcttctactgctgcctaatttgggtacattgttttaagaaaaaaattaaggcgcctgcttggctgtgttttgacacgtcgttgttgcctagctagcctgtctcccatgtgtgtcgccgacgtgttggacccacccgcatttacggacccacatgggtaacgtgaggccgtgataaactgggcaccacaaaggcacaaaccgaccggaccaaacaaatgtgactcgcacggtcgcaccacaaaccgaccggaccacaaaatgtggcccgcacggtcgcaccacaaaccgacggattcgcctcctcctcccccgtccgagagttgtggttggattggaccgaaggaccaaacacgatcaagcacggtatacatttttttttgtgcgaatttattccctcacgacttttttagtgaatgaccaccctgtcatatatgtttccatgagacactgtacgctcgtggacaacgctgcgaccgatagaagttcttcagctcgatgcctcgatacctctctaacacgtgaatgctatattttcatagtatattggtagtgttatttattttcatacaccaaatgtttccatgcttaattgctgatattaaaagttgccaggttctgaaaatcacgtcacacccaattatcgatttccatatgtgctaactccatacgagtaaatcccaattactcgtatcgatttccttatgtgctccagctgtagtatatacttccaaagttccaaattgaggctaggctggacccaaatactagtataaggaaaaagaaagcagtatttatatttttccttatttttctattttttttcctttctagggagatccagccaattcttctggcaccgtttctcttagctgtagctgtaggattgtcttgacacgtccttgtttcctagcccgcgcccatttgttccaccgacgagtgggacccacccgccattagttggaacaatatgggtaaggcaccacacccacaaacgggacccacacgtaacccggtgaagtgtgttcacgctttttgacacttcaagatgatacttcttcggtctcaaaataaacaactcctacaccttcttactattagagcaagtttataatagtgcagtcaattatttgttttaaatcatttataatcaattttcatataatcgtttcatataaacatatactccctcctttcaaaagtctaaatcatattcgtagttagtcactatgtgctatattattttttttatcggaaccaaaaaattattttagtacttattggttacatgtttattggttttggattaataagttaattacacattagtcttggtgaaaaagaaacaggactaaacttttggaaggagggagtactacacaatcaaactacgtgtcatacacacatgcatgttagagtccgtgctgcagttggatacaaatctgtagcacattgatcttctctctcatctcttatctcctcgaaatgtgtttatggctggtttatagtctgctattgcacctgctcttacctacccccaatatgcaaattgagaaattttattactccactaccctcacttagccatcaaccaatataattttcacattaattaaggatgcagtggtctatccttaccggtaattgtgcacggcacaatgcacgtttcccacgttagctatcgtaatcacataaaaacacttaaattttgttgcattttcctgtataatatgtcacgcgaaatatacaaatatactaaaattttaagaactatatgtactatgggagaatttactatttgccactttaccaaaataccagtgctcaaatgattgcttaaattaataaatgaacaagatgtgtggcaagacttattggaaaggaaaaatcttaatagtaaatcaataactcatgtagagagaaaacaaggggattcccatttttatctggcctgatgaaggtaaatagttacttctaaatatgggttctattccgcttaatgtttctttcaggagagctttagttggtcagaatttggtcaattggcataatt

SEQ ID NO: 67561 - DNA, 6696 bp, Oryza sativa
gttgctgtcacgccgtgccgtcgtgtcgccgcccatcgcatcccgccccgagccgcgcgccaccggtgtcgccgtcgccatcgacgtcccgtcgccgcgcgcgtcccatcgccgctgccgcgccgcgcgccgtctcgtcgcctcgcgccgcgagcccgccgcctcgcgccccgcgccgccgcgccgccgtcgtttcacccctccccctccttcccctctctttcttcccctctcccctataaagaccccggcccaatcccccccttctccaccccactccattccctcctcttctccctcttccccttctccacgcgccgccgtcgtcgcgccgccgcgccgccgttgtcgtgccgccgcgccgccaccttcgaagccgccgcgccgtcgccccggagccgccgcgccgtgcgtcgtcgccttgcgctgccgtcgccgtcgtcgccgccaccgccgccgccggtgagccgtcttccccccctcacctcgcgcccaccgccgtcgccgcccggggaagcaaagagccgagagagagagagatatagaaagaagccgggagggagcagagaaaaagaaaagagaggaaaggaggaaggagccgggaggagagaaagaaaagaaaagagaaaagagagaaaaagaaagagaggagagaaaaagagggaaaatagaaaagaagaaaaggagaaaatagaagggaaatttggggagaaattagaggatttaggaaataaaaatggtcggggttaatcgtagattatttttggaaattcctcgagcgtaatagtatttcggtcgaaattccgagttaattataaaaatatgtttcttgatcagattagattaaaattagtagtaatttagatataattaataactaaacaattagatgaattcttatagattattatagattatttttggtaatctctaaaagtcatcggttcacggtagaaattcggatttaattactagggattttagccgtgtattatatttaatcatttagtcatagactaaattaaatcatataatatttctaggatttcgtccgatatttagctcgcgatagaaatctctaacctattatatggatataatgctcgggtagattaaattaaaaacttatgacaacaaaatatttatacccgcaaaatagtttaagtcgaaattgggtttgccgtagttcgcagatagtaaagtttataaaaaggaatcgactttcacattcgactttcatttggatttatttggatttttatttgaattctaaccgaattcaaatcaatttttgcacgtaactatagagcccgagggagttgcggatccaagcgaaggcaagacccgcaagactctgagcaaggcaagtcatcactattccttgaacatgttgatcccaattgcgaaattgttttgtttacaaataaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaataactgttttcgactggggcggacggaggatttgggtggtatctggaaaaggctagtaccgtccccggtcaattaaggaccgagccatgaagttaagcatgaaacaacccccgtacaaccgcacttctcgtatgggtatagacctagcggattagatagccgagcggaggcagtatccctgcatagatggttcacccctgagtgaggcaggtgcgctacgatgggacagccgttgaggtagggccgagaagcgtgccctacatcggtgtcgccattggtaggactgccatgagtgtgtgagagagagaacttaacttgaaccataatttaatatgcgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattctttaacttgtgtgggatgggatattgcatgatgatttttatgctgatggagccacttcctgagaggcgggaacgtggacgtcctcagaaaaccataacgactcaatggcgggaagctatccttgggatcacaatggatggtggacagaaccgtcattgtttaatatgaacactggtattaaaacttgatcagtctatgctaggtcttaggcttgtgaaaagaattacaaaacttgctttgcgcaaaagaaccatagccatcctttgaattcctctgtcatgtgcatcattgctgtggtggcttgctgagtacggttggtactcacccttgcaaatataaaattaatcagaagcgggagatgaagcctcggaggatccctatgcctactaccaggagggagatgaagacgatggcgctcagtaggtcttagtacggtcgttgcctgtggcaatggcatgccgctgcctgaattccgctgccttatctatttctgcttttggatgtattccggaccgctcggtccgatgatttaagactacgcctgcggggttatgatgtaataattcgtattagacactcgtgtatgtgcacttggtatttcagctatgaattcgtgtgtaccagactacttgatctagggaaattgtactgtttacacaattgattcctgttataaaaacgggggtccacaggggacgacggggatgggcgacaaacttgttaccgtagcctgccgcctccaatgtcctcggtgccgcccgtctcaccctcttcaccgcgcgcgcctcgccttccccgtggaggactcgtcgaccaccgcctgcctgagctgagaagagatagagagagagggggggggggaaaagggaggcctcactgccgtctccagggaagggagcatcagcggcgccgactagtgacgtcgacaatgaaccactcgtctcctcttgtgcttgttgctccgagtcctcgtctttgcatggatacaggaaagaggagtcgggagagagagagaaagagggaggcgacgcgtgccgacggcgctcacccgtgaccccgagatacctcagcctttccgctaaccacgccgccctcacctccgtggtcactggcctctacagccaccccgccgcatcacccctctcccccacccccgccatggctaccttctcgtgtaagtctggcgtcatccgccgctcccccgaccacaggaggacaaggcatatggtgagctcgacatgccagccatagcccgcgcgcgtgccgctcgttcttagcggcgagcgagcaacgggcgagagagatagaggtgagaggggatagagaggagagcgactatgacaggtaggcccaacattttttaaaataaaaaaatactaactggattgccacgtagggccaaaaccactccgatgttgagttagggggtgttttttcctgtattgaaagtttagggtgagcgatatctgcttttcaagttaaaggggtaattcggttcactgcgatagttcaaccagtaattcatactttttccaaaagaaaaaaaaaacaaacaactttcaggcgtttcccttccttcctgacgagtttttggtgttcgtcttccctcccgcgcccgcgccttctcgctcgcgcgcccgcggggacgcggcggctagggcgatgcagctggtggacgacgccgacggggccctcgactcgtgggcccgcttctgcgacctctccgacgagctcttcggcggcgccggcgacctctcggcgggcccgcgcctggcccccgtcgtcgcggacctctgcgcccgcggcctcgccgagctgcttcgggaccaattcatccgctccctagaggtgacgcaacccccacgcttctctacccacactcacctgctgcgtgttgctcccgccgcgcggagtattggggggctttctgcattgcacggttttggggactcggatcgcgctgcgcgctgagtgtttgtgagaatgcctgccccgaatttgagacggtgtagcagtagcagagggggtatggacttgggctcaaagaccctttcgtgtgtgcttggccatagacagtcaaggttgaactaggccacactatggaaacatggggtagacgggtagtaggactagtttgctttcgctgaaacaattgtcaggacatcacttctttcatcccttcaggtttgtggtgaacccttttatttatctgtgacgtagttaaaaaggagggaagagatggccacaatgcacagggtggctgtttcctgtttgtcagacaggcagagccccctgcaatttaggggagagtatctatgtgctagagtgtctacaatacttgttttagttttatttgagcattgaaaattgacagaatgcctcaggttttcaggttggtttgaaattgtaatggcttaggatttgcacttaacttttttcactccttacattttagttgaattagctcttatgcaaacatataagaggatcctagtctaaaagatgccatattatctgttgcaagtctgctggctgtttaaaattctatacccttgctcgtatttatggaatgctatgcaaagctttttattcttactctttctctattcaacctgtccttattaatgcagggaatatttagaagcaacgcggttaagaagttctggcagcagtttcatccttattgcaattcctctgcagtggaaagaattaaattctgtgtgagttacagaatagttaattatttgttcatccatacgtttgtttcagggtagaaaatttatgttgcagaaatgacatcttgcctgcttcatattctgattgtctttcttgcatacccaggatgtgatatctttcatatgttgtatcaagaaatgaaatggcattctttgtattgaaagatgaaaccataaaaccatcccagccatgcaaatattttaaagatactttcaccagtttgtcaatactgctgtatcataatttgaaactagtgaataaagtgtatattagtaatcatcttacctaatttcggtcttttaacattttacaacagcataatttctctaaccatgaatttcaggttcaagaaaactggcctgaggatatcttaagtaaagcattggaagacatatgtttggaaaagaattaccaggaaaagtgtgttctggctctagttcattctttacaatcttatgaggataggtcaccacacagaaaatctaaagcactggattgtagttccagcttaatgcctaggtaccagttaatggtatcttcagtacttctgacaacactaccattgagttttcctggttagtatctgtttcaccactgttttactgtatgaaaaggcttgagtttgacactgggccaattctgaaatgtttaccatgacttccatttctgaaccttgcggagtggtttgtgtttctctagattattctttagaatcatgaaggatacggtgcatggcaacacaaacaatgttatattttcagtttgttttctaggcatcagttttctaggcctcacaatgatctttagaccagttatgactaaactggagtgttgtgttatctcctatgcgttaattcttccaagactcatgtggccttttcataaagagggaaagatttattactagtattaaatcttatagagccgcagattgatgcaaattacccaactgcctttacttttttggcacttttggatgggatatttatggtttccaaactttgttctctgtatctttgctcctttggtcctgccatctgggggccatatgaataatcactcattgttaggacaataagttagaatatggatgaaactgcaaattggatctgtattggcaatttggattgattttattagcctctgcagaaaaggtcataaccattggaaagcattcaacaatccaaaattttttctattcatgtagcatgcatacccatcttccacattatagttgggttgcggccgtccttttttttgttttttgtttaaggttactttacagggtttcttggattgatggaatcatggacagatctcctattctcctccctctgataaaatcagttacaatatcctcttttagctgccagagcacagcatgcttgttgcacacccactgacacagttagttcaggaatattgcacatgaaacattctacagttactaattaatccaaatagaagctattgtttttaacaaatacattttcctgaaattataatattggtgacttgtttttttttctacttgatctgtagagatattaaatgtatacttcaagaagaaactggaagagttaaatatcatgatggctggattggatgggagcgatccatt

SEQ ID NO: 67562 - DNA, 4714 bp, Oryza sativa
tctgctaaaaattagaaaaaatgagcttggttggaggtttggagcttgtgctttaggcagctttaaaatgaatattaagcccctctgaacagatacacataaatactgaccaatcatggcctcgtatcatactatatcgaaagcgacaaatgcatgttaattgcatggattaaaagcgtggtaggacctaacttttctgagcccataaggatttggattccaggcaactgaaattattagaaacggtcaccaacggccggttttggcagctttaaactcaagcatagcccttccaataacgtaactacaataccaaccaaacatgaggtgcaaggacagtatttgcgtcacctagatcgaaaccagtaaatggctaaatgcgtgcgcaaacaaacataggaaagcaggaactagcttccaataaaaaccggtaaacgtcttttttggacatttcacaactttgtcggaatttgattttccaccttattgaaattagggtttcagcggttacagacaagaacagtacaacctagaactgctagaaacagtcacggatataccgacaaacaaacagagttcaaatgaacgccttttgctcttcccgccattcctacgcctcttgttcttcccgccattctaaactgcactacagagcctacaatactaaatagcataagaaataccagtgtactacttcttgttggcatgactccatgcctgatgtctccatggacatcaaacccatcaacagttagacactcttatttactaaacgctgtgcttcaagcagccaagcctatccattagcatgtatagcatctaacaaccctaaagacgaatcacatccctcacctcttgctacgcaccatatcaccctctagaggccataacctcaagtaaccctaagaacagtgaaaccaaacctgcccggtccgaattctccaacgaaaatctcacaccatgacataattcagtggtacagaaaatggataagacatgcacaggcgcgcacacagggatcgagcccagtcacctctcttagatgcgtggtggtgtgggaggtggcggacggcgatcccgccgtcggccggcgcgcccccgccggtggccacccgcaggtgcccctccgccagcatcctcgtcggcgacctcgccccctcctccgccgccatctcccccccacctatgcggtctcctccgcccgccctgcaacaccaccacgcacgcccacaccctcaatcaatcagatcaccacagccacaaaaacaaaaaacaaaaaattaagcaaaaccaaaaacgaagcatacgatgacgaatcggacgggatgagcagacgaacacacctgtggagatcggaggcggagacggcgagcgccgacgcggatctcaggcgagcggtgcggccgcgcgggggcgaggcgaagagagaggggggccaacgcaacgggggacgcgagcggagacgagaagggagagtttttattttatctttttttttttgcctcccgtctctctcacttattactatctgcctctaattacttttaccgcgctgtattaagctaatcttttccacccattttttttctctattttcttatttctcatcaagcagtagcactgtgtgaactgagagatcgctacgcgcacttaaatactcgcgggattagagacacctcttgtccctcgcgggcccacctgtcagtggtggtacgtcggtgccgtgtagcgagcggggggtcggtcggggagttggttttgagtagaccgggtgcatggaccggtgagtggatgggcgcgtggaacggacggcccgcgcgaggtggggcggcgtatggacgcggttcacgtaatccaggtggagagagcaacggggatggacgggcgtgagggggctgacgcggccacgtcgtcgtgttcggcccacgtggcacccctcccagatggggcgcacgtagcgtaaaggcgtccgtcaccgcgacggacgcatccgggccgtccgttggtgggcaaagccgctttctgctgattttgtccgtgagcaaaaccgccccaggtttcactggtcataaatctcacagtcttgcatgttgtcacttgtcatatgctaactactgtgctggctgatcagtcattcacatggaatctgcttaaggttgcctattagtaagatactaatccttcacgctttgttaagtgtttatctcgacccatacggcttggcaagctatagctagctaccttacctacctcgtcatgatcaacacaacacacaagagcgtcgacgtgtcatcggaagtacagggatatgaatgaggcgaagcacgcgtgccattaacatcgtcacaactctggcaccatgcgtgcaatcgatcgatcgattcactcctcgttgcagaacagcagagcagtgaacaaactaatttagtctctttctgttgctccgcctctgaatccatccagagcacgccatccttggtccatcacacaggtgttggcgattacagtgccagtgcttacttacagatacatatatacacatctctcatgacaaaaaaaagaagttgatcgatgtttaattaattgtactggtatgctcatgtaaatactggagtagtagtagattagatgcataatctaatcagatcaggacttgtcgaggaggccgtcgaggtagaggttgaggaggtatctgccgggtggagaggacgtcgaggcgcttctcgctgggctcgtagcgccccttgcgcagctggtaccggtgcgtcaccgcagacaccgtgtacgcctgcccttcgatcgtcacgctctccccgcagtggatgttctgcaccgtcatcacgcaccaacgtaaacaccgcttcatcacacgagatagcattaaaattcacagcaacaatacataatctgccaacaaccaccggccatatactctttttttttcttccttttttctttttttttctggtttttgttttgaagaaccatgtcagcatgacaatgtatcagttcaacggtgatagctggcacgcaaggaggaggaaaagcagcataattttttgtttccccgttggaaagtcgggtcttggtatctagaacaatgggaggcactcggcttggctttgacaatctttttattctcgagggaattactttgacaatctgacagcgctttcgtgcatgtatgatggctatctggcagagattcttgatggtagtagtaccaaattacgttgcttcgactttccagcaggaaaagagttcgttgtcttgcaaggttaaaactgctaaaacaggcttcacagacatcatcaggaccttggcgaggttaaacttgtctacttcctccgtttcacaatgtagaactttctagcattacttatatttatttagatgttaatgaatctagatatatatatatatagtatgtgtttagattcattaacatctataagtatatgggtaatgctagaaagtcttacactgtgaaacagagggaatactaccctaccggctgctcatctacacagcttcttcctgctatgcttatgtgcctttggaaccataggcatgaggtgacttttaagaatgaacaaccctgcctacgccgtttgcttcgccgctgcatcgatcatgctagcctctgggctgaacgaatgaacaacgttggtagatatgttatatctgcttgaaaaacaagctttctcccgtttcttatatctttaaaataggtaatggcgcgaccttatcgctacggcgccctacgtaacctcaaactcgttactttctccgtttcacaatgtaagtcattctagcatttcccatattcatattgatattaatgaatctagataaatatatatgtttagattcattaacattaatatgaatgtgggaaatgttaaaatgacttacattgtgaaacggagggagtattatcaatggaaaattcaagtgagggagctctttcctccggtgatttctaaaaaaaaactactaaaacaaggtttacaaacaaaaacacaactagagtaggatatatcactattatctaaaaagaaaaggatagcatggaggctagttgttgatggtcctagctgcgcacgggtgctgaattgttttttttttcgaaaaaacgggtgctaaattgttgttcttgaagttacaacaatagcataaccagtcagtgatcacttcagaaaacactgtaagggttcattcggtttaaagaatttacaaatgattattttatgaattgaaaccttaggttttttctatatgcattattagttgtttaggaataaatcctaccaaattcctaaggattatattcttacaatcctgttttatatgtttttttagtatgagatgagagctcttcgagaattttataaggatttgtggcattctaatcctttactctttatctttttttttcctatgatttaaaaatcctgtgaaccaaataaaccctaaattatttttttgttctcgcagtgctggaaacacttcagtaagttgtcaaagaacgtgtcctttttttccccttaatgaaaaaccactgcattactacgtgctacaatttaactagtagactgacgcaatctgtatttctccaaaagctgcgaagaatatttaggatcgaatttatacactgggagcagaccgtgactctgcaaccgaaattgtggtgcactgaattctggaacaatgc

SEQ ID NO: 67563 - DNA, 2143 bp, Oryza sativa
ccctcaaccaccacttcagccccccaaaaaagctgaaattaaaccaaacatttagtactacaccttcgattaattaacaatgctaattagtactaacaatcaacgcacgtacagaacacatcaagaacaactaatcatcaggctatgaccccatgattatcatcatcttttttctcctgtgtatgagcagacgcgagacatgagccggaaaacttgcgatcagccgcggcgatttagaatagccaaagtaggttcatggcctaacccgcccgaccgccctaattatcgtgcttggaaaaggagattaccttagctagctaggctaggctagccggacatgcgttttgccaactcccatgtgattgcgttttgcatgcgagattctttgttcctgtccatgctttgcccgtgtggtctatgcaactcccaggccttttcacccactttacccagcaatgccccaaccaaaaatgccaaactcctttccaagttgtatggacagtggtaaaattgacacgaattttgataaatgtccttcaatcagactgagataatgtttggcgctctacccttttaatctactgaaaagtgatggagctatatatgtatatcatttttctttcactcgtttacttactactgctagtgtcatgcccatatattgcaacgggacatgataaagggtgtgctcgacacgttttcccaactctcctctctcgtttttcgcatgcacgtttttcaaactgctaaacggtgtgttttttttaaaaaagtttatatatgaaagttgcttaaaaaacatattgattcaatttttttaaaaaaaattagctaatacttaattaatcatatgctaatggaccgctccatttttcgtgatcactgttactgttaggaaccgctccaccgaacacaaccaaagatagcctcactagggtgctctctaactagtagtagaaatcaatctgaaccgttagatctcattttattgaaggatacagatctatttataccatcccccagttaacggtagtagaaacgtggtgggacattattattagaaaaaaaaaggtatggagggtataatcgttatttagaagtgattaaactttttttcttttttttgctttttttgatgaaatatgagtgatgcaagcgcaatggatgatcgcagatcgatttagctaggggaaaaaaataaataacaaagtaactcatcattattatattagtaaattattaatttatctctaataatattgatagtataatattatgagtagagagcaccaaagcatcgtttaaagaaagatggtcaaatggttttacggggtttagttttttcatctttttttgatcaatttcgtgtgggaacgtctcgtttttttgtgagttttcctacaggcaggtttccttttcttttgagtgagagaagtgcaatggttgggaagaaaaataatggctccatttttaaggtaatagagaaatactagtacagctgataagtctgaaacatgaaatggcgtcgggccctcatgtcagccccgtggttccatactttcatggaagctgtcgagcgagctgtatggctctgtgtagcagcacaacctgttccatctttggactttgcgaggatcggctgtcccagtgtccccctcattggcgcctttgacaaacagccgcacgcttctaaagctttgtcctttcccacgcccatggctctcccttcgccttcgcttcctgtatatacaccccccacccaccgagctctccttccacggccacaccgatcaccagctgcgcccgccaattgttgcaagaaccgagccctttcagctgagcgaattgagtctctctgaccgggctgtgtgacaatgatcaagctgaggtactccaagaggctgttcaggaggagctcctccaagggcagcactgacagcagtagcagtagcagcagcagcagcgacggcgatgtcggtggccggagcggcggcggcggcagcggggagatagagtgggaggtgaggccgggagggatgctggtgcagaagagggacgggagaggcggcgtggaggtgatcaccgtcagggtggccaccgggttctcctggcacgatgtctccattggggctacctgcacttt

SEQ ID NO: 67564 - DNA, 1305 bp, Oryza sativa
attcctgcagcccggtggactactcgagaaaaggttgttaacggataattctcgcgaacgtcgtcggcttgatcacccgacatgattgcgagcggacatccggatatgctataagttgggtatgtgagcaggggcggatctacagtagtatgagcggtgtcaggcgacaccgacgactttcggcaaaacctatagcgaaattgtttatctatatattataacactatgaattaagtataattaacatactatgacaccgatagacatgttatgacaccaacgaatcgattttctgggtcctccactgtatgtgagtcatgctggccacatgatatgcacatgtaatgaaccaactttagcgcccctataggtgattaagaaactcctactcctggttcttgaaccagtaagacgtagtgatctctctcacctcactttaagtggtcgagttacgactactgcctgttcctcgaccagcgatgtagcgtttctcccactacttccacttcaagtggtcgagttacgactactgcctggtcctcgatcagcgatgtagcgtttctcccactacttccacttcaagtggtcgagttacgactactgcctggtcctcgaccagcggtgtagcgattctcccactatttccacttcaagtggtcgagttacgactactacctggtcctcgaccagaggtgtagcgattctcccattacccctgcttcaacaaagttgatatcaggtacacaagatcgccaagtgttttacccagagatcccttaccacgacaacacttagcgttgaaacctatcctactgtccctttacgccgtcttgacaaggcctccgaggaacctaagggaacttcggctggggacgcccagagccgataaggccttgtcggatctttcagagacgaaagaccatgtaagatctggtcgtgtaagagttctcgctatgcgtattaaccaagctgtgtaatcggaaatggattttccaacttcacggctgggggttaggatcaatgcttgttcaaccgaggcaggtcaaaggtccaagagccttatcttccgagaacgattctctgatgacaaggctgggggctagggagagtgtataactcaacaaactgactgatcgaagtcggtaaaagagtagacgctcatacacaaaacattggtctgtaagtctaattcattttcggttttccatacatattataacatgttaccctttgagtgttcgctcgggggctatttctatctaatattcttttctgagtattgatttcaggaagggctgcaggaat

SEQ ID NO: 67565 - DNA, 1220 bp, Oryza sativa
atcgtcagaccgccatgtcgacaacagttagataggctaccccaaatattatactggtgtgattatcatgaataagagcaataccggcttcggccaacaggatgtagggttattaactgataattcaggggcccgaacctgtataaaaatcctcgtctccatctcttttacctcagtctcgcatatatcctagcaccgacgatccccatactatgcaaataccagaattgcgacatcaaacgtcgacactccctcagtccaacaaaaaaactcaacttctagagtttgaattttgtctcacaaaaatcaatttctaccgtcctacctaccctcaacacgtgaaacggaaagttttatcccttcaataccttttactacgtatcactcttactattttttcagtgattaaaggcattttagtcattctctatctccactaattctcctttggaatgctaggaatgttttttttggacggagggagtataaggcccactttagttttcaaaaagttttttccaaaaacatcacatcgaatctttggacacatgcaaggagcattaaatatagataaaaacaaaaactaattgcacagtttgcatggaaatcacgagacgaatcttttgagcctaattagtcgatgattagccataagtgctacagtaacccacatgtgctaatgacagattaattaggctcaaaagatttgtctcgcggtttttaggcgagttatgaaattagttttttttattcgtgtccgaaaactccttccaacatccggtcaaacgatcgatgtgacactcgaaaattttcttttcgcaaactaaaccgggcctaagagagtaaaagtgcaccctgcaggacagtagaactactactcaaccctgtgaagaagattggtgctgttcgtttcaaagaaaaaccctgtgaagcagtgaaggagagtgaacaggaataactgtaatctgcatccagtaatggcaaatccgcctgctgctggcactgaccggccccgtcgcggccctccccgaagtcgttgcgccatcacgctgtctccacgcaggggttgacgcaatgcaaccacctgctcccgcaccagaaaggccggcccattaggtcactctccactcagccaaaaaaaagggggagagagagagaagcgatgatcaggtagggcgtgtggagtggtcgtgtcatttcgatcggtttggctttgccaa

SEQ ID NO: 67566 - DNA, 4767 bp, Oryza sativa
  unsure (1)..(4767): unsure at all n locations
nnnnnnnnnnnnnnnnnnnnnnnnnnnnnnnnnnnnnnnnnnnnnnnnnnnnnnnnnnnnnnnnnnccggatctcctcttcgatcctgccgcgcatctccgcgagcagcgcagcgtctgtctccagcacgccgccggcccccagcgactcgtacagagacgccatatctgacgccaagcacatcgatcagatcaaatcaaatcaaatcaactcaagcgccaaattcccacacacacacacacacacacacacacacacacacacacacacacacacacacacacacacacacagagtcagaagcacgcggcaagcggaagctgccacggccattgattcgagtggagggggggggttgaggttttctaccatcggatttgactgcggcgaggacatcggcgcggaggtcgaccttggcgaggtcgtccacgtccgggtgcgagagcaggaacagcttgtgcgccagcaccaggtgcggctgctgcttcccttcctcgcctacgccgccgtccatctcgccgccgcttccgccgccgccgccgccggagaagagtcgcctcgcttctcgctttgcttccgccgcaagaagagattgggagagaacacgagagagaaggagagaaggctagtttcgtcctccaaagtttttaattcgggagagtatttccaggctactacgacgttgcagagcgacgtggtcttatctgagacgtccgtaccacgatccgacggctgtgcggggggccgagatctagtacggcacgtgtacaagggcaaagcgcaacaccgacccgagtccaaactccaaaccccattccgtttccgagttccgacccgcgccgccacgccacgctacatcccgagctctcaccgagagacccaaaaccctttccaccgatggccaccgccgtagccgccgccggcggtggcggcggcggcgagcagccgcgcaggaggaagccggcgccggggagagggggagtggtgctccccgcggggctgtcggaggaggaggcgcgggtgcgggccatcgcggagatcgtgtcggcgatgggggagctctcgcggcgaggggaggacgtggacctgaacgcgctcaagtcggccgcgtgccggaggtacgggctggcgcgggcgccgaagctggtggagatgatcgcggcggtgccggaggccgaccgcgccgcgctgctcccaaggctgcgcgccaagcccgtgcgcacggcgtcgggcattgccgtggtcgccgtgatgtcgaagccgcaccggtgcccccacatcgccaccacggggaacatctgcgtgtactgccccggaggccccgactccgacttcgagtacagcacccagtcctacaccggctcgagcccaccagcatgcgcgccattcgagcaaggtgatttacctcactggctactgatgtcacttggaaatactataccacctgtgagatgagctgcacggcgatgctttctctagtgttgttttgaagtatgctgaactgcaagtgaaggcagagttctgttatttattgaaaattagtcgattgtcagcaagccacggggtagttattttgtcgaaattgaagacttgcattagaggagtacaaatgatgcacaactcattaattactgtgatcaaagttcactagctaatgaaacaagaaagtacaccaatgcccactagtgatcttttggtctggcagttctatagcaacagattgtgttgggcgatatagccatgaagttgtcgccattattttgactgcttcatccctttgggtttcagaactttctgatctgtctacttgtaggtacaatccatatgtgcaggccagaagcaggatagatcagctcaaaaggctaggccatagtgtagacaaggtttgcccttacccttgagagtgttgtgtcttggtttgagtaattcgattcactttctagttacatttgattaatgctatcataagtttaaaataatttgaatacattatgcaggtcgaattcatattgatgggtggaactttcatgtcattaccagctgattatcgggattatttcattagaaatcttcatgatgccttatcgggacacacttctgctaatgttgaagaggctgtttgttattcagaacatggtgcagtcaaatgtattggcatgacaattgagacgtaagatcatttgacaatctaaactacccatatgcttaggttccttgatggttctgtatgatttccccatgaaacatctttattaacttcagttctataaactattgttgtctttcctcaaaattacaggagacctgattattgcttggggcctcatttgcgccagatgctatcttatggttgtacccgcttagaaattggtgttcagagcacatacgaggatgttgcacgtgacacaaacagaggtcacactgtagctgctgttgctgattgcttttgtttggctaaagatgctggttttaaggtagtctccttaaatcattaatcatctcgtttagtcaacttgttgctggcagcatttgttaaaataaagtatcatctcatatggttgaactgttttaatcctccattgattaccttttgataggtggtcgcccacatgatgccagatttacctaatgttggagtgaaagagatctggaaagtttccgagaattttttgaaaatccagcattccgagctgatggtctaaagatttatccaactcttgtgattcgtggaactggcctttatgagctctggaaaactggcaggtacttattttatctagcacttgatattctagattgctagtcttgtgttcactgttgtgtttgttctctagaactttttagtgagaacttaggccctgccaatgtttgttgtgtttcagataccgaaactatccacctgaacttctggtggatattgttgcaagaattctatccatggtaccaccttggacacgagtttaccgtgtacaaagagatatccctatgcctcttgttacttctggtgttgaaaaaggtaatcttcgtgagcttgctttggctcgaatggaagatttaggcttgaagtgccgagatgttagaactcgtgaggcgggaattcaggtctggaacactgcatctcctctcactctcacatgcttgtaatttaacttagctctttgtccttattattttcgttgtttgtctttatgtaggatatccatcacaaaattagacctgacgaagtagagcttgttaggcgtgactatgctgcaaatgagggctgggagacctttctctcatacgaggatacacagcaggtacatatattttgccagcatttcatgtgattttggggaacttgaaaatatgcagaatgtctgagcaggcctgtttgaaattatatgaccaacacctatcttcttggtccgggaatttttactgttatgtgtttcagactttcagcagtccattgaagtatttatttgttatttttaaaattattagatcgatactattctgcagagttcaacgcttggccttatgttctctcaatcttttggagcactcacattttgccatcttacaaattatacaggatatccttattggtctgctgcgattgcgaaaatgtggccgcaatgttacatgccctgagctagtagggaggtgttcaattgtccgtgaacttcattatatggaactgcagtccctgtacatggtcgtgatgcagacaaactacaacaccaggtgaccatagtacatgtgatattattagcataccatgtttgggaaatggatcggtgccatgacagtattagtagcagttagcaccaacgactttgctatgcttgcaaattagatatcctggcacgcttgataaattgtagtcactgttttaaatcaagcttagtgtctaaacttctcaatagtatggcattctggtatggtatattgtcacatattatccaatttcttatcattagaggaaatgtagtgttgctctataaatggtgattatttctcctgttttgacttgcaattggtacatgcctatagatatacttcctaacttgattgtccagaaatataaattacatttctgatttttttttgactcaacatcgacagggttatggtactcttttgatggaagaagcagaaagaattgctcgcaaggagcatcgttcaaagaaaatcgctgttatatcaggagttgggactcgccactactaccgtaaactgggttatgaacttgaggggccttacatggtcaaatgtctggtctaataacttctatttatggatgcttgtactccagcagcattgtcactgtagtatgggttttgtacaccagtgtaactttttttttatatgaatgagtaaacacacctcctttcaaaaaatgagtaaacataacatttgattacatacatctcactacatgttttgaagctgcatttataatagagaaatagaatagccatctcatccaaactcctcgccggacatgccaaattcatgttcagttttcactgcaacatcacattagatcattgaacatcataattttttttcagagatgactgtttttaacatgtcaacttgtcaagtgtaagcacggccacacttgaataatgcacgcacgtgttgacgaacccacggccacgagtgataagtaagctgacaccgaagggtgccagtagccaaaaggcattccggccattgcccctgccatttaatgccaagaagtctggttgaatttctttctgtcatttacagaccgaa

SEQ ID NO: 67567 - DNA, 1519 bp, Oryza sativa
  unsure (1)..(1519): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgaggaagataggattgtactctggggcagaaagctcttgaaggcttataatgagttctgggacatcatctgagagaaaatactcttggattatgtgtccagattcttctttgaaatgcttgatcttttcaccacttgcatttcgcatatcttcattaggggcagaagatgtagtgaatgaagcatcaagccatccttcagatgtagcagtcagaaccagcttgtcaaagagaatcttggcagaaggaatatcaaggctcagatcatcaatactctctgctagccgacaaaaacccttagacatttgattagaactgatcaggcaacctgcagttgattccttcaacagcttcaggattaatggctgtgatgacagattctccatgctcaaggtgagagcgcgtttaacaacctcatgatggaaaaatggaaggcccagctcccttatacacctaaaagcttcatcaatatctccactctcaatatactccttcagaatatcctggattctccttttcgcctcttccacagtaaagtgagtgctcccaccccacttgcgctcaactagctcagcatgatggggggctgacaagtagcttttctcagaaacttgcagaacttcaatacctttagaaaattcaggaagcagtgctctggctcgagtgaggaaaacaggaggcagtatttcatccacaacagcacgagcaacaaaaacagacaagacatcaatagcatccggtatgtcgacagatagatcttctgttgactcaagaagcatcataaaaccttcactcatcttggaagagcctagtagatccgcatacaacgcagacaacagaattgacgccatttctttttctttgtcatgacgatccattgccatggatatgagcttcttgataaagtaactgtggaactgatcagatccaagactccttaactcagaagctgccagttccacatctcctgtactaaagtactcctcaattacaggaactaaaagccttttatagtcatctaatgtagcaggaacctacaataccagtgagttattgataaattagtgtcaaaccaacaaaataaattagtgccaaaccaacaaagaaaaaaaaaagcaaaattataggagcagcgagatcaaaccttattgttcccattaactagtttgttcgacatcttagatggtacagaatctacatcctcaagg

SEQ ID NO: 67568 - DNA, 2383 bp, Oryza sativa
acctttctgctatctttcctccaatttttatgcattatattcttgcgcatggaagctataaacgtccctgcaaaaatagatatgatttactctattttttgtcgtcatgtgcctctatggtcaggtcaggagtaccgagatttttccttgattttattacagcatagctatgcactctcctagaatgctcaggggatgtgtgggcttgggggggggggggggttcttcatgtgaatggcccttcacatacttcagaaaaatggctacgatcttgtgttgaaaaacttgactgaaatcttattagtattttgcaagtttgtagtcatttgccaattttatgttcatcaattcaacaagatgagtggtatgatactaccatctgaaattaaaagctgaatttgctgctactttcagatgcaagagcaacattcgaggtgtttcattcaaggaacagaagcaacagaggtgacaccgttgatggagtcatgcatgccataagttgttattatgcgggtcatagattatggcggtacttcaaataagttgttatttgcataatcagggtgaacaatctagtggcaatcttgattaacacatttggttatctggcatgagtgtataatgacagactgctccaaagaatacgagtacttgtttggctgccattttaagtgtacatatccgcctataattttggtgtttgccatacaatctgattatattctaattgcatactttctataattcgctccctaaagacagtctattattaatctttagatcgattgtatatgctttgtaatttagattgtccaattcatagtgttatagttgattgacaacatttgaaggtttttggagtaactattattgtattcacaaatatatttacagaacaataatgctcaagtttattgtgtttcacgttatttaagacttgttgcaacgcacgagcaccagactagttaagaaagaacataagaaacttgaatagtacaaggagtggcacaacgggcattcacaatatgctaaaaaaaagataacaagaggattactaccgggtagtaactatctggttcagcgttgtggttgtggacgtaggtagtaaaatgggtagtagcaagatctttccggttcaacgttgtggatgtaggtagtaaaatgggtagtagtaagatctttccgccgtgggtttgtaatacccattaagctaacaagaaaacaacacacttatctgaatgaaactgtattaatcaattacatggccttacatggccaaaacaaaatttaatcggcaaagatctccccttttcactgtcatatctcccctcacaaatctgtttcactgtcataaccttttcctcaattggtgtatggatatctcgtcgagggacaaaattgacagcctttgcaagaaacactttcaaagaataatactattaatcaattacatggccaccgaaacgaaatttaatcggcaaagatctcccctcacaaatctgtttcaccgtcataaccttttcctcaccggtgtatggatatctcgtcgaggggcgaaattgacagcctttgcaagaaacactttcaaagagtaatactgtttctaaattaattgctatttcagttacccgtcttatgtacgtcataaacttctcgtcaacttgaaagcccacaattctgagaacattcaaattttgatgcttaaaatcacgagatgattcccacttcaataatttatcaccttccttttggtatagttcctcatcctcactcgttttgcattcatggtcccacatctgcgtataggagaaaccaagttaacaaaaaaaatagacaatattttaagaaatcaaataaactatatttgctgccaatgtatgtcaacaagagtattgaagaacacaattgaggttgcagtttagtttcaaaaaaaaattgaggttgcagttgttatgaatcaatatcttttgaatggtgacatatttatgtcattctgatataaggaaaacacgttatagtttatgccattatattatttacatagctaccgatgtattcctaagaacacatacctttatgtgcatggtttccaatagaggcgcagcttctaaaagaaaaaatatccaagtaaggttgcactcttcatgaatgcaagtaagactagcaatctgcagattccgcaacacaggagccaatagtttcggatgttccggttgaatccaaatctgcaacatacagctaatgatcaaaccatgatattctaacctaaaacaatttcctttttaacaaaaaaaaaagtttcaaactcacccttccacattcaaaatccagatgcagtgcgcctatagccgcattaccaagaaactcacttagcttgatattc

SEQ ID NO: 67569 - DNA, 3127 bp, Oryza sativa
ttgcatgtgctaagcacatcagtgaagtctgagttacgtagcctcacacaggttaagattagttgcttgaggcaaccaaatgcacgggggcaagcataagagaatgacatgaaacgttttccacatatgatcttgtcatcttccatccgttgtattccatgtttttctggcaaaatcataaacttcgtactgacgatttctctatttgccatggcatcattgatggagtgggcgatgctgatagattcctccctcaaatagaatcccacgctcaaaaaattaattttgcactgacttttatgtgctagaatactttgggttgcttcgatgacagagatgttgcttcttattctcaaatcgtctttggctagcatggaaccatccttaggcttaaatgatccaacatggagaatgatcttagacaggacgccagggagatgcctccaccgtcttgagaggacactagtcctcacagcatcacgtgttttgagtctatccaatatatgaatcaaaatgtcgtcgggaagtgcactgagcctgtcttcttgattagctttgtcaccctgcattagtattatacataataagtatttctgcacttttgtaggcactcataagtgacattaatatctcataaggaataaacattccttcttttctcgaggaatatgtaaaccaaaccttaatactcataaataataaaaaaaggtaaaaaaaacacacacataaataggaacacatggaagacgaggaaatgctgctcttagtgtagttacctctgccacgctggtgccgtttgatgccatgaggaggaaaaacaagaattcagtacaacggatggtgtggaaattgtaccactagtgctgccgcgcctcgtatctgttcgtccggcggcagcgggcgctcatggtatttatcggcgcagccggcgtgcgcgtactgctcggttttggccgaggagtccgattcggtttttacacggtgtactacgtaggtacgggaaatggaattcgatccggactggacgcgtggcggatgcgttgcatagtcggccacgggcacgcacgggaaggcgggaagcggcccagctctccgatgccaacccagccggccagcccacgcccgacgacatcctgcgcactcgtctgttccgttccggattcccatctttccaacccatctctatcatttttcgcgtgcgcatttttcaaactactaaacgagtttttttaaaaaaatttctatataaaaattaatttaaaaataatattaattatttttttaaaaaaaatagctaagacttaattaatcacgtgggatagtttttcatcctgcactgccgaacaaaagataacctatggccctcgcgcgcgtaaattttcagttgattatctgggccgcacctgagagcagtagtgtcgtgcaggctttacgcttcagcccatgtagcggcctacgcgtaacgcgtgcatgcatcgctgttcgattcgttgaagttgactcaacatacaccttcgattggctggtcgagctctcgctcttcttccaggattttaattgggaaacatgtactgcaaactctatgcatatctttttttttaattacacactacaacacagacactcacaacacacgcgcacttacccctatgagcatcttcgaagaccgggccggtaaatcctggagagattgacgaagtcaccacaggtatctcgcctgacgaagtcaccactaggggtgaaaatagagcggatattatccgctccgaatccgtccgatgtgaggatatggtaaaagtttttagatattcggccggatgtggatgcggatgcggattttatcatgtaaatgtggtatcaacgatatccgacggatacggattatccgatattttgatcggattatccgatgcactatttggcggataatccgcaactttcagtctttcaacccatatattgtaacccatttagcccatctattgtgacctaatccactcctcccgaaatctctctctctctctgccgaatgccgtgcgccatctatctctctctcgagtcgcctcttcgcctcttttcccacacgcgccaccgcaacgccactgcaggctggtggcaccgccgccgatcctccattcctcctagcgcgccggccgctcctcctcagctccagccggcgccgccgctggtcgtcgtcggctcctcggcgtcgccgccagtgccagtacagtcgcccgcgccatccgcgccatcccaattgtcggcccgtcggcccgtcgccggcgccaggccgccagcgcccaggcggcaccgtcgcctgcgcaatccccatcgccagctgttgttcccctgttccagtccgacgaggtgatggccaacgacgaggctgtgtgcctgtgtgcacacgtgcagtcctcactgctgtctgtcgtatgctgtatgcctgttgtgtgctgtactactactgcagtactgctgtatgctgcgtgctctactgctctatgtgctctatgttgtatgcctgtatgccttgcctcacgctgatgagtgatgacttttatttttccattttaagcaactcagtgacaagtgagctattgaactgaacacttatattattttttttatggatcatggatgtaccttgaattatattgagaccgggctaattgtattgctgcccccttgttgtatggattgaatacaaacttgacatccgacaattttttgtccgttaccgaaccgactccgcaccgaatccgacgtccgaaataatccgctccgcattcgcatccgcacgtcatccgcacccgctccgcatccgcttaaaaaaaatggtttaggatagatatggtatagctattatccgtttgaatccgctccgttttcacccctagtcaccacaggtacctcgcctaccgggccggcaaatactggagagattgacgaagtcaccacaggcacctcgcctaccactgaaagcacagcgccgttaaattctgaaaaattcgctcccatggcctaccactgaaagcacagcgccgttaaatcctgaaaaatttgctcccccatggagagtcgaacccaggacctcaggtgctactgaggctcttaaattactaggcta

SEQ ID NO: 67570 - DNA, 2651 bp, Oryza sativa
gttcaggggcaaggagagggaggacagtgaccacctcaaggacatggtgctgctccttgaggaccctgccctcaaggacatgaagcttcgggccaccctcgtggcccgggctaccatctagagcccgtatcaatcttttatccaagtctaggactagcccagcctggtccggcccatcttatcacgctaactgctagattgatcgcaccatcatccttcaatgaaacttgcctcaccggggaacgaaggaattaagtcagtggttgcgacggcggtgttgtgccatattggcgttgcatgcgcctggtcaaggaggcggtgaatacacccagacgcggatctgcattcggtctttgaaggcccgacatgcagcgatggcgccggcggcgctgcgttcagcgtttggcggcggtgctgagttcggccttcggcgtggtgggcggcggcgctgacggtgggaaagtgccgcgagcccgcgacggtcgtgcctcgggcgagaaaagtggaggcagcgcattcatcgttgctagggatgaagcatacggacgtatcgagaacgtatccagatttgtttttgctagtattttagtacaatatccatgtataagtcggtttttaagttcgcttgcttttgaaaatacatattcgtatttgagtcagtttttaagatcgttcacttttagtaatacagaataaatcatataagaaatctatttaaaaaactcgcatgctaacttgagacgattgaactcctaactgtagataaaccatatacccgtgacgggcatagtctattttaatcttattattgttatatggtttagttaagttaaaattcattgtaggagttcgcttggatatatatatatatttttagaaaatcataagctgcagttaggagtctgatcgtcttaagttagcatgcgagtttttttaaacagatttcttatatgattgtcttaagttagtattttggtacgtcattcgtgcatgattcggtttttaagttcgtttgcttatggaattacatatatgtatttgagtcggtttttaagatcgttcacttttggtaatacagatagaatcatataaaaaatctgtttaaaaaaactcgcatgctaacttgagacaaccggactcctaattgcagctcatgattttctaaaaatatatatatgcaaacgaactcccacagtgaatttcaacttaactaaactatataacaataataataagattaaaaaagactttatccgttgcaacacacatacatttttttagttattcaaaaattgtaaaaatcgccaatacgtatgggatacttatccgtatccctttgtgtatctgatacggatacgtcgttttctaatgtatgtaggaggcgtttcggtttataaatcagaacacaccgcgcccttcgcccgttccttgtcgccgaacgtatatacgtgcccgggttctccagcgaatcatcgaatcaagcgacgacacgacacgaacacgatggacctgagcaatctgcccgacaatgtcttgctcgacatcctcgacaagctggacacgcgggaggccgtgagatgcagcgtcctctcgaggcggtggaggcgcgtccccggcatgctccccaacatcaagctggacgtcgactcctccttcgagcacgacgacgacggcttcacctccacgctatccgacgccgcgaggaacaactacgcgatggtgggcgcggtgcagagcctcctgtcgcgcgagagccggcacgacatccgccgcctggacctgagcttctcgagggaagagtccgtcggcatcatccacgccatcgacgacacggttcgtagtcttgtcggagaagtcgttcttggaacgcccgcacaaggacagggtcaagcaagggaggcgccttctgcactgcttcgacgcctacccgcgcgtgttcgtcggcctcacccgactgcacctggagtttgtcacggtgcacgggcctcgcttctccgacttgatcgccgcctgtgagcagctcatcaagctctgcctcgtctactgcgacttcggcaaggaaacgacgctgacgatccgacacgagcagctttagcacgatagatctcgagttctgcgcctgttacaccatcgagctggagtggctcccgaagctggcagagctatcgatagccgtctggccatggacgtcgcatgagtacccgctggtggttggccacgccccacgacttcggctgctagacctatctcacgccggtatggttaattcaaaaattctccggttgagcaagctacttgacaatactacgagccttcaagaactgtggttgaactttgaaaccgaaaaggtaagtcgatcatggcactgttaatatcggtagcgaaccattgaaggaaacatcacttgaatgtgtattcattgttcgtcacttcgtccttggtttccttctatcttatgcaggtatggattcaactggagaccccaaaacatttggctccttttatgaggaatttgacgttggtggatgtccaccgcattcatccaaactgtggcatcaattggacgctgtttcttttggaagcagcacctcttttgaagatacttagtatttcggtactgccttcgttcttcgttctcacttactagacaa

SEQ ID NO: 67571 - DNA, 1645 bp, Oryza sativa
ttcctgcacccccagttgcacgatatccacaaacaaaaatagagagggatttggtaaagaaagccataaatgagggaataacatcacctatcaaaagcatccagttttttcacacatccgaagctggaactatcaacatcattgactgaccggtcttaaattgttttgtattatgttgcgagtttagtatggctgcaattgcaagttgtgcaatggttaccaaagaaacggcttcagtcaacagtagatttgatactcatgttcctgatatagtaatgtatatcattaatatataaaattcagtcttcttttcaaccttttcactatagttatatttgaaagtttttcacttaaaaaactatcgaatgtactcccaaaagaaaagctgtgaggctgttatgcatgtatatgtatagtgcaaagtaacgctgatggcctgaaatagtttgtgtgaatgcaaaatgtaaattgacaaaacatgagccagtagcccagaacatacatcctcgatgaatggcatggcatggtatgccaacctctcagattatatatgtcttatatgatatccttttgattcagaaaagaattagattaggatggattcttgtcatggttgattttatgagttaatttttgttccctgagtaaaaaactgttccttctccttttggtcactaaaaaaaaactcgaatattagggaaggacataatatcaaataattagaaggggtgaggctttgaacccaggtcgtctagcccaccaccttgtggagctagccggaagacccctgagcatttctcactccttttggtcactaactgttccctctcggcctctcctgtcatggttggtgttatttgttttggaatttgtatctatgggagaagcatttgtcttctgtattgagatttcatttgtatccagctgatttggtcacctcatgagtaggatcagcaccctttgaaggctctgcgagctgatacagtgttcaccctttgcacctgtcgaaaatcacgtacaccactttaggggcttgcattgtcctttgcatgctttttaatcacaggaaaacaaaacagtttgtttttcaaagctttaggcttgcttggaagcctgggtttagcttaaaaccagtgtaaaagtatctgccagtttttatttttagttggaaaagtgataggatgggctgtttatggaaaataaaaaatccctagcccacaaaaaaaatcgaacaaaagtcaggctttctcgcaccgaggtttgtcgagctggtatgagcccagcctcttgctccgctctgtcttcgttcctgtctcaatcgatttatttggagtaattttacggtccttgagaggtatcggaaggtaccaatatttttagtataaattttgatacctcctaacaaaagatgtcaaattttagacttaaaaaaatatggtaccttgtgataccttttcaaggacagtaaatttactcatctatctgatgccgccagcggccagggcatgatcgacccacacttccgccgccttggatggcatgtctgaaatgaaatttgtattatgaaaattaaatcttgagctctgaaaattccaagaaatttccaaagaatactttatgccatcaagaatatatttaaaaaaat

SEQ ID NO: 67572 - DNA, 3288 bp, Oryza sativa
tccactcccaattttgttggagctcaaactgtttggctccaattttggtggagctgaaactgtttggctgagctccagctccaggaggggtggagttggagctgaagctgtgccaaataggcccttagtgaggtgcaaagtgtgtgacggaaatataaacccaagtagatatatactccctccgtctcataatataagggattttgattttttgtttgcactgtttgaccgctcgtcttattcaaaaaattttggaattattatttattttttttggtacttactttagtatccagagtactttaagcacaatttttcgggttttatatttgcacaattttttttaataagacgagtggtcaaacagtacaatcaaaaactcaaaatcccttatattataggacggagggagtatatgacacggcattcacacaacaaaaaaaaataaaataacattacactacaaaactatgaacatcacgcacttcgcaaaatggaggttccctgttttctggtctcgatggaaaatccctgctgaatgcaggtatacttcagagttcagacctcggtgtagctacagcaatcaacccaaaagaaaaacataaattgttatggctcagaaaaaggtactacttcagaaattgtaaaagtgactaggaagaaaatgtaaaataaatctcataatagcaaggggcaagaatttaaaaacagattgactagggagcttttggcctagtaggaagtcttcacttcgcgtttagatgcttgccttaaagagtttgccataagaagttcaaatgccaacttcatgcaaatctccttgcattaatagtagagcattgaattgattacagaatattatttcagtatttgtaagcaaaaacaccacagagaagcagagtaccaaagcttctatcaggcacattgaggctttttttttcgaggggacaggttgggagtttctgcaattcactatagaagaagagagttgattcagtttataagtaaaaacggacaaaaaccttataacagcacggttaattaatggaaaaccggtgagaaccatgacattgacatacttaacctaagaacaacagcccactaagggaaaaaaaactcctaaacgaagtcttcaagaacgttgcgtcgacagaatagcgacatcgtccgatcctaacaaatctaggttttcacctggagaatttccttgcagtggagttgaacgaggggtccaatagcaatgcctcaagaaggtgaacggcgccgagggcgtccccgttgctagcaccggaagtggagcaaggctttcgcctcggagtccccatcaaccatagcatccacagcaaaagccaccagatgtcacctacatatcgaagatcacaacaaccggactccatgccacccctgacctgactaatgacgcgtcggatctgaacctagagccagatctagccgtcctcctcaccaccaccgcctgctgacgccacagcgccaccaccagcgtgggagcaccacaaacgccagcgccagacgtggggcaggccgcttgcagcaccgtccaacgccgcgccgccggcggatccgcggactccaccaccgccgtcgccatccccgccgccatcggccgcatccctgctcggcgttgctcaccccgaccgtcgccatccccgctgccatcgccatccccgtcgccagccgccgccccgcaagattcgatcggagcggtacggatctggtggtcattgccgtcgccgccctgggcgggtcccctgtccgcctgagcgctagaagcaagaagccccgctgccgcaaggagagggggcggccgggtcgtcgcctcgcgagtggcctttgggggagagcaacacgataggtttttcccaggcacattgaagctgaccgcagttttgttcactattcgccattgttttgactaaggccagcttctgtgaagcagtacattgcccaaggaggtggccgcggcaatgagcttgtggcacagggtcgacatgatgggaggaacatttcgagtagacttccagcggtatatggaggaacgggtgagacgtagggtttcagaaccatagtcattgcacaatatgagttatcaacgcgatacgttatgcgagatggctacacaaatcagtctactttataaatatttatactaaaatgcattttttttaacgacatttatccaaattttatttggtttcatcaataaccataataactattacacagcttgcgatttacacaacttgcgactatgagcatatggtactaaacttgcaacaaatacaaactgtttaggactagttaatcgatagtcttcactgttccagcttcagatgtgtgaaaaaactgaatcctttcgataggcgatgttcttccctcgttgattgctttctttaccaaatctctctctttcttggtccgtggatatcgtgtaactggataataggacttgcacacctcacacctatcatcgtgcaataatatgtcttccaaattcactgccctttttatgacttgtttatgtactccatgcatttttttccaggttgaaagccataaaatatgagcatggtcaaactgtagtgcttgaaatcagacggttcccagtatatgttgtttttctcacataaagttctctttagcagttctccctcaattggtttacattgatggtccgtcacctacataaagatcagatttagattttagtgttcaataacacaaaagttcagagaagcatcaacagtgaatatatactccatctcgttataaatatttgatgtttatgacaagccaaaatattggctataaatagatttaagctaaatgtacacaagccattttttctttttaaataaagtatttgagaagttattagtggtaaaaatttcgggagttgaataaaatctcatcctaaactttaaatatttatgactatagggtgtattaaataactgtcgggtaaacgagaatgaagaatgaatgtagtaccttaatactgagcatcttcaaaagaggtgccgcttccaaaagaaacagtgtccaagtgatgccgctgtttggatgaatacggtgcacaccaacaaacgtcaaattatttaaaagaggagccaatcgtgttggggtctcaggtagaatccatatctgcataagataaaagaaaacaagactagcaataaatacaaattctcgtgtgaaggtttgctaccaatattagcggtgcttcgattgacttaccttttctctttcaaagttcaaccacagttcacg

SEQ ID NO: 67573 - DNA, 9022 bp, Oryza sativa
cctccagctcgacggtgtcacaggtgcagaactcgagcttcaccacgcggaggtgctcgtggtggatcgtcagcggtgtctcctcaccgaagtcgcagtagacgagtgagaggtagctgagcttctcgcacgcggtgatcacgttggagaagcatggtccttgcaccgtgatgcactccagatgtaggctggtgaggccggcgaacacgtgcgggtaggcgtcgaagcagtacagaaggcgcttcccttgcttgaccctgtccctgtccgggcactccaggtaacacttctccgacacgacgtcaaaacacattttgaggatcctgcggccacgggccatggcgtcgtcgatggcgtggatgatgccgacggactcgtccctcgagaagaagctcaggtccagacggcggatgtcgtgccggctctcgtgcgacaggaggctctgcaccgcgctcaccatcgcgtagctgttcctcgcgtcgtcggatagcgtggacgtgaagccgtcgtcgtggtcgggcgtgaacgagtcgacgtccagctcgatgttggggagcatgccggggacgcgcctccaccgcctcgagaggacgctgcatctcaaggcctcccgtgtgtccagcttgttcaggatgacgagcagggcctcatccggcaaatcgctcaggctcatcgtgccttgtcctctgaaggcctgaactgcagcaggggtacttatgttctttgggagcaagagggaacggacgacctacggcgcgataatgtgtttctgaacaggaaaacctgcccgtacctcctatttgtctgtgacgctgccgctgcgtagtcgtttgactcgtttccgattccaactccaacatccgactccgacgctggctgcttaggcctgccacggtaaggcccatgtccttcgaaaataaaaataggaaaaattgaaaccatgccattataattttataaaatttgagatataccatcctgacccacatgtcattgactcatgtggatgctacatgtcattgagataccgatgacatatctcaaactttgcaaaattataatggcatggttccaaattaccctcgaaaatatgcccgaatactgtttgtcgtcgactgtcgccagctatggccggttctccatgggcatatccatggctgctgcctcgcgttggcggagcgagacgcaaatctgagcttgtcatgttatgcttgcggattggaagttttgaacctcctctggccatttccgttgacgttgagcacgcacactcgatgttcctctctatcctctccttggtcgtttcggctcccatatttctctccaatcgctatccaccatagccttcggagttagtgtctgcagcgtggggtagggagtacatcagtggcggcagtggaatcggttcctgttcctctctgatcctctccttggtcgtttcggctccgatattcctctccgatcgctatccaccatagccttcggagctagtgtctgcagcatggggtagggagtatatcggtggtagcagtggaaccagatcctcttctaagtcagagacgttcgaccacgtatcgtcgttccttgcacatccgatggcaatgaaaaggaaaccgacgcttctagcctagtgttggatgaatgtcacgactttgaatgtaatgaggtgaaaaccctctaatttttaagcaaccatagaacatataggtttgaatgtaatgacacatctttgatgctaaatcattaagttatttaaaatatattgttggtcaaaagacatggtaactcaaagtcaaaaccgaagtttttttaaatgaaaacaatagtttactatataattaaaagtagtttattatgtaattggtgacgatgtagaattaatcataagctgaacgtcatataaacaactccagaagaaaaacatacatatctactactgtactgttgagtgcagtcctttcttttgcaacatagtacaaaattgtttatgaccaatcaatcaatgattttgatagttctagcttctgatgtgtgaaaaaattgaatacttttgataggggacgttcttccctcattgatagctctctttaccaaatccctctcttttttagtatgtggatatcgtgtaattggataataagattcgcaaatctcacacctatcatcgtgcaatgatatttcatccaaattcactgctgccttcatgacccttcttatgtagctcatgaatctattttcaggtcgaaagccataaatgatgagcttcgtcaaattgttgtgcttgaaattagatggttcccaatttatattgtttttctcgcaaatgaacattctctctagcagctcttcctcaaggggcacacagtgatggtccgttacctacataaagatagcacattttagtgtttaacataaaaaaagaaggaccaaagtgaatatatacactccctccaattataaatacttgatgtcaatcataagattattttttttgaaactttgtctattgattttatgttagcataagtttatggtagtatgataatacttctatgccaaatctacacaccatttttctcccttttaaactaagcatttgagaagatattggtgacaaattatttgaatgttctttttgaaaagttgtattttcaattacgtgataatgaataatgaaaatagtaccataatactaagaatcttcaagagaggtgccgcttccaaaagaaaaagtgtccaaatgatgccactatttggatgaatgcggttgacatccataaacgtcaaaattccttaaaataggagctaaatgtgtcggggtctctggctgaatccatatctgcaaaagataaaaagaaacaagaaccaaggataaatacgaattgttgtgacctcccttcaaagattcgataccagtattagctatgcttgtattgacttactttttcgcattcgaagtccaaccacagttcgcgaaggcttgtacaattgtcaagtagcttgctcaaccggagcactttggaatgaactaaaccggcatgagttagctctagccgctggagccgaggagcatggccaaacaccagcggatactgacgcggcgaccaaaaccagacggacatcgacagctccgataacttcgggagccactcaagctcgacggtgtcacatgtgcagaactcgaggtttatcatgctgagctgctcgtgttggatcgttagcgccgtctcctttccaaagttgcagcggacaagggagaggtcgatgagcttctcgcaggcggtgatcacgtcggagaagcggggtccttgcacggtgacgcactccaggtgcaggctggtgaggccagcaaacacgcgtggatagcggtcgaagcagtgaagaaggcgcctcccttgcttgaccctgtcactgtccgggcattccatatatgacttctctgacaagacgtcgaaccgcaggtcgaggattctgcggccgcgggccatggcgtcgtcgatggcgtggatgatcccgacggactcgtccctcgagaagaagctcaggtccagacggcggatgtcgtgccggctctcgtgcgacaggaggctctgcaccgcgctcaccatcgcgtagttgttcctcgcggcgtcggatagcgtggacgtgaagccgtcgtcgtggtcgggcgtgaacgagtcgacgtccagctcgatgttggggagcatgccggggacgcgtctccaccgcctcgagaggacgctgcatctcacggcctcccgtgtgtccagcttgttcaggatgacgagcagggcctcgtccggcagatcgctcaggctcatcgtgttgtcttgtcgtcgctggcgttggttacttgcttttgcaccgtgaatgcccacaggccacagcccaccgtctcaaggcctgaacagcagcaggaaacctgcttgtctgtagttctgatttctgaaccgaaaccaaacctgcggcgagccggcgagagcaagtgcccttgtcacactgtatttatctgcgacgctaccgctggccgcggcgtactcgtttccgactacagtcctactgacctactccctctatttcaggttacaacacgttttgactttagtcaaaatcaaactactataaattcgattaattttgtagaaaaaatagcaatatttttaacacaagacaaatatataatgaaaaatttatttaattatagatttaacaaaatgttgtaaatattactattttttttctacagagttagttaaattttaagtagtttgactttgactaaagttaaagcgtcgtttaacctttaaacggaatttaaacggaggggaaaaagtacacccaaggtccctcaacttgtcatcgggataaaaaacgtcctcaaaccacaaaaccagatatacggggtcccttaattatataaaaccggtcaccggaggtccttcggtggttttgaacctggttttatccgacgtggcggctaaattagcgcaggaccccgtgggccccacatgtcagctggccacgtcatcaaactcctctctcttttcccctcttctctctcttcctcatctctctcccttctctgccgccggcagtgcctcggcggcgggcatcggcggtgatggcggcggcggtggggggagcggcgtacgggctccccgccggtcgccgtccacgcatagctcctccccccgcagcttgcgcccaccgcctgcggtgcgccgccgcctccccgtcggcgaggacgcggtgcttgaggttggatatgtcgaagcagcagaggaagcatgtaggcttggtgcagctggggatgtagtcgcggagcatgtcagcgacgccgcggtagcggcggaacgcgaggagagagcacgcccggagctcgagagcggcctccatgcgcggcgacaactctagcactgcttccactagtccaagcgccgtcgtggccgctgagtggtcgccacattccccattgagcggcgcggcggcagcgaaagcagcccgtgcctcaatgaggtagtcgccgatgatctgctgcacaatgcagagcaccaacaaatcagttgctgaagccaaaggcaaaggcaaatctaaattgggagcaaaaccgcccaaattgccatcattttttgtggcacattagatgaagaattaaagagggagcaagaaacaacctttcggtgtccgcggagccaaatccttctcttgtcaggaggggaagaagacggcgaggacaccgtcgccgaccaccgccgttcgtccgcaagccggctgtcgacgagatgtccccgcgcagcctcgcacacctgcagtgcctcctcacgctcgggctccatcgccgacgagtggcggctgggacgggctactcgacccgctcgaccagaacctccgccgcgaggtcctccgctacggcgacttcgtgcaggccgcatacacagcgttccattccatgctgtcggcggcggcggcgtcgcagcacatctcgggtgggcgcaccggacgctcgtgctccccgacctgcggcggcgtcgcagcacagccagaagggagagagagatgaggaagagagagaagaggggaaaagagagaggagtttgatgacgtggccagctgacatgtggggcccacgtgggtcccgcgccgactcagccgccacgtcggataaaaccggattcagaaccaccgaaggacctcggtgaccggttttgtataattaagggaccccgtatatctggttttgtggttcgaggatgtttttttatccccatgacaagttgagggaccttcggtgtactttttccaatggagggagtagtatccaaccccagcgtccgactccgactcccgcttgcacgcgttcgtcacggcccgttgaggcccaactaagtccaagatgggccgtcggcccacggtgcgaacgccggcgccaccgttgtccctgctgctccccacgagggttttaggcacgcctccgcctccgcctccgcctccggcagcaagtgagcgcggggagagagacagaagccggcggcggcggggcgagatggggaagaagcagaagaagcccaggaaggggaaggagaagacggagcggaagacggccaagggcgaggagaagcgcgcccgccgcgaggcccggaaggtcggcgaggaggacgacatcgacgccatcctcgtacgtgtgctccctccctcccgcccccctcctctgcgtcagctcttcacgctcgctcagtgcgctctagctcgatcggcgtctccatgtgcggttttgtttgctcaccaccaccttctgcgtctcgtgatgcactccggtggctgaaaaattggaagcgattttcgcactggctcacctttttcccttcacatttcgttgcgtagcagctatggattttagatgagtttggtgttgctatgtgtgctgtttgaactttttttttttgctgatttatctatttgctctggttatttttcattgcagaggagcatacaaaaggaggaggctaagaagaaggaggtacatatagatgagaatgtccctgcaccatctccccggtccaattgctcggtaagacattttagagcaagtgccagctaaagaagttaatctttcggtattcttgtgattatgtacttgaagtggactaggtatcatttttatgcttgtggtggtcatgtttgcatgcttagaatttatatactccagtaggattaataaatttcttcaggcaagatggatttttttatgaagtaatttgatcaaatatgatgatcttttggtgatactgaaccgattggtttttcagttccggataggtgatgtcaaattacaattcaggggcaaaatgtgttaaaagatagatgttcgttttgtttttttttttgttaactgttggaaaaagtttttgatgttgtacagagatcctccctctaaatgttaactataacaaataaacctgcatatgatcttccagctgaccaagttaattccttcttaaatgcagcttacaataaatcccctgaaagatacagaattggttctgtatggaggagagttctacaatggcagcaaggtgggagacatatccttcacgatttcactgctggttgaatgagatatgttcatctagtgttctttttgcctctattctgcttctagaggtttttgagtactgaaatagtatttcttttcctcgccacaatctatttctgcagacctttgtttatggtgatctttatcgctacgatgtagagaaaaatgagtggaagttggtatctagtcctaacagtcctcctccacgaagtgctcaccaaacagttgcctggaagaataatatatacatgtttggtaacataacttaactttgggaaggcattctatgagttaaaatgctttttcagtatgtatgatttagttttttattctgtgttgatgtttcaggtggggaattcacttcgccaaaccaagaacgttttcatcattacaaggtagaagactaattttgtcagtctatttcttgtgactgttttgagtatcttctcttggcacaaggcatttgcacaattcgtatataagcagtagcttcataagcaatacatatctggcatgattttttttcaattttaaaccaagagataggtactgattcccatgttcctacataattataagttgaaatatgactaatggagactaatatgtgcagttcttctgctatttattgatttaagattaagatgtagaggatgcggggttcacctgcccttttatttggatttgcacatataacatcactttttattcgctgattgcctttttttttcctttctgttgtgatattaatggggttatttcgagattagctatcttagatggaaaactcattattatggttctattcaaatttctggtctgattttgtactgtaggacttttggtcattggatctaaaaacaaatcaatgggagcaaattcttgcgaagggttgtccaagtgcacgttcagggcacaggatggttagtggttttacattaaaatcagtcatcaactattctgctcccctcttttcaccttaatatttctgtattatgagcagtagtaaattgtgttctttttcctacaggtcctctataagcacaagatcgtgctatttggtggtttttatgacactcttagggaagtgaggttagtacagttacattttatatgactctaccctggtaatcttgttattagagtaacatttatatttggaccatgtctagaagtagtggagtcattatgtccaaactacaaattatgcactacctgaataacagtgtagcactcttacagctgatcatccgcaaagaatgaaatggtgtggcgtagagtacgttctgaataaatagtgtgacatgacatgatctgatctgcattttttttataatatccttctgcagatactacaatgacttacatgtttttgatttagataatttcaaggtgagtacaccatgttaatattttgtttaatactgttagtagtaacacatgaagtcatttattttaatactcttactgggaatatttgtatttcagtgggaggagatcaagcctcgccctgggtgcttgtggccaagtccaagaagtggctttcagctaatggtataccaagatcaggtaggtctttttggatttaaagctaggacattgatacttcataaaaagagtttaaattaactataaaccaaccttgtcttcgactacttttgtttacaagagtattaatggcccttatttctgtagatatatctgtatggcggatattttaaagaagtagtttcttctgacaaatctgcatcagaaaaaggaacagttcatgcagatatgtggactcttgatcctcgtacttgggagtggaataaggtgatctcttgcaattttttagaacattgtatcaacttccatcatgatagtgtatcgagttttactttaagccatatatccactgagtgatttgcatattagggctgcaggaat

SEQ ID NO: 67574 - DNA, 1284 bp, Oryza sativa
acgaatgcacgcacgtaataaaggtacatgggctccctaaaaacagacacaatttatgaaagtatagaagaagtatggaaattaaaataaaggaaaattcacggcatgaactttgctatagtttggatattctcaaagatagatacaacaagaattcaaaaaaaaaagaattcacaattcatgacaataaacaacagtgtcaagttatacataaagagtaaattaggatttattatgtaaaagtactaatattaatagatttatcatgaaaaatgctttcatatatagttatatgttagtaactttttatacaacataaagttagaaaaagtaataagggaacatgtgtttttggagactgtgtttgtgtctaaaatgtaagtaaaagagaatggagataataacattcagttccatctactttgtaaatttcggcggtgccagccagcattaattaatgaacccatagcattgaattggcacaacaagaaaaaggagaagtctttcaatggtcaagatgcttttgggcggagataccacacatctaataatgattaaagattgaagggctaacctcatgtagcactggtacatgcttaatttaccgctaaatatacccacgtgtgcatgttctacactactatagatcctgctattgttggtggcctatttattattggtggcctatttgttatggatcaatacaacacatcacagaaacctttatctctaacatgtagaacattagcccgcttaagattatattgtccggaacaacctgccacaaatcgaggttatatgtgatatagtaattgtagcccgtcacggatcatttatgataggtcataacgacaacccgttatggatgatcccacacctttaacagtctattaacccatcactgataagagtgacgggtacccgatagaaataacaaatcatccctaacgagtttgttttttaacccatcaccaatgtggaaaaaccgattgagcggtcaattgcatgtcatccacacataaaagatcttcaagatatctctcttgctagctagtcagcctctcccttcttgttgctatctcccaccttcaccgtcagcaccaactccaactccaccagccatgccggcaccagctcgatctcgaccggccactgcagcctctagatctgagagttcaggccgctagcctcctcctagggtcaaatatgaagaacaccgtttaagcgtaatagcagatcaaccaacaaaactaatgttggactataataatggattaaatgtta

SEQ ID NO: 67575 - DNA, 3123 bp, Oryza sativa
ctgttctttcgtctctgcgtttttacccaaaagaaaatcaaatttgactaaaacttgtaataattgagcaaatcacaattgcatgcaagaacatggtgtaccgtacccggacaatccggccggacgaacgtgctcccatgtgcttgtaaatgtatgattatttaattttgatttaattactgtattaatcaattttgattatgtgtgatgcagggcttggacccgaagtcgacggccgacctgttctcgagcgcggcgtgggtgggcgagaggtgcgtcgacggcgacgactgcttcgtgctccgcgtcgacgccgaccacgccgcgctgcgcgcccggagcagcggcgacgtcgaggtggtccggcacgccgtgctcggctacttcagccagaggacggggctgctcgtccgcctcgaggacagccacctgctgcgcatcggcctcgcccacgccgccgccgagagcgcctactgggagaccaccatggagtcctccatcggcgactaccgcgccgtcgacggcatcaacatcgcgcacgccggccgcaccgccgtgtcgctgtcccggttcgagagcgccgacgacgccgccgccgccgcgcgcggtagtaataagcggtcgtggggcaccaccaccatggaggagacgtggagcatcgaggaggtggacttcaacgtcgtggggctctccatggattgcttcctgcctccccgggacctagtgctcaacgactgcagcaagcagcagcagaaagaggacgccgccgccgccgtcgtcgtcaaggacgccgccgccgccgtcgacgtcaaggacgccgccggtgccgccgcgaacgccaagggcggtagtgacgacggcaagaccaacggcggtgacgtcggccgcggcgtggtggtgaagaaggcgcttgttccggcggtgaccggactgggttggttcggtccggccaaggtggttgccgtcgacgacacggtggacgacggcgtcgccgccgcagccgacgacgacaagtaaatgtagatatctctcggctactcgctagatcaggtggtgctcgcttctgcgcccctcaagagtaaatattaattcgtatagtttaagttaatttctactacttaggaacatgcaagcttgatcatgttatatgttagatctagcaactgcattccattgtagatgttgggggaggagactaagtttatgttcttctccattcgagtttgaggacattttgcgtagtgtccggccggtgcttcattcatgatgtaatttaatactttggaaacaaacatccaaaggaaactttgtgtatccattttgttaagaacgacatgggggcttcagttccaggtccattcatcagaaactaaagttattaccgccaacgacgaaaagctccaaaattttgacaaattgacttgtttataaaaaattattttaaaaataaaacgtaaaaaaataatttcagaaatagatcatgacctcaacgacaattttgtgctgagctaaatgtctcaactccaccactattgatgttgagatctcatgatcttgtccgacgtgacataaatctgcaaggacacgggagctcagcataagtgtgctggcggcatcgatcgatgtatggttcagcatcctccactatcctccgaatgcatatttacattttttgagttgatattaagatgcaagaaataatttgaaccacgtcaaaatgtgatcaccatcatggatctcaaaaggtacaatctggaacacatacacatacgcacacatccccctccaaacaaaaatatttacgtaccagattaaatcttagcctctacatctaaattagatgaatacaacaccaacccaaaaaatataaactatttcttagcttccaatgttccaatacaaacaacaagatatattacttcgctcaaccatgcgcaatcataagagtggagtgcattttccgtacaataaaataaattgagtgcctaaacttcaggcaccatttttcttgttctagctaggtgacaatccaataattctcaacacttctctattgctaatttaaaaaagtctattcgatttaaataaaaggtcaaaacaataaattattatgacataaaatgcaaagttatatgaaatgaacttacaattaataaaaataaaaaatacattaaaataggcttagataaagaaaaaattaaaccatatatttcaaaaaatgctaaaaaattatacattttaggtgcattaagtgtgaatcttttttggatgggtcaactagggtgtgtttggttgcctgtatgaggcctggcccacatctgtagatgcaattttcggtttttggttacctgcgtggccttcccagcctgccccgctcatgcaaaaaggcctccgtagccaggctgagtggaaacagtcaattcgagcttcacaactcagcttggcccgatggatgtaactggctgtatccgcgcgtgcaacggtaaagatggggtcagtttgcccctcctcatttctccccccaaatccaaaagctagggtttggtgccagcgtgccaccctcctccttgacactactcgtggacacatggcctagaaaagagagacgtacatgggctgatacaagtgcatatagatgtattttgtcgttctccatcatccgcacgatatataaaagttagagtaaaatgcttggagagggtcatctaacttatttagacgtgtcacataggtcactcttctaattttaaattgcacatctgaatcacgttagtgagtcaactgagtcatttagtcaactaactatcacatgaggacgccttgtatatatgacatgtcacctagaattgacaaaaatacatcatccgcagccgctgcctcttaggaattcgactccatttctgtttacatccatagtttatcattgccgtcgggtttgatggcaagtgagagaggactgagaactagcagaaaaactcatcaaaacagacacaagtgaaatgatttggttcctttcatttcttgttagtgttgtgacaaaaggggaaaagaacacacatgtggtttcctgcatgtccaaaagcaatttttccaataagggcacccacaatggttatctatagg

SEQ ID NO: 67576 - DNA, 877 bp, Oryza sativa
tgtctttgatgagaatgtttttccttttgcatccctccactctaatgccggtgcaagactacggtctgagattttattgctgccacctacacttctgaacccggatgatagtactggtaggggtacaacaataggagatgaccatatgcttgataatcctgaacatactaatacttttgctgaagaaaatgcagagaatacagatcatatagagctggatttcaacacagccacacaagatccggagttcacagaagatcatgatgatacgggcggagattctcccgctctgtcgtcgccctcgggatcgggagctgctgtcacgtcgccgtcatcgttgcctgtgattcctaaggctccggtgtctcctactgccagccattcagcgtcggccacgactccagatgctcccgaggcacatgattcagctacgtccgctgctgctggattttctacaccggtgcccacacggccggtcacacggctacagagaggaatacgcaaggaataactttatactgatggtacggtacgctattcgtttttagcagtaaatggtgaacctcaaaatctagatgaagcctgtctaacaaaaattgggaaagtgctatggatactgagttttctgccttgatgaataataaaacttggcatttagttccaccagaaaaagggaggaatattattgactgtaagtgggtgtataaaattaaaaggaagtctgatggcagtttggatagatacaaggctcgtttagttgcaaaggggtttgagcagagatatggaattgattacgaggatacttttagtccagttgtaaaggcagctacaattaggactatattgtctgttgcagtgtctagaggttggtctctta

SEQ ID NO: 67577 - DNA, 3297 bp, Oryza sativa
aaggtttgtcagttcttacatagtcctacaatgcaacattggatggcagtaaagagaattttgagatatgtaaagtcttctgtagatttgggtctgaagcttaatagttcatcttctactattataagcgctttttcagatgctgattgggctggatcagttgatgacagaagatcaactggtggtttcgctatctttcttgggtccaatttggtttcttggagtgcacgaagcagagtacgaagcagagtataagctacagtatcctgttctatacagaagcagagtacaaagcagtagctaatgctacagctgaggttatatggattcaaactttattgaaggaaatagatgttcaaacaccgcaagaagcatgtttgtggtgtgataatttggaagccatgtatctttcagttaatccggtttttcatgcaaggacaaagcacattgaagttgattatcattttgttagagaaagagtggctcaaaagcaattggttattaagtttattgcttctggagatcagattgcagatggatttactaagtctctttcagctcaacaattcaagaattttgtatacaatcttaacttagataagttatgattgaggggggctgttagagataaagtatggtttagatttgcataggcttagagataagtctagagtttgtttctcacatgaaacaatgttttatctcttgtaatcggatccaaactgattcaatcttgtaagccacgttgagggttcttctcaacaacatataaatattcatacgcggcctcgagacgaggtgagaacgcttacgcacttttacagtgttcgtgcgtgccggtcgacctcgcactgttggatatggagctcgaggagaagatggctgctagggcattgggcaagggcatcagcagcagcaacaatggctgcgaaggcggcggcgacgagcccaaggcggcgtgggagatcgacctctcgaggctgcgtatccgccagggcgctcccgtcaagcacggcttccgcggctcgctgttccgcgcggactacgatggccgcgacgtcgccgtgaagctcctcgactgggggaaggaggggttctcgacgcccgagcagatcgcccacctgcgcgcgtcgctcaggggcgtggccgaagcctggcacaagatcgaccaccccaacatcaccaagttcgtcggcgcatccatggccaccgccgacctcaacatcccacaaggccagagcaccgcgccgccgctgccgccgccgccaccggacacaccatgctgcgtcgtggtcgagtacctcaccggagggactctgaagagctatctcatcaagcacatggagcgcaagctcgcctacaaggacgcgtccgcttcgcgctgtcaatggcgagagggctgagctacctgcactcgaggaagatcgtgcaccgcgacgtcaagaccgacaacatgctcctcgacggcgagctcaacctcaagatagccgacttcggggtggcgcgcatcgaggcgtcggacccgagggagatgaccggggtgatgtggacgctgggctacatggccccgaggtgctcgtcggggagccgtacaaccgcaagtgcgacgtgtacagcttcgggatctgcctgtgggagatctactgctgcgagatgccgttcatggacctcagcctggccgacgtctcgtcggcggtcgtccacaaggacctgcggccggagatcccgcggtgctgcccgcgcgacatggcgctcatcatgcggcgttgctggcacgccaacccggcggcgcggccggagatggaggaggtggtggggatgctggaggcgctggacatgaagaaaggccgtggcatggtgccattaggggagaccgccggttgcttctgcatctccctcaggcgccgtggatcatatatcactggtggagaaaccctttgtagtcccggttcgtaacccccctttagtcccggtttccaaaccgggagtaccaatcagggactaaagatcgagctgaccttttttttttttgcatggccctgttgctgcatggtttatatatatatatatatatataaaccatgcatatatatgtttcaatacatatatatgcatacatatatatatgtatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccccgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtattcacaggaaatttgaacttccgcctaagtctttctctccatttgccgcggaccaaatgacggaaccgataccaagccctacatagagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacaatatgaacgtcttgtaatgctgcgccttcaggagatggacgagattgtcctctgtttcttgtggatattggtcgagcattgcgacgtttactttccgagggtcgatgaatccagtatcgaaaaccctcc

SEQ ID NO: 67578 - DNA, 9842 bp, Oryza sativa
cggctcgatctcctggtttggttgctctccaagctgagggactggtttggactttccagaagatgctttcttcagcgttcgctcatagtccgatagcttgatggcctccttgacagatgcagacatacccctgaagaagttcgtgacactagggtctatacgaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagaggagcttgcgggggagtaggtgtaggagcacgaggaggagtcggtgcaggatcctgaggaggagttgatgctggagcctgaggtggagacggtgctggcggagcatgaggaggaaacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtatgcgccttcgaccaactcaacttcgaccttcgagtatcctgctggaatcggcctgcagtggtaagtacctgaagggtccgttgggatggccatgcccgacaccaccttcatgttgtgagagattatttattagtaatcaacatatataagcagcaactagcggaatggctaaatcttacctttattgataagttcttgaaaggaatatgcagctcacatggtatccgctaagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgcccctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttcttttcatcatcgcctgcccttgttcacctgtcttatatgcaacgaactcgtcccagtgatcccttagctttgggaatgtgtcgaagttcggtgtctgccccttcagtatatacttctggtacagatctcccttgaagctctaaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccctactgacaggcacgttatcccgcacaacccaaccgctgtgacgtacatagttcttggcggcttcggccggggcactaggacgtccatcttcttgcacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatctgtcacgaccggaaatcacccaacgggcgttccttacgtgcgtgcattaatccttgtcccaggaggcaaggtacaccaaaagttgatacaattcagagtttaacaagcggaagcgtaaatagttaatttattacatgggcagcgaaggccgagcacacacagagacaaacgagaaacagcggaagactagggcgacgaccacaggcacttgacggcaggcacgagctagacaccaaagccttcatcctccaggaactcctcttctgggtttgggaaaaattgagcaagactgagtacaaccaccgtactcaacaagacacacccacaagtgcaggataaatgcaagggagtacaaaggagttacactataaagggttagggttgcagtaaacagcatttaaagacattagttgctcaaagctattttgtaaacgcgattctagaactaaacaatattatttatcaaggccggtgaacccacacgaacctgccttaacccaaggcgtacgatgattcagaccgaactggcaacccgaccgtgggtcccagctcgtcccaagccaactcaggccaaccattccacattttagttgttaagcaggttttaagaattaaaacactacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccaacccaatcccacctacggccggaacacccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagagggggcggtgtgaatccaattccacaataaccaaaccattccatggtgtccaggtgatatgaatattcccaaagtctagagttgtaaaaccgcctaatgttacctaattaaaagcgaagcatctacctaaaatcatactagtgggaccatgagtagagtgtccactagttggggttttgtttatgctagggtgaacaaggaaataataacaataacaataataaggtcataacaaaggtaaatgggcatggctaaataaaacagtgataacgcgggaatttaaataaagcgataatgcaataatttgaatcaacataattttataaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaatttaaaatcggatttattgtgtcagccgggagagaggagcgcgcggaccgggtccacgggagtggggcccactcggcagcctctcggtccacggtggaccgggtgcacgcggcttacgccggccggcgccgtgggtcccacgcgtcaaccgtaccgagggcgcggccggctgacggccgggccccacatggcagccgcggggcgcgcccgaaggcggcctcgccggcacggccgacggggaggcggcgcgcccgcgccccgatggtcgccggcggcgaccaccagcgcggcggagcggcgcccgagagaggggagggaagggggaagtgaaacggcggtccacggctcaccccgggtcgacggcgacgacggaaacggcgaccggagtggaggaaggcggcggcgcggctcgggtagacgaggacggcggcgttccggcggtcggtgagcgaaacggaggggtggacgaggtcggcgaggtcgcggcgaacccgaagaaggcgatgccgaagcgggagaaggtccggggcgacgacggcggcgaaccggagctcggcggcgacggcggagagggaggacgacggcgcgagctcgattccgacggggagagagagcggcgagtggcggaaaaggaggagggaggcacggggagtgtttaaatagcgttgggagggggagagagcggccggatgagggggaatcggccgcggaagatccggccgccattgatgcgccggcgaagtttgcgggagtgtttccaaacgaatccgagggagagtgtcacgcccgaaaattcacaagtaatttccgaacttatttgtgcataaaatcctcgtccaggaatcagccgaggtacacaaactgacaatttaatatacagattcatcaaattaactaaaacgataaatacttacttatgaggcacttagtcctcatcaagaagaaaactgcagcggaaaataaaatctagcgaagctccagctccactcccacaggcagctcaactggggtataagccaaacgtcttctccttctggatcatttttcttcaactgaggttgattgattattgcaaggtgagcatatgacatactcagcaagccacacagcaaatatgcaagtgcacaaggataccaaaggatggcataatataggctcatttgcaaaagcagcatttagcaaaacatttaagagaagtaaaacagtggagtaattaatcaggaattttaatcaacactgaacagcacacccatgctgcacaggcccgaccatcctgaacaaccatacccggctgtacagatctaatctccaaaccaggaattatccattccaaaccaggagctaagcaaattattaccagttataacatccataattattgtgagaggtgtgggactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataatacaactcaccacagtgcaccattcctggatcataatcacccccttataaaacaaggcatggactccccagcgacccccgtgggcttatctccgccacttctcagtctggtgccccgcaatgaaccatgctatacaaaagataaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccttaagtgatagtgaaacattagttatcccaattgtgtgctaatgtttctaagcatagctaagcaataatatctaatatctagttgaaccaatatatataaagctcaactagtcaaattataatatcccaaggtatcaaggaatagagtaatcaatgcaaacaggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttctgaatacttccggcgcactcgcgaaccttcgcaacgacggaaacgacaagctaacacgcaaaacgaggaaaaagactaataaaaaccaaataaacaatacataaaaagtaaacaaacatgtagatcataattttagatgaattatgagacttgaacggcctcattctgatttcatatgaatttattatgaattttacaagatttaattccaattaaacctattaaacgaagactattcccaattaattaaatcatttacaaatgatttataacggagagaaaagattaaagcaacctccggaaaagattagattatattggtagatgacatatgataaaaagaaaaaggactaatatgccattgaaaagatagaacgaatttatattgattttggacggctgagattaaccttgaccgagtcgactaagatcggatggcttggattgatctggcaagcaagcctcacgagataccgactcaacgagtcaactccacgtgacatgagatcacctaaatgatcaaccgaaaccggcgaacagaaccggcggctctgtacggctctaaactaaaggacgactcaacacggacgaatgaacgaagcacggggaacacctcgttcgaacgaacgagcgaacgactcaacaacggttgtggttaaaccggtcggctagacacgattcacggtaaagccctggtacgacaaacgataggccggtaggaacctagggatgcacctacggctagacaacttggctaccgagcaacggctaaagcggcggctaggtttaaacggcacacagctgcgacacggcggcactaagacaacttgactcggctaggtggcggctaggcggaaacacgcagctagggttagggtgacggcacagccagtagcgaccatgcacggctagagcagcagggctgcgagcaaaaacgcaaccggcacggctgcggctgtggcaaagcggcaagcagctgcagctaagcggctcagccggcacacgcgcagcagcggcacggcaagcagctacgacacaacgacgacgacacacacggagacgatgatgacgctagggccaaacaagattagattagatcggattaaggccctagggaaaacctcacaggtgaacggcaaaggagcggcggttgccggcgaaccacggcacaaacgcaaacggagggcaccgggagcgagaggggatcaaagtgacccttaccaccacttatgcgacgacagacggcgagggagatggcaggcgacgagctccaaaggcggcgaccttgggttgacgatggcgacggctttccggcgacgagaggcaacaaccgaggggcggacggtcttcacctcgctcctgcgatcccgagggtggtgacggtgaatgaaggcggcgatggacggcgacgaacggcgcggctgaagatggaacggatcggcttcacggtgacgacgggcttcccggggtcttcgacgacggggaagtggaggccggtcttcttctcctcctcgcgaacccaacggcggcagcggcgaccgaaggcgacgaccacagcgacggcgcggggctgctggagcggcggccggaggtggagagaaagggagagcgtggggagagggtttcgggcggcggcagaagaaggaggaggtggcggccgaaagaggagaggctgggggctctatatatagccatgggaggccgggatcgagcccacatcgacgggaaaaactcggaaagtttatcttcgccggaaaaaggaaaggatttgatccgcgaaattggaaaggatttccatagaaacttttggggatttcttggggaaaaggaagaggagattgagaggattccattcccgcaaccaatttggaaagaggagcaacggggaggtcggattttggaagggaatcggcggcactgtgcacgagcacggctggctcggctctgactggaggaggaagatggagtactgtagcaccagggaggttaaacagactttggctgggctgacaggaagggagagaggagaggagggaatgggctggattcggcccaagactaggaaggaggatttttattacttttccaaataaattaaccaatgagatgatctttcaattgttaaaaatacttcaatgctcaaataattccaagaaaaatcttgaacatacttggacactcaaagtatttaatataataatatccagatcatttaatgattaatttattttttaaataattgctaaactgttctttgtatcatttaggaattgagctctgaaaaatccgagaaaatttcagagagttgacttaatcatggagaatttaataaaaaattaaatccatccatgctttatatttaggacattttatttcccacatttaacttcacttgtagattaaagatcatgtaatatccattctattaatgattgactaaatagatttatacatcctgaagcgaaaatcaggatgtgacagagagagagagaaaagtggggggaaagggagagggaatcacggggagtgatttccccctctttattgcgtgcgggggcggcgggatgcggcggaatccgcggcggcggcggcgctagggcacgggcgaggcggcgggtgcggcgcgaggtaggggatgacgggtgggccccacccgtcagcgagggtggcgggcgggcccgcccgtcagcggcgcgcgcgcggggaggaggccgatgggccgcgggggagaggagagagagggagggaggtgggccgagccggcccaagagggaaagggggggaaaggacttttttgaaacctttttaactttgtttatttcttcttaattattatttgtgctctgaaaattccactaaaatttatttacgcattttaggcttttaggaaatatacaaaaatcctccaagccttatttgacttttaaatttgcacattttaattgttggaggctttcacatggattttaattattctatgcataattttgaggatgtattttagagtcgttttgggacgcgacagcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactacaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatatgctaagtctaattaagactacaatagtcaattgctacttgtcgcaccaattccgtagtcaataattacatactaag

SEQ ID NO: 67579 - DNA, 1651 bp, Oryza sativa
tttcctttgctagacatgtccttcacgaaaaagacttgcgttacatcattggcaaggacaaaaggttcgtccgagtatccaaccttgttaaggtcaacagttgtcatcccactatcatcaatcattacgcctccaccagtcaacctaacccattggcaccggaacagaggaaccttgagaggaccatagtcaagttcccatatgtcctcgatggcatcgtaatacgtggcagttgttccatcgtgtcccatggcatcgacacgaatagcgctgttttggttcgtgctcttcatgtcttgggctctcgtgtagaatgtgtacccattgatctcatatccctggaatgtcgtgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtctttgataaattctacgcaaaattcgatgactcctctgttccataacccttggcgatgcttgcctctggacgagcacggttacgaacatacttcttcagaacgcccatgtacctcttgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatatatccggatcgatgaccttctgcgaaattgcgttcatgaatgcacatagctttgttattgttgtccggacattgtctggaatgataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggtccctttccgaacactactttaagatctttaaccatagcaaacactgttttcccgctgcgatgtttaggcttcgtacgatggtcgaccttatgttcgaagtgcttgcctttcttccgtaccgggtagtttgctgcaaggaatcgacg

SEQ ID NO: 67580 - DNA, 5140 bp, Oryza sativa
atccatcaactttcagccacgaaaaatatgaaaagattgatatcttttaagaatccagcgggtagtctacggttctagaatctagagcagggcagaacgagtgagcgacccagctggctcgtcgttgtctcggacctgctaggccgcgttgcgaagcagaggtccagaggcgcaagccggggtgaaaatggaaaggaaaaagttcacttaaggtcccttaacttatcaacgaatccgatttcatccttgaaccctcaactatcaaaattaatgcaatatagatcccatgatggtttggactcaaaaccaatacaatatagatcccatgacggtttggacggcggttttagttgatgtggtggctagtttgactcggtctttatctcacgtggcattgacgtggcgattatgttgcaatttgatctggaaaaatgaataaaaatcgtgggcctacatgtcagttaaaataaaaataattaaaaatattagggcccacatgtcattctcagtccctcctcttctgcttcctctctctcgggcgatcttcttcccccggctacaagtccggctattagtcgctgcacccaaaactgatcagagttgaatgtgatcaacagtacatatgaaatctcaagcaaaaattgaagcatcccatcaagctcatcgattcagcgcctgcacgacttccgtgctagtatccggagaaggggcgacggtgacacgctggaggacgcggcggtgctcggacatagatcttgctgtatggaggtttattaggtgagctcagattgtacaggtcgtaataccagagcttgcatccatattcacttgagtatgcaatgcagtagcatttgttcaggcaagcttctctgcaatcttcatcggtgtcacctggttcgtcctgagcgttgtaagggagcccttcgagattgtcaagaatagcgaaggagtcgccgtgctcgttctggccgttggcgtcgcaggctcgcagctcagtgggagagacctcgagcagccggtgacaaagtagccgagccgccccactccttcgtacgtgtccgacagcttgaaccctttgacgcaccggcattcgccaccggtcgacgtgcaggtactagaaaaatcatttttcccaatgtaggtgtcttattttcgcaggcggacataagcttgggagtcaaatgaccgcctacaaaaatataaatcgaggtgaagttcgttgtccgcctgcgaaaagatttccgcaggcggactacttaagcggcgcctgtgaaaatcattttcgcaggcggaccacctaagccacgcctgcgaggcgcatcttatgtggtccacctgcaaaaatcgtatctaccaaaaaaaaaacttcaatccttatccagtactccaacccctccctaccactcatttctatcttctcaactctctctctccctccaccaccggcttcttagctcccccatcccctcctctaccatcccctcccctcccctgcgaggcgcatcttatgtggtccaccggcggcggagcgcgctgcggcggcggcggcggctccccgacctcccctcccagatccggccagagggatgccgggggagggcagcggcggtgcgcgcggacaccgtggcggcggcggcgcgcggacgcggtggcagcggcagcgcacggacacggcagcgacccgttgcggcggcggcggcgacgtggttccccggcctcccctcccagatccgaccggagggaggccgggggagggcagcggcggcgcgcgcggacgcggaggcggcggcgcacggacgctgcggcgacccggtgcggcgacggcggctccccggcctcccctcccagatccggtcggagggaggccgggggaggacggcgggcgacgtggttccccggcctcccctccaagatccggccggagggaggccgggggagggcagcggcggcgcgcgcggacacggtggcggcggcggtgcgcggacgcggcggccgcggctaccccggcctcccctcccagattcggccggagagaggccgggggagggcagcggcagcggctcctgttgctgcggcagcggcggcggctaccccggcctcccctcctagattcggccggagggaggccgggggagggcggcggcggcggctcccggtgctgcggcagcggcggcgtggaggcgattttttttttgttttttattggattttcgcacgcgggccatttgcccgcttgcgaaaatggatgattttcaccgtcgttcgtctgcaggcggtcctcccctccgcctgcgaaaataggttttggccacttacaaaaatgcttttcctagtagtgggcgccgaagtcgccgcagaagaaaccgctggaggaagaaaaatgtccaggagtgagaatgacatgtgggggcccatgtgggccccaccatttttaatttttattattttactgtaactgatgtgtgggcccatggtttttatttttttctagataaaattgccacgtaagcgtcacgtcaattccacgtgggataaagaccgagttaaatcagccatgtaggtgccacgtcagctaaaactgttgtcttaccatgggatctatattgtaccggttttgacagccgtatctggttttccggttcaacgacggaattcggattcgtcgaaaatttaagagaccaaaagttaacttattccaaatggaaaatgaggcctgtgcttcggccctcctaggctgcgcggtgtgtgtgggtccatgatgtggtcagggccgatttggatatctatgcatctttcgaaagatttttataatcatatcacacagatttttaattcttggattaaaatccaatagacacagtaaaatacaaaaaacaactaagaaacaccataatggatactatattaccatatcttcagaaaaaaaagaccaaatccaatataaatttcaaaacttatatgcgaagattcaaaaattacactgtaacttacaaaagttacagtgcaaatttcataaattatattgtaacttacaagaaaacacactgtaaatttgagtgagaaaatcgagtaagagataagaaaaaatctttcgagtgagatatagcaaaatcgttctttgatcagtaaatgtttccgaatttccaagacaagatagctactcccttcgttccagaatatattaacctaaaaccggattggatgtactatgaatctggacatacctctgtctagattcgtagtactaggatatatcacatccggtggttttaggttgctatattctaagatgtagggagtagactatttggattgacctatcatttttagagtgggctcatggataggtagcctttggtgcctggtgtaagattttcacattttgatcataattgattggattgaccatattatttgtgacataaaacaagctttgaaagagactttcttggtcctgtaaacaagtatcgaggaccttttttttttaaaaaaaaaagaaacacagtggttcatacacgcaagtacactcatcctataaacacagcatacccttccccaacaaaaacttcgagagagtgagacggtatatcaagattgataaaatcatcaaaggtgctatgctatagacaggtacctcgcttatcactggaataataattaatcgtacgtacgagtgctgccatgtcaagtttttgagttgaatttgtgttggttaaaaaaaaatataaccagctgatttaccctcaatttacttgaaatatagtaggtctcaaaaattttacatttgttatccatgtacacaaatttcatgatcgtgttttcattttgaaggcgttgttgaatttcacacactttatagaaaaaaagtaaaaacttgtgttcaatccttataattagcctggtattaaatttgattaaaaatgattccgtagttggttatttcaatttaacgtggatgccttagcaatgtttgaatttggaaaattctaatttctattgttttttatgtactatgtgggatttttatttgcatcccaaactccacgaaagaataaaaactctagagaaaactaacatagtactccctttttcacagctgaacatgtgttttactttaaatatttaaatttgaggtatatcattgcaacgaacctataaaaaacagcctttccaatgcattctccaaactaaaattaggtaagttcgatgaaaaaatatcctccaatagacctgccaacaaaccctccaagccatctggctcacaaaattaactctctagctagctaaacatgggcatcctacctagcgggccaagccatgttgccaaccaggggatccagtcgtcagatacccttctccccttctctctcttttcccgcacccatgcagaggagcgctgccggccaccatcgtcatcaaggtcgccatcatcatccgttgttgctaccgaggtcactgtcgccagggttaatcctatcggttatgctgatttgatcgggcctcaccaaaatgccgaaatttcggtccgaaattttgaacaaaatttagttgaatttgaacaaatattaccaaaattcatgaaaaaatgaaaaatttcggccgaagtaatatcgtatcggaggggaccgaaatgatcgaaatttcggaaatttcagtccgaaatttccaaccatgactatcgccagccaccgccactgtcgtttgtgccatcactagccgttgccatccacctcgaggttactatccgttgtcgctgttgtattcgccatagtctggaagcctccgccacctgtgcccctactggattcgactggcgtggcgcggattcgcgagggcttgtgtcggattcgggcaacacggtgtggattcgagggctacacgacacccgctctagcgcaaattcgactagcgggttggatttgcagcttcgtggccttcaccgcctccgtctccccaagctgagttctgggttgcggctgacgttgtcatcgccgccgttaaaaggccgggagaggaggaagaggggagaaagaggagtaggaagaaggggtagtactagaggctggtgtatgggtcctaatgtcatatgctcggaaagaagagagtacatgaaaagactattgaagtgagtaataataag

SEQ ID NO: 67581 - DNA, 1425 bp, Oryza sativa
gataagctaaaatcacacctacccagtacatccttgaaggcaggccagacaacttacggttaaaagactaattggagtactttttttatttttgaatagtctaactggagtacttcacccggaaacaaaaccccattgtggcattgtgcattcaacatacccttatccacttagtttcaagaaaatttaacagcatgagatttatcctctctatacccgtggaccaagccggcagcacgttcgccgtggaccaagcaaggccggcgccgaccgatcaccgatcgataacagatgcatgcacgcacgcacgcacgcacgcacgcacgaacggcgctaactaacgataatatattcgtaccctacggttttttgccgacacgtatgcgtacgcaagcagccatcgacacgtagcccccgcgcgccgacgcggcgctcgtccgctcgctacctactatgtactactatagctgccacatccttcgacctccacgtatgcaaagttgcaaattaaactcactgtacgcatccacgtatacgccatgtgcgtgcggcggccggccgggcaaacggccgatcggcaaatcataaggcagccgcgcgcgcgtaatatataaccgtagctccaaggtaactgtgtctccatacacggtatatgcgtatgcattattatgccgtgtttatataaattgcgtatattagacaaagcggcagatacacgggcgcgcgcttagtatagagatatcggtagattgcaaggcctacgaaaacgatagctatacgctacgaaaccgatcgaatctccaacgtgggtgtgtcgacttgcgcctttggcacgacgcacacttgtccgccgttcgacgttatgcccaatcgcccatcgaccaaatacttctttttttaatcagttccggctagctagtttgtatacatgcatgcatgaatcatgtacatacctgataaataatatgctccgaacatctattatggccaatgatgtatacatgatatgctccgaacatctattgctagctgcaacataactgatcgaccaacatttgtcatgtcgctaactaagcaatcatcgtgcaagctaagctaggtgtatgaaatctgcaataggatatacagtgtatgtatgtgctagttcttacgagcttccgttattgttgatagctaacgattggttgctgctcgtatatttgtctggatatataacgatctatgcagctaatagcaaatgggtttgtctcggataagacaaatcactatttggtcgaacggaccaactgacctgatttttcggatctcttctgcacgtggtaagatcctgttatttcggcatctatttttcgttgtagatctcattttctcgccgctactacttgcaccaattaattaactataatatatatccgcactgtattt

SEQ ID NO: 67582 - DNA, 3613 bp, Oryza sativa
  unsure (1)..(3613): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttcaggcttgacaagtgataatactttaggactaaagaatgatagtggttcatcatgatgacaatgctaggcatcctttaagctcttagtacttgtgtttgtgtgcacctaataatgtctgcttgttcacacacacaagccaacagaaataccatactcccctataaccgctttgtattttcattaaagcaatgaacatgatattattattactatctatcaattattggtcccaggaaaaatatcagaacaggatcactcatgaaaaaacagaaagctcttataattagtcgcccataatattatacgagacaaagacaataaattgtgatgatttgtttgatgaaactaaatcaagattacttcgttggtgttttattggcctgatttggagtatgttagtaagtcatgcaatgctgttcaagaaaaaaaagctataatttgcacactgatgcaaggtcaagatcaagagtagaacatgatcatgataatttttagtgtagtagtataccactaccctaaagacagcagaagacacaacagttgctcatctattattctcatattcgttctctcgaaagcacaggactgcgtttcatttcattaaggagaacggaagttaaaatattgacaagaacaggggagcaaaagaaaactccaaagaacccccctccccctcccccgacacacacacacacatcatcatcatccaaaggcataattgcccaggttaaggggtgcgttcagatgtcaaggtttggaacacactcccttcacacggaaaacgagatagttcattaggacatgattaattaagtattagctaaaaaaacttgaaagtggattattatgattttttaaaacaactttcctatagaaaactttaaaaaaaacacaccgtttagcagtttgggttgtgcgcgtggaaaacaaggaaggagaagttaggaaggtggacaatcgaacacagcctaagtcacctaaacaggaactcatggagcgcagatgttccagctaaacaccacaagccacattcattatctaccatattataaactggcctctcatgattcagagtaaacacttcaaaaaatgaggacacttcgtccatgttcttgagtcttgacaatggttatgtgccatcagaactgaattatcctactaaaaatgagtgtactagaagcaattaagtgaagtctaaagaagaagtgaattttcttggttaattaaaacaaggaaacagaaatgatggtattgtactatgtgcatgttccctttttttcttaaagcgcactgcattattgattttctgtatactgtttcgttagttcgacagaaattagcgacatgatcacttttcaagaaacactaagcaatatgttatatagacaataacaagactataggctttatttaggttttactacagaataagtgttactggaccaatgcaaactctgtatctactattgagtaataactaccatctggcaactatagtctatagatcttttgaaccatattcctgtttccatttctttaagtggactgtgtttattttctgtataccattcctctattgcagcaaaaccttgttaaggaatacaaaaccatagacaataacttcaggtgtaacatgacgacagactttatttcgatatactactaaataatttttactgggccagcgcaaactttatatagatatcagcatctggcaaatacaaatatgttcagatgatggaaagtcaactcattaaaatttggtaatacatactcctacgacatggcagaatagcatcattggttggcataaaacagacatagcaatttaataaacaggctttcattgtcagcaacaaattaacgcctgataattaattgttaacatggtttccttaacacagtatatgagggaatagacgatgaattaaacaacagtagcaaaggaaagcatacagtaacagaatcttcttcacctcaattcttcttgtccctgtctacacgaaccaatatgtctgataaggtcttgcttttggcatcacccttgttgctcgcagatgttccttcaattgaaggacatgaacaattatacagcaagaacaaaagtagaagctcacattttcatacattgcatgaaatagctgaactgccaaaggcaaactgaggcatcgagagtatggcattcgcatgtcaaatatacttgaaagagaccacgacaccacacttctattctgaattttagtttttcaggaaatattctgaaatttgttcatgtttacactgctaatatatattcacgtgctatgggtaagcgccttggtgtcttaggacaatcattcaccaaggcctaaccatgtacctgaattacaaacagctactccctccgtttcacaatgtaagactttctagcattgtccatatacatatagatgttaatgaatctaaacacatacatatgtctagattcattaacatctaaatgaatgtgagcaatactagaaagtcttacattgtgaaacagaggaagtagcaaattatcccaccactaagagtttgaggtttgtattttgtaaacgctaatcataagaagtggtccatctgctattcacaagctgcctataaccatgcaattattttagagaacatggaaaaatataaaagttgctatggatctaacaattctagcatccttacccacacatatcacaaaagcatcatcttaaacaaaacatgaacgcgtgaaagatgattaccagcagcggggattttgcttgatgcaagccacggtgggagcacacatgatttaaggatagaggtgataaaccagggtgagccttcaccttcttctatcggcgaagacccaagcaccttccccatctccatgtctacagaaagaacatgtttgccaacgatgacacaaatgacgctcgagtttagtgggtcaatgacggcaattcgcggggtgtcctctggtcctcctcccttcacctcgcagattcgaccaagcgccacacggtgctccagcgtccagctgccgccatcgtcgtcaagcgcgaaggagctgagcacgaaaggatccttgtcggacacctcgacatagcgcagcctcccctcactgacccccacgcgccgatgaatactctgcacttctactagtagatcttcgctgggcattggccacacactgcccctcgggagctcgacgaagtggagctccggccggtcgctgaacgggtcggcggagatgacgccccatgtcagatcgacccaccacagccgtccggcgaacgccaccgcctcggtgtcgatgtccagccgccgcacaagcgggagcggggacggcaagccgtcaatctgtcccacttcccggttcgcgagaggaaccgccacatgtggaaggtcccgctgttgctgtgctcccggagcatggcgacggcgtagctgtcgggcggcccatggccggcagcggagcgggtgaggaggccggtgtggc

SEQ ID NO: 67583 - DNA, 16628 bp, Oryza sativa
tcgcgtggtggatgctgtggatcatcacccacccaggatggcgcgaggcgtcggcgtcggccgcgggggcggaaagggcgcgccgaacgggcgcggcggcggcggccgcggcagagagggcgcgccggacaggcgcggacgcggaagcagcggcggagagcgcgcggcggagcgggagttgcatcctgcgccggtggagccgtggaggaggccggcgaactgcgaaagcgagagagaaagggacccgcgtggcgtcgaggagaagccgaggaggaggtgctggttcacggtggaccaggttcacggaggtgagctcagactctgacagcggcagaggggagccgcgcgagcgtggacctgttccaccgagcgcccggtgttctgcagcagggggtcgtgacactgacacccggtgtacgtggactaggtgcacctattcagttttgtacttgctttgccgtgttgttgtagcttctcttcttttgggtccacatgtcaggcgaaaggccgtattgagagtttgaaactcggaggggaaaagtgctcttactggttttcccgccaaaattctacgctatgtgggccgacagatgggcccaagctatgggctatcgatcaactaaacctcaaggcccagttatgaccatccttttgcacccccagcacgtaagaccgaattattaaccaaaatttctccttcaatttgaaccgtgacattgagtttgtgctgtgtgcagggtttacgattccgacatgcccttccgtttcgggcactggcggaattcgaaatttcgcgaaatctggtggaaaaccggtaaatttcaaacaaatttcataaaccaaaatttgaatacaaattctctgagtttgctgacaagttctcgaaaaccggtcggttttagcgaaattccgatcaaaatcatcgaaatgaccagtaatatgtaatttggaccaactactagctgggcctagtacatacaatttggcccatataagtgttttcctttttttttaattctttattcttttctttcctgatgtaagtttcagtaaataaaacacaatacatcattttttttgaatatttatatcccaataggttctatgaatatcatagtatttataagattttatttgttttttctttttttatcaattcaaatttgaatttggatgaaactcctcgaaatctcagacggtttctactttcgagcctcgtcagaatatcgaaatttcacgaaattcgatcggatttcgtcggaatcgtaaaccctggctgtgtgagtgaaaaataacaggccggctcaatttctcttccaaaccagacaaaatatacaccacctatgcaagcaaaacaattgtgtttgcacacagagacatgttcaaatgaatttcgaattcctaaccatccgcctcaaataatagagactttttcatactatcttcctacaagagcaccagtaacactagattggcacacaatggcacctagtagtacctgatgcttcctaaccaagcatagagatactttttaagttcttttaccatcagcaagctaacactgaccttgcaggaaaaaaatatcaagctaatagtgaattgtttgctagctgaaacaatgtgatcacaggtatgaagagaatgaataagcagagaactgagatatcatgatttacagaattatgcatcatctttttcaatgacaaaaaatgagctcattgtctttcaattaacacaccatgtatagtcttatgtgatggcagtgacatgctgactgaactgggtcacttttactgcaatgctctcaatgtgctcgtaagcaaagcctctaccaaagaaaacataaaatagttccagtttctcccaaaatacgacagctaactgcgaggatcaaaacactcaactttccaggtttctcaaaagtcaaaacgagagttctccatgctaccattcatcagcttcctaattcattaaaactcatgtcagtaggtttttatgaaacctgaatcgaatagaaaacattagaatgtatatagaaaataatttagtgatcgacataaaagcaagtaaacagaaaactgacagtggctcatcatgatgacaatgctgggcaagattttgtacagtcctagtgtgcacctagtaatgtctgcttgttcagtataccacacaagccaaaagaaataccaccgtagccccctataactgctttttattgtctttaaaccaatgaacatgatattcttattactttctagattattggtcccagcctcccaggacaaaatagtagaacaggatcacttgtgacaaacagaaagctcttaattagttgcccataattttatatgggacaataaatcatattgatttgtttactgaaaacaaatcatgatgttgactatcatttttatacttggtattttattggcctaatttggtatatgtttataggccgtgcaatgcttgttcagagaaaagctataatctgcacactgatccaaggctcaagagtagaacatgattgtgataattttgaatgtagtctactactacactaaagactgcagaagaagcgaaagttgctgaagtattattctcatctgaaatatcgatcttataaactggactctcatgattcagagtaaacacttgaaaacatgaggacactgcatctatattcttgagtcttgacaatggttacatgccaacagatctgaactatcctattaaaaaatattgtattagagcaattaagtgaagcacaactctttgtgataccatgtgaagatcataactgtgtcagtcttctgttaacatttcccccaaaatgagttcattgttgcagaatcattgacatcctaatacgtaatatccaaaaagaaagagcttcctactccaccaagaacatctttcacctgttaaatttcagacattagggacatctaattgatcatatgcagagaatgagctgaggaagaagcgaacaaaaatgatggtattgtactatatgcctgtccttttttttttaataaaagcacactgcatattgattttcgttgattttctgatcaaaatcaatatgctacaaaaattagagacatgatcacttgttaactaacactaagcaatataaacaataataagactatagtctttatttacgtttgactactaaataagttttactggaccaatgcgaacattgtattaactagtgactaccatcaggcaactacagatcttacagctgatgcaaggtcaagacattaatgtttggcatactctttttttttaaaaaaaaaaggtagaaatgaattccggcctatacatcaacaaaggatgcaaacaaccatttttaattcagaagtgatattacaatttacaagatggtagatagcatcgttgattttcttaaagcagaagtaccaattttgtaagctacgctatcatgatcagcagcaaattaacactaattaataagttgttaacacagtttctttaacaggggagataaggaaatggatggtaaatattaaacaagagtatcaaatgagagaacacaaggacagaattttttttcacctcaattattcttgtcgctgtgtacacgaaccaacatgtctgataaagtcttgcctttggcatcacctttgttgcacgaaaaagttccttcaatcgcaggacatgaacaattataccacaaaacgaaaagtagaagctcacatttttgtacattgcatataatagatgaacatccaaataggtaaactgaggcaacaagagcatagcattctcatatcaaatgaactattaagacaaaggggagttactaataccaactttctattctgaaatttcagtttttcaggatatattcagaaatgttattcaaaattactctgctaatatccataagtatcttatcttaaacaaaacatgaaggtgtgaaatttggttacctacctgcattagggatttggcttgatccaagccatggtgggagcacgcacggcttaaggcaagtggtgatagcccatggcgagccttcactttcatcagtgagcgaacaccctagcaccttgcccatatccatgtcgaccgcaagaacatgtttgccaattaggacacaaatgcagcttgagtttagtgggtcaataacgccaatccgcggggtggaagtgtaatcctttgaggggaggcctcctccattaacatggtccctgcagagtggagcaagctccacctggtgctccatcgtccagctgccgccgtggtcgtcgagggcaaatgagctgagcacgaaaggatcctggttggacaactcgacgtagcgcagcctcccctcgctgactcctaggcgccggaacatacccaacgcttgtactggatgggtgctgggcattggccacacactgcccctcgggagctcgacgaagcggagctccggccggtggctgaacgggtcggcggagatggcgccccaagtcggatcgacccacaacaactgtccggcgaacgccaccgcctcgaggtatagctccatccgccgcgggagcgggagcggggacggcaacggcaagcccaccagcttctcccacttcccggtttgcgagaggaaacgccgcatgacgaaggctcgttcatccccgttgcggctgcggtcctcgttgagcagagcgacggcgtacctgtcaggcgggccgtgcccggcggcggaggcggaccgggtgaggaggccggcgttggggccgtaggacaaggtcttcttggtgccgtcgatgtccgggaggcggaacagctcgccggtgatggggttgcagacgaagcgcgtgatgtccgggtccatgtcgcgccgatcagcttaggctcccgagtgccgctgtgcgtggagacgacgggggcgtgggcatccgagtagcagaggaggaggaggccgtcgccgctggtggtgcacaccatgccgccgaggagggccatgacgtcgccgttgtcggggccggggccgggccggcggtcgaagaggtggtcgggcacgtagaggttggaggcgcccggggggtcggcgaggatgaagaaggcgcgcggcgcggtggatctgaccgccgggatgtggtagatcatcgcccacggcggcgtgcgcgagggcgaggcggccgcggtggagagggcgcgccggccggccacggacgcggcggcggagagggcgcgccggagcgggagccgctgcattttgggagtagtcggcttgccagcgaaggagaagccgaagaggcgtggtgggtggagctctgacaagccgcggcaggttggattttgcagttgtgtgagctggtgcactagacctggcgcacgcagtgggcacctgctgtgggtccttctacccgttgccgtggggttcgcatcctctgccattagggggtaaatggcagaggggaacagtaaaatgtgagtagcgctacagtgttttgccattgctacagttgcggtgggggttctcttctataggcccacatgtccagatgagcgaccggacgagacacggagggggaaagtgcgtagccctttgacgttgggtgtgtttagtttctgcgtgtaaattttttttaaagtatgcggacaaatatttggtattaaataaagattaataataaaataaattataaattttatcaaatttattaagtctaattgatccgtagcatcacattgttaaatcatggcgtaattagactcaaaagattcgtctcgcgatttacatgcaaactgtgcaattgatttttttttcatttatatttaatactccacgcatgtatttaaatatttgatgtgacgcttttggtcaaattgttttggaatatgaacaaggctgttttcgatattgcatttttggcctcccctgatttctcgaactattagatgatgatgcagttttataaaaataaattaatagaaaaataattttgaaattatattaatgcacttttaaaagtttttttaagctgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctgacgcacgccttgccccatcccgtcaagacgaaagcctctaggcactcgtctcaagccggagctagggtgttatctcttagagatggcacgttagccctggtcagatttacaccaggcttcatcctaaccattacaggcaaggtgttacacgaaaaagggcaaacatgcacgttgttaagctgacgcgtggtgaacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgagatataaaaggaggaccttgcccatttagagggggacgggacttttttcccttttggaaggctgaggggaaagggagttaatcctttgtgactcgtccatacacaaatccacaaaaacacaggagtagggtattacgcttcgcagcggcccgaacctgtatacatcactgtgtctcgtgtgtcttgcgggcgggtgatctttccagatacagagagagagagcttgagatctcaccctaagcccccggccgaaccggcaaaggggggcctgcgcggtctcccggtgaggagccacgagctccgtcatctggcgcgccaggtagggggctcagtgtgtgttttctgagctctcatactcttccgtgtgcgccaagtttttcttgttctgcctaatggccgagcaagcgaaggcgcacgacctctcaccgagtgtgagcggcgacgacggggagccgaatccacgccgtcgagctcgtactcccccacctcctccgcgccaaagccctaagcagggggaggcgcttgagagggtcgacaaatccgtggcatcaccagtcgcaggtgatgcaggagaacggcgagatggggagcgtcgcctcctcgtctgcggcgacggcagcacgcctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccaccaccaagacctccggcgccgctaccaccggctccgtgtcgtcaaggcggagggcgcggcgagcggcggctgctgcgcgccattcggccgccactccctcgtcgacacctccaactcgggaggatcagcatggagagccggatgcccgcatcgacatcgagcgccggcgtaataaccggcgtactccccgcgcaacggagggcgcctcttcgtccagagtgtcacctcgacatggacgagaggatcagccctccgtgcccccggccggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtacggcacaaccgcatgctcgaaaagatcgcttccaaagagccccagactaccgcggagctttttcagctcgcggaccgagtggctcgtaaggaggaagcgtggacatggaactcctccggttccggagtggcagcttcggcgcccccggatccgccgctcagacagggcggcgtgacaggaggaggaagaagaggtcggaccgttccggcgacgagggtcatgtcctcgccgtcgagggcgctccgcgggccactcgaaaggggaggcctgcgagcgacaaaaagaaagaggctggtactcccagcagggagcgccccgccggcaggtggtgctccgtccacaacacctccctccacgatctcgcggactgtcgtgcagtcaaaaacctggctgagcgaacgaggaagtgggaggaggacaggaggcaggaacgccgtgagggcaagtccccggcggttccttccggcaaacggcgaagtgaggccaagcagaaggcccccgctgttgacatcgatgatggtgatgatgacctaggtttccaagaacctggggccaccattgccaccgtcgatggaggagcgtgtgctcacgtctctcgccggagcttcaaggctatgaagcgagagcttctggccatggcccctactcatgaggcgatgcgtcgggcgcggtggtcggaggttgctctcaccttcgaccagaccgaccacccaccgtgcattgcccggggagggcaggttgcgatggtagtttcccccaccatctgcaatgtgaagttggggcgtgtcctcatagatggaggagcggctctcaacatcctttcccccgcggcctttgatgctatcaaggccccggggatggtgctccagccgtctcaaccgatcatcggtgtgacgccggggcacacatggccattaggtcacatcgacctaccggtcacctttggtggatcagccaacttccgcacggagcgggtgaacttcgatgtggcggacctcagtctgccctacaacgcggtcctggggaggcccgcgttggtgaagtttatggcggcggtccactacgcctacctccagatgaagatgccgggccccggtggccccatctctgtccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgtgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgaggcttctcgaggccggattcatccgtgaagtcatccatccggagtggctggcgaacccggtggtcgttcccaaggcgaacggcaagcttcggatgtgcatcgactacaccgaccttaacaaggcatgtcctaaagatccttaccccctgcctcgcatagatcagatcgtcgactccactgcggggtgcgaccttttgcgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaataggacgtaatgttgaggcttatgtcgatgacttggttgtaaaaacgcgcaaccaagaaactttacttttagatctagcggaaacttttgagaacctccgctccgcccgcataaagctgaaccccgataagtgtgtgtttggtgtacctgcgggcaagcttctcgggttcttggtctctgcccgaggcattgaggctaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagctctcccccggttctagtcgccccggagccaaatgagcccctgctactttacttagcggcgacccctcaagtagttagtgcagcgttggttgtggagcgcgatgaaaataatcctcatttcgtgcacccccattctgtgctaacttggcccgggagcgagcggggaggagaggcccccgagtcggacggtggcctacggcccctgacgaccggagtcggccctctgcccgcttgtcagacggtgctaagtgcccccgaccctcaggagggccccaaggccactgcgggaaggccgcacttaacgccctttgaccccgaggctaaccctgtgctgactcgacccgggaaagagcagggagaagaggcccccgagccgaacggaggcctgaggcccctgacgaccggagtaggacctttgcccgcttgtccgacgatgccaggagcccccgacccccaggacggccccgaggccactgagggaaggccgcccctttcatcctccgacccgaggtcatcggcacagaagacaagtgcgccccgaaaggccacttgaatgaagaacgccccggggatacggcccccagcaaagaggatcggccccaccgaagggtgcagcggcctgtctactttgttagtgaggccctccgggatgccaagacccgataccctcaggcccagaaaatgctttacgctattctgatggcctcgaggaaactgcgccattatttccaggcgcatcgggtcactgtggttacgtcttaccccctcgggcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatacccgaggccagcacggacccctctcagctgcctcgcaccacccactgggtgatgcagttcgacggttctctgtctctccagggcgctggtgcgggggtcacgttgacctctccaaacggagacgtcctcagatacctggtccgcctcgactttcgagcgaccaataatatggcagagtacgagggactccttgccggactcagagtggcggccgggctggggctccgccgcctcctggtgttaggcgactctcagttggttgttaaccaagtctgtaaggagtaccggtgctctgacccacagatggacgcctacgtacgccaagtacggcgtatggagcgccattttgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctacgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagccctcaatgatgcagtcgatctggtccggcgatgcagagcgtgtcagttccacgccaagcaaatccatcagccggcccaggccctgcagatcataccactgtcatggccatttgctgtctgggggtttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaatgccttaaaaccaagaccttcaatattctcaagaagcacggcgattcatggatcgaggagttaccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggccctccgagccacgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggtgtcccccgggcgggctccgtacggctggccacgggcgacggcactgagctgccaaacccgtggaacatcgaacaccttcgtcgcttctacccctgaggaggggggtcgggtgtcaggttttgggctcgggctaaccccgcacccccctcgggtgtgcagggttagccgggggctaccacacatgcacagccttacttttcttatttcagcatttcaataaaagcagtttcaatttcctaaaggttgtgtctgtgccgtttttccttctgaagaatcttaacttgaaataaggtcactcgtgctcaaccttaccctcgggggctcggttcggtcagctaaaatcgccaagcggggcccagaaccgagccgtgccccggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcatagcaaaataaagttaacataagaaatttttcatcatttttgattgcagattaagttgatctatacaaaaagaagaaagaaaaagaaaaaattggagattggcgggggcctgggggctcattccaatgtgcccgggtcgccggcctcgtcgccaccgtcgtcctcaccgctggcgtcgccctcctcgtcggagctgggggcgaacgcgagccgaggggccgacccctcgaagctttggacgatgtggttggcggcatcccggacccgcgcgcgcgcatcgtcctcggtcccgggggggaactcctccagcgccatccatggagagaagttggggtcccgggcctggtaactcgccagcacgagttcgaccgctccccgcgcgaggtccctcgaggatgacttgatggtcttctcaagctcctcggggagttgttcgagaacccaggccatcctgttgaggtgcggagcgaggccttccagattggtggggggcaccgtcgtctggcctttccagaggcccgcttgccgaccggcgcgcttcaggcgggagaccgcatcccaaagcatgtcgggcccaatctcgcccgccaagcgaagggcctcggcctccccgtggagaagtccagcgctcgctgcatatcggcgacggtgtgttcggcagctgcgaggcgggcggctaagtcgctttcgcccgcggccgccccaccgatatgcgccctcgcgtccagctccttttcccgcgcctcgaggtcagcagcccgctgctccagtgcggctctctcggcgcggacgcattcaagattgcggcgcgcctgctcctcctgcgccgcctcgcgaagggacaggctgtccgccagccgtttggtcgtggcctcagcctcctcgagagctcgctcccgctcagcgagtgcgtcctcgcggaggcggagcgcgcactcctcctcggcgcaggcggcttcgtgcgccgccagcgtcgcctcccggagagcagcggcggcctcgcggtccgtcaagcctttctccacggcgccggcgtgttcttccagcgccatagcacgggcctcaagggactcctcgcgccgccgggacgccgcctcagcctctgtacccgccgctctcgggcagcggcggagtcaaggactccctgggcggcgtcgagcttttctttcagctccgcctcccggctggcgttttgaaggcggagggcgtcttgcgcctcaatcatcgtggtggtagcgatgagggcggccgctcgctcctcctccacctcacgagcgatctccgtcagcgccgccttccgggcttcaagctccgagacgtgacggcggtgagctttacggcccacctccaccatggcgtccaccgagcgccgcccctcctcaacgcgtgcccatgcggcctcgagctccgctcgttccgcgcgcagggcctccacttgggcgctgaacccatctagcaccgcggtgtttgcggcggccaaggcctgcagaatgggctcggcgctcagcggggcgacggaagataaggagaagagccgccttggagagaaggcgatgcggctcggccccccggaggacgtgctgggctcggggatgtcccccggacccgtttgatcctgggcgtcgcccggggaggtgggcccaggcgatgtgcccgcggcctcgtcgcgagcctccccggaggctgtcgcctgagggttgcccgaaggagtgggcccagttgacgcgccagcagcagctgttgcctcagcctggcgagcccgggcggcctcctccttagcggcttcctcagcccgggcggcctcctcccgagcggcttcctccgcttggcgaatccgggcggcctcccgggcggcctcttcagcttcccgaaggcggtctgcggcttcacgccggtcagattctcgcctccgctcctctgcggccgctggatcttcggcctcggactggccggacttggggtggcgggaggaatgcgacgggacatcgctgaagcagaagaaaaaaccagaagacgaacaaaatgagtaagaaaaaacttccttttgggagaaagatggttgcaatgagagtgagacgaacctgcgagggggtcggttgaatgaccaccttggaggggaaatcaggtttccccggcatggttccgtctcccccgtcttgcggagccgtttcttcttgcgctccccctcgggctgcgacgtcggcgcggccccctccgggcgccgactgctggcacgcgccgccccgccccctcggggaggagatgggggaggtgttcctcccagcttcctcttcccctgggcgtcggcagggcggctgctccccgagcccccgacgcggggcccagaagcacgaccccctcctggggcagattgttccccccggcggcgctcgcccgcgctgtcgtggcccttaggggctctctcctctgaggccccgacccccatcataatggttagaatggaggcgcggtcgggatcgctgcagagggggaggatctcctgaggaatgcgagacgcctccacggagctaagattcagcaccctttggaccacgatcttgaagtcctcgggagcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggcgcccgccagctggagacctgcgccgggggctggctt

SEQ ID NO: 67584 - DNA, 1041 bp, Oryza sativa
gagtagggtattacgcttcgcagcggcccgaacctgtatacatcactgtgtctcgtgtgtcttgcgggcgggtgatctttccagatacagagagagagagagcttgagatctcaccctaagcccccggccgaaccggcaaaggggggcctgcgcggtctcccggtgaggagccacgagctccgtcataagcgcactccctccatccaaatatatactcccttcgtactccgacatgattttcgagatgctactttgaccaacaatatctataaaaataaaatgttttaaataaaaagagttgcatattatgatagtttgtttaatgataaatctagtaacatcaattttacgtgattaatcttttttatttttttgctattaatagtcaaagttaaaaatgtttgacttatccctattctaaaaatgtttatattttcggacggagggaataagatattaggactagatgtgatacatcataatactaccaatctattcagattcatagtactatgatttgtctcatccggttctaatatctaatgttttggaagagagagagtaattattcatgtgttaattagcaactccattttatgtgtcgacggggaatggttcctaacccattcaaaaaaacaacctgatgcctagttctaaacttctttaattcacagttttcgtaagcacacttctcgaaccgttaaatgttaaatggtacatggagtgaaaaattctatgtagaagtttttcttaaaatcaaataaatatatttttaaaatttataatagctaatacttaattaattatgtgctaatgagttatcccattatatatgtgccactaatattctccttcattttggagtttcgaacgagcctttagaagccgtatttttacagatagacaaccttgcgttgtgacacctagtttcatatagataagttaaaaaatagagatatattttgtaaaagaatttgtaacatatggtggtgttcgtttctaataaaggtgaaggtgaagctagggcacaaatcaaaaaa

SEQ ID NO: 67585 - DNA, 707 bp, Oryza sativa
tactgagcaaagtccggaatattgtcgtcttccacttcatcttcttccatttcaacaccttgctctctgtgggatgtccaacaattatagcttggcatgaaccccgactcaaacaagtggaaatgaatagtcctggatgcagaatactccttctgattcttacacttattgcatggacaacaaataaaacccctttgcctgtagcttcggccactctcaaaaaatagtgcacaccgtcaataaactctttggaccgccggtcagcgtacatccattgccgatccatctacatgagtcaaaaaaaccgtacacaaataatattcttacaataatgacagtcatacaataattataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaacctttt

SEQ ID NO: 67586 - DNA, 898 bp, Oryza sativa
gtcgctgttgggatcgaccgggggctcggggtcgaggccgacgaggtgctcggggacgacgaggtgggagacggccgggggctgggcgagctcgatcgacgcgcgctccgccgtggacgcgcgtatcctggtgtactgtatcatcgcccacggaggctgcgatgcggccgaggagaggccgcggcggagacggccggaggcggcggcggcggcggcggagaggtggcggggcagcagcatctcggtgaaaaagtgggggttaatttgataatttctctcgtctccttcgaacagagagaaggtgaaaggaattttcgcgtgaggaattacggagttgatgagtagtactagtagttgggtgcagctggcctggtctactgggctcggtccagggatttgaacgacattttacggcaagggctgtgtttatttccacgcaaagtttagattttggttaaaattgaagatgatgtgactgaaaagttacgtatatgacaggttgatatgatggaaaagaactgaagtttggatctaaattttagatctaaacacagctaaggtttgctgcacccctccctgttggtgcggcaaaataaattttcggaaaagtaaaacaatatgtaccacaaaattttaaaaaagggcaaatgcacaaaaaattttaagctacgcatcagagcatcgttttgtcatttttgaactttgcaggtcgagctttttctttctttggcaaagcgtctgtacaaaccgaaaacattatctgctattttcagggattagcaatgactaacattctcagggctactgaaattccgcaagaccctaaaatcttaacacatttgcacatactttctcagtcccaaagtaacgtaatcattttatttttctatgtttctat

SEQ ID NO: 67587 - DNA, 1392 bp, Oryza sativa
attcctgcagcccgtatatcttgcccactattaagcgatctactccacagtctaattactttgagattatccacattgtgccacctagtttcaaattctaacttagattgtaaggtctattacctacagttttcgaaacatgaaaaattatgaggtcttacattttgcattgagattacaacatcaatatcatgttttattaattaatctctataaattaataatattaatcatgattgtatggacataacaactaaagagttcgatgaactggccattgatgggagtaactggcttcggatatcaaaataaactttgcttcgcgtgggatttctaattcaattgaggaacccaacaatggggatccaccaatcgaggataccaagaaaaatactgcccttttccttcttaggctctatatccataaagatctcaaatatgagtatatgttggagacgagcccactcaacttatggaaagctctcaaagggtaaggcaccacaacctcgtggcaacagcaacaagcattccaataggtctggatctaactataatgttgcttaagattgtcgtatcccaaaacaccttgttctcctgtatcagaaatctttcaaggagaaaaagtcttctgaggaaccaagatatgaagcacatttcaatcttacaaatgaagcaagacctgaggttggaagttctcagtaggctcctattaaaccagagaacaatctcgatcttctcctagaggatattgctccactttctgcgatggacggcatgctcatcgaatattactcaatgtacccacttgcagatttactgtaatctcagtgtgtcccacttggagatgaaactactttagtctaagtgtgtgtgagacaatatattgatatcctatagtttgtcaaatattagttgaaataataagtagataaatacaaactcccttaagttgcaagtttgtaagatttactagtcattagagtttgtactattaaatctatgtaaacgtcatactatgtatttgatgttttaaattattgtacgtatgtatatatattaaataaagaattcttcactaagcaagtattctttcactatagatgtctaaggatattgctccgattggagatgaattatgtcttgtggacagtggtaccacaaattctatatacttagggagatcaaatactttcaaactcttaaaaagagagaaggcaaagttttgaccatcgctgaacgcgatactgtgatagttggctctggacgagcaactattacactcctaatgggtacaccaattacaatcgaggatgccttactgtatcctgattcaacccgtaccctactaaattatagagatatccatcaaaatgggttccacattgaaaccca

SEQ ID NO: 67588 - DNA, 7632 bp, Oryza sativa
  unsure (1)..(7632): unsure at all n locations
ttgcaggattcagggggagtacctctctctgggaaataacttattttcgttatattacactctttttcctttgtatgagttttaccctttaggttttctcattcaaagtttttaacaaggtaatatcaaaataagttatatgtcttatcatttcgctttccaccacttgggtttttactaaatgataaatgtagacattatactattttggacaatattacgagttttactcataaaagtctaaaaatagataataatatatcatggtttttctccttatttttcccactaggtttttgaggagtttacatgatgtatctaatatactaattataattatttctaagattgtctttacagatatctggaacaatgaaagagcaatgatcaaaggctggattcgatcaagggggagtattatgaaataaatagatgatctcatccatataaatgatgggatcggcaaccgaaggtttggcacggcggttgtgccaagccacgtgccttctcgccctctcggcgctcctcagcaacgggcttgatggttcccaaccatcgcgcctacggttgctgccccttcctcatctatatattgtaatcgcattgatcaataaaggtacaacgattgtctcgctctcacaatctcaattgccttttcaatggattcgagtaatttttgtctctcactctatatatcatattaatatccccaaggagcagccgtcactcatcgaagctggcttttaatcttatgtgttgcgtagtaaaacctctttgtctataagcctggtttgtccgtagactccttaataggatgaactccgtttggcagtgtaggagcgtcatctttgcagtgctagacaagcaaaggaaaagatccctatgggcaggaaccggagatctcacaagtggaaaatgcaaagttaattgggtgaggacatgttcacagaccacaaatatgggccttgcccctacacctcgagaaattcgtaagagcgttanaatgagatggctatggcattagttgaaatagctgggaaaagcttcgttaggatggagactccatgtgacgacactaacaaaatcctctttgcggtggcaacacaaatcaaggtgggagacagaaccaccgtgcgattctgggactcagcttggttcaatggcttgggcctaaggatgtggcaccaaaagtgtatgcaatctcaaaaaagaaaataaaacactaaagcaggccataaccaacaatcagtgggtgtaggatcttgacttgccgattgtacaaggtatgacaacagacctcctggactagttggtcaacctttggaatgggtccagctggtcgagctgtcccctagtgaagcggatgacatcatttggaagatcacaaataatgagacatactcagcagcctcaacatacgaagcacaattcttcggctcgaccaaaacaaacttcgacatgctgatctggaagccttgggccctagttggtcatgtagaacagagtcctgacgtccaacagactgtattgatctactgtaatagttttcttttcttttcaggctcttgccaagttttgtacatactctttgttctttaatgtatactgtgggggcctccctcactgtgctttgataaaaaaacagactatatgtgagaggttgacgaaacaacacatactgcccactttgcaaacataccttggagacagctttatacctcctggcagaaagcagatacactagaagaatatggaacatgattgcaacgtagacagcgcaagaacaattcaaattggcatcatgagaggcgatgaccacagtacatgattggtgggaagcattggctacatgtaaaggactgcccaagaaaaggatgagaaccctcctgctgctgacaacttgggaaatttggaagaagcgggctacagatctgtagccagctgcagcacggactttaagacgtaatatgtgtatgataggtaggaccatgtattaatagtatagtaagtaactattgtataaactaggaaggtagcccgcgcagatgcgcgggcaccttatttagtgatgtttgaaattttgtaacgaatgtttatgtataggattttttaaaaaatatttttttactcttctaaatctatgtttatcaatatttttttggattgttttgaaagttggtttcgatcactggatgcacggacacgcgttaagaaggtacatgctcctggacatttgtctgcttatgtgactatgcaagtaaggtggaccaacagggacgtcgggtcctttgagggggtttctgtgacatcctagtgcaattaggatgtggtctatgttttttttttatttaaaggatatgatatgtgatgtccataagcattgtgtgcacttgtccataagaatgaaagtgtaagtgatgtgatagcgtaagtgagcgtgccagttggagttggatgcatgctgagctaccttgttctgaaggacgggttgttataaattgtaaacaaaattacttagatttataagaaaaatatgtctcaacaatagagttggttcatatgaaactatcattttatactacatgcgtttttttaatttaaacttttaagtaatattttttccttgtatactaaacatgtccttgtagattttaagatataataatttaagaaattttctattaaaaatatgataatatgacttctttatctaattaaagacatactcacgtacttctatttactctactacctccatccataaatcaaaggattcaaattttatcctaaaatatatgagatttttaatactactcatttcatccaaccattcttcatttaatttttatccaacattactctaaccatcttctaactctttacataccccttatttaatgatggatatcttagtatttttttcattcctccttaattcctataaaattttaggatccattatagaatggagatatatagtaataaaaaagagcttcattcatagacatatttatcgggaatgctaggggacgggataccattgccccaacgggatagcttcccctccacctccatcagctgcaagagcataaggcacgagggccgagccagcagtggggggagagcggcggcagtggccggagctagagagccggggggagggggcggcagtgatggccggagccgagggagagagcgacggcggtggccagagtcggggagccggcggttggagccagagagcggagggatggggtggcggcggtggccggagccagagagccgagggagggggcggcggcggtggccggagccggcgggggacggggcggggacggtggccggagccgggggagggagcggcggcggtggtcggagccgatgggggagggagcggcgacgggggccggagccggatccaggggatgggagggggtggcggtggtgcgtcgctggagccggaggagggagcggcggcggtggccggagctagggaggaaggggcgctggggcggcagtggttggcggcgtcaatgtcgggtgtgtatcgcgtgatacctggtaggtatcgcgtgatacctggctggtatcgcatgattcctgataggtatcacccgatacctcgcaagtatcaccttatatgtggcaagaatcgcatgatacctgataggtatcacctgatacgtcgcgagtattacctgaaaacgtggtagaatcgcctgatacctgatatgtatcaaccgataccggacctgatacctaaccagtatcatcccgttcaaaaatgggattccgttatatagcaaccccccatatttatttgtacctttgagattgatttagctttacatatttgtataggtaaatagacctcgtaacaagttgagaaatataattaagttggtagaaagtcgttagatatctaatggtataaagtaagtaaaaattaaggtggatttttttggggggtaatttttaggatcttttggttaacttaattgttgtaaggaaaacaaagagatgagagctagtggattcgtctcgtccatgaggagggaaccggatacatgtgttgtacatacgcactctgacgacctgatcatttggtagggtttttttaagatatagatctaatagtttataacggtttaaaataagatccatcggtttgggtaaaatgatttttttccttagaatttcttacactttaatttattagagcgtcgtgtggtagcatagaaatgtttataggaatgtatagcagcttaagaacatttgtaagatatctaatggacttttagtatataataatagataattcatgtcatattaattaatatatcacttaataattaaatattttttataattttttatgggttcgccactgaaaggaaatggtatatatcaaagtgatatccggataattttttctaacttcgtcactgaagggtatattcatccaagtgacatataataatttctatatagaaacatatgtacctagagattatttttatatttggttgctagcttaagaaataggaaagaactcggagagacacagaaggggagagtcagagggggtgggacggagtacctatatacatgtgaacgcattatgttttcttttccgaacatataatacgtattgaaaggggaacgtgcagatttttttcttgaagataagatttaatggtaaaataaattaattgtttaaaatattgggtccaccggtttgaatgaaagtggcacgaagcgatgtaggagcttttaccggagtgccaccggacataaattatacaatgagatagataatcatacatatgatgcttataatgtctatccacttaccataattatcaccgttttcactctatattagttagaaactatagttaataaatagctaatttttatcggtttaagtcattggattatttatagtttatagttaaagaaatatgttattttgaattttattgtgactttttagtatcatttaaaaaaaattaaaaaatatgaaacaaatgatatatattttaccggctgaaaaactacatatcaaatattatggaggagtccggtacctgtgtacggacgtgtgaggttcacgtacacgcgagagagagaggagagggtgggattaaattctctttttaatctaattaaatctaatggtctaatagacccaccaatttaaatgaaaatcgggctagatattcctaatatattagaacgccacatggcgatttaggagcgtttataggaatgccacatgacggtatgagagcgtttgtagtatgtttaatggatttttagtatataataatagataatagataaatggcaaattttgctacatgacacttgttatgtgtggttttagctctaggacactgcccaaactcacttttaggggaaaacactccataaacgtggtaatttgctagtggacaccgcgccgattaaaataatattttccggttggggaggagagagaaatcgcgtggaatgtcaaaaatgcccttgggcccacatgtcagctctatctcctatctctctcctcatctctcttttctctctcggagcgcctccacgccgccttcaaggagcacagcggccacccacgatgccgccctcccctccctcctccccgtcgtcgtcggagttcgactctcagtcggagtcccagtcggagtcggagtcgtcgccctcacccttccacgccgtccgcagccaccatctgccgtcctaccggaagacaaagcagagcagcgaggcgcgcgcgcgggcgggtcccctctcctcctcatctggaacggcgagcgcggcggcggttgtcagatccgcgtccgacgcgtcggcgttggcgtccgccaccggcttgggcggaagaagcggctccgcggcggcctcgcggtagtcaacgggctcgggcagcagcagcaccgcctgcggcgggaggtcggcggggcggcgcgccgaggccggggccacgaggaggaagcagacggcggcggcgagggcgagggcgaccccagcgggggccatgctttgctcttgtgattagtagtaatactagtatttgtggatttgctcttgtgattagtactctcaggccggcgctgccgctccgccggccgccgtcctcgccaccccgtgcgagcgcgctctgagagataaaagagagagatgaggagagagataggagatagagctaacatgtgggcccaagggcttttttgacatttcacgcgatttctctctcctccccaaccggaaagtattattttaatcggcgcggtgtccactggcaaattaccacgtttatggagtgttttcccccaaaagtgagtttgggcagtgtcctagggctaaaaccacacataacaagtatcatgtagcaaaatttgcctagatagattggctattacattggctctagatgacttggggctggtatttggctatactattgaacttgtgctaaagaactcccgacaatagctcttctcaccaagattaaagaggagggggaggacttgggtgcgtgctagagcaaagcatccagcagagattgtttcttaagcttgtatagccctttttaggttttaccctctaaagacttttactcattctctattcaaggaaattggcaccgtcttgtgtctgttcattaagaaaaagcagtaacagtcatgctctcatgctctgaagaaaagcagaaaccaacatcagcaaggctcttcgtgggtgcggcgtttcggttcggctgggctagagcaagaggctcatgtcatcatgtggatgcgcacccaaccatgggtagctaccagggctttggcccatttagagcgagtacaatagcaggctgagtgctgtaaactcatgtagaggagagaagagaaaaagagaaggaaagcagaccggctgccgcacggactccaatacattgtgtgtatatgagaggtgggatcatatattaatggtgtagtatatagttataggtaactattacatgaataagctattagattgtagtatattattatatgaataaactattagattgtagtatatgtttataggtaactattacatgaataagttattaaattgactattgatgtattgaagccttaaacttgctcttaaagatgaagtagagagagataaatgaagatagagaaagaaagagagagatcgtgagataccatgagttgggtgcgcatcgtctgctcaccgtgccgggtgccaatgagaagagaggaaggggagtatctaaaaaactgtcacaagtttgttgggtcaaaaacaaactgtcacaagtttgttgggtcaaaaacttatcattcagcagttcagcttgtgggtttgcaaatcctgatcgtccatgcaaagtaatggttgggattggccaatggcacggtgctgttgaaacagagaacggccgatgatgcgcaccgccgcacccccagtagccaacgggaggaagcaaaaaaaacaaaggaattaggaaggaaaaaagaaaaagaacaattgaagagaggaaaaaggaaaagagataggaagaaaaagaaaaggatatggatttttcttttcggaaaaattccaaatttggaggatttt

SEQ ID NO: 67589 - DNA, 1918 bp, Oryza sativa
gaatgcttcaacagaagtgatcagccacaatttgggtaccagcctaaccagtgacaacgtctggcacatatagtacaaacagacttactagttttagctaaacacatgaaaggttctattagaaacaaaatggcacacacgaggtgggtatttactgcataaaatgtctaagaggtgagtgcacgattatttctgtaggatggacaccttcagactagaagggatgacaaactggatatacgactaatagtggatgaaacaagaagcagtagtggagagagtacccaaagattgtttagatgagaacctggtacatcatctgttctaatcactgctcgaacgaaccaggacgtctgccaaagtcttgttttcagcaccttcctccttgcctgaagcggtacatttaatcatttgtacaagtaaaacatcacaatagtaacacagaacatactaaaacaatatggaattctctgtatttaaatataaggtttgagctagcaataaaactcttcttgtagggtaggtaatggaaaattcagcacagcgaatctataattggcttaattacatgaataaagttgttatgaataactttcaaatggacagtcttatgtgtgatacaaacaatagacatacctgatatatgcaaataagttagcttgctaatttttggtccagggttacactctttaactaatatagttcttgacaagttggagaagtaaagaagtaagagaaatacttgaaagaatgagttcatttgctaattttaggtccagagttacaccctatctgataaaatacttgactagttagacaaatgaagaaatccttaaatggacatatcatctgtattaaactattaattgtactctatgaacacaaaattatagaaagatggaaatagaatgtggatcatgtggtataaattcacaattcacaaacattagattattatgagttccaacaaatatatcctcaaacatacatggaagggtttgaacgattatacaacagaacagcaacagaaatatatgtatataagttgatagttgaactactaaattccacagcatgtgaggtcattgtcctattccataaccaagataacgagattaacagactataagatgtcagtttgacgaagaatactgaaaatgcatgtaaagcaatgctataatgtaaaaactagcaaatgaccagcacagagaacaaattgtaactagcaaataaagaggacaagttgaacatcacctgcagaagggatccgacttgacccaagccaaggtgggagcacacacggtaagaaggtgccaatgagaaatgttcgctcatggaactcacattcccccaaatcagaacaccccaccacctccctcctgtccatgtcgacggcgaggacatgatctccgacgacgacgcacacgacgctggcattcaccgggtcaattgcacagatccaagggattctatcctgccatggccgtccagctgccgcgttctacagtggccggccaagcgccacctgatgctcaagcgtccagcagccgtagtcgtcgtcgagggcgaaggagctgagcacgaatggcttcttctgggacacctcgacgtagcgcagcctcccctcgctgaccccaatgcggcggtacatcccctgagccagcactgacgccatgaactcctcccccgtggttggctctggcagcacgctgctccgcggcagctcgatgaagcggagctctggccggtcgctgaacgggtcggcggagaccacgccccagcccagatcgacccaccatattcgtccggcgaaggctaccacctcgtggtgcgagtgtacgttcagctgccgcgcgagcgggagcggcgacggcaagctctccagcttgttccactcgcctgtttgcgacaagaaccg

SEQ ID NO: 67590 - DNA, 3350 bp, Oryza sativa
aaaattttctgccaaggtcattagccgcagctcaaagccacaaactcattagtgtttagggaacgtctgcctagctgcttttaagtacaatattaatcagtgaaacccaaaattcagcgttcagccaacgtttagcaaacaaagaaaagagggggggggggtggagtttgtgattgcagcacccaatgccattgtagcgttgcttcataagaaagaaagacttccaagttcatcataaattcagaacagctttcacaaaacaacttcagaaaccaacagaacagatatcgcctgttaaattccatagacctggagagaatgaattaagcattagcccatctcattaatgatgccaagagagcgagtgctatgagaaagaacctatttttctttgttacaatatggatgcatgcaaacagaaataatactataatcccacacacctttttctcaattttatataaaaataggcgtaatgtttattttctatataccatttctttgttccataacagcaaatatgtacatctgattggcagatctaaaataaaacacgatagccctaatttttaatatgctcaacatttaaatccgaagtgctactaaaagaccacagtataggaatcatggactatttgaaattgaagtagccatctggtaaattaggctgtcttgatctgaggtaacacttaacaaataatgatgggtagcaaaaagtaactaatcaggaatgcagtttccttaacacaggaaagaatgaatagatgatggtttaaacaatgatagctaagtaccaaatatacattatatataccatttctatggtgcaacaaaaactaatgatttcagtcacttgtgaagaaacaggaagctatgaagttaataactcatgataacaaaaacagttatttagttttttaatacgcaagctttatttaggtttccatctagataagttttactggtacaacgcgaagttgattctcggttataatgggcagatcgaaccagacaaatctgtacagttgatgacaagagtagggcacggtaaccataattatttgtacactatttcacattgaaatttaaagtaccaatagcttaaactgaagtagtatatcatatcatgttctacagtacacactacagaaggactcaattgacgctacaaacatatatggtcagcaaaagtaactagtcataattcttgtttcattaacaaaggaaaggatgaaatagattatggattaaacaagaatagcagaagaaagaaccatatgtatttgcttcttcacctcaactcttcatatccctgtctacacgaaccaatgtgtctgccatggttttgcttctgatgctggccttggtgcttgaaagtgttcctacagtgagggagttgaaccattataacacaagaaatggaaataaacacttccctacatttgtttacaatatgaaagagcataacatctctacactgaaagacatgcgctgtaaatgagtttgtcccatcataatttagctacattaggttggcacagaccacacaacatatgcatcaagaaacaaaatggaattgctaacttgctatacatgttgactgcaatttaagcaaatctcagcatttaacattgcacgtttccttttaatgacttcgtaaccaatttaacagcagaggtggctcatgaaacaataacattctcacaagcctccaaccacatcgtttagttttgacgggcgcatgcaagacagggcttttcccccgattcctcccaaatagaggagattccaacaatctgattccaatgaaaaccagcaacccaaactcgtctagggatctctgctcagccaattttaagttcggtatgcatcagcaaaacccaaatataaatgcacatccaatgtttccccaaaatgacagttcggagttgcagcaccaattggcaattgcatcataatacatcacctcatagaaaagggtaaaaaagtcctaatccatcagaacagttctcactgttaaatttcagaaaactggaaagcaaaagttatgatttgggaacatctcattgatcaggcaagggaagcgagtgacaagagaaagaatcaatatttattggttcatcatgaacacaagcaaacagagatgatattatagtcccatatagctggtcttgtggtgaatatgagacatccatgtggtagataaaatggatcaaaatcacccacggtagtatgaataggagtgagaagatagtattggaaaaagttgattggccatacaaatcaatagtttcttaatatactaccgatattgcaaaacatagtataaggcaccaaaccactcgccattgcattgccacagatcacacgcgatgcaatcatctagaaacataataagatggctaagcacattaactattgaaattcaagaggaattcaggcagttgacaattatcacttctgttttctgaaaaatcaacatgcctacctaaattcccagagattattcatgaaaacaaaccaaccgaccataacatatgcatactcatgtcgcaggtaaaacatgcatatcaaaataaagcatgagaaagaagagaacctgcagaagggatctggaattcctcaagccacggtgggagaatacatggtgtgaggaaaccggtgaaaggcgaaaatgggccagtgctgcaacctatctgcgaacgtccgagcacctcaccccgctccatgtccacggcaacacaagagtcaccaattgtgaggtacattgtgctcgcattgagtgggtcaatgacaccaatccgtggcgtgtcatcctcctccgggtctgggtggcatccatccaccccgagccggctgagcgctacccggtgttccagcgtccagctgctgccattgtcatcaagggcaaaggagctgagcacgaatggctccttctgggacacctcggcgtagcgcagcctcccctcgctgacgccgacgaggcggaacctgcctagcttccgtatcccctccacgggctccgtcacactgcccctcggcagctggacgaattgcagctccggtcggtcgctgaacgggtcgacggagacgacgccccagctcacgtcgacccaccacagccggccggcgaaggccaccacctcgtgggagacgtccatctgcctggcgagtgggagcggggacggcaaacccaccagcttgtcccattcccctttctgcgagagaaaccggcgcatggcgatgcgccggttgtcttccccgtccacgctgagccacgcgacggcgtacctgtccggcggcccgtcggggcggtcagattgggtgaggattccggtgaactggcacca

SEQ ID NO: 67591 - DNA, 12884 bp, Oryza sativa
gggggcggtcggtgcacgagggcttggttcatggacgggggcggtgcctagatgtggacccaggtgggttcacatgttagtgaaaggacgtggcttacgactgcgggaggcggagaccggaggggaaaaggctcgccactttttgaacgcattaactgccagatggcagatccccactggttgctgtgtgtgcttaatcccgtcagtcactaatctcccgccaaaacgctctggtccttttgggcccatacggcccgtatggttgggggaagttggattgagagtttagagcgacgaggctataactattttgtttggttggaagatatgtaaattttggtgggatggagataagttttgcctaaacaaatctcacccatccgttttcattagaaattgggaaaggattcttcttagttaggagcagctgactttagatgataactgttcggacaaactgtggtggactctgtccaaaaatgggaaattcactgtgaaatctttctatagagctctcaaaatgcaacaggtcaattgtccacataaaaagttttggaaattcaaaattcctctgaaaattaaaattttcatttggctttttaccagaaacaagattcttaccaaagacaatctttttaaaagaggttggagaaaaggtgataacaaatgtgcttttttgataaggaggagacaatccagcacctgttttttttttttgagtgtcctttggccagaatgttatggaatgtcattgctgtagctttgaatctcaaaccttgtctaaacagaataaatctttttggttcttggctcaataatatagagaaattcacaaaaaaaccttgttgttactgggatagctgctgttatctggactatttggaagtccaaaaacaaagtttgttttgagaataaatttcctcaagatcctactgatttagtgtatatggcttgtaatttggtggattcctagacttgtctacagaaacaagaagcaagtcgaagaagtttgcagctgggaaccatggtactaaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagctttcatttatgtaattagttttgtaagtagtctatatttaatactctaaattagtgtctaaagacagggactaaagttaaaacaccacctaagacaggtggcaagtgaagtattcaattcaagtcatggctggcgaggaggcatcagaagaattggaccagcttagtctctccctggcagtttgatcttgtttgatactccttggaatgtctgtttaatccctagtactctgtatctaggatcgtcatcttggttaggcctgtaatggttaggctgatggtcttctgttcctgtcccactcagtggtcaggtttgtcgttagttatctgttttttactacttctcaagacttgttgtaatgactatcatttctacaaagagaaatgggggcgccatcgccctagttctaaaaaaaaaatctaatattaaactaaactccatatcaatttccaccacctctaccaaacaatatattgggactaaaaatcaaattcccattttaatctcactatccatctctcgtctaaactcccagtccccttccctccagttgccagagtatgagagaggaaatgggagtttagaatattgagcattttaatctctgctccctcagtttcacaatgtaagtcattctagcatttcccacattcatattgatgctaatgaagtcttcattagcatcaatatgaatgtgggaaatgctagaatgacttacactgtgaaacagaggaagtagtttggttggagggcttgggaatttcgaagggattgggattgggaattaatccgtccaactccccaccatcctaccttgttaattcacgagacttggtgagaattaaacacgagaagtctaaaacacccctcaacaatacccctgcaacctccaccgtccgctggtgcgagaaggcacaagatgcgcaaaacattcccattcaccgggtcgagaaggactgaaatgtgcgaaaaatcccctgccactagcacgaggagtaaaacgtgcacaaaatcccttgccactcgcacgagaagaagtaaacgcgcgcaaaatccccatctcaatagcacttctctcgccctctccgtcgggtggccatcatgagagggaataaatcctgcgaaatatcaccatcttagcagcacttctcccattcacccgagaaaactacaacctttctcacacaagtttgttgtgttctcgaaaactccccctctctctcctatacagatccagaccgtgctgctaggtccaccgctgtcatgccttgtcttcgagtcggtccaggggatggaacataggcaacgggatgtgggggcggcgatggagtagagaccggatgaagcctagcccccctcccctcgaaggaaggagagagaggggtgacccactgacatgtgtgtcccactttttaaaatcttttttcctgattgacatgtaggccccacatattttgtttgaacttttatttttcttttaaatcttgcttctatgccatgtcaacgtcatgtgggacgaaaccaaaacaaccgtccaaaccaaattgggaccttgtatgcactggtgatacgttaaagaatgttattcaaactcgatgttaagacgagagatctaaagtaaacttattacctttaacgtttctagtggaccagcccatcttcctacgtaaacccaacagccggcccactcagattcccatcggcacggcacgtctccccctcctccgcacaagtctcggattcctccgcacgcagcttcccctcccgaagctccccaagtttgaaatttcgaacggtcggcggcggaaggatggagagggctaccacctccggaggcggcggcggcggcagccagccgccgcggggggtagggctgccgttggtggaggtgcaggcggcggcggcgtcgctgcggcggtcggaggtgttctacgtcgtgaaggagctcctcggcttcgtcctctacatgcaccaccagatccccgcgtaatcccccctcgatccgctcccatcctatccccccgcccttctctctttcaatctctctccctctcccaaatgctggggaagtggtcggtatagggatggatttggtgggtctctatgtgagtttttagcatctaggttacagtctaaacaatttgttcgagttcgaatctaattttctagagcaattgaggtggtactgaacttcggatttggtcaccagattttgatgggttttgttctagcaaccttagtgcttgtggatctaattgggatacaagttgcattgcatcaatccatcaaataggcaatggcctgactgaatggctgttctgctgtagcagagttgagaattccattaattcaaaatggctctagaaatatgcgtggcgttctggaccatactgttggcaatgaattgggcaacttcatcgatgatgatttgaaggttcacttttgtaacaaattgcttgcatttcctttgcttcctgggagatgtttggtattgatatgtggccttaggttgtgcattctctgttagatgaatatgactgttgattgttatgttattataaactgttaatttgacgagatactttaatttaccttattgtagcgtgttatctactcctggtcctgattacatgtgttggtgcaggtgtggtgttcttgtgctttcgttcttatgttttatgcacataataaaatagacaaaaaaaaattctggaagaaatcaaagtgtgtgtatccgttcttgtagaaatttctgctgtacgacttttttcccccgcaaatatgccaaaaaacttgcatatatttgtattaagaagaataaatagtaagagaacaaagtagcaacaaatatacatacacacacagagcttcaaaagaacaaatggtcagagactttatgtatgactgtttagtttctgtgtatgttctgggctctggttcttcatttgcaatacctgagcacatactcatgaccaacctagtttgtccagtacaacagaataatgttgatgcattggtgtgacgctgttattctatgatgtagggctaattttctggggcttaagttaggcacacagcattgttgtgcattggtgcttgacttctaggatgcgtacatcactgaagatgaaacctttgaagatgaaatctcctgctattgtgttgtttaaatttgttatagcacacctgcactgcaatcaaagaaaaagaatataagtgaacagcatttagcttggattatgtaattatccattttgcagatggccagattatatactaagttagggcagttatacactgctgtatgtaaaattatcacatgaatttgaagtctaatttgtttttctacattttcagggtattgcagaatcttgaaaatgaatttgcaagtttaaaggaggaaatggtaagttttgttctcagaaagaatgtcaccattagcatctacgcagtatttctttatcgagcctattaataatttgtggctatttatagacagagatggcattgccaccaggagaaatgaaaccatctgatcagagaaagtacaatacacggaaaagggaagtaagacggaggatcaagaagcaggagaagttaatgaatggcctctccagcgtattttctgctcttcagaaagcactcgatgaagttcctagcattgaaggagttctcctgatcctcggtggtagccttgtcaggcctctgtttgtctatgacattacaatttctcatggtagatttgatgctggaagtgccaatgagcgtggtgcaagcaaattagcgcagtccgtttctcgaaaggtgagctactttctggcttaatgctccatgaataactatcacccattagatcctagggtgactacatttctttagaatttggtagtttttctgaagtaccatagagttgagatctgaacgttgatggaattcacaatgctgtaacttttagtacctactttggacaacaatatggcaatagcatatctgaaatgttctagtgttgtagttttgctctactgtttggcattttggcatatgaccaaacagtgtaaggagaatcttgctatgtttttgccccattgctaggcttaattctatttttttttacttatcattgtgcatgtttcatcttcatatggtggtcctctttaaataataacatgcatatgtatatgtataggccattcgtgctcttatatcaagtggtgcagggagtttatcttatacaggtactggttcttctgttttactatatactagctctgttccaaaatataagaatttttagtggtggacatgggtattaaggaagtaggtggaattaaatgggagaaggttgtgattgtttgagaagtgaaaatatgtgaagaaattaaatgtggggagattgtgattagttgataagagaatgtaagtagagaagttgtattttgggacaaaatttgaatgctgaaattgttatattttgggacagtgggggtatttgattgggaatgccatcatccttttaccttaacgttttccctccaattgttttgaaggccctaccaagctgtttgttctagtcagatgtccctgtacattgaacttaccactggacttcctgccgaaacgtgattttcgttacagcaaaaaggttttttttttttctgaagttagtttatgttttttgtcagcttccttttgcaaaaagatcaaatgtctccctgattaatacatgagccttaatcttttcaacacaggttgtacccctccagatgtgtataaaatgcaatatagcaggcatccaaatagataatcaacaaataacatcaattgttgatgcttcaagatgcacttcagaatctactatttctgaggttatctggtaaataattttggtcatctgttcccagttacccatttatcactatttgctttctgctgctatttcccctcctgtgtaatggtaaccaatagttcagtattgtcttaagtacggcaaaccttccctagtactatgcaagatagagtgctcttcctgagtccatgccactttattttcttaaaatcaaggcaggagcactgctgaattctactagaagaggtgaaattatgattacaagaagcccattagtgtaatcttattaaactgcatatgaatcttttgtgttttgaaggataaaagaaatttaatttaccaacatttgaattatgtgcttttgtgttttgttggcatcaagtattgcaaagaattattttaaggttgatacggttaggattttttctcagaaatcttacccattttagtttgttatgtgtacactggtttccttctattttttcccctgaaaaacatgtatgtgttttgatgacccctgttctgtttttagacctttgaacttccccctttttcagtctattaggcagagctcctgccattttcgttaaaaaaagaaaagagtgatctccagcggatcttttcttttgaacttaagtaaattcagttaacgaatattcattaattttccaggttccagtgtaagcatacgataagaggcctaccttgcaaggcgtcattagaagagtgatatggcccaagcatgttgacacgcccagaaaacagtggatgatgtagcgatataactcctgttctgactttgtaaatgcatacggcattccgcgaaggatcatcattctgtatgttcgttccatttgctagtgctatgaagttcagttcgctccattgcctaacaaagaagaatgaaaaacaagagcacaattaaagtttagtgaacctgaagtattgaattgaatctccacaccattttacttatgctcagttttattgcgagtttgcaacactacatatttacttttgaaactatgattgtgtttagaaccaggggtgtaaagttttggcatgtcacatcggatatacggacatgcatttgaagtattaaacgtagactaataacaaaacaaattacagaatccacctgtgaactgctagatgaatttattaagactaattaatatgtcattagcaaatgtttactgtagcatcacattgtcagatcatggagcaattaggcttacaagatttgtctcgcaatttacacgcaatctgtgtaattagttatttttttcgtttatatttaatacttcatgtatatgttcaaatattcgatgtgacagagtgaaaatttttaccaggggtctaaatagggcctatatgtttataagtagcagcatcctataactacataattgccacggactatatcagaaaatattgattttaaaagtccttatagccaagaaaaatcattcatcacaagtgattaaaaagtttgaaaaatccatatagggatctagactctagagcactatgctaagatttggtagtaatataagatgttctatagttagacacggttattaagaaagtgggtagaataaaatagggagaggtatttaaaaaactagagttgattttgtactcaattcatttttgcacgtcttctccaaaaaaaaaaacacgatgtacttcatccaggcttcgtccaagtctgatccggtgcagttggttggctccgaagcgtgcacgtccgtgcgagagtagagtaagagagtaaacacgatcatttcgttcttgcaaaactcacctaaaggaaaattaatctctttttttagaacttttttatctcttcgctttcctactggagcttgagggatcaaaaaggagaacgactcaagaagcgggtgtgctctagtctctagacaagtcgcctatgctcgctaattctcacggtttcgtttgatctggttgtagattattattggcttcttgctgcgtatcgacgcatcagggtttcgtcgatcttgtcggcgcatcagggtttctttgctctgcttcggccatgtctttgtggatgcgggcagcctccatcggaggatatggccatgggattggtggatggtttggatgtttactcaattaaatgagtaaattttacaatgggccacatattttgaccaaggtttcatcatcggctagggttaaatcaatgttttcacttaacaccatacatctttacataagtcttcagtttggactagggtgagcaaaacaagggaatatgtgagacagcttcatatgatttacacagggataattataaaatgcaaaacatttcatgttttcttccttcttttcttttcagtgtgtggtagttaactagttctattttctattttatttttattcattgtgccccaatgtatatatcattttgtgccacttttgaacatgttcacgtcattattttagtgtgatctgctgaataaaaagttgttttccgatttgctaatttctttctaaagatatttgtcttaatactgtggcactaaaattgatgattttaactatcttttctctgacaactacctttgatgtgttcaaccctactccaaagtgccaactaatgcaaacatatatggtgttaaggcctggtttagttcccaactttttcttctaacttccaacttttccatcacatcaaaactttcctacacatacaaactttcaacttttccatcacattgttcaaatttcaatcaaacttctaattttggcgtgaactaaacataccctaagtgaaaaggttggtgtggaccttgcccattgtgaaactttggtcaaaatacatggtgcaatgtgaaatttactccaattaaattgatgtgcgtcaatttcaattttagatttgctcctcctttgatcatgtatgtttgttacttccctgcagcattgcttgattgggaagctgaatcacctacaagtcttccctggtctatagtatacaattttggataaccgactgccaagttttagttcatctaattttagtttccaagatttatcttgtcaaaaaaatgaatctcagtcatgtaatatttatcataattttagtttttcccgtgacaatgcacaagcatttgagttaattctaatgtctaaaattggatttcataaataaaggttgtttacttcttacatgaaactttttatttaacaattgagatataaaattatgtttcatgtatgtgggaatgtattctgcgtttgtattgattttgaacttcaactctatcttttacattatggcaatattaattaactggacaatcaacttaaaattcttaggcttctcatccattatcgaatcttgagaaatcatatccctcatccaaattgagagttgtcaacatgtttatgcacaaagttgagcgagtttgttattttgagttaggatatatcatttgaacatttaactcttttggattttatttaaacggtgcccctcttttcaaccgaacccaaatttcccttttttttataaaaaaaaatactcagcacgtgataggagggttgtgtttttacccttttttttttcccctatacgcgtctcacccagtcgcccgaccggcctcctctcctggccacggcgacgcctcctcccccggccacgccgcgaataccttgggtctctgcaatagtccaataccgatctgcggcagctactctgctcgtggaggagagccgccgccggaagccggaaggccgggtagcgccatggtgagatcccgaaaaccctaatcctctccgatgattggattcgatggatctggcgatctaattcgtgtttctttttccttttttttggtggggggcggtggtttagtcggcgctattcaacttcaattcgttcctgaccgtggtgctgctggtgatctgcacctgtacctacatcaagatccagttccccgccatcctcaacgaccgcaccgggtatttttttcttcgtttcactgtgaacttcctgatctgcgcgatttgttcttctttttagtcgtggaggcaaataatctaacccggaaaactaaaacagcgagatgtatgagaaaaatctatgtctttacagtggaaattgtgtctttcaggcgctgtattaacatgagacggctgtgtgcgctgacaaaaataaagcttattatcgtggatgaattgcatatagtttgtttgtggaccggattctctactaatgtggtttatagtaccctgcacgcaattgaattattgttcttagatgttttcagaatatatacagatgtgtttgttagtgctagttatgcagaaactgaaagtttgcctgtgcatgaatggttgtggacaataaagtaacttagctttggtgactccaacttgatttgggcatgattgatctgtgcaagaaaccagtcaaatcaatcaccaacttatatgccatgaatcatgataataccatgtgctaactgttgtttgaaacagttagtgcaactgtacttgtcactgtgtttacaatttgttcttaacccttatttgaaatgccaaatggccaatggatcttgttgctttaataaagcagaactgtggaaggatatctgttaccatgtaatgtaataagctgatatattcctttttgtacttgaatttctccacagattccgtggtttcttttggaaagcagccagaataggtacgagtccttttcttcttccagctcgaatagcaccacctatcttgtttccattttgctaatatctcctgcatgttgaacggtcatttcatttttcactctgcaccattgggcactagattttttgttggtatatatattatcgaacatagtttcgtctatcaacctcaactgtaaatgttcactcattcaaattgtcagcacctaagttcattatttggtgtttagctgagctcttaatttcagcataggcttattatattatctatagaataatggtatataatacttttctatttagataattttaaaacaaaacaagtaaacgaaaataaatctgaatcatctcaaatttctgtagaagaatgttcataaatacattgttttcttttattttgtcagatagctattatttaactatcatgaaagtcagtagtcttaatttctcaaagaaaagcagccctcctgtgattatgtttgagatcttcaattgccattttttttcagctgtggagttctcgtgaaaatttgctatcatggtatgcttaaactatttagcaaaaagatcctggttagatatgcgttgctttattgtcatggtcctcatggtcaattcaataatatctctgttaggcacataatggccactttaatcttaaaaaacatggtgtccttagagatctatatggaatgaaggatagtgaaagtttacaaaacatttagtgatgataattggaatttgaagtctgacggtgcagcatttctttcttcgttcaaagtctaatggacctgctcatggatgatatcacattaatactaaagatatgctgactatcagccttgatgatcagtagttattcaaccaatgtttttatcacctgctccttttggaactttacttgaaagcaaatagttcctatcagatttcttaccacttcctggttatttatcttgaatggttcttttcctatttgtattgaacttgattaacttggacaaatgaatttttataattctattaaggccaaagttactcagtgagaatcaactataacttattaactgcagctaaatatatattggtggaaacatttctgttttgtaactataattccattgtcactaagaaattcaggaactgctgctagttcatattgtgaatgtttttccacatctggatctcatttattgggttttcaactgtttatatgtaaaattgtaaacatggttgtccaaactgatagttatgtgctgtgggctgtggcgcaaggcccggtaaagctttgtgacagacatggctctgaagaccatgtggttattgtagacctcaagttaattaattgaaaagccagttctttagatatttcataatttggtacacaatcatgtcaattacattatttttgtacagtgataaagtttcttcatcagttcattgttaaaaatccacccatctttctatcatcccactatctactaagaaagaattctggccaaagagttctatttaatctatctctcgatcaacttgtcagccttgaagccttgtcattgccacagttgggcaagatctctactagcatcatgaccatagtgtgtgcataaaccctttgtctttgcctgcttgcccaactacacagcattttaccagagccacgttcatgagggattatttcatttgattgtctggttattaacatatatgttgtatgtgcaagtttttcaattactcaacagtgagataatgttgccaaataacatggtattatatatttatttaatgcatcatttgtttcctaggcatttggaattcatcttttgttggtttttctttatcaggtgaacgcttaagcccgtgggtagctcttgggtgctttgccatggggatatccactattttcttctgaggccttcatgattttaatccaggctgcagaagatttgtaggaagaacagtgtgattattattgcattgttttttgtgtttttggaggagcttttgtttcaattttagctgggatgtggagatacgactatggcaagtgccagttg

SEQ ID NO: 67592 - DNA, 749 bp, Oryza sativa
tccccagtttagttgactgataacttgtaagatgaggtgatttgtatgaggtcgcatgctcaggtgctagttttatgtgccctttcagctgtacgctgtaagggagagagccacctgaggctggtgattgagtcagtctatctagtttttttttctttttctttcacaagtagtagcacagttgtaggcttttccatctaaatatataacatgtagtatttcctatacttgtgggagaagtatgttttcgcaatatttacccaggcatataatgctgatgcttacttgtgagggccaggttgaggcaggtgatgatgcaagtcaggaggaacatattttcctggcgtgtgaatggcagcatgggaaagccacaactctgtagcagcctgatgagccacttgaggaggaagaagctgaggatgctggcaggcatgttgagtgccggcactatcccggccgtcatctggatcctcatgccgacgaagcagatgacgacgctgagcaccaccgccacggccatggcccgtggcgtcaccagctccctgaattccggcgatggctgcttctcgaacaccgcctccaccgatgtcgctgacatgggatcgccgatcatcgcatccatggcgattaaagctccaggtcaatggaggcaacctcctggagggtttttgggttgtgttgtgatggcacaagtgggtggtctcctgggttggctctcctaggaacaatgcatgggttggtctgaattg

SEQ ID NO: 67593 - DNA, 1201 bp, Oryza sativa
tgcattggttagtacgtaccacaaaatgagtgagataaaatcttattagatgatccaacaattgatatgatcttattatttacgtatatatatctttattgtttctctgagttcctcagttttgaggcttggagtttaagaactctcgtaactttcggctatctgtggataaagaggtaggtcggatttttatccattatattaagaaaagaaatgtaccttgtatccattgagtccgtctaagtttgaagggctatcagtttgataccactccccatgtttagtttcaaggtaaggatatagaaatccccaagagatgatggccccgaaaagtaacccaaaattgactatatgtgggcacatcattcctacaccaatatatgttgcagagaaatcaatgtagaatctgtaggcacacacaatacaatatgttagtaattcagacgcttatatcctttaaaatatatttaaatttgtacatggatttactgagatctgcatcaattcctacaattagcagcaattcgatggttccataatccgtaagaccatcttccatcgatgaaatcaggactacattttttattgtctacccccctaaatctgcagaccagattgagcaatatattcagtctcacagtttcacatgacatgtatggcccaattgtctagctagctattctgaaaactccttgccacttttctctagttatcagcataataactatattggcattaaatattgtgaaattactaattgtttcttacatatttaatcatttctgtttggaaatggatacacaacttatatacaaattgttaagagaatttcgtgatacgctatatgtatagatatataattttctgtgtgaccgttctagatcatctgttgtgatactatgttgatactcaatcattgactaataccattattttaaaaaaggaatatagctatcacctgcgtttatatagttccagtccaaacgttggaaagcttgaaaatccacaaccactgcctgaagaatagaaccattggaatatagaccaagaaaaactaccaaaaaatactttgaaaatagtcataacctgcattctgttgacataaaaatattagtgcaaaaaatatgaatatgtagttaaatgaaattcagtgttttaattttcactaaaaagacaagacttcattactttgctatataag

SEQ ID NO: 67594 - DNA, 2471 bp, Oryza sativa
caacggattaagatagaaggtaccagtgcgaaggtacttaaagtttgggctatgtataaaattcgtgcgggtggagattgggaataaaatcgacagcgtgggattcaatcgcgcaagctctgcctctttggcgagccctctccaccactgggcaagtgtgggttttacgttcaaaacaaatctacaccctagttacacatgtaattaaagtgaaaaagtttttctcctaaatattgtcgaatgtgctagctacagataaactcaattattaagccatgagagtcagaaagacttttttcaacaacaaatcatgtgttgttagaattggaggatgttaaagagtagtgctttccaaacctctggttagggtgtgttcaggacactttgctgacctctgttatattgttttccatgtgcatacttcctgaacttgaaattttttctaaattaaagttgttttaaaagatcgtattactacatttttcaattcttttatatttacttaattaatcatatatatataattaattatgcgctaatgagctactacctcgttttgagaatgagttacaaacaagtagtgccaaacacaccactatagcctgtggatcagtaagccgttgaatctgacatgatgagtagtagtttgttaatccaacgggataggtgattcgacaatattgatgtgtatgaagatttgcatggttcaaagatatgcataattttacgcatgtaggaagatcttaggaggttatttacgcacttatcattttgctggggtggcaagctgatgtgcagaaatatcctaagtgactcttttttctaaacttaaaaatgcacccactaacaaggttttaataccggcatactcaggtttcattatcttgtactcaatcacacccaacgaccaatatttatgtaccctcaagaagagggtagaaaaaagcaaatgaaggaaatgatgacaaggaaaaagatagaccccgtaataagcccttccttgcatcacaatctcaccaaaaaaataaaagaaaaaagagctaacaacaaattaaagattgaagcagaagcatcaagctaagcataggatgaagagcaaggcaaggcagggataaactttatttcaaaaaaaaaaaggaaaaaatgtatgttggtagctatatacacgtccgtgcgggtactgactgcctcatcaaccaatctgccctccgttagtgtcaatgtgtgtttgtgtcgatcattcacattcacatatggccattgttctggatgtgttcgcgtcctacgttggcaacctgctcaagcaggtggccaaggacgagctcaacctcctcttcggcgtctccctcgagatcgccaccctccacgacaagctgcgcatcctcaaggactatctcgccgacgccgatcgccgacgcatcaccgacctgagtgtccagggctgggttacgaagctcaagcacaccatgtacgacgccaccgacatccttgacctctgccacctcaaggccatgcagcgcgggggtggtagctcatcctcctccgaccctgtgggctaccgctgctcttctgcctccgtaatccactcttcgcccacgacattggcagccgcatcaaggcgctcaatgccaggctcgacgccatctgcaagagcgcagccaccttcagcttcctcaagctggagtcctacgaagacatggtggcgcctcgacggttcagcgtcgccaaccgcaggacggacccggtgttggagcagtcggccgtggtcggagagaagatcaaggaggacaccagggcgctggtgaggagactcaccgatggcaagcacaagaagcaggacgcggtgatggtggttgccatggtgggcaccggcgggatcagcaagacaaaactggcgaaagaaggtgttcaacgacgaggccatcaaggaagcgtccgacaagaagatatggctcagcgtgacacaagacgtgaacgaggtgaacctcctgaggacggccatcaagtctgtcggcggcgccagcgatggtcgagagagcaacaagtcactgctcgtgctagcgctcgtcgacgccatcagggacaagaggttcttcttggtgctcgatgacgtgtggagtgaaagatcttgggacaatttactcaaggcacccttcagccatgcgccgccggcagccacctcctcatcaccacccgccatgacgaagtcacccaacggatggaagccatgcaacctttccaccacgtcgacaaactgtaccctcaatatgcatggtactgctcaagaaacaggtcatagctctacccatattaattattaccagcatatatatgtaatcttgtactaattgctagctagtaagctcaaaattaatctgaattcatgcatgcatgcatgttcaggtagcatcaagtgatgatatggaggaggttgaaattgatgacacactaaaggacatcggaatggaaat

SEQ ID NO: 67595 - DNA, 2284 bp, Oryza sativa
tgtagtttacaagagctggggcctctcgctcagctacggagactttcactaagaaagctagataatgtacctgctccctccttggctacagaggctaggcttggtgaagttgcatcttatgtacttagcttgagattagactgtagcagtagacttggtgaagatgggttagtaaaagatgagaaaagtgtctccgaggaagaaccttgacaaatcgaggaggtgttggatgagcttgccccaccatggtgcattgagagtattgagatcaatggctattttggacaacggctaccaaggtggatgatgtctagaggagcaagtgcatttgagagactgatgattgtgatgatgcaggacctagcctgctgcacccaactgcctaacagcctctgccacctcccatgcctgaaattttttcaggtcatgcatgcccctgcaatcaagcgtgttggccctaaattcattactatacgaccatcatccagccaacaccaccatggtgcccaagtataccctagtttgaaggagatgaatctaataggcatggaggagtaggagtgggagtgggagtgggatcagcaaccaaataatgtgcagacaatgcctgcattggaagagcttacgctcgaaaactgcaaattgagaagccttcctcctggcctttcctcggaagcgatagctttaacaagcatggacctatataaatccagcaactcagctctatagagagctttgcttctcttgtcaagcttgagctgcaagataaccctgacctggagagggtcacatctctccccaaattgtagaagctcatcattgtcggctgcccgaagatgagggcattggagggggtgcctgagctacgggggctggagctggaggactacgacatggaacaactcccaagatacctgcaggcttgcaggatgtgagtcctatgcacctggtgctggactgcaacttagagctgctcacatccatagcccttggagaatctggtcctgagtggggcaaattgagccatgtccagcatatcaaggcctatgctgatcaaagagacgatgaaaggaagtggcacatgttgtacacaagagaaccctacagttttgagacaaacatcggtgacaactcttcttccagtactggagtaaattagctcggctgcttattcttcttctgatttctgtccatattttttctttctttttacccatattcgttccatctttcaactgcatgatgagcctttctactgtctccgtttcacttaatggacagcttcagaggatgaggagtaggaaacaaatacttcgatagctcaaggcacccaagtggtatctggcagccatccattgtcgaagacattgctagagacaacagtcaatgcatgctacaaattgttgcggtccacaactgtcagcaaatctcctagcctaacgagcaattttacagtccttgaagagataccatgaggtaaaaaaaatttaatgtaaaatttggtgcctcatagtatttaatttacaatagaaaaagtggtacctcatggtatcttcttaaagactgtaaaattgctctagtctaacattcattttttagataatgcctagtctatcattcataaggaaggctctacagctctgtacatgagatgggactgtgaatttgtgatttgtattgttgacatatgctactacttcctgcaatgtactgaaagaaacaaatatattactatttgagccaacattatttgatttgaggactgcagtgacttaacacattgttaattttgtacttagcctctcccctgaatattgactattatattgagaaaagttaggaaagacctaagaaggtagcctcattgcctatcaaaaacagctgcaattcaaacttttttttttgaaacctaagccagctcttgctggttttatattaagtgaggggggaactgtacataaattcaaacttgtggctagaacagaacatatgacatcaaatcactaggtaactgaatattagatattacgagtagtatgcaggaatctttagatacatttaacacaggaagtgccagtgaatcaacacaccatgggtatgcaacacggagtgccatccaataacatttcaagatgaagatccaacagaaaggtgggattggaggcttactactagttataagccacctaaagattttcaccccatgagttgttgatttgattcaggagattttattttgctatgtccttgatgacctcatccatgtcgagcttcttcatcgctg

SEQ ID NO: 67596 - DNA, 2203 bp, Oryza sativa
gccagtgagataaccgaaaagttattttagggttgattgttgcaaaaaaaaacaatggcttgggtttaacaccatgtagatactttttcagggttgattaccacagataccccaggaacaaaactttccagatcctcctttaccttcacagctctgatcttgaactgtctgcattgagtgctagagaatcgtacaaagagcaaggataaaagaaaattcaataagaattgctaccaataattcatttaatgcaataggacttttttagatatgtcaagataaaggaatgatgtacgagttatctagaattattcagctaagcaaggagaacattttgtccaatgtgcaaaagcaaattataagtctgttcgataacagatctattgcgcgtatggtcaatcatcattcttatatgtaaaatacaaaagaaggtggtcttacatactgattagagatacagtaaggaattctgggtttgggttctatgtcgatggtatctattgacaaaaccattgttaacacttccagtgataattcacaaaaactaaagtccgttattgaagtttaagtaactagtattaattgaacgtacagaaaacagcagaaaacactcaattatcaaggaaggaagcagagtatatgaccccccaaaaagaaatggaaacctatagatagcaaagcacttgacagataatcacaaaaaatggcttcatatatacaccaaaactagaagccgcaagaagaagtaagtaaacctactacagccaaaatactataatcccctagcaactatttgaacttaggtacagagagaacattgttctttttctttttcttctgaactgacatcgttagaaaatgatttccttatggcttcggcgggtatcaaaatctgaagaatgcacagaagaccatccatagtatgtatgtaaaagggggcttcaccttttaggttatcaaccaaccattagcctgttagccccagcagaacgccattaaatcccaaggatgaacaagtaatcccctcaccccgagcgtgggggcacttaccatgactccacgacgatgcgcttcccgttgctggccacagcgctgtaatccgcagccgccacctctgcatcttctttcctggccctcttcctccccttctactcgggtgctgccgcctcctttttggccgcctttgccggagcctcggcccactgcttcccgacggccatgctccgtgtcttcctcggtgacccggccgccggagacttgcgcttaggaggcatcagcggcagtaggcgagagttagcgttggttggttccttctccaagggagatggagttggggttggggaaatgggggggtttcgtcggaattgagggaagagaaaaggtgcgagaggttcccgcccaaccctcttcccattggcaggaaagaatccactcccaacttggtccttcttgggccttgggcctatgaatcgattgatgtatgagccttccctgtaatttatcgatgtgaacccatctgtcagctggaagtatctttcagttggaaaaagtacaccaaaggtcactcgacttgtcatcgacttaaaaaacgccctcaaaccacaaaaccagatatctggtatcccttaactaattaaaaccgatcacaataggtcctagatcagtattgcaacaggttttgttcgacgtggtgactgagtcagcgtgggacccacgtaggcactatatgtaagagtgatccacgtcatcacccttcctctttctcctcttctatcattctgggcgaggcgagaggcgggtgcagaggccggcagatgaggcgggagagaggaggagggtggtggctgcagcggggtacagcccagccggcccatcccgtccccgccgcaagcggtcgtcgtcttccacctccagacgctgcccgttcctctccccggccacaaaaccctagcgctgccaccgattcgatccgcctccccgcttgttttccattccgattgattacgaaaatcgattacccttcacctcctcataaattcccccatgttttccccatcaatcatgcctttaatcgccttgaatcatcgcctcttcatctccggcgaaccgacgccattaccttcggcaaccgagctccccggcactgtgttcgtgttcctttcttggcctctctcttggttcgtgttcctttctttcttgccaa

SEQ ID NO: 67597 - DNA, 6622 bp, Oryza sativa
  unsure (1)..(6622): unsure at all n locations
gtttctccatattagttcagaatttattaggttatatgttaatgacaaagtcatatgactaacggatccgtaaaaaacgatcctaactctagcgcataattttattttttttcataaaataactaagcacataaacaccgttttggcgggagcatatgatgggattaggcactgatgaggacatcccttccaacgatacaaccacgcctattgcacagcaaggaccaatgactagagctcgagctcgtgaacttaattatcaggtaaagtcattcctagctaatcatacaagttcttctcagaattaggtgctactaaatggttgttgtgatctacttgttgttaggaatatgggagaggaaccaaatcgcaagcagcactagcagcgctgatttgatgaagtcaatgctcttcactccggagggcaaacggggcaaatgagtacttgttggaaagatctcgtcgtctactgtcagctatgtgtggcctcaccatcaactttgacccaggctactcagaatgacgaaaatagttctttacatcagaaacttgggcttgggccttgtatcattacagcccattaggggtccacaaaacctagggtttgctcccacctcctctcctggtcattcctccacctatatacactcctagcagccaccattttgcactttgggttttgttttgatgtaagtttagctgcagctacttccttgtactcgcgtgtgtcggctagaccacccggatacttgtatttagaaccccattttggtttgtttaagtttcatcatttgacaagtgccgtgagctgtttccttgtcaacttgtttcttgcttgttcttcgattgcttgcaggttcaaggttgttcttggcacgacaagaacagcaacaacgtggagtcggtgtaccagttgctacggcgcagcacccctgtggtagttgtagtcggacagccaacgtcgtatccttccccaaatcgaagtttatcctcctctcatcgaaagatcgggaacccccgttgctgcatcaggcacggagaccaatgagcatctgccataaggctgcttattaccgaaacgctaattagcgcgtaggcgttggcgcgcaaacactaattccctttttatctttttttctctgttgctctttttttctcccgtgattagttacctttttctcgccgcaagcgtgattttcttcacgattttttttttgttttataaattaaaattttcacatccaatttaagttgaaaatttttaaaaaatgttttaaattntaagatgaaagttttcaaatttaaatcgaatgtcttgaactgtgtgatgaaagtttataaaccagtattttcttacaaatgcgataaaaaatatattttttcaatttttttcccaagcagtgcggaagccggaagaggagcaagacaccgtcaccaccctgacatgacatgcgggccctacctcattacctcaaaacacggcaccgctccccccgcgtgaaccgagctctcgtggacctcaccgaccgcctcggcttctccacttccttcctcgagtgttttacccctatgccattaagaaagttggaggtacgcatgtgccataaaaaagttttgagtcatttatatgccatgacacaaattttcgtttacctgtgcgccactttggatggaatcagcactaacggagactaacggaggtttaaaaggtctattttgcccttgctctatttcagccactttggatgaaacatttggaagagaaatcggctcacacaccacatagaggctgaaatgtagattgaagaaaatgaaataaagtgaacatttttaaaaaatgaaaataaagttaaaacaggaaataaatatggaaaaattcgtaaataaattttaaaatgatggaaataaatagaaaacagggaataaataagaaaaaaaattcgtaaataaattttaaaaatcataaataaatacaaacatatgaaaacataaggaaaattcgtaaaaggataaggaaaaaaatgcgtggataaataagaaaaaatgcaaaaaaaattagaaaaagcaggaataatacttggttataggatcaacgttcaagcaactaaacttggtcatagcatcaacattcatgacataacttgcatccatagcaacaagttcatatcaccaacatttaaagtagtaattcaacacactaagtccacacataaaaagatcaccaactgctagcattacagaatcacacccaaactgaacaaactctgaactctgcaacaatatgtagcagcaagaaagcaagaaatgcaacaagctgttcgtcctcacagctgcttcagtccgtcggcgaagcatgagctgaaccgcgccatgtcggactccggcagcgccacgccgatctcgatgccgcgccatggacaccgtgccgggcgtcttgtcgatggacaggagctccaccttcgtcggctggcccagcccgaagtcggtgtcgtacacggcgtacagcggcgagccgccgatggacatcggccggtgcggcatcagcgacacgatcttctggaaccacccgtcggcaccgtccagaacgccgtcgtcgagccccctgatggcggcgccgatgcccgccgccgccgtcaccacgctgccggcgccgagcaggctggatctggcgaggcgacgcgagacgaggcgaggcggcggcggcggcggcggcatgccggcgaggcgaggcaaaggcggcggcgtgccggcgacggcgacgaccggcggcggcggcggcggcggctatagaggcggcggctaggctagggttcgagtgaggcgcacgggagaggaggagtagagatgaaaatgcttcaggggcaatttagtcattttcatacgtgagtcccacatgtcagagctcattctctaacatggatggaatggtacacgggtaaacgaaagtttgtgtcatggacaggtggctgtcgttttatacacggcacacgcgtaagcttcaacttacttaatggtacagggggttaaaagactctccctccacgccgcaacgcaaaggcagcaaaaccctctcctcgattcccccctctgcttcgctccgccgcctccgactccgaaatgcagcacccgctccgccgcggcgcccgtggcgcgcgccctctccacggccgccggcgccggcgcctcggcctcgcgccctcggtgggggatgatccaccacacgggcctgctcatgcccccgtcgtcgccgcgcgccgcgttccagctcgccgagccaccgtgcgcctcccacatcctcgtccccgagcacctcgtcgaaccgcagccctgcccccccggcatgatgcgcgcctgcagttcccacgcccgcgcctccagcggcgacggcctcctcgtcctcgacttcacggacggcctcaccgcggcccccgccgccggtgcgcgcggcccgataccgctcgacggcaagcaactgaagcccgacgtcacgcgcttcgtctgcaaccctctcagcggcgagctgttccgcgtcccggacatcgacgggacgaagaagaccttgaagtggcaactcgtcggcatcctcacccaatctgaccgccccaacgggccgccggataggtacgctctcgcttcgttcagctcaaacgccgccgccgccgacaacgatgagtggtccttcgccgttcggcggtttctctcgcaaaagggggaatgggacgagccggtggttttcccgtccccgctcccgctcgagcggccattgttcgtggatcacgatccggtgaccttcgccggccgtatttggtgggtcgacgtgagctggggcgccatttccgtcgatccgctcagcgaccaaccggagctgcgctttgtcgagctgccagggggcagtgtgatggagcccgtgaaggatgagaagcggaggggcctagtcaggtaccgccgcttgggcgtcagcgaggggaggctgcgctacgctgaggcgtcccagaaggagccattcgtgctcagctcctttgcccttgacgacaatggcagcagctggacgctggagcaccgggtggcgctcagccggctccgggtggatgggggactcccattgcagcaggaggacacgccacagattggtgtcattgacccactgaatgctagcataatgtacctcaaaatcggcgtgcaatgtatctccgttgacatggagaggggtaaggtgcttgggcgttctctgttaggtgatgagagttatactcgctcatgtctcaccgctctcctaactccgtgtgttctcccaccgtggcttccatcataccggataccttctgcaggttctttctcatgctttctttgagatgcatgttttccatacgatgtgaatatgcagatttttattgttacgctcatatgttctgatttgtccttgaaatttaaccgtgtggttggaggcctgtttatagtaggatgatttgtttcatgaataatctatgggatttttgcaaatgctaattgtcaagcgtctgaaagccacttaaatttcaatcgatgtgcctgctagctatctgattctgtttctagatgagtgtgttgtgcggattggtaattcaatggggtgatagatgaaaaaaattatgtatgtccagtcaactaacctatgctcttttgaatctgttttttttttcctatgttaatgattcatgcataaattctgtatcatcatttgtgaagatttattgtaggtcaggagagatatcttaatgcaattatatttcgcagtcttttttgttgcagtttagaattcactatgcaagactaatagactatactaaaactctataagttatcactttcacattttactctagaacttacatgcatttactttagaattattgtacggacggtacgaactgccaggagtggcttaatgcaaaatttcacattggtccaggaaaacttatctagactggaaccaaaataaattgccttgttattatcttgagacattgtctatgttgcttcctgcttcttgacaatgatcctgtcatacggttttgatgtaatgatgtaagtggcatgtagaagaaaaatataatcacattattttttctattagaagagtaaaaaacaaacatgtatatgggactataatattgtttttgtttgcttgtgttcctgatgaataaataaatattggttcatttcatatcacttactcccctcgcacgttcccactgcttaactttcgctttctaggtttctaaaatttaacaagtgtaagctgttctgatggattaggatttttctcttttcggtgaggtgatgtattattatgcaattggagctgtgattccaatttctcattatggaaaacaatggccgagtcctcaactttgggtttactgatgcatattgaacttaaaattagccgagtagagattccaaacatgaacccataagttggcatcagattgttagactccttttgggagcaatctgggaaaaggctgtcttacatgtcattcgaaaataaaccatatagttggatgttttttgatattagtattgtgtcataagtcatttccaatttcagttgttcattgaatggtggaattagttgctgtaatctgggaatttaggtaggcatgttgaaacatccaaaaaaaaacagaaatacccattgcaaattgcttgaaacttacctaaatttctgtcaacatgcatagccattttattctgtttgttgatgagtacgttattgatctgcactagcccaatgtggagctaaatggtgatggaaaattatgcatttacagccaactgagctgaacatgtttcagtgtataaacatggtttatctgttgaatgtgtcagagacaagatgctatgctcttgcatactgtatacgaatgtacacaaaagtacagttccatttcttatgttgtattgtttaactccctcactgtaggaactccaaataccaagagcaacatcaaaagcaaaaccttgtcagacatattggttcgtgcagataaggacacgaagaattgaggtaaagaaccaagttcgcttgatactttattctgctattcttgtctaactagcatatggcccgtgcattgcaacaaaattttaattaaagaaaattatcattaacccgttattaccatcattttctacatatataatcttttaattgctgcatatatttgctacggatatgtggaccctttggccccacattatcctttttctttccaaaaagtagagagttggtgggggtggttgacatgtggaccctctagccccacctctcctttttcttctccagaaaaggtaggagttggtggtgggggtggtggcagaatcaccaccatgacaactctcttttaaaggagtactacactcttttaaaggagtatagacaacccgttattactaacattctttgcacatatcatctcttagttgccacatatattatgttactgatatatggaccctttgaccctacattgtcatttttctttccaaaatgtagagagttggtgggggtggttgacatgtgagccctctaccctcacctgttctttttcctctcaaaaaaggttgggagtttgatggg

SEQ ID NO: 67598 - DNA, 6681 bp, Oryza sativa
aaatgttggctgacagctgaatttcgagtttcacttatgcatgcgaacttaaaattagctgagcaaaggttccctaagtgagtttgctttgaactgtaggttcatgttggcagcagattacgagtcttcgtttttggacgtagggaaaacattgtgtatgtcatcttagatactcgttttctacaactctttgatttgatgttgatctgctggaagatgagcaactatttgatgttaatctgttggaagattggcagctttgtgtgttaacacaatcgatgactggcagtctgattactgatggtagtaaattggtaacttgctgaagtttttgagacatttggttgtctgattcatgcaattcgaatgtgatgtttggaaattttttttgccatttttattgcattctttgtccttcggcatgctcaattgaagcgaatatcgcattgtttatttattttgtttctaccattagacttctgtagcccccaaaatattagtcatcgttaaccctgcttgccagaaaaataaacagtctgctttttacaacgcgagatcgtgcttagtataatttggtttaagttggaaatgcatcaatgttggatgcactgccaatctattgatgcatgctgaactaactgccaatctgctgatggtaagtaaacagtctgcttttactgtaagtctgtaaccaaggttggtagtacctgcgtatactaagatattactctctacatatttcctccgtccaaaaaaaaaagctaaacctaggagctaaacctaggggtcctaggttggctctgtccaaaaaaaagtcaacctaggattaggaggttggctaccctaatcctaggttggctttttttttttgacaggagtatataaaaagaaacttcaatgaaggaatctggaagcatttgacccgttcattttcataagttggaagcatttgacccgttcattttcataagttgattttttatgagacgaatatattctcaaacgttgatttttcactactattgaaatgatcattgcgtgcgggcggtaactcacaccccacggaaaaatcagctcattttcgcatgtgatccatttaagaggactgcatgggaaaatcgatttttccgtgcggtcctcttaaataggctgcacgtgaaaatgagccaaatttcccgtgcaatatattaagagaaccgcaggggaaaatagtttccctcctacccacttcaaaaaattccctttttctctcctttcccctatccgtgcgcgcctaagtccccccctctctctctcttttatttatccggccgatctgactctctctatcctccctctctctctctcactcctctctcctcgatctcctcctggcgacgggcgtaggcggtggcgacagcggtggcggcggacggtggcgcgtggcccctccccttgcagatccggcggaggggaggcatgggggagggggtggcggcgacgacaacgacggcagcccgcggctcctcccctcccttccccggcggcgatgggagcgggcggcggatccgtcgccagcgcttgcagcggcgacagcggcggacctcagctagggtggcggtggcggcggctggattagggttaggctttggtttttttttcgatttttcattttcccgtgcgggtggcttaagcgcctgcacgcgcgggtgcgtcgcctgcacgaaaaagtcgcgattttcgcagatacttccttccagacggtcaaattctctacacgcgaaaattgaattcatccatacgggaaaatccttaatgtagtagtgttttcatgagacgaatgcaaaagttgctctgaactctcttttgagcaaaacacaccgacgtggggagggggggggggctttgttcgatctggctgaacgggtgggattttttggaatgcaaaattattagcacatgattaattaattgttaactataatttgattttttataaaaagatataaaagctttttataaaaaatacatcgtggttatgaaaaacgagatacgttgtactcccttcaggcttcatcccacgaagatttcattttccagtttttgaatatactcttcgtcttatttaaaatttttctatgattaatatttttgttgttattacatgataaaacaagaatagtacttttatgcgtgactaatttttttataaaatttttaaataagataaacaaccaaatgttggcgttggacgcagacaaaaaaaaagtcttcgttagacggagagagtagtacacaaatcaaaaggctaattctaactgaagaattatcttcatattgttacgttggaccttgaggatcacagcccattgggccaacaccgtctgtggctcccaggccgacacaacctgagcattttggcgggaaaccgttgccatgctttttgtaggccagctgtcaacggatcgttcaaaaaggatgaacaagtacagaggcaggagcagatggatagagacaggtaacgtcaccaagtagaacaacgcaaaatgctgcaccgagtctatgcgcaccgggccacaccgttgcgaaaccctctcggctccaaatgccctggctcacggtggaccgagcccacggccggacgtcacggctccctgcccctctgctgctcgtgtcagagctccacttctttccatggacctcacccaccgtgaacaaccgaccccgccgcctcgccttctccggtagggtagggtaggctaggctaggctacgctcgccacgatacgcgcgccgcctccgcccaaagatgcagcgcctcccgctccggcgcgccctgtccgccgccgcgtccgcgcccgtacgccgcgccctctccacggcgtcgcggcgccctccgtgggcgatggtggagaagtacgtggcggtcggatctcccgagcggcgcgtatccctccggctcgcggagcccccgtgcggctccaggctcatcgcccccgcccacctcgtcggctacgcgccgcgcgtgcccgaccccgacacggacgagctgaacgccttcttcgccggcttcgtcaaggccgcgagcggcgacggcctcctcctcctcaccttcatggaagtcaccggcacggcccccctcgtccccggcggcggtgggtggcgcgcgctgactggcatcagcatcgaccccgacatgacgcggttcgtgtgcaaccccatctccggcgagctgttcggcctcccggacatcgacggcaccaagaagaccgcgtggttctccgacatcggcatcctcacccaatccgaacgcccgcacgggccgccggacaggtatgccgtcgctttgttcagggaggactcgtgggctaccgcggcggggacgaacggttcgccatgcgccggtttctctcacaaacgggcaagtgggacaagctggtgggcttgccgtcctcgctcccgctccaccggcgtcgcatgaacacatccacgcaggaggtggtggccttcgccggccggctgtggtgggtcgacctgagctggggcgccctctccgccgaccctttcagcgatcgcccggagctccgcttcgtcgagctgccgagaggcagcgtgacacagcccatggagaaggagcgccgggagctgcgcaggttccgccgcgtcggcgtcagcgaggggaggctgcgctacgccgaggtgtcccaggaggagccatacgtgctcagttcgttcgccctcgacgacgacggcggcgggtggacgctggagcaccgcgtggctcttagccggctctggccgcatgaccaaaacctctgcaagaacacgccgcagatcgcagccattgacccactgaacgctggctgcatgcacctcgtagttggcaggcaggttgtctccatagacatggacaatggggatttgcttgggtgcacgctgggaggtggaagtgatccatccgtggatacacttacaccatgtttgctccctccgtggcttgcatcgtgccggatcccccgtgcaggtgatcatctttcatgtgatttctcccgtgtacatgcatgcttgacacaccagatttgcttattaagtgttaattagatagatccaggactttgttcgttttacatctctgttgaaacttgaaacggtataatgttagtgggaggcttagcttgtgcatagtggtactggtagtatcatttgttttgtcacttcaatatgcaatgttggaaacgtgtatctacttacattattgttttctcttgtaaaattttgaaaatccttctgtttgtgattgaagaaactctttcaaggaacaaggcggatgcgaaaagcaagagtttatcagacatgttggttcgtgtagataggaagaagatgacttgagaccaaacagcaaatgggtcagcaggtacttcattaagctaactattattcaatcagtcgtcttgttaattcttttcaccatacatggatgccgttcgattaccacttttcactgcttgtattccttattttcttgaagtgtgtgctccgaatcatgaaaggccattttataagataagatggatattttagttgaattagcataacatttgagcaaatattgctttttcttccgtcttgtggtagcactttagacgaaggggcagatccagcacacattcatcactgtcatttgacaccggttactctttgccaatcactgtataagtcctctttagattaagaaatttctcttataatctgcaatggcacgattattttttaaagaaatttgattagtgacctagatgatattttctcctggatccatccctaatacaaggtgcatcctagggtaaagtacactaaaaattatcagtcatgttttactcttcagtattgactttgcataaaaaagcagattatagctgttgtttaaacagcattgcataaagcaaactccaaatttggccaataaaatatgaagtaggtaaccaagtcactaagtataaaagccttaaaggtgtttggtcttgtcatcattataagtatctattttcataagagttaattatagtttgttgcattgtgtataatattatgagcaaccacttaaaagcttcatgtaatatttttgctgggataaaaaaaattgatggaaggtaagcagtagatgtgataagtgcaaactagaaacttttgcctataaaacataatagtattgtgtaagagctgaaaggattccctgcattgtaatcatgctgagtcactgtcattctttggtcctaaaatattatctcttatcaagcctaagagtctaagatgatgaagcttgctactacgatttgatagtaaaaatcataattaggtattctgctgaataaagacatgaatataaaataaaattgttgtgtaatatagtactgaatcaggacttgaataaaagataacatgctctcttttcaatttcttaagtagaaatggctagatggactatcatagttttccatttacttgtttatgttttcattttttttataccgctcattctattcaaacatatcctaatgtttcctgtttgattcagatttcttaaaaaccaactgaagaggtgttttaacgaatgaggaagctgatggatggtagttgtagaagtcccgtttcggaaacccaatggaagttccaagtgttttgacctcacagtttatctacatatttttggagaaacaggaacccttttttttttccttttttgggtggaggctttgcttgtgagcatattgagaacattgcagtagagtgactcaattcagccagcatgtcatgaccatcacataagaatatacatgctgtgtttgttgctggacaatatggtcatctttgcacttgaaaaatagatcgatggatgttaatgtaactttccaggattcttgtttaggcatcttctgtgcttgcttattcatatcggatacctgtcatcacattgtttcagctggtaaaaaattcaatactaaatctcgggttgtatcttcatgcttggttatacgtgtgcatcagcacctaagtgccaatctattgttactggtaggcaagatatgtaaaatatctctctgttacttatttgaggcagaagagcagggaatcattcgaatatatcgcagtgatttcatgatttatacgcagaaaacagtgttttgctttcatttgatagaaccattgcactactatgaagtacaacgaatccagacatggttatgaagtgttttatctggtactaggttgctttataggacggagggagtagcagctagcatggcaaacatgatggtcaatctctgaactttcaatgccatttgcttcaccccgctttaagacaaaaaccaccttggtttcacattttcacttgtacgttacgccggtggttttatcaagctttggtgaagggacctaatgatttatgtattcagcatatttcagtgcatatataaaaaagtttctcactgttcttataataaattttcctccctaagaaaataagaaggatgtaaagagaggaggctgcttattattcagcggtggacaaaatgacgatgaagataaaaggcataaacatttttacataaaagagaacacagaacacaagtacacaacaataacatagagcgaatatttcttaacaaaaaacataggacgaatattttacatggagtcgata

SEQ ID NO: 67599 - DNA, 849 bp, Oryza sativa
ccccctgttatcggctaccatgcccccaagacttcaactctccttcacagcctaaccagggaaccagccgatgcaggcaagaaaagaaaaaccagatcatcggccgtgagtaccttggccttagctccaaagaaaaaggccaaattcaagaaaactaagtcgactgataagccggctgatgatctacccgccttggatccatctattgaacaagctttagatgaagaggaaattggtgaagatgttgaccaggctgtagccgaaatgagtgacacagaaaaaacaccatcggcttcacccaagcaaacgcctccaactccttctgcccccgttcattttacaagagtaagtatctctctttgacttcttctaaaattacttccctcttcggctaattactgatagactttgtggatgcagaaaaagaaaactgctgtgaagaaaagccagcagcaacgattgccaagtcggctccaccagtaaaatgtttttaattcttttacttaatcaaactcaaccagctctatataacacttgtctattctacagcctcctcctgcttctcctcctgtacagcaaccgtcaagtgaccagactccatcggctgtggggagtcatcacatcgaggagaagaacaaccagttgctcctgctatcccagtaagttttcctttgtctcaacaatctgatcggctacattttacccagctcttactctttctgaaattgtctctgcaggttctagccgatctcttctcttttgacatcagggattaccttaatgaagcagaagaagatacttcaagcaaagctctagctcccctatatgatgacgtgagaagaacacttg

SEQ ID NO: 67600 - DNA, 1424 bp, Oryza sativa
taatcgccttcagcgactcataccgatgatcaaactcggttaaggaaaatatccactttccaacccttcctttcaatattggagccgatagcatgtacttgacaacgtcggctttgcatataacagtacactcgttggatagtagataatgcctcaaccttgtacacgaaaaatatagacataagcataacttctccacaggggagtaccaagtttcagcattcaagagccgacgactgagatagaatacaactcgttccttcccttccaactcctgaatcaagactaagccgattgacttctcaccggccgataaatataacctaaacggtattcctttctgtggaggaatcaaaataggaggagagctaagatattccttaatattatccaaagcattttgctactctgccccccaagtaaactgctgatcggttttcaatctcaacaatggtgtaaaaggttctaatcttctagacaaattagaaataaatcttctgacaaaatttatcttgccgatcatctcttgtaattctgtcttattctccggaggctgaatcttcttgatcgcattaacactcctttgagttacctcgatccctctttcatgaacaagaaatcccaaaactggccagccgatacaccaaaagcacattttgtcgggttcatcttcaggccatattttctggttctctcgaaaaccttcctcaaatcggctatatggtcctctatttctttagacttaacaaccacatcatcgatgtagacttcaaccaaccagccgattaaatcatgatatatgtaattcatggctctttgatatgtagctccagcactcttcaagccgaaagtcatgacaacccattcaaataagccgattgcaccagggcatctaaaagctgtcttatgcatatcttcttcagtcataaagatttgattatatcctgcgtttccatctataaaactcaaaattttgttccctgatgcagcatcaaccagctgatcggctactggcattgggtattcgtccttcggtgtagctttattcagatctcggaaatcaatgcacaccctgaccttgccattcttcttaataactggaactatactagaaacccattcagcgtatcagcaaggacgaataaaaccagcatcatacaatcatttaatctcagccttaaccggttcaagcatatcggctttacatctcctcggaggttgctggcgtggtctaacccctggtttgataggtagccgatgttcaacaatcgatcggctgagtccaggcatctcataatattcccaagcgaagcaatctctaaactcttttaagtgctctatcagcttggttctacactctagagataagttcttactaataaatgtcggccttggccgatcgcctggacctatgtctatttggg

SEQ ID NO: 67601 - DNA, 2831 bp, Oryza sativa
ggtaaggctgccgatacaagcttccagtctcttttggtttaagcccaaactgttccctcattacgtcagcaatcacatcggcccacggtcgttgccgagctgccccttgtgactactgttgcatgggctcgaactgaccgtattgagacgcaaactgaggttgagccaatccccctggctgatattgggcttgcggggaaggaggctgatattgataattcaagttacccccttggtaattatgaaggttcggctggatattgcgtaccaagtgctcaggaacaacttgaggcattactgtgccatctggctgtacgtggtgaaccagatgttctgggacatcttggcttaaaaattgttgtacaggctgaccaccaggcgttgcaaacccggccgatgcgcttattgaaccttggtgctggataggctgaacgatttgctgtcttaacggcgtctgctgaatcggctgcaggggctgctgccttggtggtgtttgttgaactggttgcatgacctgttgccgaattggttgtacaacctgctgaattgggagtgtctgttgaatcggctactgctgtattggatcaacaacaggttgagatggcagaaacatggcagcaacctgatcttgggtcagccgactcgtaacctgcccgccatgctgtggctgctctctcattaacaaccgagggttcatcggctggcctggcgccatcgctgatgaagcaggtaggggagttgatgtcggcgctgttggctgagttgttggtgcaacggagggaaccgcctgagtagatggctgaacatctgtaatcaaagaccgataatttgggaagacacctccgtgcaaataaaccgggcctgcagcctgatgctcagctattgaaccatcggctattgacttcatcatgtttgataaggtattgactaacaccccagactgattgatcaaagcatgatgcacagcgtaatcaacctgatcttggaagttattgaaaaaatcctgtgccacatcactattctgattaagatttcctccctgcagcccctgagcaccgtcaccttgaactccatgcaccccgtcaccttgtactccatggactccttgagaattgtcgccttgatttcctagagagccgtcggtagcacctttgatactcggctgagccgagccgtctggagcttgtttcccatctccatccttagaagaactggtcccaggatcatcagcaaccacttttattttgtacttctgaacaagtgtccccttgcgggtctgcatgaatgatttcaagaactgatcccgtgcttgctgcaatattgcttcaaactctttcttctgctcaggtgtgaatttttctggatcgatcggcacgacgtttccttcattgacgtcagtcaatcctaacttcagcatcttgtccttaacagagcatgggctagatggtggtggtggttgtttcttggccatgaggaagaattgttggctgacttctcaaatgtcccaccaggcgtgccaaaagagtgtgccaaaagagaagagaggctaaatcaatcaaaaccatttggatagataaaataaatcaattttttataggtgagtgagtcgtcatatccgatttaggttgagggaggaaaatcggagtcagggcatctgttgacagaaaacacgaggcctgggagatctgcttaactccagtgcaggtccaaagctcgccttggggtgtgctagcgtgccagttgatttgatcctgtaatcaataagaaatagaagcaaagaaacctcggttaaatctataaatgatagccgatcggctaggcgccgatgacatatcatttatctttgagccgatgtcatatgtgaatcgatcggcagttgtaaatagacaataaagaactaaatctattcgatcggctgtagatatttccaatatatagttcttatatcgatatatacttaaatcaagtgattgggatagatcggtcgccatgccgagacagtataaatcacttagatcgaaatatatattactaacaggactatatatgtttatagcatagccgatcagatagatctagcatgtatcggctaatactccgatactactctatcaggatattaaaacaggtataatatatcaaacaaaggcctaatatacttagatacagcaatatcttggcataaagggcagatttaacatgtcaatgaagcatatagagcaaatatagttaaatcggataagatcggctgaaacttcgatgctaccctaatcggcaaccagaaggcaggctagagattgatattctaagcacgacttaatagatcaaactcaactgatgcagcattaagtatgaaaagaagaacaatatctagacaatcaacccgctggaagtttcatagagtggtagatatcttatataatctaaatcaacgtcaaaatctaacctaatcagctgccctcttcgatagatgttagtcgattgtaggttagatagcgatattaccagagattatgtaagatatatgataactctacgaattacatacacaagattagagtgtcataaagatagaagcactaatcctgagaatacaagccgtcataacaagttttgcctcttgttgaagatcaaaaccgatgcaactcaacccgaaagcaagaactcgttgaaacagaactaaagcaaaagggtggcggtgcgccgaaattgtattgaacatgtgtgttcgaagttatatagggctcgggtctatttatacccgagaattacaagatatgtccataacggatacaactactatctctaacaaactctaagataccatacgt

SEQ ID NO: 67602 - DNA, 923 bp, Oryza sativa
tcttagacttatatatgtcaaataattctttttttatagaaatacatgacttgcatacacactattgagataattgtgtaataaactatttacacagttttctctataaccattcagatcttttgtgtatgataaattgataatatgttgatactcaaaaacattgattaatatatagtttataaaatgtcatctttttgtgaaggtgaggaggacacaactgtaaggcatgtaacatcgttctttagcagaattgaatatatttatcacctgtgtttgtataatcctagtccaaatgttggaaagtgctgaaatccacaatcatcgcctgcagtatagaaccactggaacatagaccaagaaaagctgccaaaaaatactttgaaaatggtcgcaacctgcattctggattacatgcaaatattagtgcacaaaatcatgaatatagttaaatgaaattcaatctgtcaatttttactaagaaaacaagacttcattactttgctacgtaagctccttcaggggtatgaaagctattaataagctgagctataactgttcctgttggaaatagtaatttgtagtcaataatcatgacctgcagtataaggaaatcaacttatgaattatgtttaaggatgagaataatgaaaacaatcttagaaatgttaagtaggaacttgtaaaattaaaaaaaaatgatcaatcagtgaaagaagaaacctggttaaatggcacatttattaacactcccgtcataccaacaaggaataggtatactatccattttccgattggtacatggtccataatatctcttggatctggatcatcagcaagtgatctggccaccgtagaagtcattccaatgatattggtcgcaaaaccacctaaaaaatgtaacaagaaaataggccagttaa

SEQ ID NO: 67603 - DNA, 934 bp, Oryza sativa
atttaattaaaactaacactaaaagaaaataatagaaaagaaaaaaaaacatgtaaaggggtgttgggccgaaatcaacaaggcccaccaccgcatcggcgtcggcccggcccaccaggctgaacaaaagaggcgtggcaaagtcctctgccgccaccacctgcacccatcgctgcttccccttcgtgtccaccgccgccgccgtccgcatccaccgttgctccactgtccgccgggtcccccccttgttcaccggcggcttgccgaccagagttaggccgacggcccccactcctcatcggagtcggagtctggttggacccgtacgatgttccccactccgttcgggagtgtgtggctcggagaaccatgaggaacggcgcgaatggtggcgcgaaggccggggtggcgcgctgcagcggctctggcatgatggtgagatgatgatgaagtgaagagtggcggctcccccgtgcgtgcggctagggttccggtttaccgaaacccggtggtgtgggagttggggagcggtgtcaaattggcggctgcgtggttggtggaggtgttgcaggtgcaatcggtggtggtagggagacgagcggagccagcagcgattccatctctagaagagggagcattgctcactggtgggcatcatctctgcgatccatccatggtgggtacaaaactgtaccccttggacttggacgcggcagggtgccctgacggccggcaaggcagggctggtagtggaagaggaggagcgaccagagttgcgggaaaacaatgcgacgctgagagtggtggcggcggccaccaaccctagttcggcgcccgtcatggtgatggcctcctcgtcgattgacagatgagatggtgaaggcagcaagtgcgatagtggcgagaaaggctgagaatggcgtcgatcatcgaa

SEQ ID NO: 67604 - DNA, 4370 bp, Oryza sativa
cgttgccctcggcctccacagcaccttccccgtcgttcctcacggttcttcgagcctcacactcccgaacagagtggggaatgacatacgggttcgaccagactccgactccgatgaggagtgggggccgttggccaaactccggctggcaagccgccgatggacataggagggacgtggcagcggcgaacactggagtgatggtgggtgcggacagcggcggtggaatcaagggtacagagtcaaaaaggggttctggatttttattcccattttttctttgaatgacaccttcaacttggctccaccttagagagggttttcggttttaatcaaaatagggtcaggggcatcagacctgcttttgacatatctatcctatccttatttgggtaccatatgcacctctttgggcttctattaaactagccccataacttcgggagaaggggtgcccagactcgaaggggtagcgatgatggatacgggcggtggcgacggtggactcggcggtggcagataaaccgcggggcaacccccatgccccatgcttcttttgttcagcctggtgggtcgggctagcgccgctgcgatggtgggctgaatcctattgattttgacccaccacccctataattgttttcttttcttttcttttaatgttagttttaattaaattagcaaatttaacttttagtccctatcattttagttaatttaggtaagcagatcatcagttgtaaaacaattatctaatggtcgttcagacccctaatgttatatgttatttgacatatgtgtttattaattccctcctttacttgttgttttaataaaatgccttttgcatattatttaaagacacactctacttactcgctctgttaatttgcaaaattcttttaattttttatttttaatttagcaaattctcttaattatgtataacatgattaatggagaatttaatgcatgttcaactacatattttgacttgtaattaaaccacatgttgatggagccctagtttggtcataacgttaaaccacatgttgatggagccctagtttggttataacgaccataacctaggcatcgagtatctcgcccatcattaagtgttttacatctgaagatgattacccagatggagtcctacacattggctacaatggtcaaaatctaggcaacgagtatctcacccatcataaagagatctacatcttacaataattaaccacatgtgttattctgataatatgttttgaaaatatgagattatttgaaatctagatgcgcacaaggtagtggagtcctatattggctgcggttgtttatcaaaatatatttgcctagagaccatattttaggcagcaagttcatcttgctcactattaagatatgtgctccactgtctaattacttggagattatccacattgtgccacctaatttcgaattctaacttagattgtaaggtttattacctacaattttcgaaacatgccaaattatgaggtcttacaattcgcatcgagattacaacttcgatataatgttttattaatttatctatgtaaattagtaatgttagtcatgattgtagggacatggcaactaacgagttcgatgaacttgcccttgattggagtaagtacccaatttgggtttcggatatcaaaataaattttgcttcttgcgggatttctaatgcaattgagaaacccaacagtggggatccatccaattgagggccggaagaaaaacactgtccttttccttcttaggctctatatccataaagatctcaaacatgagtatatgttggagatgagcccactcaacttatggaaagctctcaaagaacattatgatcatcaaaaggaactcatctggcctaatgctagttatgagtggaagcacttaagcctacaagatttcaaaattgtggcaaaatacataacattcgctctaagttgaagttttgtaaaaaaagagtcaacatgggcagagaagatagaaataactctatatactatccttctggaggacatgatactgaatcaacataatcttattggaaaaagcaaacacaacaacaggcgtaaatccaatagtcgaaagaaatgaaaaggaaagggtaaggcaccacaacctcgtgacaacagcaacaagcattccaacatttgtggatctaattatcatgttgcttaagattgccgtataccaaaacaccttgttctcctatatcagaaatatttcaaggagaaaaagtcttctaaccaagatatgaagctcatttcaatcttacaaatgaggcaagacctaaagttggaagttctcagcatgctcctatttaacctgagaacaatctcgatcttctctcagaggatattgcttcactttctgcgatggacgacatgctcatcgtatattgctcaacggatccactaggagatttactgtaatctttttttttgaaacatagatttactgtaatctcagtgcgtcccacttggacatgaaactgctactttaatcttagcgtgtgtaagacaatatattgatattctattgtatgccaaacattagttgttgtaataagtagataaatacaaactcccttaagttacaaggttgtaaaatttagtaatcattagagtattattgacggtcgttatataccaatttcgaccgtcaatggctatgcttgcaatgcatattattattgacggtcgttatagacctagctatgcttgcaatgcatatttgttttagaataatctatttccacttgtacttggatattatttgcttgcagagattgctacataaaatggaggagaatcgacggaaaataactgaacaatcaatcgaacgccgtcgagaaatatacttgcgggtaaatgggcttacaattccagtgaaacaacctcaaaaagcccaagacaccacgtcactaaagtgaggagtctacagggagacgacctgccaaattttgggccgattgggccagcccatggttcggtcgaacccccatcccagccgttcaggctgggtttggagtggacgctccagatcactcctcaatgatggttgctgagcagttaggacatttccatctatcacaactatcattagcagcttatttaatgaggagcttattctccactccaacacacactcaagaagaagatcaaagagctctcttaagtttagtagtgttctagtgctagtggagtaggaattagaatagttttcttagtcctcaagtcttcatgagatttcgggtatagctctagcagtttttctctcttcttttgtaagacttactgaattaatagaatattcttatttatacatcttcgttattttattccctttatatcatctgagtaccgagattattttatatttgcatcgatatagttgtgtagctagtttaccagagaggtgcattagtgtgggtttaatgtcctagtattcggttgctctatgtcggatgcatggatgtagagtggtatttagtaatgtaagcgtggtgtttatattattaagtatcattattaagcaactttcatatcgaaaacttatacaaaaatacacctttagcagtttgaaaagcgtgcacgcgaaaaacgagtgaactgagtagggaaagaggggaaaagaacaacattgactaataaatctctagaatggaccagtgaaggaaaagattcctatgcactattgcttgccaattacactttgaaccttggtatattaaatcaagattttagatttagatgggtgtgagttttgcaagtttacggagtttagatgacatcttggaacaaactccagcaccgataatgagagaaaaaaaagagaaaaaggcacgaattacccaccctcccccccccccgaactatcgcggtcggctgaattcccccctaaacccgaaaagagacatgactcaccctgaactttcaatacgggacgaattacccacctcgatccaatccggagtggttttatcctacgtggcatacgcgtggcaacccagtcagcattttctttttttaaaacatggtggggcccacctgtcacatactctatctctctcctcttcccctctctcactctctctctctccctctcccagcgagcacggcagcccgcggcggctccagcgtcgtcgtcgttgtcgtgggatagagagccggtggagtgggatgcggcggtgctggatgcggaggccgcagcggcgctggatgcagaggcggcggtggctgcgtcacggggacgttcacgctcgaacttcccatggagatgaggagtctgaggggctcgccggcgtgccccgccgtcctcccttgcttgggggg

SEQ ID NO: 67605 - DNA, 2909 bp, Oryza sativa
ggaaaagggaagaaacggtgtgtatatgacaggtgggcccccctatgttttagaaaaagaaaatgttgactgggttgccacgcgtacgccaagtaggataaaaccgctttggattggataaggagggtaattcatccggtattgaaagttcatggtgagtcatgtctggttttcgggttcaggggggaattcggctgaccgcgatagttcgggggggggggggtaattcgtactttttccgaaaaaaatattcatggaagtttaattgctgcttcctccatcccaaaataaaccaatctgggacatgatgtgactttgccttaaacaacaaatttagacaacccctatccagattcattcttgataacgtctaattctactttagatttgtttattttgagatggaggaagtgggaggcgactcccggtcgggcgcccgatgcggagggggtaaaatcgggcgctgacgtcagtgccacgcatgcgtgcaaaaacactttaaactattttttctcttaaattatttatccaaatcatgatatgattgcaccattaaatttgttgcaattaaatcttcaaaacaagaccacatatggatatatttcgataaaatttttttagcttattattgaattatttttaaatgttgcacgatgttccaccaggtatatcggaattgtttcactaagtagatcgaaaatgtttcaatcatttaaatcggacgttgtttcaccttatataaaaacaatgtttcagcaaataacgaaagaatatttcagttcactgcaacatttgatccatacatagtgaaacattataagtgcactaggtaaaatatttttggtggaacaaaaaatggaacgaattagcttaatagagggtttccaaaatatgtgggtgatttgttgcaaaagaatattttaattcactgcaacattagatctatacatagtgaaacattgtgagtatattaggtgaaatatttttttgagaaacgtggcaggcgtgagcaagacacatgatggggcctagggggacatgtggggcgtcggggggagcgcccgattttgatccctcggacggtcgcctgaggcaaagaattttcggaggaagtgccttggtaaaataatttataggaaagtagtaagtaagattttcaaagaaaacttccggtagttaaaccagtagtactagtaggtttttaaggaaaagttaaataaaaggtgaaagtattagtagttattattaactgtgtgacaccgtacatacttcactgcgtgaaccaatcccaatagagcatgccacgacgctaggtgcacctctctgttggaaggaccgaggaaagagagtgagaaccccaccctcaccaagattgtgcttcagtgtcgcatctctggccgcctccgccgcggcctctgtacggccgcatcgcagcctccgtgggcgatgatacaatacaccaagataggcgaatcttcgctttcttcggcacagcgcgcgtcaatcgagctcgcccaatgttgaaagcatagtgctaggagacatattttaccatgagattaattcctaaactaaatggaaaggtagaaacaagaattaagaactcccacatggaaatatatgctagtagcatgatcacaaaagatgcaacgtaatttgacatggcaacgtcaaacacgtcaagctattagctatggctctcaatttactccacatatgcaggctaacaactagcaagaattaatttactactagcaattagtaagtctcaaacaataatatcacgtagaaagatggaccgattttctcacaatcaacggtactcaaaaccgttgagagacgtatagtgaagcacgacgaagtccgctgttcgtggcgagccgagacaacgaagttgagacctagaaagatcagcacggggatgacgaaggacgagaagatcgcagatcaccagctgctgctgctgctaatcactcaaaattatggaggagattaggttagagagaataggctctccgctgtcacaccaaggaaatactataagaagatgtgctgctcctttgatcagaaattaacaaccagggcgcaagatatggatcgatccacatgactcgcacatatccatgctgcccacctcccttcttttcctctatcccagtgacatgtaggcccaagcctctctctatattcattgggaccacctatacatttgtcaacaaattttctactaaaaatttgacagatgtaattatagtacaatcgtagtgtaattacactgtaacttatatgtaattacactataacttgcatgtaactacaatgtaacttgtatataagtttcatgtaattttgaatctttagatctattacaagatttgttttggtgaggaagaaaaataaaatcacagcacatacatatgtaaggatttgtttccacaacctctattttatcgaaataacatattacggagagatttttgaaagttacatacaagttacactatagttccagtgtaattacactacgattgtactgtaattacatctgtcaaatttttaggagaaaatttatcgacaaatatatagcaaaatcgaataaatatatatgacgtaaaattttagtgatggttttaccagggttcttatggttatattgctggtagtgaaggctcgagatcctctagcccctatgatagatccgctgctgattcggctgggaataagccgcataacgcggtgctggccttcgccggccggctatggtgggtcaatacaagctggggcgtggtctctgtcgacccgttcagctaccgaccggcaaatcatcgaattgagggagataaattgatcttgttttaataattgagggaggacagaattgtaaaccgggagcccacagatgctaggaa

SEQ ID NO: 67606 - DNA, 1229 bp, Oryza sativa
cctcccagttcatcaactagctagctatggccatcgtcctggatgccttcgcgtcctacgtcggcgacctgctcaagcaggtggcccaggacgagctcaccctcctgctcggcgtctccagcgagatcgccagcctccacgaaaggctcaacagcctcaaggactacctcgccgacgccgagcgccgccgcatcaccgaccagagcgtccagggctgggtcaggaagctcaaggacgtcatgtacgacgtcaccgacatcctcgacctttgccacctcaaggccatgcagcgtggcggcgtcggctcatccgcacctcccgtcaacatcagctgcctggactcgctgctcttctgtctccgcaatccgctcttcgcccacgacattggtagccgcatcaaggcgctcaacgccaggctcgacgccatctgcaagagcgccgccgccttcagcttcctcaagctggaggcctacgaggacatggcggcgcctcgccgacctagtgccgccgaccgcaagacggacccggtgctggagcggtcggctgtggtcggagagaagatcgaggaggataccaggacactggtgaagatgctcaccaacggcaagaacaagaagcagaatgcagtggtggtggtcgccgtggtgggcaccggcgggatcggcaagacgacgctggcgaaaaaggtgttcaatgacgaggccatcaaggaagcgttcgacaaaaagatatggttgagcgtgacacaagacgtgaacgaggtggagctccttaggatggccattaggtccgtctctgtcggcggtgccagcgatggtcgagagagcaacaagtcactgctggtgcccacactcgtggacgccatcagggacaagaggttcttcctggtgctcgacgacgtgtggagcgacagagcatggagcggcctgctcaaggtgcccttcagccatggcgccgccggcagtcgtgtcctcgtcaccacccgccatgacgccgtcgcccggggtatgcaagccatgcaccccttccaccacgtcgacaaactgtgccctccagatgcatggtcactgctcaagaaacaggtcagatttacacaatatactaaatgttttacatccctccctcatctatctctgccataagaaacactgtgacacctatcttcttggcataataattaattctaacaacaaaaatccccgaaaaaaaataatctaacaacaaaaaga

SEQ ID NO: 67607 - DNA, 758 bp, Oryza sativa
cggggtgatcgtggcggcactccacatctcgtcgcaagcgatgcaggacctcaagtcgggccacatgacgctaacgtcgccacgcgccatggtcaccggacagatcttcggcgtggccgttggctccatcctctgcccatgcgtcttccttgccttccagtccacaacgaagcccaacgcaccggtgggttcaaagcagtccgattacccatgccctttcgcgggtctataccgcgccatcggggtgatcggcactggaggggtgaaagagctgccaaagcactgcatgacattctgtgtcgttgccttctgcgtgacggtcatcattgacgctgtcgtgctggtctctcagaagaggggttggagcatccacaggtacatccccagcatgacggtgattgcgctgccgtttttcgctggctcctacttcaccatcgatatgtgcgtggggagccttttgctgcttgcctggacaagaatgaatgcaaaaagtgcagagatgctgtcatcggccgttgcggcaggcttgatatgtggagaagggctgttcacactgccatcagcgttgctcaacatgttcaaggtgcaaccaccgatgtgcatgaagttcctatccggtggcgaagaagttgaggcagcggactcattcttgaacaatttgggaacatccagaacatgatgagaaatgcactcaaagatttaccagtagaaaatggactatgatcgttgtaaatgatgcacatattttacatatgtca

SEQ ID NO: 67608 - DNA, 1823 bp, Oryza sativa
tatctctgagctgaattccaactctgtatatgttactgaagattttactccaaaggtaaggtgcacgttatttttggttcttcagagatagcctttccttgtctgttcatccctatccttagagtgcaatactctccaacctggtgaaacaaacacaattgttttccatttttgttttcagctggttgattttgagtgctggaaaatgatgttcaccaaacaaaaacatgagaaggctcctggccgcatcaataacaaatcctctttccctggccacttggattcttcagaggacaaacaagcagacatccaaggcaatacatttgcttttggagtgattttgctggagatcatcagtggacggcttccttattgcaaggacaaaggctatttgattgactgggtgaggcattctactctttctctatctcattgtgacaaagaagtaaatattttagaaattgactctgaagtctgctcaagaggaccagagcctagttccaccatgaacttaaaatgacttaaacaaaacatatagttcagaaaatacaggagcatgcagtttggaatattagttgcattgaacatttgcactgcttattctgaatatgcattctctacattgttcaggccatcaagtatctgcagcagacagaggagatcggtaagcttgtcgatcctgagctgaccaatgtcagaacagaggatctcatggtgatctgcagcgtagtgagccgctgcatcgaccctgatccatccaagagaccatcgatgcagatcatcacaggagttctggagaacgggatcgacttgtcggcagccgccatcctgaaggaatcctctctagcatgggctgagctcgccctggcgttgtagcataccattcttaccgctgtaaattcgtccgtcacatcacacactaatatttatctgatcatggccattgcatgctcggaatatagaggagctgagacgcacgagcaggcaggcactagttcagtttggtcgtgatactgtattgactgtttttgactcataatgctgtatgatttacagttgattgccggtattgcacagcaggtgtttcttcaatgcctcaccggtctaacgaaattcctttgttcgcctctgctggcatacatgtgtaagtttgtggtgcaacctattaggatgaaaaccggcatggaaattcccaattggctctgtacggttttcgatcgtttctgatcatcaccgcgtatgaatattgaaactgttttcctagttctcttatcatcgtattgcgattaccactcgaaaaattaaattggtaaatatggaatttctcgactgacacgtacaaatgatatcgcatccgacagttttcgttctaggctcctactccgtagtgtatgctgcgtgctgcacggagtttggaattgtcttggattgttggaatcggcatcatttttctatccgaatattatgtcaggtttctgtgctgcgtttcctccaacttggcatgctgcaatcctgataacatccacagagatggattgagaattccaggcaactacgcgaatcacaggttggggcaaggcgcagggacgcgcacgcgtccggttccaggggtcgtggaggggaagccaagggagaccccagcttcgccgagcgccgggcgatcgcggatttctcgtggttttgatcgcgtatttttcccgtggttttggaggctgcacgggtcgagctctatcgagattttcggccacctccttccctgtggccttgtgggcttgcgtgggctgtggctgggattcgctacagggatacgtaggagcgctcct

SEQ ID NO: 67609 - DNA, 1832 bp, Oryza sativa
cgccccggagtcggagaggtagaactcgaactcctcctgcgtgtacgccgggttcagcggcgccgccaccgcgcgcgctcggatcaccgccaagaacatgatcaccagctgcaaaaacacacaagaaccagatcagcatcagcagctcgatgatcgtcaccgtgatatcaacagcttctgtgactggtgctttacctcgacggtgttggggaaggcgagcgcgacgacgtggccggggagcacgcccgcatcggcggcgaggcgcgcggccgcggcgtcgacgagcgcgtcgagcgccgcgtgcgacaggtcgaccttgcccgggacggcgagggcgcggcgcgaggggaacgtggccaccgccgccttgagcagcgtggtcagagtcggggtctccattgggtcgcccgctgcaggtgcttcacgtacaaatctctcgtgcgtcgcgttggtttgtgtgtgtggggagaacgtgtcgtgtgtttggcgcctctcaaaccgtttggccgtgtggggtttatataggcgcggaaaaccgaaaggccctcctctgcttcgcgtttgggcctctgcttcgtcagccacggattattgctgtgctctgatagtgaggtttactggagctcagctcacaaccaaaatcaaatttggatgtttggcctttgctttgcctccttgcattgcaccaggtgtgtgcgtgttgacgatgggaggcctttttctttctttatttctttttttttcgagggttcgtgtcgtagcgacgagtgtcttcctgctggaccccacaactgttgcacgtggacgcatagattaaacattttgatcctaatacgacacaaaatccttttgattaaacatttttctgtgatatgatattctccctgtccaccactgcgccgagtcttttttgttgtttcttcaacgaaactactgtctttttttaggcctcgctgggaggcagagaatcacttgctactgtttggcaccgaagagaacgcaaaaggctggaaaataattaagttggagtgtttcctttcttacgtgtccgggattcttgtcttgtgcggtttatgttatctctcacggtgttcaagggggaaaagccagcatttttatatgcccatccaactgggcattgcaagcgtcacgagtgcgcgcagctgatgcagttctaaattccttttcttttggatataaagctaagaaaacaggacgagtcgatcgtgctcagtatgcagcagcagccggtggtcagccaaacgtcgacccggccggttatttgtggctcaaagtgcgtgtggaaacgctcaaactgattgattaatccgcgtccgtttccaccgacggtaacccagagcgtaatactagaagcaaaagctatcgacaccgtgaccgtgtatgactagagagatctactagaatatactcgatcgaggatattcctctctctctctctctctctctctctctctcacttgtccgttagaactataataattataaactataaataaggagacaaattaacagaaattgtaaggtgccaaattgtaaggtgccaacaagctcgacgtccatatcaactcagctcagttagtacttatactacttctttaaatacaactatcattgaaacaattgattagtagcggctgtgatttaagcgcagttgtatagtagcgggggacgtaacggtgataagacgtgtcgagcccgggcagccggccagccaatgtttcgatcgaaatggaaagaccaaccaggcaagcaagcggcgccgcgtacgagcgagcgactgtgcgatcgaggcgaggcgaggcgaggcgagg

SEQ ID NO: 67610 - DNA, 1919 bp, Oryza sativa
tttccatcctcatctctttgggttgtgccttatggttagaataagtctattttgtcccccttcaggcatggcacaataggactcggcccgcggcccaaaagcacaacagcccatcgtgcttcttcatagaataagtctatttttccgttctcatctctttgggctgtgtttcatatggagaataagtctattttatccctcttctctttgggccatatcttatatgaatgaattaagtctaatttagatccctcgactatttttctttgaccatgccgtgtcggaccggctcaccgtgccaaggcatcgccctaggcacggcccaactgtcgggtcgggctggcacgggtccgacaccaatcgtgctgtgcttgtgcttcaaataaccgtgccgtggaccgggccgtcgggcctcggagcttatggccatcgtcttcttgttcgattcaaactcttcgtgctctgcccgcacggttccataccctactcgttgtgttgttcttcttctacgtacgtcttcgatgcaatgcatcggtgatcgtcgaagctcgaaggaccttgtgtgattccggacggcgacctctatggatttgttcctgtttcaagggccatggacaaggtcgatgtaccggctgtcggtgtttgaaaatgacacagttggacatggcccatggacaagtggactttgacacagatttgtgttgcaatattcggcaaacatagctagcttactgtaaatgtgtaataaatcatatcgatttacttatagtccgtatgatcgtcgccgaggtctgccgtgacgacgtcgacgaggaagtcgaagagatcggtgttctgcacggcggcggcgacgtcctccttgtgcacagtccggcgcttgccctcgagcgtggcggcccaggcgcggcgcgtcagctcggcgatgaacagctcgcacgccttggagaacaccaccggcgcctccccggagatcatcctcgccccgccgccgccgccgccgccgccgtcgacgacgctgctgtcccccgccgaccgcttcatgatcttcttgatgcgagccagcggcagcgcgtgcggcccagtccgcgccgacacgccgccggcgaacatcgccgagtagggcctcgcctgcctcatctcgcctccttaattactggttaaccaatggtgcaatccgctgccggagacggtaacgatggaatggatatttatacgcggccatgcatttgactttgcgaggagcgtgcgtcgccggcggaggccggcaaatggaggaggccggccgttttgacagtgatcggtactttgcagagattatgaaatttaacaaagtacgagatgtttaattaggaacataggattgtgtacgttgctttcacttgcactgtgcagtcaaatttttggcccttgttgcttgcatccttgtgttgcatcattgcttgctagcttctcctagcctccttgtgttagtgcacatgtcattcggatggtgagttattttctaatcaaagatctagaggctagctatgtggcgcgtttaccagtattcgaacaaatattttttagattatttaccaatagaacattggtatagtcgttgatacaaacaagctatttttgattgaaattattgttactgttacgctattaatagtggagacaatgcttgatcattagtctttattctattggaaaatatatatgtaagaatcctttgtttttgttgtgactttcgaggatgactttttttaacgaaattttcatggggcaaatttggatcgcgaccaaatcttaacaacatcttggtgggccgaattaggatcgtaattttagtgggccgatatattcctttccccttcatctcattgtaccgcacaatgggcgtaaggctacgtaactgcagctgcaaagcgtaaaat

SEQ ID NO: 67611 - DNA, 1866 bp, Oryza sativa
ctttctgttggaaaaaatggtatcatgaaagtgtgggagtggaactagctcccaggtgctaaacaagtgggcgttggtgaccaatgcacaccaattttctagacttggaactggagagttttaatggggattacactaaatctagactccatgggtatataatacagtctgggaaactgatggatctttcatctcggtttaattgtttttttcaagatgtgcctactttgcccgcatgttaaaagtctaattcatttcattgtcttagtgttatttttctgtgtccattttaattggtagactgccttgtgtgacagatgttgggtttgttcaaaggaagcctgggcgtggtgacactacattatcaatgagttgttttgacaaaataactcgctggagtgttgttggaattcaaggtttgttgtccacgatcattttcaattcaatgttataagtttgttgattgcatcctatgtggcagcattttcatgctattcatcatttgctgttcatggcaatatatgctgcagatctgctgaagtaatatatagtggacatgctagtatttctccacaattatattgcttctttatttttctagttacgatattcccgtttcacgggtcaatggatcaactctataaccccttacctctgttctttcacaggtgcattactgtctcacattcttgagcccttgtacctgtccaccattactattggacaatcacctactggtgcttctgatgggttttctgttgaaaataatatcaagaaagttctcgatgctcgactgtcctctctatccagcaaactgctgttgccttttaaattgaacaaggtcggagtggcaatgttgtgtactgatatacaaatcatctgctaacttctcatgacagtggatccgttttctttcctacagccactattttatgaggcacctatccctccaaaagagtttcaacagacttctggagatttgcaacctttgacatgcgggtagtatatggtttgttgtctttataaacttagaccctttttttttagtttacctcatgtagtatgtacatgtttttagtaagagcacctagctttgcaatttatattttactaggtactcgatatgctggaacaaatccggttttcatgaagttgtcttaggaacaactgggagaaaacagggtacatcttcaaaggcagcatgctcaccatccactgagtcattgctctgcaagtaagagggtgcatcctttcccattccaagcatcctgatgcaaaactgttatggtatatttatattctgttttttaactgtaggagaaggttgctagaagcctttgtgttgattgaacatccattagtcaaaaagttccatcgcgaggaaatgtcctaccgtcaaatcaaggtatttcatcttatattggaaaatacagtagcttagtagcgtatgatgaactaacccttttgtcaaacgattctagtgtctgatgaatatgagaagtcaatgactgactactggaaggtggctgatgttctttgcaggatatggctcatgaataccagcagacacttgagcttctcaggaaggctccattttttagccggtggagtgctaagcctgcatccctcgattcattcacggtttcacggtgagattaacccccaaatggctctttgagttcccccagaatgatgttttcagtgctagttttagtgttgaggtgtgttaactctgaatttgttcagaaaatgtatgctcttcagccgatgcagctctgaactactgtacaagctgtcactgtaacaaacctacaaaacttttggcgttattaggttaagatatggataactcatgctgtcttgctc

SEQ ID NO: 67612 - DNA, 1002 bp, Oryza sativa
acgtagggtttggagagtgttcgagaggtgtcgatcgcggacggcgatgagggacggcgagcgtgcggaggtcggggcgaccgggaagaagaggaaggaggtgagcgcgtcgtcggactcggagccggccgctgcgtccgggaagaagacgaagaaggagaagatcctcccggcgtggagggccaatgcgatcccatgcgaggggggcgaggtcctgaggaggaagaaggaggcggtggcggccggcaagctgtggagcacgccggatatcccgggggcgatggggagccatctctgggatccgatcgaagtcccggcagagatgctggagctgtggctggagaggcaaaaggcgaatgcggaggccgcggctgcgaagaagaagaagaggaaggtgttcaagtgcagggtgccgaatagcctcgtcgaagtgatgatcgcgcggccctacaagtgcgttgatcacgatcgctctcaggaggagctggccgaacttactgtgtcacatcgccagggctacatcctcaggaagttcatcgatgaaaagaagatgaagtacgagcagaccctcatcgaccggtacgtcaagcagggctatgcggaggacgaggaggaggtcaccgatgacgatgacgattgacgacgaagatccagctaccctaacctaggtcaaatgtctgctgatctgctcatcaatggctatggtgtaatcatcatcagtatcatctcctatcttatatggtgctccacttaaaacttgcatacagatgtatttacttaggctctgatggggaacctagcgcatgattaattaaatattagctaaaataaatttaaaaaatagattaatatgattttttaaagtaacttttatatagattttttttgcaaaaaaacgcactgttagtttgaaaagcgtgcgcacataaaacgagggaggtgagttgggaaaggggagataagaccctgtttagatgggactaaaacttttaagtccctatc

SEQ ID NO: 67613 - DNA, 1656 bp, Oryza sativa
tcctgcagcccagactgtgatgtatccttactgccctccacatataaccaagcccaaggtacattcttgcttcaaaaggctttttttcttagggcctgtttggcagggctccaactcctaaaataactccaggagtggagctgtggagtggcccgaacctagctccacccatctagtatattttttcagattactccagcccgctccactccctttttaggtggagctgaaaccgtttggttgggccccagctccatgagaggtggagctggagcgctgccaatcaggcccttataacttagtgaaatcagaaaatctaaatgtgcattgtggtgaacaggagtgcaagaagcttttcattgttcacctatctgaaagagagtattttgctgttccgaggaacctgaagctgcttgctgttccactgtttgaactctatgacaacgttcaggtaatctaactcatcctatagtacaattagaattcttgaagtttgagaatatttttcccatctgtgaggcgttatgaactatgtaccagtgggtatagtttctttctgtttcattaggaagcatttccatattatcaatttgattttgcttcattctttcttttttctatttccacttaaaatcatacttacacagaagggaaggatccctatattaagttggtttctaaaagaaaggatccatctcttgtatttagattacttccctgatcttcgtcttgtttggtgtcattgacagggccttagttgtcacataatcacttatctttaacgaggcaacatgattaggacatcttacaaacagaatttccaagtttgataaaaatagattggtgttacacaaaatctaggttcaatcataatgtgccacattagcttttgtaagaacaattttgtatgtatagcctttcctttgtaggccatcacttctgcacagagtttgcttattcttctgatgcagttttttttgtgtcttatgttgtgcttattcttcaattactttgctactgttgctgaaatttctttgtgtggatgcagcgatatgggccagtcatttccaccattccgcagcagctgtctaggttccagttcaacatggttagctcgtgaaggtgatgagagatggagattagtgtgcactaggctctatttgatgggatcttcaacgggctgaactacctaatcgacttggcatgactaatttgttctatcacagagaatttccatgaattagcttgggaaaaatattctggatccatcgttggactgttagctggacatgcatttcgactgtattttgttggattgttttgtatcacatcgcaaagctggtgcctggtgtatttttagatgatcttttgttggctctgcacgctaattgttggtgtacatggctctgtatgcttactgccttgatgttgtatgctgtagctgtaactcttcaggctgcctagcttttttttctagccaggaactccccctcttaactgtaaaaatgctttggatttaagacaacatagagaggattaagctttttacagtgttccatcacatgcaaattatcgtgcgtctgtatgtggcatgcttgtcagttgtcactaaaaactttgcggctgaatgcaaatgcttcacctagcagcatcact

SEQ ID NO: 67614 - DNA, 2902 bp, Oryza sativa
  unsure (1)..(2902): unsure at all n locations
atcatcgcccaccccgaccacagcttcctcaccgccagcatccctaccttccgcttgggcttccacgtccgccgcctcgtcgccgcggggcacaaggttggcgtcgtccgccagaccgagacggcggcgatcaaggcggcgcacggcgggggcgcggccggcacgcccttcgcgcgcgggctctcggcggtgtacacgcgcgccactatcgaggccgcggccggggagctggagggcggcggcgcgcccgacgaggggagcaggtacctcgtgtgcgtggtggacaaggaggtggacgccatggggacggaggggttcgaggtgaagatcggggtggtggccatcgaggtttcgaccggtgaggttgtgcacggcgagttcatggacggagtctcgaggaatggccttgaggccgtgctgcttggcttggcgcccgttgaggtcatcctcgggactccaatatcctctgccacggaaaaggtatacctgtgcggtttgtgatgtgcgaattgtaggctacctgatttgttataatctgcaagtaattccaggttgtaacttacctggtctgttttctcagctattgtagttgttctaaatggaaacttatttaggattgttggtggaaagactcacagtcatctgggtagtttggcagcaatagttcggcattttaaaatttctcagcaaaaaaagaatgattgcttgttgactctgccaaattaagttctagcaaattattcctatagtgaactttggaagggttatttgccttacagtttaatgagttccccccagaattgtttaaagttcttacaatctgtgtgaaagttccttcctgttttgatgtgcttgagacccctctgtttgatttgttctgttctacatgttgtccagctgatggtggcatatgccgggcctacctctaatgtccgggttgagcgcacctcgcgtctttgttttagtgagggtggtgctttagctgaactgctctctttgtttgagaagtctggggttgatgctccaactgttgagaatggcagacatttgatggagatgaacgaggagaacaataatcctcgtgggattgaggtaccgttaagttcttctgaactcactgtcatcgcaccttatgattgggtctccatatgtagtttagtaagttccaatttctttttttctttttggttcaagcagggtatcatggctatgccagaactagttatccatgcactggccttgagtgttcgctatctcaagggttttggtatggacaggataatctgctttggttcttcatttcagccatttacagctaacactgaaatgtctctgtcagcaaatactcttcaacaacttgaggtagacttttatacaacaccgccaaagtaatnnttttgttggcatatatatgaccttctgtttatttactctgcactgtctgtaagtctcatcttgaatcctaactatatggaagaaagtgcatcctatcattanataatatatatatatatatattatttaatatgagacttacagttggcttttcttagaaacacatggatcacgtcaactttttgtttttatgacctatgttcttaatacacttttccactccattcttccatatatgaaagtaacacctggagtgctttcaggtattgaagaaccactcagatggttcattggatggatcattgttccaaactatgaacaacacatgtacagcttttggatccagattgtttagacactgggtaagactctgtaacctggtcatggaatgaatattaatccatgatgcatcatatcactatgaaaagtgataactagacagctattgtttatcttgactattgtcttaaaggtctttggttgtgacatttcttgcagctgactcaccctttatgtgatagaaatcaaatatgtactcgtcatgacgcggtctctgagatctctgaatcaattggatcacaacaatattcaactaacaatctccaggatgaagtggacatgtcttgctcatcttctgtgagaagtgatctgagcaccattctttcatccgttttgagaatgctggcaggaactcttgatatacaaagaggaataacaaggattttccactgcaaagccacagcgaaagaggtcaaatatttattattccttttcggttctagacttctagttaatttgataatgacacctaattatgctagtttatttcattaaactgacattatacagcatgaatatcctgcttagactaatcccttttttttattatactctctgttcagactgtacatttttattatttactgtccaaatattcccatgatttcaattcaatattcatgtaatcagggtacttcaaatgatactcccttcgggctgataatacttgtcgttttagacaaggatgaggtcaaattttagaatctttgattatgaatcatttttaaaatatttgtctttcaaatatggtgactacatgtatagattagtcttaaaaagtactttaataaaatcatatatttgttaacatttttatacatattataatggaaaataatggtcaaagttgttttttggagaccgtgcccttgtccaaaagaccaaaacaacaagtattatcaacccggagggagtaaatgttatgctgctgaaaaattatggcttggttcttatgccaatagttgactggtgcattctgttcttgacgcctgattgcctatagttttgtattgtagtttgttggggtcgtcaagctatcctgacggctggaaagcaactgcagaagcttgttcttgaggatacagacaccatgtcttctcagcatagaactgtgcactctcctttgttgagaaggctaataaatacggcttcatcatgtactgtcctg

SEQ ID NO: 67615 - DNA, 2051 bp, Oryza sativa
actaatgttatttatcgaagacgattttgggactaatgttagccattgtgctaatggcagcagtgtagactgtaaaatatagtggatctggaaggtggaggaccttgaagttaaagccaactctatggaagagcaagtaacttattgtaaatctgtagttacagcatcagttgatgtatccagacttgtccaaaccatattaaagctttgcctccattttgaagtgtagatgcagaaatgagatgcatctcttatatcctattcctcagtgaaatatccctgtgtttctaatttgtgtctatttgtgataatcctggaacttcaaaatgctgtcctccgtcttgatattttcgatttgaatttggactgatctatcttttttttaaaaaaaagttacactaatctatctactggagtacttcagcaacattttctaaaaggaaagaaaggaggatgctgaacgcagcacagcaacattttctaaaaggaaagaaaggaggatgctgaacgcagcacatcctgaaggcgtacttaagaaaggccagcccagcccagcaggggcgccggcccattcatccacttgggggcgtaccatcggtccatcgcacgtgagaggagaggaatatcccgtaaaatccgaagagaaggaatcctcctactacacaaatttcatatttttttagattttctttgtttgagaaagtttcaggtggcagagtcacgaatgcatcatcgctctcctgccctgcctcgtctcctccgctcagctcagctccggtccaaaccaaaacacacacacaacataagaggcggcggccctaacaaatcccaagagacttccactgcacaaccaacctagagcagctttgagacttgagagtgagagctcgcgagtcgcgcacagactcaaacagaggcagagagagatgggaagggaatgaggcggcggctcctctccccttctccggtgacgtgacgacgcccctctcctcctcctccgctgccgcatccgagttcataaaccttcgtcccttccgccccgccatccgtcttcccggaatcccggtatgtaagccccgcccccgcttcatcagttcggtcggattggatgaacgcccattttttgtggggacgttcagcgtgatgtatcaacgattcaatcgaacagccattggttttttttctcccgtgtttctaatctaatgccgcttactttttttagccaaacattttgttggattcctccggggttctgatttgggtttctgttgatattgtgttcgtacagggggcgcgtggggatggatttgtctaggtttactgccccgcggccgggcttgcagatcggcgccgccgggaatggcttccgggcatgctccctgcggcgtctcaggtatcgtgtctgcggcgggaaccccatgggcgcctccgccctcggaggctgcggttcccgtagcctcttctacttggctccaaaccatgggagccctcttgccctccggaccagagggagggcgctgaggtgccagggaaatgactcactggcctatgttgatggccctttggaaggtaccaatggctcagtagtcgataataccgaggacgaagcaaacagctctgggttggatgaggagaagggtgatgatgatgcagaaaatctcagggacttgcttcagaaggcgaggaaagagctggaggtggccaggttgaacagcaccatgttcgaggagaaggcgcagcggatatccgagtcggccatcgcactgaaggatagggcagataaagctcagagcgacgtctcttctgccgtgacgaccatacaggagatcatcagcaaggaggctgatgccaaggaggctgtccggacagctacaatggcgctctccatggctgaggcccgcttgcagttggcgtcagaagctctggatgccaaaaggggatcagtcgggccgatggaagttagcattgatgatgtggaggaggaggccccttgcgtccgcgcaagaggagattaaggagtgccaagaaagtctgtcaaaatgtgaggagga

SEQ ID NO: 67616 - DNA, 1453 bp, Oryza sativa
cctcatcaagaggtatgttccctttcaactgaacctgtacattggcgaatttatttcccttttttgtgagtacattctcttgctgctcacacaagttagacaagaaatttggcttgtgtctaactcccttctgctctttgttaccctaggtaaatgaggaagaagcttcactcttcgacatattatatttgcttctggctagtgttgtgtttgtaccattatttcagaaaatacctggaggtgatacatttatttctgacatctatatgtgcatagcatggtatcatggcaatcaaactttccttatccatctgccttttttttacaaatcatatcaaacaaattcgtctctgttctactctagttttagtttcaagtttcaaccgaacactacaaagtacaaacattcactttgattttctaatttgaaatatctgaacgtttgttcactgtccgatatttctttttctaatatgcaccttgatatcataggtagtcctgttcttggatatctggctgctggtgtcctaatcggtccctatgggctttccatcatccgtcatgtccatggaacaaaagcaattgctgaatttggagttgttttcttgttgttcaacattggccttgaggtagaaactgagtttcttttagattctttccttaatcctcatgcaggatatatcagcttaccattttttacctgcagctttctgtggaaaggctaagctcaatgaagaagtatgtctttgggttaggctctgctcaggttatactcatgctatgcaaccagtaaagcaatagttccatgtggatactccctaacaaattggagcaattgacaggtgctggctactacagcagctgttggtatgatagctcaccgttttgcagtgctaccgggaccagcagcaattgttattgggagtgggttggctctgtcctcaacagctgttgttttgcaggtacttataactggcatttatcttgtgtcatagattctgacattttgatatttctcatagtcaccgtgatcatatcacaattggaataaattgatcacctggaaaccttttttttctctgcttcaaactttgataccagagtattgtggaaacttcctttctacatatatatttgtggtcttcatttttttagttacactgggtgttgagcacttatggtttgcttctctaggtactacaagaacgtggggagagcacatcacgacatggacgtgctacattttctgtgttattattccaggtatgaccaccatgatcatgaatattggtgattatgttccaagtttctcttcctccctttttttttcttctgatgcacttccttatgttttatcttgagttcttgatgacaccccaccctgtggttgcatttatttgaatgtcctttactgttccttgccatgcatgtatgcaagcatgggctgcaggaa

SEQ ID NO: 67617 - DNA, 1632 bp, Oryza sativa
tgagtcggatattgctccttaccgtggtcttctgttaggtcttttctttatgacggtaaggactctgaatataatcatcattttttttgtctatgtcaatgagctgataggagtttgcttcaatgtttatatggataatataacaatgtacatatcgaatgcaacattacagacatcgaattatgttgatattatcttgctagttcattagttatgatgccaccgacatatgcaatgaataactttacacgcttgttcactatccaactgtttgacttcacatatttgtcaagttgttatgttttatttatttaaatttttaatggtcatgtattgtgtagaacagtattaatggttccagtgtcatatcacttatgtttctgtctttgattcttattttagatttttttttaggtccaacatcgtggtttctattatttactctggaatgacgataaatcgctaattcttcctgtaagctactatcttatttgaagcccttgcttaatgcttgcactgcatttgccctttccaggttggaatgtctattgaccccaagttgcttctgtcaaacttcccagcaatctctgtgatattaggtcttttgattattggaaagacaatgttggttacatttattggtagagtatttggaatttccaccatagctgctgttcgggttggtctgttgcttgcacctggtggggagtttgcttttgttgccttcggagaagctgtcaatcaggtttggccctggttctttctgtttttttgtattgttttaggtgataagatgtatatgtcacacacatctgagttaagacaaactcatggacaatatttttgcagggtcttctatctcctcaattatcgtcattattatttctagtggttggcatttcaatggctcttacaccatggttagctgctggtggccagtttttggcatcaaaatttgagcagcatgatgtgagaagtttattacctgtggaaagtgaggtatcttcttttcactctcatagaccaacccatgttttaccttctgtttcgatgacctttttttttttgctgcaatagaggacatttgcaaaaacttagtatttttcccagtttagtttgtaatgaactgtcaagttcacagattttaacaagaatgcataattccatgctatgttcaattcagctagtataatacaaattttgtccatgtagacggatgacttgcaagaccatattataatattgggatttgggcgtgttgggcaggtttgtaatcctcataagattttatctatctatctatctactttgctcgataaatttctactaatacgcctttcatatatttttagataatcgcacaactcctgtcagaaagattaattccatttgttgcacttgatgttcgaaggtatggtactgcatcttgcaataaccttgttaaaggcagctacaagataatattgaagcatatctcagcattactattggctatttatatgtataataatcctcgttctcaagcatgcatataagctgctatgtgttcaaacactttgttatgatttatgtctggctggtgatgcctacttgtggttagtggcatgcttgttagacagtgaacatgtagct

SEQ ID NO: 67618 - DNA, 1031 bp, Oryza sativa
tttcatcaagtgtggaatttaatgcacaaacatcaatttttcctattactgtatttcaggcaaaactcccaatgtcagagattgcagcaactgtcaatgagttcaggaaccgtcatctgtcagagctcacagaggtttgtgactgcattgcaacttagtgatcttagtcataaactcataatgatttcaataaaatccatagagctgtaaaattttcctatgtttattgaagaccttaatgaagtcctacgttggtctattggtggatgattttttattcaggttcaaatgctaactgctaagttcttttttctgacagttatgtgctacaagtggaagttctctgggctacggatactcgagagtcatgtccatttccaaatcaaagaccgtcacctctgatgatgagagtgaaactgttgatggagcattggcgatttgagctgatgcgttagtcacctcccttagactgtacagtagataatctgtcatcaaagataatttgcgtatagaaaagtagtagcaaaataattcacgcaatgacgattcccatttttgaaaacttagcattacccctttttttaatgtatggtaggacataggatattacttatcttctaccatcagttcatttatttgtagcccttttactccgttagcaagtaatttcttgatggagaactaggacgatgcttgcaccttacatggagaacactgagaatttcacaagtggcctccaaatggcgcatgatggataagtcgtagtcgtctcttatgaggaatccatacaaccaagattttgggttcagaactaaatattatgattttgttagtactcagagctgatgttggaaacaagtggtgtcgggtttcttttgatattgcattatatttttaacagagcttgtttattattgttcttgtatagtatcttttgttagagctgcaaataacaaattaaatatcaaactagtaaacatttgcttaattaaaaacgagtaatgctatacgtacttaaaaatatttacgaa

SEQ ID NO: 67619 - DNA, 2296 bp, Oryza sativa
cccaaagtatatgggctgtgattggtctaatagttgaggaagtctataaatactagaaggatcttctagaggcgggtgtggtaattgaatctaacttctatctgaagaaaccattcctcctcctaactctgtttccttcttcctctgctctgaaatgctatgttctgttctgttcttcctcctcatccccaatttcatctgtgattcgatctagggttcgtaacatcttggtatcagagcccgatcctggagcggccaacattcaagacgcgtttgcaaggtcaagtggacgccatggagaagcagcacgaaggcttcgggaagatgctgtccagtattcaagaggcgatcggcgccttgtcggtgaagcaaggcgaggtgcaggagacgatgaacaaaatggagaaatccatttcaagttggcgacctcaagttgatgctgcggtgcagagcttgcagcgtgacatggagttgctgagaaatcaagtcggtgcggtggagcgacatcaagcggaagctgacaaatcgtcgaacacctcgcaggcgttggaggagcgggaggaaattgctcgtcgcacatctctgctgccgacgccgccaaccacgtctctgccagtatcgcaggcgttggaggagcgggaggaaattgctcgtcacgcacctctgttgccgacgccgccaaccgcgtctatgccagcctcgactggcgaaattggtctggatggccaccgcatttcaactcagttccgggggagggcaccgggggtagtcactactctcgtcccacctccgggcaagggtacgcactctctaccgtttcctcctcgtgttcattcaaatttttcggagtttgttggtcgcgaggagagtgggggatcagaggggcgtgggtacaatcacagattgccgaaattggattttccccaatttgatgacagtgatcctcagaattggcgtttaagatgtgaacattattttggggtttatggcactcatccagatttgtgggttagagtagctaccatttatttcattggtcgagctgcatcttggttacgttcttcgcgagctcatttgctttgtgggagttggggagttttttgtgatacggtggataggaagtttgataggaatagacaccttcagcttgttcgtcagattgatcagctcaagcagtcagggtcggtgaatgagtactatgagcgttttgatgatttgtggagtcagttgttggtttatgatccaaccttgagcactgtgagttgtgtccatagattcacggagggattacgcagtgatattaaaaatgcagtgttaatgcattttccccaagatttggagactgctttggctcttgctatcttacaggaggaattgggagaggctggtggatctttggtgtccaaggatgggaagaaattgggtgatcacgctgctcgaattaaaggcgcttaccctttacctttaccaccacccaaatttgtgcatgctggcaagggagatgataaaagagcagctgaagttcctaaagtggccagttcttctgacaaattggttgctctcaaggcctatcgacgagctcaaggtctttgttatgtttgtgctgaaaagtggtctcctactcacaagtgttcaggaccagtacagttacatgctgttcaagaacttttcagtgttttggcagctgatgtttctgatggtgaacaggatgctgattctacctctagtctgatggctatttctttacaggccattcaaggcacggtttctgcacatactttgcgattacaagggtccattcaaggctttgatgtgttaattttggtggattcaggcagctcttgcagttttcttagttcagtggttttacctcatctcactggtgtgaaatctttacttactccaattcaagtaaaggtagccaatggtactgttctttattgtacctctgagttgccggctgcaaaatgggaggttcaagggcatcagttctctactaatttcaaactgcttcctttggacaattatgatatgatcttgggtatggactggctagagaaatatagtccaatggatatcaattggcaggccaaaacaattcagttttgtcttcatgataagtcagtggaacttaaaggagtggtacctgaattggataaatgtgatctggtctctattcaccagttacagttgttgcacaatcaaggagctgtggagtcattggttcagctcactgccagtgacggctctagttcttctcaaaatgttccaagttcaattcagtccattttggatg

SEQ ID NO: 67620 - DNA, 1120 bp, Oryza sativa
cgaccttgaggagttcgctgaagatgaggtggctgcaccggacgaggtggtggcggcggcaccagcggacgacgcgggggcggccgcggacgacgagggcccggcgccggcggcgggggcggccgcggacgacgcgggcgcggcgccgtaggagtagcagcaggatgttcgtgctcgcggtcgcggcagatcatatcgtgaagggcatactccgtatgtgtgtttaccgagatgatatcctatctttttttttggtatcgtctcatgacagattcgtcgtcgtttgataggtactatagtcctagatggattcagttatctgttaagtagctagtgatggtgttttgtgtgatgagacctgcgaatggtactagaaactgaagtacttttccgatcgaggagttgcaaagtttgcatgtctactacttcctcggcgtgctcgtgctgattgttctacgtttcatgcgtgttttttttctttttttttcacttcgtcttttttctatttgaggtagtagtagtgatttgttcagagaaacgatatggtttctgcctctctctccctctctctctctctgactgttttttttttggagttcttctgtgtgttctgcgttggtgtgtgtgtttgcgtgagagggcggacgcaacaaggtggggcagggggggaccgcgtgccagactgccagagagaaccgcttggcacacgccacgtaggagacggaggccgcatggagcggcacctgaccggacgcgccgtcgtatgagagcgtactttgcggccacttttttttaattcttttttgagagtatacgctgcggccacgtaagattccctcggtccaaaaaatactcaaagtttgaattttatcacacgaaaaattaacttctatcattttacctaccattaacacgtgaaacgaaaaattttatccattcaatactcttattatttttttaataattaaagttactttagtcattctcactctccactaattctacgggatggtagaaatggatttttttttttttgactgcaggagtacttccaaaactgggcccatcagagatggaagacgctttatagatgtgcaagtcgcattactgctgcattttt

SEQ ID NO: 67621 - DNA, 1973 bp, Oryza sativa
  unsure (1)..(1973): unsure at all n locations
atatatatatatatatatatatatatatatatatatatatatatatatataaagtttatatacacgtataaaaaatgtgatacatcatatataaagtgtgtatatgtgtatatttttttatacataaaaaaatatatacgtataaaacttcgtatatatttttatagtggtagtatagtaaaaatagtacgcagtagtcctagtagtattagccgccgcgcgcccagcctagccgcccattagccgcacccctacatgcactggtttcacttaatttttcactcattaattatacactcagactcagagtcatctaattcttgatctacatcgatcattgttccctgcttcatgtacacgataagcttcgaaatctttagaaatgatggcaccataaaatacaaatggttaagagcagatacaataacagattataagccagctataaaacacatatcaaagataaatgaagagagataagagaagcggcctacagatttgtaaccagctacaacataaactacaagagataatgtatgtatgatatgtgggaccaagtatgatatgggcttgagttactaaagaaaggtttaatttgagaattggagatggtagagaggtccaaatatggaaggatcagtggatacccccgacaatccacaccgatcgtacgtaggttgtcacgacaaagtgggagttgcgcgtgacttaggtcttgtttagttactattttttttcaaaaatatcacatcgaatctttagacacatgcatggagaattaaatatagatgaaaaaaaaactaattgcacagttatgatggaaattgcgagacgaatcttttgagtctaattagtccattattagccataagtgctacagtaacccacatgtggcaatgacggattaattaggctcaaaagattcgtctcgcggttgccaagcgagttatgaaattagtttttttattcgtgtccgaaaactccttctgacatccaatcaaacatccgatgtgacactctaaaattttcatttttgcgaactaaaccggcccttaggtggtgggtttaacaactgatcaatcaagagagccattaggtggtgggtttaacaactgatcaatcaagagaccaatccttgggatgtgaatctagcaatcatgttttttctccatatgagatgctaatgaaattctgaagattaaattgccacatggcagaagagaagatttcctagcttggcatttttaaaagataggcgtccgcaacgcttattgtctggccctgaccaatcaatcgatcaatcatatgcatgaatgcaaccgaactgggatcgatcatctaagctagttcatcgacaaatgaagaacgtaatatatataatatatgggcgagtttatgggcaacccgagtgtcacaaaacattaaaatctttgcnttgggcagttaattagctagagaagggtcttgccacgaaatgggtaattatattggaagatgcgcagattggaagcagatgcaacttattgccgtatttgttgacaagctagctaggttacgaagacatgtttcatgctgtcgtctcctgtacccgagctgctgcactacgatctggtagctcccaaacgtcataccattgcgtacgtgatgtttgggagctaccaaatgatagacaattggttaggtctgggccggattggctcctcatgcatcatcctggagtcaatcaaaccagaggtacagggcaaaattcctcctactctgttagagacctcttctcttaacaaagcaacaacaatctctagtacaactcacaaatacacaactagttgcttgagctgaaactcaagaagaagaggaaggagatacaggctttagaaggttctagaagctaaggtgggggactggaggaaggggtagaggtagggaaggaaattgacaaggagccaaccggcctccaggtcgccgccgccgcc

SEQ ID NO: 67622 - DNA, 954 bp, Oryza sativa
acactctcaaaccatcacgtggcgctctgatatattagagaaaatcataaaaattctaagaaaaaataaaaacatctaccccttgattttacacttaaattggtgggtcctatattacacaccgttagatgaaattgatcttaaaacaaaccaagtactatagggtcccacctctcctccttctcccgcacatgtgtgggtatacgtatgtaccatggtatgtatgcttccctcccctcctttttttccttttttcttattttccccatttatataatatatatatatatatatatatatatatatatatatatatatatatatatatatatatatatatatatatttaaataatcataatttcaccaacaaagaatgctcacaggtaactaaattagctctacaatttttgaaaataaaatttacaccattatatgttaccattaaattaataatgttatatattttctacataaacatgtgtactcattattttgtactattattttcacataatacactattttaaaataaagtttacacaattatattgtgtacctatcaaataaacaattttaatctatattaactgatttatatgtgcacttaaaccgatggacccattatttaaatcatcggaactattttttattacattggactattattctcaaataatgcactaaagtctacatcattatattgtgtacccattaaattaaaaatttaaaatctataataactaatgtacacttataaagaaccggtggactcatcatttaaatcatctgatatattatttgctaataaataaagcgtccgaagttctctttttggcccgctacacaatgcacgtctgtacctttaccttttgcacgcgtgacaaagcatcgtgtctgaggcatctaaggtgattatgactgccgcatcactaacgttttgccacatataaat

SEQ ID NO: 67623 - DNA, 8049 bp, Oryza sativa
  unsure (1)..(8049): unsure at all n locations
acctcgccatcgccgccatgaggagaaagagaggggggagggggctcgccgacgcagttgattctttccagccggcaaggcaggcggcggcacggtggggcggtggtggttgggaatcgcacgatggcgtgaggacgggaggagtggtggcagcgatctgaacggggaaggagaggagttagggttagggggtttgcacgaatcttaaaacatatctaatggtccaaaatttaaatgataggaggtgggattttctgtcacaagatatatagacaaccccttcttttatatgttcctcttaattttctccttctgttccttccgtgtgtagggtttcagccgccgaaaatcttgggaatccacagagaccgtgtcgatcgcgggcggcgatgagggacggtgagcgtgcggaggtcggggcggccggggtgaagaggaaggaggcgagcgcttcgtcggactcggagccggccgggaagaaggcgaagaagaagatcctcccgaagtggagggccaatgcgatcccgtgcgaggggggcgaggtcctgaggaggaagaaggaggcggtggcggccagcatgctgtggcgcacgccggatgtcccgggggcgagcgatgtctgggattcgatcgaggtcccggcggagatgctggagctgtggctggagaggcaaaaggcgaaggcggaggccgcggctgcgaagaagaagaggaaggtgttcaagtgcagggtgccgaatagcctcgtcgaagtgatgatcacgcagccctacaagtgcgttgatcacaatcgctctcaggaggagctggccgaacttgctgtgccacatcgccaaatctacatcctcaggaagttcatcgatgaaaagaagatgaactacgagcagaccctcatcgaccagtacgccacacagggctacgcagaggacgaggaggaggtcaccgatgacgatgacgacgaagatccagctaccctaacctaggtcaaatgtgtgctgatctgctcatcaatgactatatatggtgtaatcatcatcaatatcatctcctatgttatttgcaaccggtgattattcctgtatatgtaccttgctactggtattaattgctacttttgcaatcgatgaatcgatacatgtgttttatgcctgtattaaaatcactggttcacaatatttaatttgctgctgattagtcctagtgcatttgcaagatcctggaaggttgtgcgttgtgccaaaggaacggctttgatagcttcagggtctatctctattcttttgcgaccacaattaaagttaagcttatttttcacaccttctatcccaccattctgtccttcccgccacaccctctgcacaactctaactggcacatcaaactgcagtgcaactgccttggagactccatggtgcatcacaggaggatgtgtgcatgctagcaatttcagatatatggcgatcttcaagtcatccggatagaaccttctctttttcacagtcccacctgcaaatgacaaagaaaaatcaatagtgaaattgggaatacggtagtgtagcaatccatacaaatactgaaaaaaaacagtttaattctgaaaacatatgcaatccatacaaatattgagtctgtaactctgttgctaatattttcaggttggtactagaagtaattcataaagacttgacatgatatatatgtctgtggtaggtggaagctaaattcatgattgaaggatagggttgtttaatttcatgattgaagctaaattcatgattgaagggtatatatgaccgtggtaagctaaatacatactgttttcagatttttgcagacaagatgttttctaacctacaggagtcggcgaacagatgttttgcaatgtataaaactatactcattgaactataagcgctgaacagatcatgtaggcagagagctaggcaaaaacagaaactaaaaacaaaagctatctggtggcagtacctccatctccggcagcggcatctccttcgcctccatcttgggcggcagtacctccgtctccggcggagcacctccgtctccggcggcagcatctccttcgcctccggcagcatcagcatctacgatagcaaactgattcaaaatcaaactataggttattaggttcctaaaccaaaaacaatggcacatagataagtaccttcatctgcatcagcccacaccatgtcataatcaaggtcatgagccggcccaatccaatcgccaatggcatcccaatctatgggaggctcaagattgaggtctaacaattgtgccgccgccattgatcatctacagctttgtgtgtggtagaggcaaggaggagaagatttgaaaactgaactcgttggtgcatgccgtcgtcaaatcgctgcttatatagggccattgaacctgtgaagttcaatttttgaattttgcccgggcataaccccatccgttttcagcgagcgatcgcgagtaggcgagcgaaaaattggcgtggcaaaaaattatttcgcgcgatcgcgagcgctgctaatccgaacggttaggcgaaggattttgcggagccgaagcgtcacgctcgcatgcacccagctttaattgtgggccgagccatgcaggccttggatagctgataagagcctgggcttatctttcttagtctgtgtgtcaagctaaaatatgatgatcaaaaatagatggagggagtagtattcttactagtagttgattgatatccccaatctcgatgtttcactacttctgccgtaaccttgttttgtaatcatatgtatgttctatttcttcagttgttttggaatccaccggttccatttcttggatcaatttggctttaccgtccttaagccgttgttacatgatatcagagggcttgtttggatcaatgccttaccaattttttgtagtgccaaaacataggcaagttttggcactaccaattatttggtagaataaatttggtattcatcttatttagtttgctatcaaaatatagccaagttgtgatactatagtgaagaaagttctagattgccaccaaatttggtataggcattaccaaaaagttggcatcaatccaaacaaacaaacggtgggtactatttagactacgaaaatattggtagagcaaattttggtagcaatccaaaactgtccagagtcttcctcgtcaaatgacataaagcattgcattgttccttcaccaatgcacacatggtacatctctgtgtgcattggtaccaaaaccagaatattccagagtccaagtgtccaacttgtatatgtagattgcggtcatccttatgtagtttgccctgcaaagcctgccgtcatgtccaggtattatattttctgtcaatgaaatgcatttttacattctatggaagggaattaactactcccatcctagaattgttgaaggaaatgatcaacagtggattggcaaaacagtggacaatcgccctctggagcaagctgcctggtaaatcttatctgtagcaacctcaagcttcgctcttctcttcggcgagctagacagtaacgaagactcgttcccacgaatgtaattgataactactagctaccgcatcactaggcgatgagaatcagcggactacttgcaatcttcattctagatatacctcttcattaagcatactttattatattttgttttcacaaagggattccggtaagatggatcagtttgctacaaagagtttacaaggtacatttgatatattcaatatttacatagtaggaacagtgggggtgcaaatgcctgacgaggctcattaagaaatagtgaggaacagggtcaaaagaagagaagtccgatcatgctcattcagaaattaggtgcccatgatttacagacctggccaacattgatgttcagcacaaacaaactagcagtgtaaactgtataggcagtacaagataatctcctttcactaatacagaaatatccttttgacagtgacctattcgatgaggttcgtaaaacaactcatctagtttggctaacatagacagtgcggtttcttgctggtaggcaaccaaaagagtgcagagggcatcgtgtcgtcagtttgccaggttcataaaagaccagcttgaagggcataactcccgcaccgtgttcccatcctcatccttgatttgaacatcagcatgatgcttgacaagcaactcagcaatatcttctcgctcacagaggacagcatagtgaagcgctgtttgtccttcattgtcctgaatataaaggacatggacagtgttgctcattgatctcattataatgtttagactttttcagggaagcagtgcctatcaaaccaatatatatccactagtagtacctagccgtggcaatctcatatttattgacactattatatggccacaatgaatagcaactttttattcaatgtagtacataatgtaatcccaatgaaaatgccacgccaagatatattaccagcttcttgctccaattacatactcaccaactttatcagcgcgtgaattctactagaatgcactgagtgaagcattaaaggtagagtcaagtacctgagcattcacgtcagcatttgcattgacaagaatctcaacagaatttagatggccacggtcgacagcccaatgcagtggagttctgccttcactatctgaaaccatcataaatgaaactatgcttagatgagctatgctaagcctaagctacaaagagaacataatggtgaacagttcagaacacaaacctctcatgttgacttctacaccagcagccagatgcttcgctatgtcatcaattgctccttcccttgctgaaacatggatatcgccaagttcactgcagttacagataagtttgttgcaatcatggaaacactgtcatgtaactagatgactgaataaataatgcttaatagcaccaacatggagataattagttgcatacttcatgaaataattaatcatgtcattgttatttgctatgatttatcagccataagagacgatgcccaaatacaaacctaactgaacttgaatcaaggccgttttaacacataataataagaccaaaggtacaggatatacttcgtgtcgaaaacttacgagtcatttccctgatcttcctcctcatacattaaactgctaaatacaggtcccattggtcccttcgaacttgaagcagatactgtggtatcttcatctttccttttctgaaatcatgtaaatcagattatcaaataagccaatatagtgatgggatcccaactagcacaaattgagcggtgttttttttttcaggaatcatgtaaagcagactataaaataagccaatacagtgatgggatcccaagtagcaaaatacgaacagtacaagaggacataagagaattaccgtgctcgaacccatgctccagttagggaatagctcatccacaactgtgatgtacttctgcataacttcttctgtcggcatagcacccaatttatgccaagcattccttggatattgacaccatatgaaaattaggatacttgtaaannctagattaagtctttgaaaattgganctagagatagnnnacagcgcnnaaaagacnaaanncagtatgatgttaataaaagttagctgcaaacagagatatcttaattcagactccagtgccaaattcaaaagggtaaattcaaaaccaccaaaggaagtcaggaaacaataaatcaaacaacataatgcaaaagtaagttgaattgcagcatctgactgaggaatgctactatttgtgagatcatcgagctaccaggagatttcacttccaatgaaccaaacctgtaaacctagaggcaataacaatgagttaagtttctaacaagaatcatagctacaagattaacacacaggaatttatgagtctcctctggtcagtgcaaagcacaaaaaacctaccaccagatttcgtgatcagcaattctagcagtaactgaacctaaacttagataacgataaatttcgatccatttccctaaaccctcgaactgaaacagtgggggttaagcggagcccgactctaacagatgcttgaactaaatccagaagagaaaaaagatcagggaggcagggggatcgaatctaccacttggcgcgggccttgagcttgagggcggacggctgcggcgcggtgcagggcccctcggtggcgatcttgtagagcccatagagctgaagctgggcttgctcggggacgctcgtgccagacgcagcggaggcggcgacgaacgcggaggcggcgctgaactcctcgtcgagctccgtgctctccacgccctcccagtcgctgtcgctgtcgctgccgctgccgtcgctggtgtccccatggccgccgtcgagggaggccggaggtggggccggggcggcgggggtgtccgcggcggagggggaggtcggcgtggagcgggtgattcggaggttgtcctccttgaaggcgatgaccgtggagatgagcttggcgacgaggaaggcgaagaggaggccgattaccgccgcctgggcaagctcctgccagtcgccgcccatggccgacgccgacgccgacgagtcgccggggcgagatgggatgcgccgcggatggaggcggcggcggagaagagaagagagaagaggacttgggtgatattttgtcgagggccccttgcgcttttcgtttatagaaattttggtaaaaatattcccaattgtgggcttagaatttggtaattggacgcctaatcatgggctctcgtcatggttgaaattagaaagatccaacaaatatctgccaaaagaactggatcactaatcacttccacttgagatcacacacgagtgaatatattttggtgttttttttaattttcaacgtaaaccttaaagatggtgatgagtggtgaatcctaaaacattgaggtagatggatttttgttactttcccaaccttacatcaaatagaaaaaaagtcttttgaagtgaggtggaaatgatggcaaatataatgtgaccctaagaaattataacgacggtagttttattttaatttttgaaactttagagtgtatggcgtggttctcttattcaattttccgttgcagtgcacagtcattcagctggtagatgaaacatcttgagcttccatatatttattgatacagatatataacctgtttatttttaacttttgtttggttcaacatgaacaaatatctttgcaaaatcctattagcatttatggatccatagcttttttgtatgtttggatcggcagcacgaacagacgacctcactccacaaaattcaacgcaagttaaccatagcctataataatttcatcataagtccatttttagccaagtattatccaaatagccacctcttgcttcatgtaaatttgcagctcttataacctgtcaagagaaaaaaaaatcatgtaccactagtaataaataaaaaaaaggacatttaaacttaattaatgaaactacactattattgttattaagtagaagataaattaatatactccatccattttatattataagtcactttgacatttcttctagtcaaacatttttaagtttgatcatgtttataaaaaaaatagtttttcaataaaaataaacatattatcgagatatattcaatgttagacttaataaaactaatttgatgtcgtagatattgctagatttttttataaattttaggaaaaaggtcaaaacgtcttgggatagtacttactaggatcgacggttgtgataacgccggtctggccgaagtcacagtcaaactcatgctggccgttggattgaaagtaaagattcatcgcgaatgctgcgtgcgcctgcacgttgttgggatcgtagcacgaaccccccgcccggatcgcgccacagtcgatgccaccttgtccgcacacgaagtcgatgttcacctggagcgccacctcgtccgccgccggcttcggcacg

SEQ ID NO: 67624 - DNA, 1813 bp, Oryza sativa
  unsure (1)..(1813): unsure at all n locations
ttcctgcagcccagcacaaaagagagagggagagagagaagtgagaacaatgaactgttgccactgcaaacatagcatatttagcagccctacaccacacgcattcgtcaggtaaagccaaatcacgacgctgtaacatggtaacagaacgtataataaattttgagttatagccaaccacaagagcatgtatgatacaaggagatttccaacgaatgagcgatgaactgatcacatttttacatcggtagcacctaaagctgattctcccaagacccaaccccctggggtatcgagacagtgccagcttgttctgtagacaacacaacgagtcatttctattcacccacacataaacaagggcattcgaccgacgtgttggacgcaacgttttctgtacctcatgaggtcagttttgttccttcactaaagaatctgccattcctcctctcctgtttcacctgaggcatcgaggtcctcgacattgatgttgccatcccctgagatgcccaacacatcgtcctgattgtacatttgttttgacggttgaaccgactgcacaacagtgaagagtggtgctccattggctttatctactagctcagtggcgcgagaacagaaatcatcgaagtcatctacataagcaggcagacagtaaataagaaaaccaagattagagtgaacttaaaatgatgacgcgacatttgttcgacaatcacagttcacctttatcacggcagtaaaaaccaatagccaatgacggatctatcaggtctagggccaaatctcgtacagtgctgtcaaagtgcagctagataataagttttttcattattgaaaaattaaaaggataacgaatattaggtaccatttaccaaatcataactgcaattgcgaacatacctgcagtggtatgaagaagtgtctgcctctatgttatcagctgcaatatcaactgcctgagatgtagagaacaccccactgtaactaccatagctcaaaaatgaaaaacaaaaatagctccctagtcattacattgataaatacaaaatccatctacttctacaaggttactaaccaaaatggattccaagcaaaaagggatactgcaaaaatagccagataataacggtcgctgactgcatgcataataaacaaaggcgaacactaatataccgctttgctgtttttttgtgttgccattgttgtgaatgggagaacagggcaccattanaaaggcatgaattacttatcacattgatgaaatcaagattctaaattacaacctactacatatgaaagttttacttattgaccagattgcagatagaaaaacacatctataaaattggcgctcatatatgctaagtaaataatgcagttttaccatctgaacttcatggggatctaggtagagcgccctgtcatcctgtaccccagcaatgtaggttgatgttccaggctttccacccaaaatccccaagctctgaggaaatgtgaacgtctcctttagtaaaggaatgtacctgatagtaagggcaatggcaggaagtgattaatactagaaacaaccatcagtagaaacatcaaccgttcaagggtgaccatatgaagcctacaaagaatgagatttaatagcttgctgcttaccttggattaattttgtcaagccaagaaccagagggaccagcaaaagaatcggtgaccaagttgattgacctttgttgaaatcacagcaaagctgagcagcaacatcaatacaaacaactggagctccacctctttcaccatcttcatcaccggataccacata

SEQ ID NO: 67625 - DNA, 2336 bp, Oryza sativa
agtaccaatcaggtggtgttggcacagttccttcctttcacgattgtacttcagcacgcatcaaacgaatcttctgcaacgcaacaaactggatgggccaattattacatttattcattcattgcagagaaagaaatatgcggattagattagccacagcaaaagtgaaacagactagaacaaaactccgaacacaacccaatcaagcaagctaagagagtccatcaccaacaaaagaacacagcccaattccagatggatctctgcagttttactccacgcaggcggtgcggcgaaggaaggcttgggggagaggaataccttgggggttcgagagtcgagaccgaagcgtggctcttcagttgaggccgaagcgacgcgtgtccggcggagagcccgaatcgccgcacccccgtccgcgtgggggaagaggatagatagagaaagcacggcggcagcgaaggccggagcaccggcggcggggaggggaggggaggggaggagcagccacggcgaggcggcgaggtggggggtggcgtggcggacgcggggaggaagcgggagacgagatggagacggcgaatcgcggccgaatcggctggctcgcgaggaaaggaagagggagtttagttggtgggatggttaccctggccccaccagtcagtgaccgcggtgggcgacgggttggtgtgtctgttggttttgtggtgccgtggcgtgcaacagataccacggagtagaagtagaagaagatgcttattaatacgctggtattccctaattattttggtgtttttctttaagcatagatgctagtggtagcggaatttgcacgggcacgtcaaagaccatccatttgtgtttgttccaaacgtgcagaaaactaatcgtgtcatcagggtatctatccgtttggatttgcgtaccaagagaatttagtcgcatcgtttcgcatgctataacaaaataatgtacgaagatgtttttacgtttgtttttagcgatttaagagtcaatgctgaatatataaatcacaatgaaaagttaaaatcaacttaaaatttaaattctgattagaataaattgcattttacacgggggtagaatgtatcttgtttcactttacatcagagtatataaaataaaaatcacttcgcaagatcaacagagagcagcgagcagcgacgtgcgatttgagatttgacagttccacaatgaaacaacagtgcggtactttctcagttattagtacagatatcctcaaacaggacgcatataggcgagtcacactcacacatgaaacctgggaaccagaaagtggtaataactagcagggactacagcaaatggtcctcttctatccatactcacacccatacttgaccagcaacttaacatcctaacaaacgaacgaattaaagaagccaattcctatctgctgctgtcgccgatgttcctttctatcatcacaagtcagccgcaaggaagttgccaggcagggcaatctgccaatcagagaacagtgagttgtttcttaaaaacaagttcaactggcatcttggtgttctcatgaatcaagaatttagggtcaggagagataattaccttctcgcccggcttgaatgctggtagacctctgtatgggcaagtaccacatcgaaatgcatcgcccaacccacactgcaattatcatttcacacataagcataacaggaaggcaacaaatctgggtaacaggatgaaactatggattttcagagggagaggaccaaaggcaaaaaaaaataaaataaataacacttaaaaagcagtcatgctcacattgccacaagctgactgagggttattgatctgttctgatgtgagatttagcttctccaccttctcctcagcctcagcccggccacaagtacagttcttgcatgccttccttgtggctcccacctcacaatccccaactggtaaaacataagcaaaccttcaggatctacatattaaatttatagacgttgaacaaagctgaagggttctataaaacagtaccaactggaagttctggtttcttcaagtcgtcttcagtcaagaggctgtcttcatcaatcagttcagaatcatcatcaatctgaatctttggaagaccctttgtggctttcttgagggggaaggaagagcccatgctccaagagaccttctttgccttaatctgcatgtgattcagttagcactagaaagtatgacggcacagaagcattaacacatattgtggcactagatcactcacagtaacagaatgctcgctatcctgggaacttgcagcagaagcttgcacgtcaaca

SEQ ID NO: 67626 - DNA, 4548 bp, Oryza sativa
tcctgcggcccagcataacagaaatcgaaactgaacatatagcagagcaaaacagtgtgtcggttgtagggtccaaattttggaatttagtagtcattggtgagaattgcatattgcatattaccactagatgaatttagataatcaatgcagacatatagggagatgttctccaatattttcccctcgtgattaatgcgagcatatggaaaaaaatttttccttcgtcaaccaatagcgctgtctcacaggtgttccctatttggtcctacatgtggtgaaatgaatctacatagaattagcatatgaagtataataagggggcgtcgtcagaaatgagctccaatcccaaacaggtctttcaaggagctaccatgaatcgattgaactagtgtgatttgtagggttggaacaaatcaaaaccaaaatcagcaaaaggacaaacgctggtaacacagcctaggcacaattccagattgattctaagcacgcaaagtcctaatccgagtagatggattcagtattcaaacaaatttcaggcgaaaagtattcaaacaacccaaacgagacgaggagaagctcaccaagcgaggcgcactgcgtgatgaccaccacctcctcccgcgagacccccgcggcggccgccagatcccccaccgcgcggagcggcaacgccagctcgtccgtcaccgcgagcgccgcagctgtcgccgccatatggacgcagatcgacgcaccacctgcaaccgcgcaagcggaatccaaaaaaagcaaacccccaaccctcaaaacgcgatcggtcaatcggtggagcaagcaatcaggaaccggaaccagatcgaagcagccagccgacgattcaaccggcgtacggatggaggggcagccacggcgaggcggcggcgagggagacgagatggagacggcgaccttgcgggcgaatcgggggctcgagaggaaagggagagagagtttagttggtggtctggccccaccagtcagtgaccgcgggggcgtcgggttggtgcatccgttggtttttgtggtgccgtggaatgcagcagatacgtagtagtagtagaagatacgctggtattcccattttggtgctttttcaaaaagttactcccccatcgtttggcttttttcttataaaccaaaacggtttattagggaataaaaataaatttataggtaaacgttttatatatgtgttcttggtgacttaaagccaatgctgtaaaagaaactacgttgaaaatatctcaaaatcaatctcaaatttaaatttaaaaattcaaattttagctttttctttggctgtttaggccatcagatgggagcctagatgtagtataaacctggtgtaaagggagattacattttatcaacgtgcattctactcttttgattaggactaataataagatgaaaaggagtccttttaatattcatatgcatcatgatttttttaatgaatcggcgagccgtcaatttcattgaacataaaagaagtaaacaaaagaaaaaaaaagatgtacatgtatcccgggctaactaaaaattaaccaatcatggagacttctcacgccagacccaagttttggcctcctccttacatttgccagtaagctggccattggaagcatgattgtggcccaagagtgaggcctaatcttgtttgggctgggatggctgaaccgtattgatctacatgctgcatcgttcaaaacttcaaatgcaagcacgcgtgaatccctcagccaaatactcccacaaacatttttttttcctttttcaagtcaccactaatcaaatcttatgttgtaaaccaacgcgcctattaacggattaccggatccgttccctgtccctcccacagcagtagagacgtgagatgatgtaaatcacccacgtctatccctttttttttatacaattaggtgaaaatatgcattgcatcaagccagtctccccggcatgttctcgtctcatgagttcatgtgccggttccagctcaacctaggccagaggaggctgctcggctcgtctctttctgcaagataaatgctaggaggaggtcattgacccgtacttaattcttctttttttttaattctcctcaataattaatggttattagtaagacacagactgtcagagtgggccatgctggctacttggccaccttggctggcaccttcaacgacttgctatatgagttggtgaagattactggccatactagcaaaggggaaagtgcctgtgcaacatcatcatcaagaagaagaagagatcaacggcaagaagactagcgactagcgagagatcgatcgaagagaagaggagagatggtgcacgggaagctggaggtcctcctcgtctgcgccaagggcctcgaggacactgacttcttgagtaaacacacatccttctacctcttcttgctgtgtttgcaaagcttttgtttttgattacgccatttcttctcttctttgctggttgactgcttaatcgtttctttaggattgtgaacctgacagattagatgcatgaacaaggcatcaatagatatcatgattcattaccagtgaggatactagacagagtgatcgaggaggggcatttcgcggttggttaagcaattatcagcatgttgttctagctagatcatgggtcaacggtgacttatagtgcttgatgtcctgttgttaatgcctaacaattgttttatttcacttcattactctaaagcaaacctaaaaaaaaatatgtatctgcatgcgaaaacgacgaaggatggataaaagcacgccagtatatcgtggagttttgcttgtgctgtcctgtcctacactcctactcgagtaaaaagttaaaaacatcatagcgttagagtgagaaagcatgtgtacgtaggggctagacatactcaatcacaatcttctcaaactttatctgagaatcactgttttttacgctcttcatttgatgccaatttgtgtgtatttttgccaaatcagacgacatggacccctacgtgatcctcacctgccgcactcaggagcagaaaagcagcgttgcaaaaggtattcgttaactgttagcacatactaattccattgcattaggaacaaggttcagtgctgttgctatggagcatcaactgatttgtactgtacctatacctaaatgggcgggaatacgatcctaatctgatgaacctcaatctttgctttcaaacgattcaggagcaggaagcgagcctgaatggaacgagaccttcgtcttcaccgtctccgacgatgttccacagctcaatgtcaagatcatggacagtgatgccttctcagctgacgatttcgtcggtgaagcaaagtaagcatctaaattatgggtgacactctgcattcttccattttagcagtgcacagctgaaatgcagcttctgaactcaaacatgtttatccatcttgagagtagaatcccttcttccatgagacaacatgagcttctgaagaaagttcagaagaacacctttctctgaacatctcttcagagtgatatttgtcagtctatgcatgtatggttcttgctcacctgtgcaaaatttcagcattcctctggagcctgtgttcctggaaggcagccttcctccagccgtccaccgtgtcgtcaaggaggagaagtactgtggagagatcaaggttgctctcaccttcactccagcagcggtaaaaacacttacctctgtctcttgcaacatcgatggtgttgttgccattgtgtctgaacatctggttggagtgtgtgatgctaatgtgctggacactcgaatttcttcaggaaactcgccatcatcacaaccacgagaacgagggggagggttacagcagctggaactgattgcctgctactaatgagcatcaacgagaggagatcttgtctcaagaattaatgtgcttgtcaacaatactccgtgctatgatgtcctaagaactgaaacatccatttatatgtatatcccagaccattgacctgctctgcctaaattttgaatattttttactacaaagatgtgatggtgtgaaatccagaatatttttatcgaatcatgcactttctttcatgacgagggcaaatctactttgcgaacgcgacaccgacgcatattttcgctgatataaaattaaccttaccaaattttgggaacaccaaaatttagcaaagtttgataataccaaaatttggtagggtagaagtgtgggtgttgtttgctttgctaccatgccaaatattcttgtgtagtgttatgtggagaagtttgtaaaaaatcaccgaattttggcatggcaagacatggacatacggggcctgttcactttgatgccattttcaaccttaccaaaatttggtaaggttgcaaaaaaaagtggctacatttagtttgctgctaaattttggtaactatataagaaatcctgcaaaaaatttagtaagttgccaaaatttggtaaggttttttttttgcatcaaagtgaacaggcc

SEQ ID NO: 67627 - DNA, 2248 bp, Oryza sativa
ctgcagccccgcgccacagccactcttcctccagacaccaagttaggcacgaaaattttcgggattggaagagaataactcaaataagacggattcaacaaaacaaatcgagacgtatgtacaccacatgatgaaaaaacaaatccgccgtgtccgccaaatccgacgccgaccgccgcatcggagtcatctcgccgccagggggagctcggggagaaggagggaggcctggagcggcagcgtccccatggcagcgctagaggaggcggaggagtcgaggtgcgcggcgacatccaccatggcggcggcgtctcaccgccggatctacgcccccaccacctcctcctcgtcgctacagggccttgcgccgaagaacgccgcgtccgccagatccgccgccttggccaggtcgtcgccgagctccgcagccaacactgccgcaccgagcccgtccaccacgctcccgtgcggggccagtgaagagggggtgcggaaggaggggccgcggtggcggtggggagggcggaaggaggggcagcggccatgcaggagcggaggagtaggggcggggcgggacgagacgaggaggaggaggagcggtggcgtgggaggaagtagagcggagaagacgatggaggaggtgaaagcgagaagagaagacgggtcgttgtccgagggtaggtggggaaattgatttccttcggtccccttcgctgccatccaccaagtcacgagcgttgtgggccggtttccttgtacagtgcccaaatccaactagtcacgcaaaataagatccttgtaccgtgggaaagggtgtctttgagctaaatgtctggggtaagacactaccgtcggtgcttgcaatgtgaatggcctcacctcaccccaatccataggcgcgattggtcacgtgacgtggcgctcacccccacctcgtcctcctcactctcccactccacgagacggcttgactttcttcgtcttctcctcctcctccgcttcgcctcctcgcgcagatcccgacgcacacctcgcgcccgcgccgcctataaattcccccgcctcgccgttgccgccgccgcgggaagcgaggcgaagcgagggagcgcgtctagatccgcaccggcgaaacgacccaagctgcctttcccgtcgccgcacgcatcatccgggctctgttgctgctgctataccgcgcccgttcgctgtagcagcaggaggaggaggaggaggagcggagtggtggcgatggcggcgaggaagaatgccggtgtcctcgcgctcttcgacgtcgacggcaccctcaccgcgccccgcaaggtttccccattctccggatccgcttccgtcatctcatctcatctcttcccgagcgatagtttcctcgctgcagctgcatcgtcgttgttgaatgaatcttgttcttctcttcttttttttttgggggtataggtggtgacgccggagatgctccagttcatgaagcagctgcgcgaggtgagaatggcgtctctgcgcttctcctcttcacttctcttcctcctggtttccatggaccatatgggattcatgtcatgttttggttatgtatgtattgggagcagcatgtcactgtgggcgtggttgggggatctgatctggtgaagatttccgaacaactcggcaaatcaggttttgaacctgtactctctactgcggatttagttgatgtgtgttctctaatccaagaacacattgcttatgctctatgaaacctctctgagtagctgcattcatccttgcaccgcagttactactgattacgattactgcttctctgaaaatggcctggtcgcgcacaagaacggcgaactcattggaactcaagtaagtccttaggcaaatatatgcattatatagtgtctgaaatttcacttggagatcatcaaattcctggctggggcctgggaataatggtagaggttcttcttttcatttggccaatttctaaatgacatagtgttgccatacccgccccccccccccccccaaaaaaaaaaagtcattggctgctactggtcttagaacgacgcctttctatattatggaacattatggaacataatgttttgtgctctgcagagtttgaaatcgtttcttggagatgatcagctaaaggtgagccttttttagttatagtgttgcttgttcacacataaattttaaggccatgcaatcgatgatacatgttctttgcaggaatttatta

SEQ ID NO: 67628 - DNA, 1271 bp, Oryza sativa
ccccagaaattattggtttcatgatatttactgctgtatcactttaacaggtgttcccacaaggctgggacaaaacttactgcttgagatatcttgaggaatttcaagaaatccatttctttggggacaaaacctacaaggtgatatgtactctttttagcaaaaaagtgcttcctactttatgtgtggttaagtattttatccatacaatgctagaataacaccttatatatgctttgccccttttatgttcactacagtatattcttgttgttatctgtctatcatattcaactatataacatttccactatttagttcttcgcctgacttttttttcattcaatagggaggcaatgattatgagatatttgagtctgaccggacaattggacatacaggtgtgctgtttgtttcataaaagctattattctcatgacattactgtatatgcgttggacttgaacttcttgttataacttaaaacttgtgtataagataggattaggtttattggacacaaaaattttataatgttactgtgagacattctataaccatcagcacacagtcgtagatcagactgtgaaacttgggtattgacccaaccagacaggctattccaatcaagcaatactgcacagatcatgcaaatgaatgttcagtagcagtatacttgctggcagtttccatcattagaattgaccaattcaggttaatgttcatgaataaaattcagtttgaaacaaccacaaacacttgggtcaagtcttgaataaacaaagcaataacattttcttctggaaatacttcacaagttccattatggttgagctgtatcctcttactaaataggaatactcttgcaagcttctcatatgtggctgagtcttgtttgccgaggttaaacttgctttaaatcttttctgagctaatacatgattgatgccatcaccaagctgatttcatcatttatatttgcagttaccagtcctgatgatacagcagagcagtgcagatctctcttcatgtcgaagtgacctgattaccgtgcattttatttattttacatagcattcctcacatttcctgtatttcccttttttttataccatacaagtgctgcttcttacagaatgtacttctccgtattcacaagtttcagattatatgtgtacactttggttcaaataaatgagagctggcattgtttaccccgtctggctggttttaaaattcagaggtgtaaaaggataaatatacgcggacgt

SEQ ID NO: 67629 - DNA, 2352 bp, Oryza sativa
gttaacattccagaagtactacaccgtcaaccagacaaacatggaaggggacagcaacttaccttaacaagttcagatagcatgaagctccaaccaagcatctctcactcatcagagtggtcatcagttggcatcatgattcataaacaaacatgcaatggttccacatagaggtttttaccattacattgcactgacattgttttcatctaccatctagctcagataacctgacctctaagaagtactgtactgacccaataaagttaggacatggtcttttctccaaatgggaaaaccagtcaattaaagagaaatctccctacaaaagaaaacgttgacgactaataattcttaagtgatgggaaacttaggtagattcttccatcaagttagatcaagccacaagtggcctgaagtgaatggtgctagacgattgaacgccttttgtggccacctcctgactgtgcaaaatgatcctttgaacaagcttgagaagcattggacccagcagtacatttcttggagatggcatgaggctcaaagccaggtggaccagcccaagctgttggctgtgactcagaacaattggcaactttgttcgacgcagaagagcaatctttctcagcaaccaaatcgactgatttagatccaggcaacctttccttctgagatgtttgaccagcagaagcatcggttgcagatgtagtggtgacttggcccaggttctcagctgttgtattgtatgcggattcatcgtaatagtgcggccaataggacgtaggtattccgacagccgcctttgcgggatcatgcattgtgaagtgggagtagaaatgcgccatgtaactgctcatagcatctggatgaacaccagctatcctaacctccaacacatgcccatccagagggtaaccattcatgtgagtgagagccacagcagcagagtaagcatcagcaaacttgacaaatccaaatcctttgctcacaccagtgtatctctcaacaactacttttgcttgagtgatttggccacatggtaggaagaggtcgataagtctttcgttgttaacatagctcgggagatggctcacataaaggttagtcatgtcgatttgtccctgctcattagaagacatctgtgatgtcagagcacccttggctgcattggattctgctggaagccccgcgactctcacagccagtatgcttccaccaatctggtagccatccaaatgatcaattgctgcagcagcacatgaaggattatcaaacctaaccatgccatacctctgaaatcgaaacattctagcttgaacaactcgtccaaatgggcggaagagatcgatgaattgatcttcagttaaacttgatggaaccctgccaacatagagattggccatgtcgatttccttgattggcttgccacctgcttgtgaagcgttggttgtacataactctgatctcttgaccactaacctctttccttcaaccatgtatccatccatgtgttggacagctttggtagctgagggtgcatctgcataccacactagactatactccagattcatcaggactttagtgatctgaccaaagggcgcgaaaagattaaccatcttatcggcagtcatcgaccgtggaagattagtgatgtatagtctagacttgttgatgtcttgagtggtctgtacagctgagatggatgctgatggggaaaggcctgcaactctgacaattatcatttctcctccaaccaatgctccattcattgctgcaatagctttggtagcagattcagaatcagtaaacttgatgaaaccatatcctttggctgaaaaggtgtcaggatctgccaccactcttgcatgggtgatcttaccaaatggaaggaaaagctcaaccaacttcttggtgtcaattgacgatggcatgttacagacatacagattagacatgtcaatttccttgacggttctggtggtgctgggtgattcaacagctgaatttctggtggtgctgggtgattcaacagctgaatttggcagtgttgaaggtatgccagatactcgaacctctatctttcttccatcgacaagacgtccattcaaatggatgacagcctcagctgcatggtgaggactagagtactgcacaaagccatatcctttacttaagcctgttgtgtgatctttggccacctttgcattagttacttccccaaaaggcagaaaaagatgaatcagcctgtctgtgttcatggacaaggaaaggttgcacacatacaatttagccatgtcagtttcctttgaaggctgctggctattatcctctgatgatggaaaaccagct

SEQ ID NO: 67630 - DNA, 1573 bp, Oryza sativa
ttaagcaggctataatatatccatcatggcaaaaaagctgagttggcggagggaatcaaggacagagaacttaagcgggcgactatattagcgccggctgcacgcagcctccaagactaggtgaatttactgcaattggccatacccttgcttacgcatagtgattgggtactagctgttcaggataaatggtgattggacagcaatcagtttgtgcatgcagcttttggcctgcccaaggaagaaaacgcaagctacatctatatactatatagcctactaaatgacatggcgaattttatagccagcaacgggcggtattattgatcctgctcttataagaagtaagcaatgtgcctcccaacagagagctgtgaaatctgtttatatatagttcaaactcatgtaaatttgcactgcacaacttgttacttctcttgtagttctatgttgcttttaacatcaatgccaacatgttatagggcacacattggtgatgccatcatgacaccatatttcacacatttatccgtgcaaaacaagcaaacatacacacaccttcctaaaaatataataatttcatacgatctgcagcacagtgacaccccggtgagatgacaaagtgcaaataatcaaacatcgcgttacacatctctagctgccccattgtagcaaatttgtggtttctttgccgtcaataatccatgatctctgcatattatcattccatcacagaccttctattctcaagaactcaccatgctttataccaacacaaacagtagtaaagaaagcttctcaaggaaatatgtgcgcagtaacacaaacagtacacatgcagcagctataataagcaagcagtgtgcctcccaacggggagctgtgaaatctatctagttcctcacagcttggcgcccttgcctattaatctttgcacccatgtaaacttgttagtacttgtcttgcttttaatttgttcttaagatgaaatagtcaaaaatcccgacatgttataacttataagtcatctttttttagataatggaagctttatttaacttataagtcatacgctggttatggcatcaagattcaagaggcaccacaattttacataaccttcctcacaaaacaattaatactagtgatttcacacgatcttcctccaaaatattaccaaaaggaaaaaaacaaggaaacaatttcacaaaacccgcagcacggtgataccatgacatttttaacactccacatctctagttagccccctgcaacaaatttgtggtttctgtaacgccaataattaatgatctttacatttttttagcatttccatcacaacccattaattcgcaagaactctccatgctttacaccaacgcaaacatcactaaataaagctttcgaagagaacaggtgtgcgctaactgaatccttgcatcaaacacaaaaccctaaaaaaagaaaaagaaaaaaaagagcaaagaatcaaactataaccaaaccccacggcacaatcgcacagcacaaacaaaagaagcacgcacgctggctgaagatcgcggggggttaa

SEQ ID NO: 67631 - DNA, 1942 bp, Oryza sativa
  unsure (1)..(1942): unsure at all n locations
aatttagataggattatttctgttgtaaatgtgtaattagaaagaggtgacatggctacatctaacccatataaacaaagtaaggggtcagattggtccaaattcaccggttgaagttggaagccaactccaggggatctgcacccaacattttatagtacaacgaatttgaatattcttttattcagattcgttgtactataaaatattttatctggttttaaattgctatattataggataccggttgctatattatggaacggagggagtacacgtatagactgtattcatttctctcattgggttctcatgaaaacttttcttttttcatgtcaaaagaaaaactttttttctttcatttttaccctatagtaaagctataccctctagtaaagctactactacgtactccactggtactatttagatgatgtttggattcagtacctgtcatatcggatgaatttaaagtattaaacatagactacttataaaactaattacatataaatgagagctaattcacgtgacaaattttttaagcctaattaatccataactagcgcatgtttactttagtatcatataggctaatcatggattaattaggctcaatagattcgtcttgcgaattagttcagggttatataatgggtcttattaatagtctacgtttaatatttataattggtatcaaacatctgatatgatagggactaaaaaattttaaaaagttttagtcatatataaacaggtcgtacgtgttgccgtgttcatgctaaaattgtttagcgtgccggctgcaaactttgcctttctatcatcgataggtaaacgcgtgtggagatgggggctgaaatttcgggcggcacgccttagcgagaaagtatgaaacgatttacacttccttatttcaatgatttagccctattagctggtcttaatgcaactttccatatctcatagataaccgttatctcatactaggtattgggagagtagaattttcgttttgagtccatcgatctcatcttattcatgtgtttttcttttgatatattcaaatggatattctgtattttataatatttagttttacacttgcatttctataaaaatccatgtttttttaatcctgtgtttcaaatatacttactagacaattcatgtatgaaaattttagatagaaattgctactcctatatgattattaacacaacccaaatatccaatccatatcaaatcagtcacacgtcacatttgcagtatagagtagcagccttactgtgctgttcactggagtgtgcagataaaattaaaatcatccgtgaagaaaaaaaggggtccaaatacaccaaaaaggaaagcatcttgtctgcacaaacgggatacacgaagatccacgctagtgaaaaggattcgcaacctatttactaatatatctttctacaagggtccaactgcaaaaatacctcccattttgggcctttttgggaaaaaccccaactcttcaggggctcaaacgcataattccaaaactttctcgtcctaatcgcgacgagctcgaaacgaacatggccggcggcgatggcggcggcggcgggggagacgagagcgagtttgtgggggtaggcggcggcggaggaggaggaggagaatgagaagggaaccagagcccccccaaccgtaggttcttcgtggccgtgcacgtcggcgccggcttccacgcgccggcgaacgagaaggcgtaccgccgagccatgaagcgcgcttgcctcgccgccgccgcagtgctccgcgaggttttgtactttaccctatcccctacttaccccccactcgcctccttcntcttctgctctcgtgcttggttggttttgtatggcatggagctcggattgacgcgcgatccccaccaagtgttccatctgagcaatgg

SEQ ID NO: 67632 - DNA, 895 bp, Oryza sativa
accaggtcttttttctcccttactgttgctcttatttcatctgtgtgttagtatctctaatcacttctatattgattaagtggttatttatcatatccacaacgcttctttggttgaagtatcttctaaaacttaattgcagtttaatttattctcgtatatgtgttaaattcatgcaaatgcacaccactccttttcacaaggtcttccaatagttgtctatgctacatatgctattgcgtgttcttctgtatgccggcattctcttgtgttcatctgcatgatttttggcctccataaacggtcatctagatgctaatgtctgtacgagattcctttcaaatatatataattcaacactcaaatatgcagcactaggtcccaggcttgtggtactgctcattatttgcttgtgctttctgtgtgcatcagtatatgtaataacgtacttggccagtccacatcacatgttgccatttcattttaggagctgaagctgaggatattactggtgtaaagaagatgaagatgatcacacgatcaatcatggaggatgatcaagactgcgtgatggatactgttggtgctgtttgtgttgatgcttatggaaatatagcatcaggagcatccagtggtggcattgcactaaaggtccagtggtcatttttttcattgtatgatacttaaatttgtttgaggaggactcttttatttatatttcttgtatgatgcctttgcatagagattccccaggccttcaataagcattggtttcttgcaggtagatggacgggttggtttggctgctatgtatgggtctgggtgctgggcctcatccaaagggccctttggcacaccgtttatagttgggtgttgtgcaactggagccggtgaa

SEQ ID NO: 67633 - DNA, 1894 bp, Oryza sativa
ggataatagctatggaggtcagaaatgcaataatcattactactgtcatcaccactgtagcagcatgaaggtggcttatttcctagtaaaagaatgaacaatcaggccacatgaagctggatattgtaaaaagtcaaaaaattggatatactcacccgcccagttatgtggacatatggatcactttcgccaattacaactgttaagggatcattgcctaaccagccagctgaattaaaatgtagccaattaggatcgtatgtgtgtaacatgttaaatggcatacaatggaatttcccttgctatattttggaattatgacatgcaaaagtgaaccatacctttaatataaaaaaacatggtaacagagattactagagcattgaaaaccactacagttatccatggcgtggcaacaacaaaataacgaatcagaagcaaccagataactgacaagaaaagagggagcagtccaccgcaaacaattaacacaggccatgacttcccaatgtcagcaacgtatctctgcagacgaaggaaatggtaattaatatcttcaaagacaaaatgggactccagtgctatatagatcatgttgcatcaggaatttctcaaaatacttcaaaaggaatatccatttcagttgctagaaagtaatatgcttctttcagagcaacagtgcaacaaagttcttttgtaaggataaaaagaattactgcagtgtaatgtacggtcagcgttagctataggaatagctggataatttgtcacttccaacgtaaatcagaaatgtttatgacaaaaaaaaaggaatgtgcagataataaaacagtgccaggaagtttacaaaccttcaggactgaagatttagaattgatggccttgtggattgttttatctatgagaatattttcgtcgatgttgataccacccatctgttgccaatgcttcaaagagacatttgatgctcgcgcaataaattggcagctccagtagactgaaggcaacaaagattttggatcagctatctcattatttaaacttattacatgaaggaataaagccctcaatttaatccatgctcacaaaaaatggtcgcacggaagtgctacaaacagagcaaagattaccattcacacttggaaatataacagggtagcatggaccctgcagttgaagagaactatttctcatatctggtgtgagaaactcaaaatagtcatagtccctgtcgatccaatcatcgacagacaggcgaatgtccccttctggataatcacaaacaaagtttaatccgtctgctgctggcatggggcactccatcaggcagatggctttggcatcagcaaggttaatcttgttgtccttgaccccactttggtacacctggtttgggttcatccaatatctaacatcaagctcatgcaaatccgggtcaccatgcctactgccacaaatgttccctttgtagtctagttcataagtaagcctgtgtcatcaaaacaatataagacatctgtattacttagatacacatgcagcatgtactaaataggagtagtatggttactcatcatagtgtctgaataatagtaaaatgatagccatgcaaaagttgcacagcactgagttttatccctaaacaaattttcttttggtcagcactcagtagtgggttttggtttctattaatatataaccgtagtgtgaattgcttttagggagcacaaatcctgtatagctgggctgtaagttttttttcggagggaatacaattccaaggaccacacaactctaatatataagagtaaccactaaaggcacattttctccctgcaaagcaaaagtgggattctttacctatccggttgggaggttgaaacccagcaagcaa

SEQ ID NO: 67634 - DNA, 4398 bp, Oryza sativa
caccacccagcaaaggaaaagttccccggatgaacgctcttagcatctagctacagggaaccgaaattaaacagcaccgacagcacagatcggcgaatcttgaggagaggagaggtgaaggcgagtgggtgggtcacgggtcacctcacctgagtgggttgccctggttgaatccgaagctggagttgacgatcatggcgacccagaaggccgcgaagagcacgaggaaggccaaatcccggcacctccggttgtgccgaatgatgccatccccgccgccgccgccgccgacacctcccagctcatcccccccgccgccgcccgccgccgccgggtgcctgcctatgatggcgccgagtggccctcccattccgccgcctccgccgccgctcgccctcgatccgatgctgtggtagctcgcggttgtgcttcttgtgagcggaagtgggcgagctcaagctggctggtggagtgatgagcttgtcagtgtgtgcagctagcttttcttttttttttttggctttttgctgctgcggctgcgtgaaaaggagagtgggagcaggagacctggaaactttaccaacttcacagatttcgcacaaatttttgtccaagatttgatggtgtttcaaaagatttcgcttagatttaaatccagaaaagagaatggatgaaacggtttggtgaagactggatcattaaccacggtcaatggagtaagcttcgcaattaagagcgagatttaattaatatggctggatttggttacctgttcgcggccgatgggttgcccgttctggtcaaatgaatcgaccaatcgtgtgggtgcagttcgtggagcacgctactgactgtcgtcactgcatgcatgtagtggtacacgttaattacggtgaaggtacatggaaaataaaatgtctttttctttttcttttgcaagagcaagtaaaggtttcggaggaatacaagaaaggtgtccctgtctttcggccttcactaacagagattgttgcgttggctcgaggatgggatgggtgagctaggctagtgcaggaggcaagttggtagtacaaaactacaaatgttgcataaacatactattagtactacccctctttcaaaaagactatagttttacaggtttatatctaacgtttcatcatccgttttatttgaaaactacaggtttatttgagaaatttatgattagtatttttattgttattactatatgataaaacatgaatagtacatgactattttttttattttttcataaatttttgaaataagatggacggttaaacgttggacaccaaaacctacaactacacttaaaatgatatggagatagtaatatactccctccgtttcaggttataagatgttttgactttagttaaagacaaactgtttcaagtttataggaaaaatagtaatattttcgaatcatggtaagtttattataaaaatatatttaactattaattaaataaaactaatttggtaatataaatattactatatttgataaaaaaaacatcttacaacatgaaacaatgggagtatatctgattagtactttacatcacatactgatagataatgatggggtgacctctatgcatagtatagtgttgacttagactaggtcttgtgagcaggccatggtatttcttacatatactacatgttgtatcgttggtattcaaagttgaaatatgtatattctctttcaaattattcgcctgtccctcggtagctctttcaaatgactgtaactctattgcttctttagagccaagtagtatctcgttgacgcgaccccatactttacagtgggataaaaacggagcggatagtttctgtatgctctgaataagaacgaatatggatacctttcagatcggataattcccagatagttcggatacgaatacgaatattttctcatggatacggatacgaatatggtatcggggtttctatcggatacggataataattcggatatccagtgaacagtgttattcggatatctacagaagccatgagacataccttatttttttataaatctatgacctttaatatagcttttttagattttaacagtagttcatatcttaacactagttcacactattaatattatttacctttttataatatatttataaattatattacattttatataaaatgagctaattatatatgttgatatttgtttctataagaagttgagttggttttcgtgttccgagaaaaaaattatttccgtattcgtgtccgatcatattcaattcttattcatattcaaaattatccgtatttgtttctatatatggcaaaaaatataaaaacgaacatggtatgagcattatccgtccgtatccgctctgttttctccctactctacactctacaggcatacgcgtacccatcgtacatgtacagatgaattttgcatgggctctacgctctatctagcccaccgagcctagaggagggctcgaaatgggccaggcccaacggggaaaaaaaacacgagctcgtcgccggcggcggcgcgcatttccggcacaagaaacacgcaaaatcaaaacacgcggagcacatggcgaccatggcgtggaggttggcacggtgtggttttccatcggtttcggaggcaatgcgtcatcctcggagctcgctgctacaaatgcaacctcacctgcaccgcctgctcgccccagccgaggcgggatcgatcttccaccgtgccgttgccagtgccaccgggggtgggtgagcaccgtcacggggtcacctcccctcccctccctccggccggcatgacgatcgagggaaccatatatggcgggcgcggcggcgatggccctgttgctctcgaccagcgtgctgctcgtcctgtgccttctccccgtcgacccggctgccccgccggtcgccgccatcccgcaccgccgatcggggcgccacgacgtgccgttcggccgtcacgccgcgttcggcccgttcgccaccgaggtcgagctgctgctccacggcggcggcgccgtcccggacatcaggacgtgccgcgacacgctcgaccgcctccccgactggtcccacttcgacgccgagctcggccccctggaacggtgcgtgcgccgctcgccgcgctgcagaactcggtggtcttccacgcgcgcacgcggagtgcttgatgttttgcgcgcatggatggatgcaggtacttcgggtcggacggggagctgaacgtgaaggagcggctgctgtacctgttcccgatgctggaccgggcgcccaaggacggcggcgtcagctgcggcgagctggaggcctggctgcgccggcaggcggcggaccgtctcgacgccgtcgcgcggagggagctcaagaggcacgacaaggacggagacggcgtcgtcacgctgcgcgaatacctcgccgtcgaccacgatcaacacattggtacggacaactgtaattttagtgtcagtgtctgcacggtttttgttgacgcgtcgccacgctttaagcacgttatatgcagtccgcagcggcacccgacaacacgtcgtcgcaagggaggtagatgtaccgaatgaacacccaggagggaccccgtcagagtgaacgcgcgtcagtttatcctagtctcggcaggccagctagaacattctctaacatcatagagacgagagacgataagcaattgggggttgagaggtgaatagacttgggtacaagtagcaagaggaagggagatgtagaatgtagaggttagggcattcacaatgtgggaatatgggtgggtattacgacaccaaagtagacctcatacattgtgaggggatttttagggtggtctctagctaaagttgtccatatgcttatagcctgctcttatggcattaaaagaataaaaaataacttcactctctcaatgacaaagagaaaagaagagatggatggagagagaaacaacgattttttttaaaaagtgtgggtcccatcttaaggttggtcccaccttaataccaccctagtacatacacactgctgatgcccttatgggcaatagattgattttgatgattgattggttgttttttcaatctgccttagcctctatagttataggaggggtgatcttacgtttacatgactctttttcacgtttggaaagctttacaatcaagaaaaccctaagattaaggaaagaaaaatgaaaaaactcaattcgattcgaactatgtgctgaaggtctgaccgcccagacatacgtggtctgaccgtagtttattgtttggtctaaccggctatacattggcggtcagaccagtcttcacgggaaagctttggtatttttcatatttggtt

SEQ ID NO: 67635 - DNA, 742 bp, Oryza sativa
agagacgggaaattaagtttggatgagtttatcagtcagtttcacatgatcgaccacaactccattgtagagcatagtgctgatgatgatactagttgtgctgaagctgagaagaagtttcgagagctcgattctaacaatgacgggtaatacttgaaacagaagaaaatagcaccactttgtgtagtgaatatttgcaagataacccttttttactccacctttccccttttcagctatttgacagtggaagaagcacgtccagtaatccagagcctcatctcgggagagttttcatatgctaaatcacatgcaaagcttttgatgaaggtgactaactaaccataccaaatataactagtaagcaattttcactatttaattgataaccactataaactacctttttttttggcaaatatgataatgacataggctgatgataacaaggacaacaagttgtcactagaagagatgctgaaccactacctatctttctacaatattgtttacatggatgatcactatgactacgatgacattggcaacaatatccacgatgagcttaggtgacaaatttagccaagacggtatatataaactgttccctatgacaaacaaattatcatgataaaagctgtaaattatgacaaacaatatgaacgtgtacatatgggtaactacacgcgtaagtaatctgacatttgtgcgtttatactttccaatggaatatataacatgt

SEQ ID NO: 67636 - DNA, 3703 bp, Oryza sativa
  unsure (1)..(3703): unsure at all n locations
tccaggatacagtcacattatacgtcttaacaactgagattgcatttttcagtttgcaacagaaggctcatcctgccagcgtactggtctgatcgcacggccataagcaaatttcaagttccagccccaattatgtaagcaaatttgaagcgaacaatattcagacattcagacaagatataaccttcttcactatcattgtattagcaaagtatagtaggagtacatacgttagatcaggccaggggtactagtcacgctatagaccagactttcagcatcagagtgcactaccaaaatggtgaaattacccactagccagcaacaaagaacataatgacaaggcttctacttaatttctccattctgacttaattctacttgcaagaagaagaaaagtcaaggcccttgagttagtctatggagttcactctgttcatccagtgtctccactaggagagggggagcgtactgcgcgttcccttggtgctcttctgaatcttgacagaaggagaggattatggtgtcgatcgacatctcgacgacttggaagaaaagcttggcgactataaaaccaagtgcccatgatacctgcagtgtagcagcatcagaatatatacagacacctttaggtcttagcaatggaaatggcatttgtcagtttgcgagccgcaatgacagaacgatgaaatgcttaccactacaggaacaagaggagatgatatcttgttatgtgcagacttgtacttgtgagtgtctaacataaggaaggcaaagagcgcacagaacaagctcacacagagcttccccagaaagaggatgacgtctccaatgacgttaacttttccaatgcgcagtatgttattcatgatcaaaccagttgcgagaacagaagctttgaagaaccctttcccagtaatggctatctgcaacaccaaaagaagggtataagcctaatgaattcaatacaagcatcaacttggatagtgtatgttttccagatgattttgcatccacaccanaacaaagcaggggagacaattggtttcaggcatggagcaattgctccatgaacaagaatttttgtatgcttaccattatataggcatttcgattcacagacttgagggtccagtctatgcagcccaggcagcattgagaagaggatgatgtcattttaccaaagcagctttcacgagcggaatcaaatagcttcaacttgcgtctgaggcattctagtataaaccgcacccactcaacagcagatacaacaagtgaacctatagcaactgaaccaaggctgtaacgcaacaaccgcttcaatgaagaaacaactgtaacaaatggtatgtcatgctgcataggaatagctcaaatagtcagtggaaaggagaagtaaactaactgctaaatatagagtaaattttttaagtgcctcaattcacttacggatatttcaccacgtgcccaatagtatgaagcaactgatccagcaatcacggttgaagagcacgcaataaagaattgggttgcccagtaacagccaaataagtggaaaagaatggcaataccaatatgaggggtgtaatggatgctgtacccacagcagttgtcacagtttactttgcccaacttcagatcatatgagcaacaatctgtattgcagtcatttcggagaacttgaccagagctgaagagatggagtgtggcagaaaaccagaacatataaaagatagcgaagataaagtatggcacaactgggaaaataattagtgcctgaacttcaccaatgaccttcgcagcaacctgaagataacaattatcatggttagtgcttaggaactatatattaactatactcttgccatcaaagaggaggaatggcattgatgctgcatgtcttcaaaaccaagcttctgcttatatagtgttttttttttgcgaggtgcttatatagtgtagctaatcaagcttgtatccaatgattcgcgtaccttcaggacaggtgttgctatcagtatacgccggataatagctatggaggacagaaatgcaatgatcattacaactgtcatcaccaccgtagcagcatgaaggtggcttatttcctagtaaaagaatgaataatcagacaacagggctggatattgtaaaaaagttgacaaaagttgatatacttacccgtccagttatatgcacatatggatcactttcaccaattacaactgtcaagggatcattgcctaaccagccagctgaattaaaatgtagccaattagaatcgtatgtgtgcaacatgtgaaatggcatacaatggaatttcccttgccatattttggaattatgatttgaaaaattgaaccatacctttaatataaaaaaacatagtaacggagattactagagcattgaagagcactacagttatccatggcatggcagcaacaaaataacgaatcagaagcaaccagataactgacaagaaaagagggagcagtccaccgcaaacaattaacacaggccatgacttcccaatgtcagcaacgtatctctgcagacaaaggaaatggtaattaatatcttcaaagacaaaatgggactccagtgctatatgaatgatattgcatcaggaatttctcagaataattcaaaatgcatatccattttagttgcaagaaagtaatatgcttctttcagagcaacggtgcaacaaaattcttttgtaaggataaaaagtattgctgtggtgtaatgtacggtcagtgttagctataggaatagctgggccacttttcacttccaacgtaaatcagaaatgtttgcgacagcaaaaaggaatgtgcaggtaataaaacagtgccaggaagtttacaaaccttcaagactgaagatttagaattgatggccttgtgtattgttttatctatgagaatattttcgtcgatgttgataccacccatctgctgccaatgcttcaaagagacattggatgctcgcgcaataaattggcagctccagtagactgaagggaacaaagattttggatcagctatctcatcgttttaacttattgcatgaagaagtaaagcccttaatttaatccatgctcacatggaagtagtacagactgagcaaagattaccattcacacttggaaatatgacagggtagcatggaccctgcagctgaagagaactatttctcatatctggtgcgagaaactcaaaataatcatagtccctgttgatccaatcatcgatagagaggcgaatgtccccttctggataatcacaaacaaagtttaatccgtctgctgctggaatggggcactccatcaggcagatggctttggcatcagcaaggttaatcttgttgtccttgaccccactttggtacacctggtttgggttcatccaatatctaacatcaagctcatgcaaatccgggtcaccatgcctactgccacaaatgttccctttgtagtctagttcataggtaagcctgcgtcatcaaaacaagataagacatcagtattactaaatagtagtttggttactcatcatagcgtctgaataatagtaaaatgatagccatgtaaaagtcgcacagcactgagttttatccctaaacaaatttcctttggtcagcactcagtagtgagttttggtttctataatatataaccggaatgtgaatttctttt

SEQ ID NO: 67637 - DNA, 8270 bp, Oryza sativa
tcaccggcttacggcttccgcctccctcgcctcttttgccgccctcacttcctccgacgcctcagcctaccgatagcgcgggcttggcgacgtggtgagtatacccctacatctctcggtagtcggtactgaaatcccaagctattactatttgctagtgagaaggtttgatatgaatctctcgattccacttttatctgttgacacactgtatcatgctactcggtcagcctgcgcaacgacaagcactgcagcatcgagaactccatgaagaacaactgttccatctgttatgaggtgtgttcttctaccagaacataacagtgatgctaccttctgtacctactgttcattaaaaatccagtctcttatgtatgaaactgtgatcatcgatcacaaatgcagtgctcatccatcacataagaggtaacgtcctgtccttccatttactcccatgcagatcagttactgatctttgattgctctattcgaatggtgtagttgaatgtaaaaactgaattctgtagtcgggttttgtatgactgattagatgaatgcttgttcttttacggaactatcaatttagcattggttagtaatgtactgatcagctgttttctcttcgggaaaaagaccttgaaaaacgaaaataattcgttcaggctgttagtagtaggttcagtacatatatttggataatgcatgacagaaatcttgaggctttaaaagaactacaatagtacaatgcataaaggaggaggcaacaactgtgcatgtttgtatgctaccagaaaatactagtatcctacaactcacaactgaattgtgaactagtatattgaaaaatttatagtaattccattacagctaacaaatgtgttctgttgagtaccctgatgaagtccactccctcgtgttgctggcaagcctcacagcattgttgcctcttatttggcatccatttcctgcaccgtgcatgttgtttggagttgagtttactcatgttattattgaaactagctgggtggcccgcgcaattgcgcggctagcacccaaacaaaatcgtatattttttagtataattttacttaaaatttattaaatagctatctcgttgtcttaagactttgaaagactaaactaaatagctatcatccccgtatttctaattatatagtttttaaaagtcacaccagctgctactccttacttctgtcatatccttttttatttgcttgctcgatctaccgctatttctattcattctccttgaaacctttaaaaattagatcttatagtttttagagtttattgtctcgttgggtttcgtttttataatttctagaagttccgtcaaacactgccattatacttctctacagcccgtgcactgtcttttctctttattatcattgggattttcaaaatcgaacatagctatcgttcgggttcaattttttactttctagaagtcccaccaaaccattagcggctttgccactgtactccttaatggctcacccgttgcctcccttctttattgtcattgggttttttttttactttttagaagttccgaacctttaaaaattgaaccttgtagattttagagtttattgtcttgttaggttttattttttataatttttagaagtccagtcaaacgatgccactatactcctctacgacccatctgtcgcctactctttattgtcattgggattctaaaaatcgagcataactatcgttggaattcattttttattttctagaagtcccgccaaccgtcggcggctctgcaactctactcctatgcaccccgcccgctgcttctcctttttattgacattgagattttaaaaatcgaatatgattatcaatggggtttattttttttgtcccggcaaccgccttgcctgtttgcttcacggcttgcctgtcgtccctccttttaatcgtcattaggattctatttggtgttttattaacagtttttatatgtcgtattaaccgtccaccaatgtactcctttataggcatgttacttaatttatctcttcaggtgttttagacggtcttttctttcaatagtttttattttatatcatcatttttagttatttacaaattgtattcctaattgaaatctttttttctttttataatttcagaatttatattttttttcaaatttttatttaatttatctcgtcatgtgttttagacggtcttttctttcaatagtctttctttttatcaccaattttagttatttacaaattttattcctaattgaaatcttttttatttttctaatttcagaatttattttttttcaaattttaattaatatcatatagtgtaattttaatattttttttttgaatttaagttgtttcaaaattatattcctatttgaactctcttttagtttttataatttttgatattattttatttttattctgaattttaattaatctcgtattgggtttttatatggatttttcttccaatattgcttatttttaattctgaatttcggttaattttaaattgtatttctactcttcttttctttttgctaatttcagattttatttttatttttattacgaatattaattaatctcgtgtttggttcttatatggactattctctcaatatttcttattttcaattccgaatttcagttatttttaaattgtattcctacttggactctccttttcttttctaattttggattttattttatttttattctgaattttgattaatctcgtattgggttcttatatggactattcttttaatattgcttatttttaattccgaatttcagctatttttaaattgtatttctacttggacttttcttttctttttctttgattaatgtgagaatttctagcccccacaacgaacgtggtgcctcctttcaaggctgttttaataatataatagattggatacaggatgatatcctataactccgatgcctctgcaacacatctccggatcaactttcgggtaaacagctactaatttatctgtggcctgactaacattagttgctcataatattttctatcttatcttacaattagtgctgtgaagcactcctatttgtttagtttcttgagggaggctcgaagctgtttctgatcttatcagagactagagaagaaaggagaataaccagatgccaatgcgaggctcaaggagtattttaaaagtcatgtttttatgtgacctcaactgtgcttacatgtttattggtccaatgcctctctgacttctttgatgttggctcgaaactgggataaggttgtaattttgcacataggaaaacctaggaccttgaattgtatagttttagaaatcaagtttttatctgatctcaactatgcttacatgttctggtgcccttgtgacgtcatgttcggtgaatgagtgcaagtgctatctatactgttgctctgtgtgcatgtgtaaatgtcaatggttccacaaaacagttgatcagtaaaaaagcagctctttctgagattggacgatgtcaccccaatcacctatcggtagtgtactacacacggtccaattttgaacaggataatggtaatgttttgagtgttgctaacgccagatggtttttagaaaaaagtctagaagattttcgttcacgaaaataccatcaaggagtcacaccaaaataccagaaggatttaccatgtgagaaatttaccaaacaaattgcctgcagacattagcgaagcagagcgttgcgacagtgatgaacgctggctgagatctaccggaatagggcaacaacggcaatagtgctaaagtcagcgaaggatcgatgcgatacaagattgaaacgtaataaaaatcacgaatattttcctaataccaagtttacccctaatcgtagtactaacaaagtactaatatgcccttggaaatcaacggtttggattatttctagttgtagtatatactacaagtagaaagcaccggagcgtcgcccataggagtaaccactaaaggcacattttctccctgcaaagcaaaagtgggcttctttacctatcctgttgggaggttgacacaaagcaagaaaagattattcgattcacagtacacataacaaagccgggagctagaagtttcattccgaaataagcaagatctgttactaaagtctttaatgacctcaagaatgttccatactagcaactggcaccctcattttctctctctatgtcagttcaattagactgaaagtctgaaagtaacacgtcaaggtgaagaagaatgagccaacaagaatgtgaaggtatgcactaaacacctgaaatagctccgttcttggtaattattgctgtctaaagaacagctcaaaatgtacagcggcactaatcaccacccagcaaaggaaaagctccccggatgaacgctcttagcatctagctacaggaaaccgaaatcaagcagcaccgacagcacagatcggcgaatcttgaggagaggaggggtaaaggcgggtcacctcacctgagtggattgccctggttgaatccgaagctagagttgacgatcatggcgacccagaaggccgcgaagagcaccaggaaggccaaatcccggcaccgccggttgtgccgaatgatgccgcctccatctccgccgccgccgccacctcccagctcatcctccccgccgccgcccgccgccgccgggtgcctgcctatgatggcgccgagcggccctcccattccgccgccgctcgcttcgatccgatgctgtggtaggtcgcgcttgagcgagacagcgagcgatctgtagcttgggagcagaagtgagcgagctcaagctggcggggctggtcgagtgatgggcttgtcagggtgagcagctagctttttgttttttttggctttttgctgatgcggctgcgtgaaaaggagatcaggaaccttttccaagtttaccttttccaaaatttctataaaggcatcacgttgaatcttttgacacatacatgaagtattaaatataaataaaaagaaaaactaattgtacagttagaagagaaataacaagacgaatcttttgaacctaattagtctataattagccataagtgctatagtaacccacatatgctaaaaagatgatggatgaaacgatttggtgaaaactgattcattagagagacgctccggtgccctctacttgcagtattctactccaagtagaattaatctcgaccgtttattttaaagggtaaattagtaaagtgctaaaaccgaataggggtaaatctggcacttaatttttttctcatttgtgcgtcctatggtcaagcgtcgctcgatccctctccatcgaacagcagagtcgctctccatcaaaaaggagagcgcagggaaagaaaaagaaaagcagatcgcgaggtccggccaccgccggcgcttgtgcatcgcgttccatagatgtttcttgctgtaggtatttggtttccattcagcttgattgtttcatgtaaaatttaaatatattagttatatatctgaatattacacacgatggacaaatcgaaacactccaatccagcaatgacagatacaaggcaacggaagaataatccggtatgtttttttacgtagactttacaattgcaattacaacaagtaatatacattgaaccacgtacaaaaacgatgatatacacagataggcactttcaaaaccacaagctgttaataagctatagttttgaaaaaaaaaacatggccatcagtaacaagccaaagccacccaaagccatcttgagataatgaattcataggaattacaggacatagcacaccaggaatctctcaagcgttcattgacgtagtgatcattagcttgtccaccttgtcatgctcagccattctgaacaagctcacttgctccggattcagtttactggcattcaacttgaatcccttcttctaggaggaaaaattatgaccaagaactacagaacttgagtagacaagcagaaaaactattcgagaactagaggccaacgaaaaagaagattcagtgcagatgttcgagctgcaaacctacaagcagcaagaaaaacaaatcaaatctgacctgcaaagcagaaaaagagtcttctcatgtcagctaatccgttggagagcagcgctatagccagcgagaggagtcttggatgatgattcggaggtcgagagattggtggtcattggctccggaggttgcgggttccgcttgggaggcgatggattgggggctcgccctcgcggctgtgggatcaacggcgggtggagatggacagggctggagccgagcgtgggggaggaggccgacgacgaggaaggggatagcgaggtggacgaggtctcggcggcggccagtggcacggtgctgggtcggaggcggagatccgggaggcgaactcgtcggaaggtgggccgacgcgggggagcggcagagagggcgcagctctggcgatcccagacggagatgcgagctcgtcgagggcggctgaggcagccagtgcgacggaggcgagggagtaggaggcgtcgagggcggtggagcaggcgaggtcgtcaaggtggtgatgggagccgcggggttctctccgcatcggctccagatgcgcgattccggaaggacgaaaatatccctccgcagataatttttcctggataaaagtacccctccacgattctactaccactaagtgtggtggtagtagaaatagatctgaaccattggatcaaataagatcaacggttcagatttttttctactctaggtagaaggcaccggagtgagactcgattcattaaccatggtcaatagagtaaactaagagcgagatctactaatctaaagctgacggttaaactagcttttgattgggccacgtggcacccataagttatcaaattaatcctagatttcatcaaagaaaaaaaaaatcaaaagatagaaaatggcataagttttctatgacaattctaaaagcaagcagtaccttaatctagttcttaaaaaaaatagtaacttaacatcacaacatgtataacattagaacattccgatcaggtgggatcaaaaggaggatgtagcccatatatgctggtccacttaaaacttacatatagagacatttacttaaagaccctaatttttttatttgggagagtgatccagttgtagaaatcgcttaggatttattgccaatttacaacatatattgttgagaattatacatttccatgttattttttcaaataggaatatcgcaaatattccattccacacatcttttagaattaatcattaaaaattaaactaattttgtatataaccccatacatttaacctccctagcttttagtatttgaatttcacgtacattggtccatccatgtgaacaaattgacttatcttacaccacttactttaacttgattttgtggaatatgtctaactaaatgatttccagttgatacaattgccatgtgttccagaaataaatttcattccaataatttcatttctttttttatcagcctatttgcttctgcttgtatagagtaaggtattcaatctctcaagaaaaagaaggaataaaaatggtcaatttatatatatcgaacaaaaccaacaataccaccgcatgctatattaattggagcgctgaccgacgaacctattttctagttaacaatatggctggatttggttacctgctcaaagccgatgggttgtccattctggtcaaatgaatcaaccaatcctgtgggtgtatttcgtggatcatactaataagacattttgctcatgttgctaatatgactatagtgtgtacttcaatcattatggcatcttctcgaccttggactatcacgtagatggttaccaaagaatgcctctccttcatggtaaccttcatgaggaggtatacatgcaatcgccttttaggcgtggaacatttacttttgttttctctagttctatgtgccctagactagccggtttggtcagcgtcaatgcatcacgtcaatcgaagcactgagtaagttgttttgtactggttttaatacttaggggacgcgagatataaccggttttgcggttgagatatacgggttagattcagctgatagttgagggagtcaaaaaggactttctgttcatgtaaaataaaaaaaggccggatcgggtaaac

SEQ ID NO: 67638 - DNA, 1065 bp, Oryza sativa
tttcttagatgttctacaatataacgcatgcatgcaagcatgcaattaactatgacatcttctccattaaattattattatttttaaatcctctactctcatgttatctaatcctattggatgcatgggttatatttattaggatgattcaaactacaagatgataataattattttttagtatttgggttaagggtggttgtgtcttatattttggaatggagggagtatatagttgagaattatatatttttcatattattcttttcaaataggaatatcgcaaatattccatttcatacatattttagaattaatcattaaaaattaaactattttttatataatcccatacatttaatctccctagctcttaactatatgaatttcacatacattggtccatccacatgaacaatggacttatcttacaccataaaaaaaggaaaaaggaaccttcatgagatatacatgcaagatgcaaccgcctcttaggtgtggaagttccaattttttttctctagttctaggtgccctagattagccggtttgatcagggtcaatacgctacattagttgaaacagtcgagtgaattgttttgcacggttttaatacttaggagacgcgagatataacccggttttacggttgagatatatgggttagactcggccaatagtcgagggagtaaaaaattgacttgttttatgtaaaacaaaaaaaggggccggatcggataaacgggttgtgcttatggttaggcctggccatatttggttccttcatcctcgctatcttttattgggattgctatatgtcattcgactgaaatatggggatgaaatcttacagattttggaccattggatccatgccaagatttgtgctccaccttctcccctccaactccggcgctggcgacacccgggttagggtttagggttggggtgagggtaggaggaggggttgggggagggggaagaggggggcttagagggatggccgtgggtggcggaggaccggcggtgggcggcgaggcggcgggggctaagcaagagtgcggt

SEQ ID NO: 67639 - DNA, 2119 bp, Oryza sativa
accttaaagcagtagcaaacacactgtatggtactaccttggaagatacttcaagcacggtgggatttttccaacaagaaagttgtatgagaaatctccaacatttaatcgaggagaagggcatagcccattgtgagccgtggatctggtggagtaaaataaaatcgattcagataattaacaaaaagataataaaacatggtcaaatataagttttttgcaggctcactgccagatgtcatcaagagagaatataataaagaagctgcatgcacaaagttactaaggctcccatcggatggcctaataagccaaagaaaaagccaaattttaaattttcaaacttaattttgagattgattttgagttattttcaacgtagttttttttttcagcattggcttttaagtcaccaagaacacacatataaaagttttacctacaaatttaattttattccgttttggcttattagggaaaaagccaaacgatggggccttaagtaaccaccacttgatacctagtcttatcctttttactgtcaccaaatttactgccaaattaactagtatgtaagaacgaatgttttttaagagggacacacaaatacaatcgccatgatatcatagctgcggtgttcagttcatgaataaaatggtttgactatggcatggatatccagaaatatagacatagaatacaagagcacaggaacctgaagggaattaagtgacatttttatggtttaatatatatagaaaatgcatctacagtcttgatcatcaaataaaaatggagtaaggagaagtcaccaacccactattggccgtaggagaaaaaccagaaccattgcttccaggaattgatcctttcagtctatttctgtccaacctcagctgaacaagattctgtagcttgcccagctctgaaggtatattcccagtcaacccattggaatgaaagtttctacagcagatgaatgaaagcagccttagtttcaatagcaaagaagcaccagagacaggaaaaccctgaatatataagcaaatcaattggcatcttacattacgcttacgctgctcaatccagccagctcaggaggtataggaccagtaagcctattaacacccaaatccaagaccctaaggttcctcagtgaacctagctgtttcggaattgtcccaaaaagcatgttgcgatccaaatacctgcccaaaaaggagaccttcagaaaccttgaagctaattcatcataaccagttgaaaaaacaataaaacagaacatacagctcttgcaagaagctcagctgtccaagttcaggcgcgataaatcccttcagcgacgagtttgacagcttcctgcaaggtgcggaatcatcgagtcatgacacatgagaagaaattccatcccagaaggattttgactgatcacgcaagtacgggttttagttggcgtttcattgcaaacaaaatctactgactacatatctaaatggcacatcatactccattatttccagctgtttgcacatgcaatatgcgtctatgtcaaacatatacagcattgtacagctccaacgataagctagtggcagtgcttatagtatcaaacaagtcttcacctacaaaattgtagtacctgctaatgtaaacattaataaatcaccataacaaactcttttccctccccactttatgtacacagtaatgttgaacaggatttgatattaccggctagtaagtaccacagtagtaactagtaaagcagtaggtgaaacattagtgagatctagctgagtgcaggtgcaaggggggggggggggtttcttacagggagatcacggagccctgcggcgaggagcagatcaccccgtgccagtcgcaggcgttcccgtccgcatcgctccagtccgcgagcgccgaccgggggtcctcgatgattgcgcgcttgaacgcgatgagcgccgagactagcacaaggcgtagcaaagcgcgtgtgagcagaacgccacatttctcatggaggaacagaacgagagtgtacgagacacagcaaaaccgttggtcacagatcagaaatgcaccatagaaatggaggtggaattcgagttttaggcac

SEQ ID NO: 67640 - DNA, 2449 bp, Oryza sativa
ggcgcaaccgcgcaagcgacaacactcaccgtcactgcccaacgcattcgccgagcagtgcaacaccaccaccaccaccccgcagtgcaacgcgaggaggagccggaggacggaggaagcaccgccccaacaatgcctcatctccgaacgccgccgcagctgcagcaccgcctccgaatcactcactcgagcactacactcccccctctctcagagatcgcacgtcctcgcgcgaattcacggcgccatggctaccgctccgattcctcgctgctgctccggcctcagcaccacatggagatggagatggaggtgggttggttgtttggggagtgtgagcagttgagtaaaagagagagccgagcactggaagaagaagaagaagatgcagagagagagagagagagagagagagagagggagacgagggcgtagagagagaaagaggaggaagcgaggagaatgttgggctaatttagtgcgagcaattaaaatggcaagggtggggggaggcggtggccgattagttatcacgcgcactattaatttgtcaattaagtaccactcaattaattaacaaattacccccaccacttactgagtattagcattagtgttagagattaagcatctcaaaagaaaatttaggggttagggagcatcttccttttattttaagactagccactggttatagaatgtcattagcagcatttttttgatctgctcttgtgctgtttgcagtgtctcttaactctctttgcctatatattttttaacttctttaggagaagcttattttggggttcttcagaaatgggtgtggtgtttctgaccgttcaacgctgtgtcctccctttgttttttcatgtggtccctccattttctctgcgttcttggattctctcttaattacagtgcggtgacttagcaagatataataaaaaaggtcatgttatttttacagcatatggtgtgataactaggctacaacagatttaatattgggtaacacaaaaacaataccgttagctgaaatactgttaagaacttaagatggtttatattgctagaatgctgctgctacatggtacatcttggacgtgtgtttaagtcatgctctttttagtttattcactaaattactaaacatagtatttactctacgctttgaaaattcattttcttaaaaaaacttagataacttattttaattttttttacaaaaaataatttatcgctataatagaacatataatccgctgtaataataccgagccttagattttttgtaaacagaggaaggataaggatgagacgtagctgctgcagtaatagcggtggagggagtgaagacagctcggcagtttcagtaattagtttgtcttgactcttgtcctcttgcacttggacttatatactccatgttcttcatgtctcttcttctaattcgaatgcatggtcgtgttgcagaaaagaaaaatctcagttcagaaattattggttgacaatggcatcgatcagccgctgaaagagaattggaaacaaattaagtaacagtggcttttttttttgtttggtagtcacctgcaaatttgggtccaggttgttgcctactatcacaccatggtcctgctgcttgcatggcagccatggttaatctcatgagacaccacaatttttggtaggatcgatcgaatccaattccaattctgcatatatggtttgcaaatcaagggacccactcttaacgttaatctcaacgtatcagaaatgggtgaaacgaaaggagccttacagctaataatgttcacgtgcaattcaagattcagacagcttccaaagaagagaaaagattcaggctgtgtttagatctaaaatttagatccaaacttcagttcttttccatcacatcaacctgtcatatacacacaacttttcagtcacatcatcttcaatttcaaccaaaatctaaactttgcgctgaactaaacacagcctcagtcacactcttgattataacatcgtagttcagacagttcagtttgttgtagcacactgcacacgcaaccctcttcagaggccataacgtagcaaagctgtaactgcagaaatgagatagtagtaagatgcactgaatattcagagtgagcatatcatattatcatatcatcctttctgccagccaagatcgtgtaaaaataggagctgagattgcaaatcctttttgccacttggtggcttgggagtccagcaacaggcaacagatcaaggagagaagaaaaacatcgcattcagcaaggccaagaagcgtacacgacatgcatggtacgaggagagcaaacagacacctcaattttatgaagatgtgtctacagacggggctgcatcgcatggcaatcgaacgtgacagcatgagagaaaggacactgtcaaaaccactatgttt

SEQ ID NO: 67641 - DNA, 1324 bp, Oryza sativa
gaacctcgccgttgaatgtagccccggcgccgtcgttcgccatgctcagcgtgtacgacgcgacgtacgccacgcgctcccttagcttccgcttcggcgcgcggcgcgcgcgctgccgctcctccgggcgtccctcgccgcagcgcgcgtgcccgaccgccacgcaccgtacgtggcaccctctccgtccccgacgtcttccgcgctagctcccgtgcagacgtgcagtggcagataaaaaaaaaacagagatgtctaaacaaactagataaaactacaatcctctctctcatccatctatagtaaaaaaaaatttagcaggggcttcatggactcttgtggtcttcacgctagtagtggagtcagggctcgacaccccaccgctccaatattggatatgcacttgctcctaggcacctcgagtagtgtcgtcgctgcaacctggggcgaggcactgccctcaagtagagatggcaacgggtgcatatccatcgggttcccctgccccatacccacacccacgatgtcaaaatattcccacttaaatacccacacccgtcgcgggtacaaaatgtccccatacccacatccatacaggtaacgggtacccatacccatataattgatttgtagcatttatagttttgtattctaattagccatattagagttgtaaaccattaatattttccctagcaacaatgctattaatattagtgttcaaaggcgagtaaaaaaaattatacaaccacattacataatcaagaaatcaaataataatttcatataactagtctataacaatacttaagatgtgaaaggagttttatgctatgatttagtagtcgttgagacttatattgctaatagttttaggcttaatcaacgaatttttttacccatgggttggtgggtacgggtgggtaaagaacatacccatacccacgtactcaataggtaagagttttcgcccgttagtagacccatgggtataagagttaaaatacgattagcttctagtagaataaaaacctgtcgggtcttgggttatgggtccccattgccatctctaccctcaagtctgcccgcttctctccatgtcacggcgccaccatgtggaccgaccagccgaggctgttggggaggtcgcctgcacgctgcccaaccttacctaccgaattgcacccacctcttactaggacactcctctcatttcatctagctctctaccgttgcaatgtacgaatattttttctagtttatactaagttataaaaatgagggatagattgttaccgagggacgcaatctaaaactcgagcct

SEQ ID NO: 67642 - DNA, 728 bp, Oryza sativa
gtaccttttatgaggagttgagtgaagcttccaacatattgcataactgctcatctcggtcactagttatcatcgatgagcttggtcgtggtacaagcacacatgatggtgttgctatagcttatgctacattacactatcttctgaaagagaagaaatgcatggtaatttttgtcactcattatccaaagattcttaatattctgagagaatttgaaggttctgtcggtgcataccatgtctcatatctagcaacacggaaactgttggaagtagctgatagacagatggtgattaacaacacagagacaaaggatcttggtgaaatcactttcttatataaacttgttgctggagcttcagacagaagcttcggtcttaatgttgcgctgcttgcacaggttagttttaagttgtcatgtctttttgtttctatatttctagtttggtccaaatttgattagttattaagacatgtgcttaataccatgacttgcaagtgaccacctttcttcccttgtactctagactgattgtagaataacgacatacattcttcagtttgcttgttgctgtctatatagggaataggttctagttttgggttcattgttttagtacaggaaataagtcctctgttttcttcaatgacgatgcatgttgtggttaatttttgaagtacccttcctcctttgcaagctgagttacagtttgaagtgaaacagtgc

SEQ ID NO: 67643 - DNA, 7320 bp, Oryza sativa
tttgcacgtgatgcagcaaaagcctgttacatggccgtgacatcaggaaatgaaaaaaaagatattcttagtaaggctgcttctttttatctgttcttttgttcagagttctatattggcatcttcatgctgaagttttgatttatttggcagcatcacttgaagagaggttattggattttgatgtcaaagttagaatgcaagctggttttgcatcctgcaatttagggccaaatcaaatctaagatcagttccttctgagctgatattgcaggcagcagagaagccacaaactgttgttatttctcgctactgcaggttctatacagtgcctcacttaaacttttgttttatgtatctctgactgtcagaaagaatctaatgcttatattgctggacctataccgagattactgtaagaaatgctcaaaaggaactgccacgttaacactcactatgaacaaatccctgctaaacttataggtctttgtttcgataaggattgaatcttaaggtttcttctttctaattttgtacattgattatgccatcaattcaactcatgatttctgacctcttctttatggcagggtacaaaacctaagccgttgcggtcaactaactcccgcatcggggaagaagatggcgagggagtgaatgggggagaagaagggcctacccgggaagctccgccaaccaccgactacccgatctgccaccaacggccaccgccggtcctgctactcggccacaccgagcattgccgtgtcgatccccacctctgccgcctcgatccgccattgccacgttgatccccacctccgcccgccttcttagcggtgtcgccgaagagagagagaggggagaggtggcgtcgccggagaaagggaaggtggcgtcaccggagaaagggaaggggaggcggaggaagacggggaggagggacggggtgagcctttatatatgtttgtgatttttggggggcgtactacaaatattggacttatatatgaatagaaaatctgaggatttaaatggaaaatgtaatcgactgacaggtgctgaaatgcaaaaataagatagagctgtggcttatgtaacaagtgtgatttcatcccacttggcatctcctttttcatgagggtatagcttccatcggccatggtcttagtttactttgttcctcaacctttttgacaaaaatagaagaaatattgtcaaacgtgtggtttctttttacagacttaataggaacaggttccaagttccgagcttggatactctagtaacattatattgccgattctctagtaacaatgtattacacctgtgttgatgtcaagtgtcttttctttctcccttttctaggaatgccattcaaatgacaatgagctctaaacaattttagaaaaaaaaatcacaaacaagcaaaaatagtgatctcactcactgtgaagaagcagatctggactggggtgaagtgcagtttgctccatgaagcaaacagactgtgggtgatatgatcatgttccctaggctgcggtagctcgatcgaccagctagcatatgaatgaatcctaagcaagcagatagcagagagacaggtagtctggattgggtgtgtggaatgagaatatatgtatatcaggggaaagagaaggatcctcctagctgtgagttggcttgtgcagaaggaggcttgattgcaatccagagcaaggagatggtgatggcgacgaggccagaccagacgtagacgatggtgggtgtccttcccctcctgcccatgaggcccttggcgaaggggtagagatgcgcgaggacccagaagctgaagaagactccaccgagaagcttgctccactgcgggatggtgctgtagatggtgcggctgaagccgacggcgatggcgacgaggttgatcattatgatggtgagcggcggtatcatgagggacgtccacttgaccgcgtagagctcggcgaactcgtcgtcgacgtcgtcgccgagctgcttggaggtgagggtgaaggagatctcgatgccggcgatgaccttgagaaggccctgcaggacggcggcgaggtgggcgctggttccgccgatgagccagaactgctcgttccgccaccactcctccagcgcgatgccggaccacttgatctccagcatggccaggaggcagagcgtgatggtgatgatgagcaggtaggtgaggaaggtgacgttgagcgtctgcacgatgaactgccccgagaagagggagagcgccgggaggaagcagtagacgatgaggaagacggaggtgaaggggtagatgccaacgttgaggtaagcgatgcgctggagaacctgcaaatgcaatggataattgtttgtttggcggcagcggaagaagaagaagaagaaaaataatcgatcgaatagcaagctaggtaccttcatctttgaggaagcgaagagtgcgttgttgcgtgagaagaagatctcgacggagccagtggcccatcggaggacctggtggaggcggtcggtgaggttgatgggggcggtgccgcggaaggcgtcgcggtgggtgacgcagtagacggacttccacccccggttgtgcatgcggtagccggtgaccacgtcctccgtcaccgacccgtatatccaacccaccctcgtcccccactccgtcttctcctcgtaccagcacgacaccacgctgatcgcctccgccacgatcgacgcgtccagcgtctcccgcgggatcgtcagcgcccccggcggccgcccgttcttcaccgacgggtggtccgccagcggccgtccctggaactccgccaccgggatggagtcgatcaggaagctcgagttgccgaacttcttggggaagctcgccatgttcatcgcgccgtccatgtccatgcggagggccatcgtctcctcctcctcctcctggggctggggctgggatcttgttcggcggcgacgtggcaggcagcaggaccacggggtggtgtggtccttggacctgggcgggtcgaagccgtagagcgcgatgcggcggaagaggcagccagttccgacatagacggggccctggaggccatcgagggcgcgcatgttgacgtcgaagaagacggtgttgtggttggcgtagcggtcggaggggtcgatgccctcgaagcgctgcgggaactggacgtagcagaggcggtcgccgccgcggtccatcatgaagcacatcccctcccggaacgccttggagttgtacacgtagtggtcgcagtccaggttgaggatgaacggcccgttggacatgatcgccgacgcccgcaccagcgcgttcatggcgcccgccttcttgttgtggtcgtaccccggccgcttctcccgcgacacgtacaccagcatcggcagccgggtgtccacgcccgacaaatccaccctcttttccatgtcgccgccgctgctgctgggactgggactgggaggctttagcatcacctgtatgatccccgcgtggtcgcccctcgcgtgctccggcgacgcctgcagccacgtccccggccagtgcgtgccgtccgccatccacgtcgccttggggatctttatcggctccagctgctgctcgtcgccgccggccttcatcttctcccgctgcaggttcatggcctggatctcctcgcgggcgtggtacgcgtcggagcggcggcggatggcgtcggggaggccattgacgcggaccttgaactcgtcgtactcccgcttcacccgccgcctgtccttgacgaagtcgcccttcaccttgttcttgaacgggtccctcttgaggttgaagtagctgtcggggttcctcggctcgatctcgtgcttccggcagaatggcacccacaggttggcgaagctcgccgcctccgccatggcctcgaacgtcagcagcgccccgccgtcgtcggacacgtagcacgccaacttgtcgacggggtagtcggcggccaggatggagaggatggtgttggccgtcaccagcacgggctccttctccgggtcggcggtggagacgaagatgtcgatcccggggaggtcggacttgccggtggggttgctcggcgtgggcgtctcgaacttgtccttgagcacgctcaggtcggtggcgcggttgatggggcacagcttgggcagctggtccagcacccacgacaaggcgaaccacagctcgcacacgatggacatcccccacagccagatggcgtcctcgttctggtgcttgatgcgccacatcaggaacaaccccagcgccaccagccggatcaggaccagcagcctgtacgggctgatcaccgccgcctggatccggagcttgcgggtcagcggccgccatggcttgctcatcagctccttggggtgccccgccacgccgtcgtcctcgggccagattgcgttgccgtagccgtaggtgcccttggtctcgaagagccagcggttgtggtcgaactcgccgggcgcccccccgttctgcttcaccagcgacagccgcctctccatcttggggccatgcccgtgcccgtgcggcagcgacagcgccctgttgatggcgtcgtggttggacgccgacaccacctcctcccactccgcgtgcttgtacggctccttgcaccccgggcacacgccgccgccgcccttgacggcgtcggtgaagcagtccacgcagatcttgaagtcgcactcgcaggggaggatgtcggcgccgcgcccgttgcgcatgatcttggacccgcacccctgcaccatgcacgccgacaccgtcgccctcgccgacgacgcctgcttctccatcacgtgcgcgcgtgtcacgctgttgaacccgccggtgaagagcgagctggacacgtactgctgctcgtcgccggcggcagggtccatgggctggttgtccggcgtcatggggatgtggacgtggtagtcctggaagtccacgctgctgatctccgagtcaaggtcgtcgcgggagtagctgatgaatcgccccgagtccgtccgccgaccgaacaccaccgtgggcgccgccgacgatggcgccgtcggcggcttaccgccgttcttgaggatgcccttcgacgccatgatcgaacacctagctcccctgctctgctatgtttctctcttctcttgtgttggtatggtattggtaacaacaacaagaagagagtatagctagctagcttgtctcgccgccgatcaacgtgatgcagctagctagctagaaaatatgaataggaatgaattgaatcaagcatcagcaattcaggcatcaagcatattttgggtggctttgacccgaccccagtaatggcgatccaaaatcatcagtcctaataataggaaaaatgtgactctgcttcttaaatggaaatggaaacaaattagatgcaggcgggttgaaaacttgcagtaatttactggccgaattggtacattcctattttgcatgcaacattataatagccccctgagaatcgatcgaggattactaacattacatacagtatcaagctagtttaatttgtagtggcaattgatcgaccaaaacatgaacaaatcaggtgaagaagaagaagaatcaatcgatacctgttggtcctcttcaggtggggcaatgcattgcaggtggacgagtttaatttgggtagtctgagagagagaaacagcagataggtccaagaaagaaagaattcagtggaagccgcagtgcaagagaagaggagagatgtcgaaagaaatcagagggcgtagtgttatttgaaggtccaaaggcagcaagcgtgtgttggtgctcccttcatggcctccctcctgctcgatcgtttgcttccttaattcttcttagttgttccatcatcggttgagtttagttggtggcgcgcacgatgggattatcggtctcgctcgtgtcgattgccactgcaagcaaagccatgcagatttcttggaaattgctgctgttttccccccatcgtgaatggattcgtggtcagtcagacttcatactcacacacaacaacacaaggaatccaaatcaagatcgtcgtgctcgcgactacctccctcccggtcggtcttgaaatgtctgtctgtcaaaaaccaaaataatgccacgcgacgcaatccaacctccctattgtatactactgtatttgtatgacaacatgcgcagatacatgcatacaagcatttgatgccaaattatcttctgaccaatcaatcaataaactagtgtcccttcaagggggcgggagatgacttttttgtgaaagttcgaggtcaggcatgacatgtgtctccctctctctactctttcaaaccatttccaaataaatttcttatccttcttcgctgctataaataagtttagttagtccaaaacaaacagtaaatccagccgctcgaccctgtcaacttgattactacttcagtggtggtgttattggttttcgactttcttcagacgaccttccagaggtcaactccatccaaaatccaacccatggatggatattaacaagctgatgggttcactgattgtgctcatcatgccatagcattactagactgactccgcatgttccctcttaacttgcatgcacgatcaatcttgctttcagctagctaatttatccaggttttttataaagacaaaggacctaccttattctggatatatatctgatacaacagttcagacaaaaggttataacctgacaaatcaatagttgtatataaaccagattactcagttattcctgataccaatcttatatgtattcgcaaaaatcagcacctagtcatgccaatataaaagcctcaggatcaagaggacttttacggtacattctactgctagtatatactagcagtatatacaagggtaattttggtattaggtaagagtctgaaaagggctttttggtcatttaaattagagaattaatttcagccggattaattttccttcgttagtttttcctggggatgtcgtcatctgtttcttctcgtcacatctcgcgtctccggcgtcgctgcccctggtgcacatcgctcccgcgccgatgcctctcgcgtctccggcgtcgctgcccctggcgcacatcgctcccgcgccgatgcctccgtaccgattcctccggcgccgagagaagccgaacctccacgcgcccggtgtctccctcgccccggcgccttgcctccagccctagcctattctctcccgcatccgacctcccacagcttgtgctttgcccaaaccacggcggtgagagtgcactcgtcgag

SEQ ID NO: 67644 - DNA, 4129 bp, Oryza sativa
tatgatgctatggatgttgatgactttgagagatgttgggttgagtataaagcgaagtatggattcaatgaaaataacttatggataagcatgatgtacgagcactattttggaccagctacgtgaatgagttattatgtactagattgttgacgacatcacacttgctatagaatgctccaaatcctcacaaatccaaaaagataaggtaatcattttattcatctctacgtactttgaattatacatcacaacacatggtttaatatccattaaatatgatatttcatcatagaatgtccaagacattacaagagacagcgaggagagcaaacaatcagaatcatgcatccctactgataaggtaatcaaataattcatctgtacttacattcaattatacatcactacgcaaggtttaatatccattacatatgatatttcatcgtaggatgtccaagacataacgagtgacagcaagaagagcaaacaatcagagtcatgcatccatactgataaggtaatcgtttcatttaattgtacttgcattaattatacatcacaacgcatggtttaatatccattaaaaatgtcatttcatcatagaatgtccaagacataccaagtgacagcgacataaaaacatcagaaaaacgcgtcgacagcacaacacatgccacttcacacaaggtagtcaaaaaattatacttttgttactatttatttgaattacaacagcatatgtctcaaaacttaacaaacacatattatgcaggataggccagaaactgagtcactgacccgaaaactaatcatgctgatagaagagcaaggaaaggagatgaaggagatgaagcagaatcaacagtccatgcataaccaaattcaatcactcaccaacataatagctgcattcaaagaggaaaagacaataccaacttccaagaactctaagccaaatgtttgcaaaagtttcgacaaagaaacacatataattaaaaaaaaggtaagacaacatcttacttcttcagtgtctgtcaaatttaatactaattatttttaaaatgccaattgaatagcagaaaccaaacccaccaactcaaacgcccgtcattgccaagtcactttcaggatcaacatgaagattgcgtaaatcaacaattaaatcaaattctgatttcatctacaatttaggggctacaaagaagaaaccaaagaatgcgcaagcaaagaatttaatatccaatggtaaaagtcctataattatcatcacatcctactctgcttaatttttgtgttgcagttcacttacagatttaacttcaatggcagagttcaagtgcaccgcagaagatgaggaaaccattaaaagtataatgagtgcaccagaatcacaactagtggtgcatatcgatgatgtctcaatttcccaaaaaacaatgcaaattctgactaatccagtgactgaatcaagtacgagctatttggatgatcacgtaagtttactaacccgtgaaactattctctcatgcaactactagcacaatcataacctgccattttcctctacttttaaataatcgatgcatacgttacttgtctacgtgagaaagatatgaaggaaggtacagggactagggcagaaggtacggtgttcctagagaaaccgttaataacaaggttgctacaaagagatggcgaacactatgtttccaaagacatcatcgatcgggcaatggctaaagcaacggcaaatagatatctaaagcatgatatggtaatatttatgccacaatactatcaaattttcagcaagtttatactactaatatatcctacaaatgatttctttgtacagattttcctccccatgaacataaaagaaaaacatcggtacctggcagtcatacacgccaaacgccgcatcatccaagtgcttgactccatggcgaattcatccacacaacgcaaggaactaagaaaagttgtaagtattctacttagaaataaaccaaaaaggacatgaacataccgcagtaatgacgttttctcacaaaacagctagaaggattacaacaatattttcagctgttggaaccagaagaaaagcacatagcaacacaatggcctgaccatcatattacttcctgggaagtcacggtcatacagaatttgccattacaaggagatctgtatgttatgcagccactacaataatagtttttttcactacctaaatgtatgttatcacttctctaatataattcaattcttccagcgtctcatgtgggctctttgtactaaaaaacatggagcactggcaaggcaataggttgtcgaaggaatacacgcatgtaagatgcactaaatatttttgcatcttctttacaagtcctcaattgattgtttctatctaacaaatacctttatgaattttgcaggaagatataaaatattttagaaggaagttagctgcaattttggggggtgctcagaagaaggataaaaagataaactaatggatgttacaccttccaagatactagtcgaaatcaatgactttgttctaattcctttaatataaggagttagtattttcaatagtctgtccagagcaattgagcgtgtaccattttgtgcaacatactctagtatcagcggtgttattttagactaatcaaaactccacaaacaattacacaactgcaagttcaataataaatttaaacctttctatttggaatgttctgaaattctcaaaaaaaatgtacctctgttgtgctgcagctatgacattgctttcttccatcggcagcttcggtatagggcctgttcacgctgtgacatagctagagccagagccatagcatgcaacaagagggtctgcctcgcgacagccatggcctgctgctgctgcggcatgctgccctgccgctgccacctaccgccggccggctgcccctgccgatgcgcagtcaaggtccccagcaggcctcgccctcccgtagacccagcagccggcgacctcccgtagacccagcagccggcgccgatttggggatttttttggaagagatagggttttcggtggccggaaaatacacgagaggaggaaaggagagaaatcgaatcgatttcgatggcggcggcgccgattttggctcccggtggcggcagcgactgtggctgtcgacggcgagggcggcgccgacagaagacagcggtggcggtcgcccatgcgagccgagcggattcggtttgagtcgatgcggtgaaatgtgaaacggatctgactaagtgagctcgtgttaatttacaaaaataccccccatgaaaaaagataaaaagacaaatataccctattcaatttatactgcagtataattaggagggaaatcagataaatttacaccgtcaaatcaaatatactggtagtatatactagcagtagaatgtaccataaaaaaactcagcatcaaacccttcaccgagcgtacagcaagtaatgaaacctctgacactgatagtagtcatgagccaaaatctgactggcttgacacagtaagggggactgctacatctatctattcctgtacagcaagaaactagtcatgcccaagacattaaaccaaacaaaatccctgggatacattcaagcaagatgggcatatcacacaaatccatatcaagtgtctccctgcggccctgctgtatctggatctggtggtcagaaactgatgaaatcgtccttttgttccttcctgtcctgctgagatgaggtgccgcccttcttgccaaatatcatgtcgtcaagatcctgaagcaactcatcagcaccagaacctgctcgcttccctacagtgccatctttagtgcggggggagttctctggctccacggtgactggaatcatggctggctatgcctcaggctatgcaacaacaggttccttgagttctttatacttggagagaaccttctcaagttcatcgtggacactcaatgcctcaaagagctgagcctcgttgtcaccagccgtctcaatgattctctggatggtgcgctgacactgttggcattgctgaaccagggtggtagtcaggtcatcctgcatgcattagaggtgcaa

SEQ ID NO: 67645 - DNA, 2933 bp, Oryza sativa
tcatcctgcatgcatttgaggtgcaaccagaagtttagaacactaacacgataacagaacactagcaattttatttattggatggaaggcctataaaattaacatatggtagagtaatgttatccagtaactgtaagttaacttcagatattgctacaaaccaaaacttagatgtatatatataatttaccaaactcagatgaccatttatcaaggggaaaaaagagagagagcaggctcaccttgagagcctctttttgtggagaagaagaaagcaccgtggaaagaagttcaacgctattacgagccacctcaaaagcttcattgacttgcacagcaggaacaacgtggactggcgcaaaactttcatctggaatttcttgatacccttcctgtgctgcagcagaatatggttcagctgaaggtgctgaacggggaggagtaaatattggtgccagactctcatcatcacgcccaggaaagcgaattccccttgatcttaagctctgcgaagaatattgaatgtaaactgaataagcctggctaacagaaacccacagtaatagtgtccagatgtaacgattacttcagcctttcagacacaactatgtatgtggtcaacgaatgaagtccgatcgacatacatcagatttctttatcgaatatataaaagcagcaagtttatatgaataatccaccaaatgcgtaaggagaataatagttgcatttgttcttggtagatcgttcataagcattattgtttcaggttaaagtgcactaattgatgtaagcagaaatcattacttgttatgtaccttgtaagtctcttcatacaccggaaggtagcggagctcatctcctgactctccccatgcttcaataagcataagtgccttgtttctgttgttgactacagtctgtggatcatcgatcagttttaccatctcatcaaggacccgctcagcagcaatctcagagaaagccttctcgcagtttttcacaacggtctcaaggaggacaagagcaagatattgcactcgtggattcttcaacatgatgcgtctcttgatggcacggatcagctcaatgctgttgacatttccagtgttaaccatatcacatatctcaagattggtggcccaatcaggagcatccatggtctccagcgtggcctcatcgactatcttgtccgccatgttctggccttggaagaattctttcatcttgaaactcatgttactgacaccagctgacatcttccggctaacttctgccccacttaccttgagccgctcacccaaggcattgaccttatccatcagattgtcacccatgttgatgtcaatggagggagggctttatctgcagcagcatagagaggccgcatcaagatgaggtaatgaagaagaaaatatttgtctcgtgtgctactagagctatgacaaggctagccaacacaagagaaacatgcaagtagatgaacaaagtgaagaatatgaattccgatctattaacccccaaaaaaaggaatatagtgtgtaattcatagatgagccttgaaataatagacatgatctttgtgtaatactacagcacacatacaactagaaagagtgtactgtgtctgtgtggtctgcccaaatacagagatacaagatgtgggcagcggagcgattttctttgagagaatacagtagatgatacaggtgcacccaagaaattactcctactcgtcaagacatggcatgaactcaagtatcgtagagatggttaaacaaagaaaaggagaagtggaaatttggggatagggttttaggcttagcatcatatgggggcatggattaagcggtaattagtaacctggatcgaacattcgaacccgggggcaacagtaattaattaatctcgaacgagtctatctatgtctctcctcgtaggaggagatggagatggagatggagatgaggcgcgatggatgagatgatcggcaaagaaagagcgcgactaacctggcgtccgccgcgcttcttcgccggcgcaagcgcaacccgcgagcgctgttccactttcccttcgctttggtcccaactccaacgcaagaggacgacgactagtagtcgatggattccttcttctgtatttcccccttgcctagtcttctttgctttcctcgcatctatctaaaagttactggtataagtaggagtattatcgattttggattttatggaaaccctcacgttctctaatacttcagttattattatcaactagaaaaaatacccgtgcattacaacacgggtgaaatatattttaatcttactattattatatggtttagttaagataaaatttattgtgagagtttgcttagatatatatatttttataaaatcatgagctgcagttaggaatccgatcgtctcaggttagcatgcgagttttttaaacatatttcttatatgatttcttatgtattactaaaagtgaacgatcttaataaccgactcaagtacggatatgtatttccaaaaacaaacgaacttaaaaacctactgtgatacacggatgacataccaaaatactagcaaaaacatcttcaatttttataatagtagagataagataaaattccaatagtaatcatacggagggcaatgccacatcttattagggttttcctttcttaaaacctcaccaatatgcatagggatttttgccttgttttttaatcaaattccatcaaagacaccaaaagagtttttccttggatagatcattatcgtaatcatcaaataatctgaattccacatttcgcaaatattttatttatgtctaatgtgacagattaacttccccgcaaaaaaaaatgttacagattaactgtaagattaataaatatgactgaggtttggggttttcattctaaattt

SEQ ID NO: 67646 - DNA, 1524 bp, Oryza sativa
gtgtgcaaacaatgaacgaacgcatcatgtgtggctgggattcagctgggtaaaatcatcatactaggcctgtcaacaatcacagggtttttatcagttattgctacatataactcaagtgtgtaccaaatgataccgtgaagagccacctgaccagggccttcaataactcacaagatttgcatgacagtaacagcctccccttcatgattagtatgggttaggataccgaagtttaaaaggttctgccaggaaaaattgcaatgtcggcagcagttcatctgctgtgtcgaaaagaaatgaaggtaacttcattgagaaatccagacctgaaaaataaaaggagtagcacatttgttatgtcattcatcagatagttcctgttgttgagcaaatcacctttggaacagtacatcacaggaggcagtaaatgaggaaaaaaaacatgaaaaaaggtaatttcttgcggctataatgcttgcttcataataataattaataaactacaaaaccagatgtatcgtacagaaacaaggaatcaccatgtgcaaagattttttaagtcaaagtgtattgtgcattatgtggcgcaaccacatgcaatgatgcaaggtatgctctagcatggtaccagctatatctatgttcagctgattttattttaaatgtaagttgtactccatccgaaactcatccaccatgtaacaaaaccaatgaactatacacatgcatgtaaccaataaatactaagattgcttcttaggttccagtcaacaatttaatttaacacagagattacaaataggtcttagacttttggaaaaaccaaaaaatgaaataggtcttagacttttggatggagagagtatatagcaagcttctatagaaattattatgatgtctgctgtatatgctgatcaactagaacctggctccatgaaatcaaaacacggtaaggaagtagaagagttaaggctttaatgaactcaaaacccagtaaacggaacatagtaggtgccaccatgcgtcagtgcaacaaagaaaaaatagaagggaaagaagctcaggtcagtacagaacaaaactgagaaagcggagtttcatcgccatggttgtgagagtgagatggcactgtccgatgaatctgctcctcgacctctaaagatagcagatttgagcgcattatactgatcaacgactgagttgtacaatgactctgagaatttctctctgcactgtaaaaacaagaagaaccaaagacattcaacttcacaaataaaaaaaggaaggcttaaacagatgaggcaatatcaataagtaacactatcagtgagcaagtctgaaagttcaaagttctgtaaactgtttacaaaataagaaaggttcttagcctaaaccctggagacaaggggcctacaagagtaacagcaatgagaattttcaaatccaactaccaatctcaagctagcatgggtgaatatcatatgcaaaagtggaatataaactgagctgcacaatgatgaa

SEQ ID NO: 67647 - DNA, 1467 bp, Oryza sativa
agatttaagggtgtaaaattgtaaagtgccacatcgagtattatataggatgtcgtatgaggtgtttagacactaataaaaaaataaattatagaatccgtcagtcaaccgcgagacgaatttattaagcctaattagtccattattagcaaatgtttactgtagcaccacaatgtcaaattatagagcaattaaacttaaaagatttgtatcccaaattagtcgcaatccataggattagttattttttagcttatatttgatatttatgaatgtcttcaaacgttcgatgtgataggatataaaattttagggtgggatctaaaattacatacggtacggtacctttgcctcccaaactacctttcctcctgtccattaactataatactgctccttgcctccttggtcactcgcggttgctctactttaaaggttttctcaaaatgattattttctctatttgtgcaaaaaaaatgaaatatgcatcataaaatgctctatattcaggtcctgtttagttaaaaaaaattcatgctgtcacatcgaatgtttagacacatgcataaagtattaaatgtagaaaaaacaaccaattacacgggtaaattacgagacgaatcttttaagcctaattgcgccatgatttgacaatgtggtgctacaataaatatttgctaatgacgaattaattagggttaataaattcatctcacggttttctagtggaaactataatttgttttgttattagactacatttaatacttcaaatgtgtgtccatatatccaatgtgataaccaaaaccaaaaaaaaattccccaaataaacatgcctcattcatgcagcaaatcaagattaatttctatttgttcaacccatacaacatttaaagtatgaatgagtttttatttcacatgaaacgacagagcactttagtcgatgagaattaattttaaaataatagatgtcttggtgttttttgtcttgatattttttgtttatgggatgatcaaattacggtagaggggtattaccattctcaatactcatacacaaggtaaaacacaaacacacacagaaaatattgttatgtagtactagtacgacagaccaaaactacgttaatttcagtatcagtataaactagggaaattaaataatcgaggagtatatactactagcactgtatgtcactacactggatcaggtcagcactgacgggctcaaaccatcaactttgacgggttcagctcccggttagagattagtggtcactgatgacttgagtcacctgtaacgggtgaagacccatcagaattaagagccacctcaaacggcccccaactaaaacccatcacaggtgagagttacctctgactggtcccaaccaaaacccgtcacaggtgagagtcacctcaaacggcccaactaattggggccgtcactggtgtgaaaaaaaaggg

SEQ ID NO: 67648 - DNA, 2393 bp, Oryza sativa
ccctagccggcccggcgccgccgcgcctcccctcgccacggcacagagaaagagaggagagatagagagaagaagtggaagagatagaggagaagtggagaagagggagccggccggccttatctcctcatgtgggccccgctgggagaggagacatatatatacagtggcagaagtcatctcaaacgggctgggacttaaaagccgtttgaggtgagtaaacctcgcctctgacgggctgtccggctgcgacccgtcacagataactagtcacctgtgacgggttaggacttaaacccgtttgaggtgaggtaacctcacctgtgacaggtatcccgtcagagatgtgaggatctggtgtagtgtgtataaacccaaaagaaagaatataaaagaggatgaggcagttggcatctggttatggcgtgcataccactagagtctagcagcggaaggtaggttggtggttgttaattgttgctgttggctggctgctcccaagtcccaactctcaacccaacatccttcaaatatttatgtataaatttcacatatacttttatcaatttagcacaaaactatacattttaagatgtgtacaacagatttaacatcataccttttttttttatgaaactacacatgtaacatcagttttatcataacactacaactttttttgaactctaaaatctgtagttataatttcatcatcactaaatctgtaatttatctgtaatttagtgatatgatatcttaaaactagtcatcctagctaagctatctaatcgtcctccctcgtgggggagatagaggtgcatgtgatgagggatccatgagagaagagccatctctgacgtgggctcacctctcagaaatccatcccttgaacttgagaggagcttcttcatgtgcacgcgggcgtggccagcaataacaagcaggtgtgttcggttgcatatgccatgccaatttcattcgttattgttacaagtatttttttgtgtactcctacatgtgggccggttgactagtggagtagtagtacgttggctagtggagcagcaccaccgcagcacttcactagcggagtataaattgttgccatcgccttgcaaatgcaacacgagcttagctatggaaaaagaaaacacttttaccgtggagacttgaaacaaattaagctggactgcttcaggactcaagaggagagcattcaggtctgaaaacacaaccccagcagtccagcacgcactcgccactctcgctcctacggagtggagtatatccatccatcttctgaaatgcgctctctcctgtaaaaagaaaaaaaacaatctttatttctagttacttaaccaacaaatatatagctaaaaataaaaccccattatttaaatacgtatgctagaaaaaaacatatgaacgaaaaaaaacacatgaatcaaattaaagtagatttttttaattaattctatacgaattgaaaacatatgaaataggaatagaagccattagcatatgattgattgattattaactactttaaactttaaaatggaattgatatggttttcaaaacagctttctatatattttcttaagaaaaaacagcctttaacatttgtttcaaaataagttcatttttatctttatacctaccttaagtctacaaatcaagtaatattatctcttaaatactccttacctaccgtactagtttattctcctaaacatccactctcttttttttaaaacaatccacacaaaacagtgcgacgtttctattgatagagtagaaaaaaaaaccccatccgtctctaaattagttcttttcctatcatttgattcactgttaaatatacttttatgtatacatatagttttacatattttacaaaagttttcgaataagacgaacgatcaaacatgtttaaaaaaagtcaatggcgccaaatatttagggacgaagggaatacaagctattgctctaggagattatagtcaagaaaagaaaaaagcaacaaccacaccacgcgtttacatttgatctagatgttgaaagcaaaacaagcatacaacacccctaagaaacgaatcttctgaacgatgctgaaagcatcgccgtcgcccatcctggggagctaggacgcggttttcacctaaaaaagcattgggaagaggagtaaacacgcaacaatgcccccaagggtcgagaatacgacacccgcaggcatcgtcgttgctagccgaaggctaggcttttaaccgtagttttcctaccctcctgcgaatgcctatcaggttcagcagccaaccaccatctaaagcctttcaacgcgcagccaccgcaccaacgtctcgctgttggccggccatcaaagcaggatttc

SEQ ID NO: 67649 - DNA, 1967 bp, Oryza sativa
tgcgggagaagctgtcgctgccctctgacttccaagcttcgcctcctcctccctgcgccaaaggtttggccctgccgccgtcatccttgctcgctgcccggttctcctagcggcacactacggcgacggcgagacggagatgaggaggtgaggcgcggcttccctcaattatcacactttttttctatgatgtgtccttttgctaattccttaaaaattttaaaagaatattatttttttatatattataggatggatgaagtagtaatgtcacctgtactaattttcttttttttcccagctatactagtctactgctactccagactccaggcctccgcctttccggccggctgattgcttttgtgtttcctgcaagacaagccatatttcttgttgtttgtgtgtgtggctccctcctctccaggcgccacagaattgtacagtacactttgttgagttggcgtgttgcaggccacggacatggccgtcacgtcgcctcacctcgctagcttcgtactagtgtactgtagcactagtacctacataaaaagccatccatcctttcctgcatggagtaggatcaggcagcaggaaggaacggaggacgtttcagtttggagcagcattcgttttcgtttcctttcctttgtgctttcttgtgatccacagaatactgaacggatatgattctctcactccgatcctagctttgtgggggaggggaggctgcattgcatgcgcgcgtatatgtatgtcgtggtcgatcgtccttccagttccatgtggagtaggaggagtatttatctctgggattcgattcatgtatatatgatgaacagagctcaatcgatatagatcgctagctaagaatcgatccagaatatactggactactccactatagtggtaggtactaaaagtacttgatacatatgcttccattccttttgcttttgcttttctacttgcattgctggccgcctacctaagcttgtggcaccaaataacccagcctcacgctccaaggatattaatttgaccagatcgattcctactacatgtgcttttgccatgcatcaaaccgtataccactggctggggcggatccaggaaaaaaaatagggggctcaattgtacagtttcttcaacctacagccatttaggaacctttagtttattattcatggtagaaaaattaaagagggtgcttcagaggtatccatagatcttgtgggtgtagaagggactcgagtcccccctgcagccacgttggatccgcccctgcactgccacatggaccggtttaattaatgtcatatcttagctgattatgctatatatatatatatatatatatgctctctctaagtagttgtagatcgatcctgatgcatgccagtttaattatttgacattttacactaccaaatattgatatatatacgtcgttactttttaaaaatgatgaagtgatcgaacaagcctaaacagaaaaaggcacatctaccattccataatctatccacgtgcgcgcgcgcgcatatatatatatatatatatatatatatatatatatatatatatatatatatatatatatatatatatatattgtttggtgctctatggtgcccgggcaccattgttgaaattgagtatatacccaattcaaatgagtatgaaactttttcaattacttaggtattaacattaactactttactaactagttcaaagcatgtttgtactgaatttgaacttgtttttgttagattttgattctaggtatatagcatccatacatataattagttaggtatgtaatcatggattgtgaaataaagttaaatttgagttgttttgttgataggtatagatatgaatcgaattattataactaggtatatactcacaatttgaaaattttgaaaaatttgagtgattttgtacattagataccatgg

SEQ ID NO: 67650 - DNA, 2168 bp, Oryza sativa
caacgacgcgacggtcagatcgatttatagcagagcagtagttacgttgatcgatcagtttgagagtttgctagcgctagatagagctatagtatagggctcgaagatgacgacgagctcatggagcggcctgcttgtgatatcctgtatgttattgatgagctgggcggcggcggcggtggacatgtcgccggtgcggttcgacgccgcctacatgccgctcttcggaggggacaacctcgttccctcgcctcacgcccgcaccgtcctcctcaaactcgaccgcttcaccggtaatttgtttatttatgaatactaattaatttgatttattgctagctagcatgtatagaatcaatcgatcagtccatcgatcaattagagataaatatatatgccgcaggttctggattcgtgtccaagtcggcgtaccaccatggattcttcagtgcttccatcaagcttcctcatgactacaccgccggcgtcgtcgtcgccttctacgtatgtcttataccaaccttcttcaattttctaaattatgatatcgctatctccaagttaattcatacgtaccgtacgtatgtggatcgatcgatcgattaattgatcagtgctaactaaaagttaatgatcaattaatttgtttgtgcccaaactaatttgtgcttcaatctagctcataaccaatttaatttgtgtggagtacgtacgttgtaacgattatgaatttggacggtggagctacgtaccctcgctgttatcttgttgacaatttaatttctttttgcaacttcgatcgatcttttgcgagcgagcatggtgttatcttgttgacgacgtccacctgcaaaagatcgacgtacgtagcagccgtgcactcatctcatcttaattaattggtccgttaagttggtacgtgttaagttagttggttcataaattctaagcaattgtgtgggtttgaaatttggatggcgatgacaaaggcaaaaggcaatatgtatatcaatagagaaaggtcgacagatgggtggtggatattaataaacctatagctagttatcttatactctgtccggacataattaattgacattttcaaacaactatagtatatttttttagaattacatagcaacaacgcggagactatagtatataatttacaaagaaaataagcctgcaaaacatttgtctgaaacgcaaagttataaagctgagcctactaattaacatattttttaatgtgaattttgagttgataattatcacgtattttctctaccccataaaacactactcaaatgatgtcggattagattattttaagatagagggagtgcatactacacgcatatagctgaggtacctatttgtttgttattgtcgcgctcgattagtaggtgagtgcgcattgcacgcgcgcacatatgcatatatgccgccacacccagcatatccatccattatactcattggccatattatgcatatggagtatatacatcgggcaatgcaatagggtatagtagctagcccatgcccggcctccatcaatcaaaaatcgccgcccaatcttcttttcttctcgatgggtggaggagattgattattcaccctcaatggtaggcgacatgtacctgtcacaccttttcctttttccccctcttcaattttatagccaaaaagcaaacaaatatatactagaatacatgtatatactagtatacataccacacaaatatatcttgtacgcataacaaataaatatcaccaaatttttttcaaaaaatatacttccaataatattatacatatgtataaagtatacatatgtgtttgtatttatttgtataacggatttatactcttaaaaatagctgatttttactttaaaaaaatttctaaattttcgatgatatttattatgtcagttggtattacatccgtccaaaatatagcaatctagactggaatgagatgttttagggcattgtagaactacaaatataaggcatgtctagacgttttaggatggagggagtatgtataatgtgtatactcagattttgtgtctttagtgagggattttttttttcaaaagtgacggctgtatgctacacctattctacgtgtgcgtgtttgctagtacgtactactgtacg

SEQ ID NO: 67651 - DNA, 5837 bp, Oryza sativa
tggtactgacgacgaccactgcgccgccatgggcctgatgacgtcggaggtggccgtgatgacgccggcgaagcgcggctccatgcggcggttccggtcgcggcacctgacgtacagcgcgtgctacgacacggtgcgctacaacggcaccggcgtcgtcttcccggagtgcgacgagtcggagcaagacaacttccacgcatggggcgagtccaagcgtgtcatcaacagcagatccagttccagcgccacatacgccactggttcaggcgtgcgcatcgactaatttatttactagtactgtgtaatctcaatcatgcattattccaccagttgatcctgcttctagatgatcgatgatgagtttgtacgtacgtgcacactgacacattttccagttcatatatatactcgtatttccttcggtcgttcgattcgattcgattcaattatttggtgattttgctatcaaccgggtgtaccctatgatcttttatatctcaatttttaaaagggttgcatgcatgttaattcctatactataaaagataataataatgataggtgacatctttgccaccagcttaccaccaccaactttttaacttgttttacaaattagttattgatgacattttttgatattttatttggattccagtgaatagactgggcatttacccatagcaaaggcatgtgcgttttactagtgttttgcgctttggttattctaggatcgacggcgcgttttgcgcaccctaacatacagttaattaattattccaactagtgtagtggctagcattttttttagaaaatgtaaaataataattatatttagtgtttttgaaatatagtagatatttttttagataataaatatagtagatataatttcacactttatcgtgaacacaaaaaaatattaaaaatgatagtataattatgtttagaatggattaattgtaatgtaaagcttaaagaataaaatagatactcctacttgtatgtccccacaatttcagttatccatgtttaacacaactatttactcagctcacgtgtttcattaacaaatggatgataaaatagttaaacgctaaatgtaagggtggcaaatagttatatgcggccttggtgtcagcccgtagagactagcaggccagggttgaggttgaaggcgtacatgtgctagatggactgggccgtagtacgtatgtgggcctagttgcaacggctagtaggtggcgtgtagacggagacgggaggcgaggcgagcggcgccgcggaacgggacaacggtcatattaccgaccgttgtactccaccacccacgaacgaacgaacggctacgcacttgcgtttaaactttaaagcagcagcagcagcagccgcggcctccgtccgtccgtccgtctctctctctctctcttcttctcttgtcagtctcgcgccttcttctcctcctcatacgcagcagcaagcagccaagcatggagacgcccctctccagcaggaggatcacccgctccatggccaaggcctccgccgccgcccccgacgccacgtccacggcccacccgccgcgccccgccatgcacgacatcaccaacgactcccccatcgtcggcctcgcctcctcgggcctccgcacgccggcctccaccgccgccaaggcccgccccaccagggcctcccgccgcacccccggatccggcgaggcactcctccgcggccaggtcaagacgctcctccagaaggtccaccacgacgcctcctcctcctcctcctgcgccgcagccgctcctccctcccccaacatcctccgcatccacgcgcccatcggtctcgccaggtcgcccgcccacctcctcgcccccacgccggccaacacgccgcacctcaccgccgccgcccctcacgccttcaccatgacggtgccatgcgtcctcgaggaggagttgctttccaagctgcaggtaaacattaacctaattttgcccccccccccccccattcctcctcccttgcttgcttcccaatatggtttcctttgcttctgttccaccaatcaatcatgcgtgcaatcattttcttcaaataatccaatccaatccaatctatatgtgtgtgtgttttgttatgcgcgaaattgctgttctagctgtaggacatccaacattaggcgaattctgttcgattaaccatgcgtcgcagcaatcattttctaggataacatttcgtttcttcacttgctgcccattccaaatatattagacccaaggattcagaagatggtactgtatttgcttattgctgcgcttacattacctgtaacacgacctctgcattacgtaatgcagatttgacaaggacatttgtcaggtgttgtacatgaaattcaatttgtctatatcttcagtctggtattgattctacactgggtgctattctgttggattgttctaagatagtaatgtttggtttcctggcttgctgcattcaaaatagattggacaaaaggatccagaagatgcttatcgctcttcttacatgacctgtaacaccaactctgcacaaggacatttgtcatgtgtttgcagtacatacagtagtacatgcataaacttacttgcccaaatgtttgtgtttgtgtttgtgaagctatccatgtgtagttattgttgcaattggtcttgagctgatttggtccctctgtctgtggtgcaggtcattgcagatgccctgccgccacctccagctcaggcggaggagaaccaccttggagagtgcaaccgtgcactggtgttcgacgactcccccgggaaatcggacctgtccaatgctgcctcggtgctctcgtcgtcgtccctctcgttccaggacagcagcagcaccgacagatcaccggacgacgacagctcatcggcttggtcaatccaggtcaatgccagctccgagaagggcgacgaggacacgttcactgatcaagacccagaggaggaggaggaggagtggctaacagaagatgatgatgatgatgagtgctttgatgatctgtgtgaggggatgagcaagatgtctgtgtttgacgatgaggaggaggaggacaagaaggctgggctgcctgcgtttcaggggaagcacaccaggttcatctacgacagcgacggcgagatggagagggaggacgtggcgcatgtgccggtggagaactgcaccatggttctgaggggcctgccggtgccggaggggaagcatctccgcttccacgaggtggaggaggatgaggaatagaatgacattgctaccagtgatacacttcgcatccaagcaacaaaaacaacattgctactatagtagcttcttctttttcttttcatctggacagacacattgattcagtctactgcaatataatgccttctgtgtttcgcttcatgtttcagttcttctgaatgccttttgaatgttacaactgaataatgcaatgcaatgcaaatatgcaatgttccattacccttcgttcagttgcatgtttatgtgaaagcatcaattacccttcgtttttcgaaagaaggagaagaagttcagacaaggtctgaacttcaattcctgttagctgcctggcatattactatttgcagagcaatttctttcttggcccaattggaccattcctgatactggaatgtggaaactatccgaaggaagaagaaatcattaaatcaacgaagcaatacagggagatggagattaaaagattttccctccatttaatattacaaatcgttttaacttatctttaagtcaaaattctttaagactaaatttatcaaaaacatagtgacattttcaacacaaaataagcatactatctaaatgccccctccgttttaggttatagatgtcaaactgctttaaatttgattaagtttagagacaaatatagtaatatttacactaccaaattagtttttattaaattaataattaaatatatttttataatagatttatcttggatcgaaaatattactattttttatacaaacttggttaaacttgaaacaatttgattttttgaccaaagtcaaaacattttataacctgaaacggatggatggatgtagcgcccgttccgtcgtggcgcctagcgggaaaattatctcctaaaaaccctaatttcgaaatttgtttcttcgcttgttgtctagtgtccgtgccatctcaagatctcaatccccgatctatcgtcgagttcaattccgaatccaaatccttccaaatcaaattcctccgcaaaagtccattttgcctcccccaaggtcgatgggtcgaatcccgctcggcccatctctcccccggccccctctctcccgggcgctcttgctgtctatggtttctgtacaatctctaccaccacttggtgctatccaaattatctgtgaaccgccactacatgtcataaaagataaaacatgagcaacccaatgtaacaaggaggtgaagtacatgcgtttgcgttaagaagaaacaaattcagatctatgacggattaatggtgaatgcagaataattccttgaatagtcttgactgcactgcaactaggtgctaaatttgacacattataaaactagcatgtgtattatattttctattactaagtactaactatatatgttctattatacatggttaaacaatcaagtcaaaaaggcctaatatttataagtaaaaaggatgaaaactaacatgttactataagggaagaataccgtaaaagtaaagccatttccttcagactacgagtatttgccctcctcttcatatcaactagctcaggaaaatcattcatatgcttttttgagtacacacaaatgaggtttctgcagggagaaaattcctttatgaaattaatatttccaggcaatagaaacactagaaacagaaaagacaactcagccatatgagcttctggggtggattaaaaaaccttcccatactaaatggcttgcagagaggatctgtaacaaccctatcaccagcaacataaacctacaaaagatggcatattagtgataatgtgattagtcaatagcatatgacgattcacatgtaaattatccaagtattgtccaaaaattaccctgtcgtactattttttcgctgatccatgggttgcttctttcaagcagcaaagcaatgattgctggatctgcttctgtctgatggttagacatcagaacaacattatggccctacaataacaaacaatttcagaaaatgcataagaatctttagtaaacaattaaaagaattattcgacagctctaaagcatgacagaagtatgttaggataattactacaaacacctaagtacctagcgtcgggtgcttccagcaatgacagaaggtcagaagcaacttacacaaaaatcatccggtgtgagggacgtcatgtgctgacatacactggaaacacttttatcactaaagcataagaattggcacatgatgtttgttctcatcattctcttctatcagacatctctaaataactatgaaaccaaaaaatcaaacattgatgtgaggtagatcatatctagttgaagctttcttatggccgtctcttgctgttgatgcttatatatcaaaacccttggaaggaggggaacctctgttagtatgtatcatgatattactatcaacgacgctgggaggattacctctcctgttcatctaaaaaatgaagggtcgattccagagaggtctttggagggtgctatctatcctagttcttttaaccctagatatgtgattcatgggttattgg

SEQ ID NO: 67652 - DNA, 15513 bp, Oryza sativa
caaaccgccccgccgtcatcgccgtcgtcatcgcctggccccgccactccgcgcgcaagccgccaagggacggaggcagcatccctcctccctctgccgcgtcgcccccgctcacctcccccttttccccgaatcggcaaaggggcaagccccctttctccccctccttttcccctttttcctcctcgtcggcgtcatcctccctgtcgccgctttggccgcgaccgccgagcgccagctcgcgcccttgaccgcgcaagtcggttcccaaaccgacattgccgcccatttaaaccccagcctcccatttcccttcctcttccattcgcctccgtgccattgttgccgctcccgtgctctgtcccgcctccgccgtccatcgccaagcgccgggagagccggtgcgttcgtggacgcggaaggggactccgggcgcgccctctttttcctcttcctcggcccgaggccggagagatcactcccgcgccgtcggcctctcgtcaccgcgcccgtcccgcacggtagtgcctccctccgttcttcctcctcgctccatctccccccccttagctttcggtagtagctcgagtagtctccccgaagttagccggcgccgccccgaccgttgccgtcgctcgccgtgtgctcgccgccgtcgccgcccgagctcggaagcgccgctcgtcgccggcctcgctcggcgtagttccgcccaatccgacgctagcatcggattcccgtaaccgcgtagatgctctcgccgccgggaattagcccctagtgacctcgtcgccgtttcccccttctcccgccgccggttgcctccgccgcaatccgccgccgtcgagcaacccccagcaaatccgagccgttggttcgtctcccctcgtcacgtgcaaccgcccggtgtgctcgcttttgcccgtatcgccgtggttcgctccgtcgctcgccgctgtcgaccgccgtccgttccggccggcgtcgtcgtctacctcccgccggcccgcgtggcagccacgtaggcgccacgtcggcgccagctcagcctagaccgggtcgagccgaccccggtcagtccctccccgtgcgcgcgttccaccgcgagccgtgaggctgcgcgtgggcccgccacacctgcgtccaccgcgaaccacgtgcgtgcaccacgtccatccttcaccctagcgccgcgccgcgtgctccctccgcacggtgagccgagccgctgaccgcgcgtggtgagcccggtccaccagactctctatccttcctccgcgcgcgcgcgtcttgggccgccttgggccaccttcttgggccggccggcccgttaagctcggccgagccgccctttctctcgggccgcgccctagccgcccgagggaagtctatattccctccctctccctttttcttttctttcttttccaaaaaggatttaattaaatccttttcctttagaccaaaaatccaataatcttagaaattcaatatcttccctaccgtaaatccgtttgactccgttcaacttccaaaattccccaaatctcgagatctatctaatggcacgcttagaggtcattaatagggctttattttcgccgtttgttgagttgtcccatttcgcgtgtagttccggagcccgaagacccgcagtgcgaggatttcgaggatcaagctccagatctcgagcaaggcaagccacctttgaacatcttgagcctatatttgaaatttaattatattgcttgcaaaatattatgcattgataggatcgcacttaatctgttgttccgtctgcaaggcagattggcggacctgcctaatttgttgcatttgatccttccttttttaattgttataccatgtccccttgtaaccacccagttgcgcctcgatattcgtgcactctgtgcgagtatcgacggtcaccttcaaacttaaaatctgagaaacaacttgggtaaaacttgggttttacaaaagacttggaaaacccgacacctaggtcggtgcttgcgaactaaatgaatttctaaaaccgcggaccggggaacgtaccgggtgtacggttttcccgctcccgcacttaaggaccgattccttggaatttcatccgaacataggacaagtacgaccacatgggtggaatgggacacccctggctgagtaactagcttatcaggggagccatgatgccgagagacatgtggattcgccggggtggtgtcggagaggaccccctaggcttcctggcacagtatggtctgggacctaacctgttgttggtctgggacccctctcgtcggcatatggtaagcctgtgtcggctttggaaatgccttgtcatgaaagcttggaggtctcccgacgtggctgatccccacgggctgggtgatccggattagtaatgtcgtgtgggtaaagtgtaccccctctgcagaggttaacaaactgttcgaacagccgtgcccacggtcatgggcggatgtgaggtgattcctagcgtagttttgtttgacaactgcttgtgaaattactgttgtgaaaaagggttcgatgtttgaaaaatcagcagctgacgggatcagctaggcccgggtggccgtttgaaaagctgttggccgggtgccaaccttgttttaagatctaaagattgatacattgcacatactccgaccggacgggacgcactgtctcaaccgtgtcgtttgagaagcactcacctagatgtttttagaaaagagttcaaataaaatcaattacgaaaacaacagcctttccttgaagcctgcattaaacacttatttcccctagcttgctgagtactcccgtactcacccttgctctatataaatatccccccagttgctgataaagatgaagcggatcctgctgatgaggagttcttccaggagcaagccggttacgatgagttttagggtttcggcctagttcccaagtcgcgcctgtgttgtttggtccaagtcccggcttccgtttcccttttgtaatgcagttgtaagctcgggatctgtccgcagcccaacatgactgtactcctactctataataaagagacctctgttgctgtgatattctatcttcctgtgataccagcactgtttcctgggactggtatcgattaacaggttaatttagagcgtcacgggctaattccagtcgggactagctcggggcgtgacaatggagtaattaatttgaagtaatttaatgaaataacagatttagtgaaattaatttgaagtaaatgatttgcttttttttataaatttagttaaacttaaggaagattgataagaaaaaagtttaaacgatttataatataaaacgggaggaatattatagtatttttgtttttgaggggaagtgtattatagtacttgaggagcaaaaacgacatgcatcgtcgttgactgtcattttgtcttgtttggctttagtttccttgctttcgcttggcgttgccctgccaacatcagcttagtttccctgctaattacgtcttcacaaatttcctgttcataaataaaccctactatgtcttcacaaaagcttgttattcctgcagttttccacaagttcggtgttatcgcaaggaaaaaaatgttgagttcagaagaagacgtttctcaaaaaaaaaaaaagttcagaagaagacatggaataatttgctggatgtgcatgcaacagctggcccaagtcaacttaatcggttgatgtaagaaagaatgtttcttttacacaaaaaggaaattatataagcaaagcaggtatctcgagaaattattaatttgtctagcttgttcaactctatttcataagtaagtagaaccgatctccatagcttggcgtttagattagcttatgaattaggttgggtttttttaggacggaaggagtagttccttatgtcggtagaacatgtcgtttggggctttctgcaaaggtccagaaaaaagactgaagttttacctcattctcagtataacgactacgttcagtaaagaagcagtatcatttcccttaatttgatacaatatcaagatgtctcaataatcattactatcaaaatcattatgcaccttgtatgcatatacagatactcttgtactgtactagatttatttttgacctgaagaagcaggacttgatgattgttagcatcgttgttggtcaatggctattagtagtagctatgactgtgtttagtaggtcttggattccatattcagaacgcggaggataatatgtggtcatctggacacgctattgcaattgcaggcattgatatctgaagcgcgttgaagtggagtgccctctagctccctccctgcttgctgatgccgcagttcgtacgtgagttttggttaacgtttgagtaaattaagataagcacccgtgttaagtctcaccgaataaactgaataagaagaagaaggcacatccgatcctatcacctatggcgatgtttgttcaatacttgagtccttttttttagataaatacagtacttcggtctggtgtattttgtggtgcaatttaactccataaattactttcagaaatgtgcagacctagcaatgtaatttcaaggtctagtaatgtaaatgagtgaaagaaaacatgaagaaaatgaaagctgctagggtttgctggcaagaaagagaggattgagaaccaaaactcgtcaaaacaaacacaagtgaaatgatttggttccactaatttcgtgtattattaattgacagttttgtgcgaaggaaaaaaatacaaaggggttttctacacaattctagatgcaattttttaatcctacaaaatatgccatgagtacaaggtatgctcatagatagttagatggataaatgactctttttatttacattagtaatttaaatgtgtatttttaaagtaaagtgacttgtctaaataagctggattaccctttatacattttactttaatctctttgtctcctttatcttgcagagactgtaaattcatgaggtgatgagattattactgcaaattggatatggagaagttgttctttttttcttgtgaaagagcgagaagttgagactgagaagagcagccagcaatggacacaggaaatgggagcaagaatcttgctatatgtacgaccgagccgtacgatttgtttccgaccgagtcatgcaaccaatcactgaaattatgcttatacatacaccagtccaatggatgggtcggacgtatagcaatttcgtgggagcaaatagggatcagtagtactgtagtagtagtagattcgcttgccgtcactctcgtcccgtttgccgctgcactgcactgttgccctcggccgctggctgcctggattagtggtggtgacccaaaagtcaagaaaagaaaaaacaagttgcacttgcagttttgcggctcacttccccttctccttccccttccgtgtgcatcccggcttcctctagctccgccctcgacgccaaccccaccaatccgccgcctccatgccctccccttcctccccggcctgagattagcttcgccgccgcgcccaatcgccccgccctgctgctccccgccgccgattccgtcccccgtccaccgccatggatcgcagcagcagcagcagcagcaacagcaacccgcatctcggggtcaacaagctcggccgcaacatccgcaaggccacgccaccgccgccgcagccgcagccgccgtcacgcccgccgcagccgcagccgcaggtctacaacatcagcaagaaccagttccgcgacatagtccagcagctcaccgcggggaccccctccccgcctccgccgccgcagccacagcaccagcaccacccgcaccgcccgctgccgccgcagcaccagcagcccaagcccccatccatgcgccttcagaagatccgcccgcctcccatctccacccccgtcgcgcggccccctcccgtccacaaccaccagatccccaaccctaaccacaaccccgccttccaccgcccaccgccgccgcagcccatgcccatgcctatgcctggtccccccgtctgggctgactcaccggtcaccgcctacatgcgcatcctcgagaactccctcttcagcgccaccccgccaggcgccgccgccgccgctgccgctgccgccgctgctgctacgggacaacaggcccctccgcaccaccctcatcccccacccccgccgccggtgccgtcgccagggatactcccctcgccgagcggctttctcaacctgctctcgcccacgcccaggtcgccctacccgctgctatcgccgggcttccagcacccggggccactcacgcccaacttccccgcgctgtcgccgctgccgggcactgggatcctgggtccagggcccatggctccgccgtcgcctggcctctggttcccgcagtcgccgtcagggctgctctcgccctccgggttcttgccaattctgagcccaaggtggagagagatgtagtgcacatcgctcgccgcagcgcagcacaaagctcccgtgaaggccacagccgggtaacatttgacgctagggttgtagctactgtgaggtgaattggtcgctgccccggagatgggcgcaggtgggttgcagcttcggacaccactatttgttgctctcacttactgcttgtgtgattagtcagtcattatatcagtcagtctataaggtggttgctcatatatttgtaattgtataactgggaaagtttttaattcattcacttctcttagctgcaaaaacctggacagcaaaaactgggcatgttgtagtttagactcttgagtgattaggcttgaaacatgtaattgtaaaactttagttcattaaagattagccctttctcactgttattttgcttacgagtgatgtttggtttacctactcttgagcagaatgtttgccctacctttttctttcctagggggaagctaacttttagacatcagcttgacaggagatcagcaactctgtcttatttgtaccaacacctatcagatgagagttgaggtttagtacatcattgttatcgctatcactttttgagcgcttgccagatatactcatatatctttacagtaatatggaattaatattccttatccctaagtgtgtgatgtatatctttacattgtgatagataccgcagcaatgttactttcgaatttgggaaatgccacaatgtgaatcatgctagtcttttcatgcatccatggagcttgataagcttggttagttggttgcatatccatggttgaaaagtattggttactggtttctgccagggatatatatacctttttggtcccagttattagcatccaaaaatgtccatatacctttttgtacgaatggggatacactgatatactctttggctcttgtatgctactgattcattttcttgtgtacctacaatgtgtgatggacccaaaagttatgcaacacactaccaataatatatcctctgattgaaactttcaatgtgcaaaaaaaaaaattctagataaatttgatatttcttgaaatggtgtggttgatgtgtattattctgtgcatcacagaaatgctgttgcttttgcaagtgagggttcctgggttatcttaattttcttctaggttctagccttttgagttatatggcttattatagtctgctattcctctgttctaggattaatttgacatctccttgtgaatcctggccttgtaatgataaggtagggaataacttaagggtggttcgtgttgttctctatatataggcaatcagtattctttgtgcacctcatacctttgtaagttaaagagtattattgcaatcattatcaaattttgtaagttaaagagtattattgctatcattatcaaatttcatggtaatggcatgatagtttttctgaaaaggaacaaggtgtatgaccatgccatgcttgcttgtcgaagctagggcagcttccagaaagcaataccgttgctacattgtggtattgttgcataatactttcaaggatgaaaatttgaatctctggatggctttcttttacagcttttggtcccttatactccggattcagggaatctcatgctgcacataagtaacctttccaattctctttacctgttctaatgcaatactggtatttctccacttattttgaagaaattaaagacattgcatttgccatatcaactacaccattgcaccatactttcctgctgtttctggtctgtatccaagcatatttgcttcagggtaacaagttaaataccagggtgacacgagtgacaagtaattagccagctgtaactctagtgtttttgaaggcttgtgttggttagcaggcgtgccaatcatgccggatagcttagaagcgttacactgtctttgtattcgtgaagataaatttggcagacgtggtacaattttttttaataaaaaatgtaaagcagtactagctgtttgcctcgtcgtagaagtagaagggatatattcatttggtgatgcggtatttgtgtaagcaaatggatgttgctaatgcttggcgtgtccgtgtggagaagaagaataaataatccttgcatagctttccggggtcagccgaaaatatgggcaattacaggacgtaagacatttctgtggtcaagtaaatgacgtggcaaattccagtttactttaagggacatatatttgcgtgggggccgtggacggctgacgtggaaatgggccagcaacctttatttgtagtgcttcattatattgcttgctgattctggatctggtcaaatcaaatctggatcgaattcttcacattcacaggttagagcgtactgcgtgtggcgagcagattaaccctctgttgatctggctggcaccacttgactggctaagctaaaatgctcttcttatacaaagtggctgtcaccatcactcatgtaccttgtttttcattttctttgtaagtattttttttggtcactttgttcttgtgggatataatcggcgtgttctttgcaatttgcaaaagaaaagcggggagaatatggcaagaggcaggcacagcacatatactagagaagatgatgattatgatagtgatgtgcttccagtccacaaaccggcctctatccgagctggtggagcgcctgctggtagcctggtagtatgttgtttgtttggcaacccacaattatcaataatacaagtatgtactccttttgccttgactaaacgagacatttcttatacaacgaatctggacatgtaagacatttctgtattctaattattttgggagagagggagtatctatctacatattgctactgctaagctattactactaggagtactccagaatctgatgaagacgattaatccaatccatcctgcaggctgcaggaggacaggagtggagggagacggaccaccacccatgtatctgcatctgtatcattcccagtggcccagatctatcgatatgataatgatgatgatgatgatgatgggaaagacaaattaattattgacttttcaaagcacaccctcatccgcctcgctgaaatctttgaccaggacgacgactactggagcctgcagccgcctgatgcatccaatccaacggtaacaaactgggggacctcttttcttatcttctcttcccttctgttattatagtactagtatactccatgatgaatatcaacggttttagatttcaattctgctagcatgtccaactatcatgcctacatactgagggagtagatagtactttttttttttttgaaaggagtgggagtagatagtactagcagctgtgatatttatttaacagcaaaatgggtgatttctggattcagagtttcagacatttcatatggatacatgttgcttctgtacgtttatggttcggtgacaaaatcactcaatgggtacaaattaacgagcctaacactagtaccaaaaaccaataacctgaacatatatggagtagttgcgaggaaattaaagaacgggttgttagcatagggtgtacatggaattcgagtttaagatactagtttggcatggctgttcaacttggtgaaatgagctttcttcttgagcaggctcccgaatttcttcagcaaagccttcttcttcttatgctggttgtgctgctccttgttgaaagacgacgtcggcccatgaatcagcggtccattcatctgctctacagctgcatcgtctccctgcgactcgatctcctcatcgtcgctcgactcattatcatcgtcgtccctatgcttgcttatgtcatcttctatgatcttgctgttctcaagagtcttcacctccattgctaaagcctcctcctttccatgcttcactatcacctgctgctgctgctgcttcatgatcaccgtctccacttcgacgtgcttaatctcatcctcttgggttctcctgttgctgctgttcacatcatctcgcacattgtccatgggcgagcagatcatcttccggaacatgttgtgctgcttctctgggctcctgatagccgccactccattagccgagtactctcctgctagcttcctagctgtggaggcctctgcaaccagtgaagagagctcatcgatcttcgcttgcgcagcggcctctctcgtccgcaggccgtcgtactctcgtcaatgtcagtagctcctcctccttctccgcaagcgtctccttcaaccttaggctgctgattttctcttcttcggcggtcaggttggcctcggtcatcttggactcgagcagcctcagcttggcctgcagctgagccttgtcatccttggcagcatttgcttcttgctctgctgctttcagtgatcccagcaacttgtccatttccagcttcatcagtagtaccttggatttctctgtgccttttgccgcctcttcttcttcggctttcttcgcagttgcctctgctagtagctttgagagctcgttggcctttgccaaggcagctgtctctctgagacgaaggtcagtgacctcatcattcagagcaagcacttccttctcctttcttgacacaaggtccttgaggcctactgtgctctcggactcatcagctgtttgttgaacgccagtagatgagatgctactaccttctgaattggtgagttcagattgtttcagtttatcaagcagctgggttctctctgccttgagctcctgcacttgcttctctgcagctccaagtgacaccattagactgctcatctctgacttgatagagctcatttcttcttctgatctcctgatcatttctacaaacccggcctctttcgatgcccattcgtcgttggaaatcttggcttctgaacccagcttctcaactgtcttgctgatgcattcaacctcgctcttggattcatcaagcattagctggtacctgtcctgtgcattcttcatctctgccttgagctcggatatctgaagctgtgcactgtccagctctgtctgttttgccagtacacgttccttggcttctcttgcttccgatgacacttcgcgcagcgcagccgctaaatcttcgacggccttcttggccttatccctctcatctctggcaccatcgagctcctgctcaatcctgatcttgtcttgagacagcaggctgatctgcgagttcaccgtcttctcgttggtgacaacctgctgatgtgcttcgttgagcagcttatgttgagaggtcaagcgatcaatggtggcctgcagctgatgcgactccttggttgcaacgtcgaggcgcctgttggtctccaagaagcactccttgtactcgcgcgcttccttctccaaggatgacaccttctctttgagctggacgacctgggattgctcgtgctgcagcatggatttgcattcgtcgaagctgctcgtcagtgactggagcgagtcctcgttggatttgttgagagaggagagttcgtggaggcgagcttgaagcgactctgccttggtcttccactcctgggcggcgaggttggcatcggcctctgccctcttggcgtaggcgatgtcaaccttgaggccatggagaagctgctctgctctgcccacgtcctccttccgagacgcctctgcgttctggagctcggctcgtagcccggaggcctcggactccagcttggcgacgatcgccgtggcctcctctgctttcgtctccagctccgactggaggcgggacacctccgccgccagggtcgccgccttgtcggcgttggcgtcggcgatctgcctggccgtgttcgtggcctcgacggccagtgccagctcgtccttgaccctgccgagctcggcggcgagctcggcgcggcgcaggtcgatggcgtggcacctggcgttccagtcgcgttctttcgtctgcgccaggtcgatggcgagctgctcacgctcgatggacttgaagcgctcgaggtcgagggcctcctcggcggcgctctgagcggcgtgggcgtcatcggcgaggcggcgggcgagggagaggtcgtggaggagctgggccttgtccctgtcgatgacggccaggtgttcccgcgcgttcttgaggtcctcctgcaccgcgttcagctgcgcctgcagcagctgctccgccgccgacgccgccgcgggcctcgcattcgctccgcgcgctttctgcattctcttcgatccaccacatatcaaccgatcaatctaagaaatctataaaaactgaattcgttgatcgatcgatgagaatgcatttgatccaagttagttggggaaacgtacatcgggagttgtggcccgggatgccttgaaggatcgtcgttctggcttgggtatgtccatggaagatttgtcgagcagcgcattcgcattcgcatgcgcattgttggaggtggaagcagctgatgatggcctgacctgctgcagcctagcaactctaggcaccgatgaggaagccctgcagacgatttagctttgatcaccatctatccatcttgttactccaattaagagaatcaaatactagacatgaatacatatctgacgactgactattgatgcagcagcagcagtaataaagctagtattagatgccttaaaattaacacagtgcaaatgcaatgcagggagatgcacacatacttgggcttggatgcttgctgcattttgttggccggccggagcgtacagttttaagttgagagatggagcatgctgcaatgcacacagacaaatgatctctcgtcctatttgttagtatgagctactcctatatgatagtatcgatccatcgatgatatatccaggtccagtatggcaacaatggacgtgctgggctgtttcgtcccttaataattatggcatgcagaccactactctaatgttatacgcatgttgagctggtgatgatcgatacgatcagtgcttttgcctgacgttgatgcccaacactaaacacgattacatcatactctttaactcatggccccatgtttgacacacgtactattcttcttcaaggttttattttgcttgatgatttcttatttaaaataatggcatgccaacacaaacctgaattctaaactctaaaactaaggaattttgtggcttccaagttatggcaactttgaggaataaaaaaaatatagttgttgatgttttatatgtgaggtgtatgaataaatgcagttgcataagatttttgtctttcaacttgggccttattatggtccatttgatcactcagcctgtcgaaatacagctagtcgccccaattgtcttattatcaaagacaccaccaccattagtgaagtgtttgagagcacaagcaactatccagctccaaattaaggttcttatatattactgaatgtgatatttttgtgtccccaaattttggatccataccaagtgtataatataaaacggtatttcttgactataacagatgatttttttttgacaccaacagatgattcgttggttgacagtagtaccaacacagatgcaagtaaaacatgaatctgaattctgaagttgtccgttcaaaaaaaaaaaaaagaattctgaagttgtcgaggaaggagacaaaaaagtgtaagtttacggagtttgataactgggccattggaccgttcgaaaaagataagtgggccattggtatgaggcccagcagataggcataaggcgaggccagcccatggggcagtattcctttctttcaacttttggcagagtccatgcttagtggctaagctaaagcagaggaggacgacagacaaactcaagtgaagactggagatttctttctttctttcattcctttcctcctgcgagtgcgagtgcgatccggggcaaggcaaatccgattccgagctcagaggcatcaggcgtcgagttcgtcgatcgatcgctgcagagaagcagagagagatcgagagagatgtgggtggagattctgtgcgggctgttggcgtacaagatcatccgccgcgtcttcttcgccgactccgacgaccccgcgcacctcgccgacctcgattccgcccactccgacctctgcttcgccctcgcctccaggttccgtctcccgccccctcccctaatcctcccccgatgccctaaatcccctatctccctccctccaggctcgagaagctctactccgcccgctgcttcgtcggcctccgcatccccgaccccgacgccggcgagcgccagcatgtcgacctcgtcctccttaccaacaggtacgtccttcctttcgtccccccgtcttccgccccattagtacctctaccctacatcccctgcttattacagatttcttcaattctatgtacggatttgtaccacctctctactgcacctcacaagttcacaacactagaatcgaccaatccacactggccttcactgtaatttgcataccgcactacaattcatggatcattaatgtgtgcgtttgtatcatccatgttcaattacttgtggggatattgctttgtgcaaccaacttctcaccttctttcctcaacagggaggtcatggtagtggctatccacaacatttctggttttgttgaggtcgataaggatggcaactggacttgccccagtgataagaagaacaagcatggtgttatcccaaacccggtatgtcatttatttccttcactgcctcattatgacccattgccattgcctcttgcagtaaggcaccatgtatattgcaactcttgttttcattcggtgctatactcttgggtgaaaaaacaaaaaacaaaggcaacatacataattaggctccgtttgacattttggtagattatggtcatcttgcttggtgcaacttcttttagacatttcagcgttcggcaaatttcttttctctcgatctttgttgcagatgataactattatgttccgaaaatttggaata

SEQ ID NO: 67653 - DNA, 3264 bp, Oryza sativa
tcttccaaaccataaacatatgtgcatatcaggtcggaatctgatttgggattttgagtgtttgagcgtgcacagttgatagcccttctcatgttgagcattttgttttgctaattgtttcttacattttgttctgtaggtactgcaagtcaatagactggctgccaatcttcaatcgtacttggagaagaggggagcaaaactgcctgatggtcatataactggaaagattgtactgccaaatcccaactgcaggttagttcttcatattgagctatgttctttgtgatcgtacttgcagaatttttctttctgttttttgtttgtctttttattttttaagttttaactatctaacaagtgctccaccaggccttcctatgccatcactcttcaaccagaagttatcttgtacgatcaatggaaagatcttaaagcagattccaaaggtggactttcaacatggattaaaggtgcattcagtggaagcaaaggtgacatgcaagattcgttactccaaaatctacatttcattctcagcacgtcgcctatgtgggacaggtaaagaacatggccatgaacacttaaagcgaacagccaagaagcaatctaaaatttattccgataatcgaatcgcagcctatcacagaacatccgttacctgttagttctgcacaaagatgtagaggctgaggtcaaacttttatagttgatatttccttgtgtaggttggaactcaaaggggacaggaatattcttggtgaattcattgaattcaaaggcaggcacgatgatattcaggccttgaaatgtctgaagagatcaaaagtttgccgattcatagtccagaaatcaactctgtttggaggttttggtaacttttctgcactgtaccttcttgttattctgtttgcgaagcactcctgtgaacgtacatgggtcgaataatactctaaggttgtcagaaaaatgcatttgtttcctggaagctatgctagtacaaaatgaaataagaaatgagaatagatcaactgatatgcacggaaattgcttattgatgtcttgcactaattcatatttgtaaaataaaaggtgatgtcttgcactaattcatatttgtaaaataaaaggtaaattatataattcagtagcagtagatgattctgttgtcataaataaatgagataattagcttgattgacttgctacatttaccttacctggtcgttttgttattgcattgcaggtcggtcaagagtgcaaatattgtattcaccacgagattatcgtgctgaaggaacttcatcctctgaatggaaagagatatcagtgaaacaatatacagaaattctttttcagccattgcactcgaaaaaagttaagaagttcaagctgtcaagtgttgcttctgtgacactgagtgcctagtgagttgaaattttatccacggggtacttcctgttgcagtagtatatagagtaccttcctggcttctgtatgtgctcctcagttaaagtttgtcttgttgtttctgtacaccaacctgtacttactttaagatgtcagttagcatgaaattagaaaaaaatgaatgatttgaatatgcctcttaatcgttgatatttagtttcatatctgtcactggaagcggagtccctatcccttcacagtattgctggtagggattgtcggtctagtttattttgttctttcttcatctatgcgctaaagatgtgagtggtcattttctcttctccggacccacctcattgattcacaagatggacctggaacatttccttgctggccatgtgcttttagtctatgaattcgtatgcatcaagaaaatcgtgtacaaattgtcaaggagttgtgttgttttgggactaagggcagaaagataagagaaatcgtgaactgtaatacatattgtcaacgagtgatgttgtgttgcgactcaagagagggcagagagataggagggacgtttacaatgctatctgtatctgactgactagggtctccgtcagatgtcaaacatgattttattattattatttcccatggtttttgtttaaaggttggtgatcttgacctctttggatagggtatttgatgtttgtcaaagttgtggttaaaccatgataatggatggatacattaaaactgatgtgcaactatatctttctcgtcccttcaacatgactacatcacaaaatggctttgcatagagagttaacacagctgcaaatatattttcctagtgtttgatcacctagggattttgtttgttggtatataagtaatcattgaaatgatcttaccctctgtaagaatggaatacatgtggcagcttggcatgtacaacatgtacatttgaccaaaccaaatttccctccctttagaggagaaagaataaaagaaatagaagaagatacaagaggagtagtacatgtctagttgcacgtgtgatatataaaataaaggaaggcaaatcccctagtttaatttaatttatgtccccgtatacgccactggtgaagtccagcatgagtttgttgagcttctttgtgtggatcctctgtgggatcaccttgagctcatcactgcaatttgcaaacaaataaaaaggtccatattaatcaattgatactaattcatattaattaattaattaatctaatctaaatgacgaagaagaggaagacgatgaaggaacctcggcggcgcagggggtcgcggcgcggcggcggaggagatgagcatctgggcgagcttggcggcgtcctccgggcggcagatggcgttgttgaagcagaggtagcgtccgtaggcggtggggcactcgtaggcggcgatgtgggcgtcggcgaggaagtcgacgtcgacggtgacgaggacgccgtggtcgtacatgtcgggtgcacccttgaggtaagggtggccggcggtgaggccggggccggtgagcaggccggcgttgatggccaccatgtctactcctctgtccattgccagggcccacgccgtcctctccgatagcgtcttggccagagcgtgccacagctgcaattgatttaaacacaatgtcactctcactcactgtgcaattcttcttcttcctaacacaattcatcaataagctataatccgctacttggatggctgtcaatttcatgatccaatgaacaagtaaattattaaaggagtctgatactacctctttttttttaagagacaatccattatatgccactgagtttg

SEQ ID NO: 67654 - DNA, 1814 bp, Oryza sativa
ttaaaaaaaattacaaatataaaaaacaaaaaagttgtgcttaaagtacattagataataaagtaagtaaaaaaatagataataatttttaatttttttaaataagatgaatggtcaaacagtataaacaaaatgtcaaaatcccttatagttttatattataagacggagggagtagatcatcatcatagcctcataggtgggttagtttcttggccataactctagctagctggcaccagtgcgcatacatacatacacacacacacacacacacatatatatatatatatatatatatatatatatatatatatatatatatatatattacatttatattttgctcggagcctccataggagtagttgggtaggtagagtagcaagttgtaaaccagccataatcacatattgagaagaaaagagaagagagagaagaaagcaggctacagatttatagccgactacaacacggactccaaaacattatgtgtgtatgggaggtaggaccgggtattaatggtgtagtatatttttataagtaattattgtataaatgggctattagattagctataaatgatttggagccagtagttggctatactattggacttgctctagtgcttaggggtgaatctgcttaatacttttattttataacggaaataatttacatcttttaatagatctgggcacaccgtttaccaaatctttttttaaaagagaaagagtgttggattgtcttacttttatggaaaaacaacaatgctttcccctaattaatactctctccatctatttttgatagtaatatttcatcttggcacatagaccaaggataagtaattctacttatcattcatttaaatatgctactagtcattcctcgtaaacaagcgattcattaatatttacatttctcaatgtctatgtagtcaatcatgtgtggaagaatgaagagtcatgcattaaatccaagaaagcaattaagatgataatttgttggattgaaatatgcctatcaaaaataaaatttttagatttggaaatatgactatcaaaaatagatggagggagtatttttttagcgagattatcttttgttaatactatacatatgaacataatatataaatataaacataactgtacgtgatatatagtgcgatcacatatatatgcaggtggcagcgagacgggcgggcgaatatcttggccgatcatgagatgagacagcccggtcgatgtcgccgatcgatcgtgtttgtgtgaaagaaacttcacctgaaaactatggcagtatagtagggcgtagcgattgccaattgggcggccaagttacgttacgttgtcagttagcggagaggagcagacggtttgcgcatccatcgtccatcgatcgatcgatgagaggcgtttggaaagaaaaaccagcaaaccgccgtacgtatgtatcaacggacaaccgcgcgcgcggcgggcggtttcgatcacttgccaatatctctggcttctggcgaagcttgcattggctgcttgtgctatattcgatcagccactttcactgtactagtctccatcatctatatattcatcgatccatctgttccaacaaccacttcaattccttcttttctgcttcttttggaatatatacgtacgtcttgctatatattctgcttaattaattgccaccgctatatactctacttgtatatatacttgtatcagagacgatcgatcgagatgcatgcatgcacctgcctgcggtatgctatactagataccaagccaatcgtcgtatgcaga

SEQ ID NO: 67655 - DNA, 3340 bp, Oryza sativa
cacaaatagaattcaataatttttgtgatcttttatgctgtgtgagtttttattagtttgtgtgtacttttgtttattcaggtgtgagtttttgttgagttggtataataattgactgtatctctttcagcaaatgccgggattaaatttcattatctaaaaaataaattgattaaatgtgcatcatagtatattaataaagaagttttttttcttttttttaaaagtttcttttcacatatgtatatatatgcattgcactaggattttttttggtggttcagggtcattgggaccacccctgaatccgcctatgtattgagatgattacaccatacagtatagacaaacatgattttaattacatcatccaagttaaatcatgtatatcggattggcagtcagtattgcactctaaactagcaacaaatatgacatattacctaagttgcccactcgtgacgtacatcattcctccatgtccatggcacctcaagcgacctctattggggcactatccacgcatggttgactgtaaaatagtcgtctggccaagttaggcctcacttgttggggccgctggcttcagcaactcgcgtgttatccattaacacgtttttcgaactgctaataaatgatgtgttttgtataaacttctcatgaataattaaacaaatttatttttaagtttataactaatgctcgattaatcatgcgctaataatttgtttcttttttgaacgcaaactgctatacagtcgtacaaccgatttaaactcagacataaactgggaattaattaactcgaatttaaactgaagatgaataccgcaggtaggaagcgagattaaattaaataatcaccgaaagatatgtatagtacgtaagagtagccaacgaaaccaatcaagcgattgatcgatcgatcgaccgacttgcgctagttcgctgcactttacgtgcgtacgccatatatacgaataattcaccgttaaatgaatcatcaggatatacagatgcaatgcatcgacgatactagtgcccagatgtcacttgttccttgtccacagcgaattcaagactactactagtattcacatgctagctacgagtactttgaactacttacattgacctcacaattcatggagtaataagtaatccctccatcccaatatgtttgacgcagttgactttttaaaaatacttgaccgttcatcttattaaaaaaaatttaagtagttattaattatttttctatcatttgatttattgttaaatatatatacttttatatatacatatagttttacacatttcacaaaagattttaaataagacgaacggttaaacatgtttaaaaaagtcaacggcgttaaacatttagggaaggagggattactagttaagtaacatatccggcctgcgcccgaaaaatatttttttcttccaaatggaccgtccatcgatcgatcggtcggtgcatggagtaatctatacgtcctgcgcatgaaattatggacgtgtcttcttcgccgtattcaactcgtagctgctaccaaaaccatcatgtttaagaccggccggtcaacactctgacggttacctcaaatgaaaaaaaaaaaaaactctctgacggtgcaatattatactggctgcttacatctcaagtccaagtaaagccgtatcgaaactcccatcttaatcaatattattacgtatggaccttttcatactattgacaaggtgcgcgtgatgtatttattatcttgatgatcggatatatttttttcgaatgcgcaaaatcctgatgatcggatagattgtgcactggcataaagcatatcaattacaacttcaccgtgatgccaaattaaaagagatttatattttcatgaaatatataactgaaggtcttcacaattaagtcctcttgatacgacccctcagaacacttactttgtccggctacatttacaacatatttcccatccttcgtattgttcagaaggtgaaacttcagccatatatatccttaccagcactgactattgaatctgaaacaaaaaggtctactgaacttgtttttttgtcttggaacagaagaagggcccaattctttactagatgatctgatgatgaaaagaactgtttccatcgatcagcatgccaccgactaattctaagatgcctccagcatcattcgatctggaaagccataaacaaggtgttactcatattatatcacgattcacaaggtttggagaaattagtcctgttttatggtttggacaaattaacacaaaaacttgtcaacatgcacaacaggaagccgatcgaaaccctgtgtcttttcccactaaaaatgtttatcagaaaacccactaggatagataatgcagttttactagcttgcttagtcgtagtgttttgcagcaaacaaatgctatgcaagtcaacaagatggagatcgagcaagaagtacaagagaaacggtgagctctgaaagcaataaatctaaccaaacaacccgtgatcaacagtataagaacaacatggagacctgaaaaatgaggcaaaaacaatcattggccagtgctgaaagccatacaagtcaatccaaattaaaagctgaaggtatatatcattgacacgctaattcaatgtgttagaacaaggaaggatccgatcgacttcattgtttttgttatgaaaatatatgcgtaacgaatatacgaattttacgtggaaaacccttacgggaaaaaaccacgggcgtagaccggcaatgatcactatagatgaattgatacaaacggaggacatattagactacacaccctccccgtgcggcttacaagcgatacatagagatatcgaggagtactagtgggtaaagacttagagtcatactagggaactaatcctaatagttaagttctattagtaaacttatttgaatatattgtggacccaaaatttggatcacatatttaacaatttttgtgataatatggagcaccaatagagttgtatgcagcgaaatagtattaattattattccttactatagtgaaaagtaactaattaattttgttagatacaccaactgtaactaacacatttcaagaatgtgtagtgaattcatgcatatactgagaaacactcagggggtctttcggctagctccacaagatggtgggatagccggtctgggttcgaagtctcaccccttctaattaattgatattaggtcctttcctactatatattcacttttttttaattcatgcatatactgtactggaggtaattctaattgaagtgagcaactaatgca

SEQ ID NO: 67656 - DNA, 1389 bp, Oryza sativa
ggatcaatggtatataagggaatagccaattttcagtggcatataagggatcagaccaattttcagtagtatataagggattatctctatattttgggatgaaaatagtatccatatatcatccagaaataataataataaatctatttatagtattatcttactgaaagaaagctacgaaagaaagctagctatgtaaaattcgatgaaaaactttccaatataactacacaataaattattgtaattacattgtaataactagcatgtaactagaatataatttatactaacttgcacttatatatcacaaattcccactagcacacaaatagttaccacgacgagaggagaaccatgtgtcccagcttcaattcccgtctagcccacgcgaatcttacctcccctctctcgtcatcacgtatcttgaagtatgtccaatggatgaaaattcaaatgtttaggggagaataactgtcgaattttttttcttttgcaatctaaaatctatacaatttgcgtgataaatctagatcataactctataccaaggtatattaataatatagttgtaaagatattacaatatgtattttatagaattaatccattgtaggctaatgaataaattgtgtcccttccttgttgttggtggctatgcacttcttccatccaaaataaggctattactacactcaagttgtctcgaaatgaaactatctctccacctacccctcatatctttgtttaatttctcattacctactttctcttcccaactaaattacaaccttttcctagtcattttcacctacgtggtacttcttcaattcacataaaaacctccagaaatgcttacagttgtaacaagtagttgtagcttgtattgaagcaaagaccagatttaatccattataaaaaaaaagaactataataattatgttatattttgaactaatgtgattatatttccaaataaattaatttcgctccgaacaaattgcatgggaaacatggtgatgaatagtattatttttgcagaggacgataaatgcatttatctagtataaatatatatatagcggatttggtatatggcatacatacatacatacatacatacatacatacatacatacatacatacatacatacatacatacatacatacatacatacatacatatatatatatatatatatatatatatatatatatatatatatatatatatatatatatatatatatatatatatatatagtgagcataggccaacttggttaaggtttcttgtgtggtgaaacttgtctactcaagtttagtcatagatatgggtggttatatttagggctaattatttgttcaacgataaatgatatacccat

SEQ ID NO: 67657 - DNA, 8323 bp, Oryza sativa
caagatgttgaagaggattgattatcaaagaagatgtttgatcagaaataaatacagaaaatagatagtacaatggagtttagatgaactaacctgttggagcttctgttccatgtcttggaaaatggatatattaccaacatatgaatttctgggcatatgaaataaaaagttagcatgataaggaagacatacctataagctatacagataaattataacacatgtgaatgttgcaagtttgacggcatgccacggtaataagcaaaaccaaaatgtgttaatagatatcacttttcttgttgaaggtatatctatgactaagccattagttaaaaaaactagctacttatggagaggatgggaacaacaatgtcttcaaggactgggaaagcaggtaatatcttatgctttgattaaagaatattgccttcacctatacagggtatctatatcctcactgcacccatcaaaacaatacggtcatgtcgcgcgacatgacagaaatatctgccatctatgtgaaatgtgattaaagcatttgtgctacaaagtgtggaaatatactaaataccatgaatgggcaaaaaaaggggaagattgaaagggtcctcgatacctataggggaagagatttgcattacctatagtctacaaggggcctaatgtagttctgaccaaacatgtaatagtcgaatggttccctgacagctttgtgataaggcggaaaggtaaacggattctgcaaaaggaggaggcagcttggtataaaagggggcataaaagaaaaatgtcagaggaaatcaggaagataatgacaggaggtagaacctctacatcgagcagaacacaatcgaacagggccaccatgtttgaaagcacgatgtcgtgtgcatttggatccctgctctgcataacctgataaggcagagtatccccgtggccatatgagccgatgatctaattgcaattgcagcagatagaaaagaagaaatgttaccgcgtccttgtagttgtagtatagctcttctagattggcagcgacatctgcaggcagcttccctttctccacttcctttctgatatgcaaaatgagctctgcacatgacaggaatcgagaagtgagcagagcacctcgtggtttcatctcatctagattctagagcatctaaaggtagagtgattttctaggtccaatatatccaaggcacaactaatataaggataataataatcgagcaattcaccaaccaaccatgtccatgcatcgaggattccaatgcgacccccatactaagtagcaatgcgaatgcgaatgcgaatggagtttgtgagattgggaaatggaggggagagaaccttgctcgttgcgcgcgtcgaggaggggagaggggcccaccacctcggaggcgaggacggcgcccttggccggcacccgcggccctcgggccgccggcctccaggcggccttggcttcgaggcggagggcgccgcggcgggagcagcagagcctcgccggcgcgggcaggatggcggtccacgccggcgacggcgaggaggcgagcggcggcgcctgcatagaagaagcttctagaaacctaatccgaaagggggttgttaccctagtggggactgggttgggagtggtcgccggagcgcttcgggatttgtgccaaacccaccctccatctccatctccatctccatctccagcccaattatttctttttctattttctcttgtatatattttcacttccgttgtatcattgcctattgtccccctacgatatcaaaaacgaactgtatcatacgatttgttttcgtagttcttttattagatacggaaacgaatacaaattaccttgaatacaaataagatcgaacacaaatacagaaacaaatatttatcagaacacgaaaccacagacaaataccataatatattttaagctcattttatacacaaagtttgatcataaactaaacatgtacaatattattggtataaatacatgtctaactggtattacaacacataatacatatagtatattttataaaaaaatatttaaaagtttaaataaaattattagtgtggactaatgttaaaagactagaactagagctagaacgaaatggggtatgtttttatgccttcagcgaatatccaaatattattgtgcaccggatatctgtattattatttatagaaaaagtgctcgtgcgttgcaatgggaaaaaaactaatgttatgataatgattatagttattttataattccatgggagttatatgagatagttctaaacataaacaatgaattaaatctatacctaaccctaaattcattcctcttctctcccaccgagagcgatggcggcggcacatttccccacctgtgcagcgaaataatatgatatagttcgatttaatttttattaaattaaccatgattaataacactctttgaaatttgttgttggaattttcggaacttaattgctaattttgacaatacaaacatcatttcagcatttatttaaataaaaatcccaatttctctatgggccattttcagtcgatttactatctcagcccgcaaatcaagtctaatttgcctcccccaactcctcctctgattgcgttgtagacacttgatggcagggccatcaagtgtgtgcagcccggcgatggaggcggcccgaagcggaggtgatctgagccattcgatttgatagatggcttggatcgcctgcgcaccattgaagatgcatgtgcattggaaaccctaaccctcacgttcccccgttctcgatcctgatcctttctcccagcaatgagcgagcggcggtggcggcggcactctctcattccgcgtgcgacagcagcggcggcggtgcccttcccccatcgcgagcgacggcgtcggtttcccctaggaggatccgatggcgttggtggctgcaagtggcggcggcgctgccctcccctaccgcgagtgacagcgtcagcttcccccgggtggattcggcggcgatggtgacttcccacggacggattcagcggcgtcggcggcttcccacggggttgagataagatttgtgcgctttttattatttttcatgttccttttctctttctttggattgtccaattggatttcaatcggatttacggatgaaaaaaattcacggacaacggaagcaaattgaatcggacttttttttgcccgatttttttcaccctgtttttcacgtacggaatcggattcgatttgttttttttattgtgtcgcattttttttaccgcatcacatataatttgattcgatttcgtttcgcccttttttcacggacggacaatggaaacacttctaattttttaagtagtagagatagagatacctatcgaaaactatgataccatattcatattcatatttgagaaaagaatatttgtatctgtatccgtatctagactatccaaaaattatacgcacagaatggtatccatatttgtttttcaccagagcggctgaaaactatatgcttcgttttcactggaccggctgaaaactatccgcttcgttttttctcctagttatctccacttatctactatattcattctgattttcctgataaaacactcttgagtttatggtaaatgcagaaagtttaagtttatatacacaaggtaattgaaacatgtacttaaaaaaatacagtatatttttaatggttgaaggaacaactatgaggaatattttagtactctcgttatcttggtcgcttgggacatttggaaatatagaaccgattgtgctttttcaatattgcaactcctagtgtagcggttgtcactcaagatgtggttaatgaaggtgcactttgatgcttgactagagcatcatagctctaggagaagttggctctagctgtgtgtttagatccaaagtttttcttcaaacttctaactttttcatcacattaaaactttcatacacacataaacttcaaaaatttccatcacatcatttcaatttcaaccaaacttttaattttggcgtgaactaaacacaaactctatagcccttttgtgtcgtagggtgtttgtttgcagttgtattttcttgttatattttttgttgcaagacatgttggtgttaggggaagggggtttctaattccgcaccctttgttattttctatcttgcttaatatataaaatgatgtgtgtatcttatacatgttaaaaaaaatataaacgagcagtaaaatcatgtctccagctatctgaataaaaaacgatattccctcaaatatttgtagaaggaaggatttaaatccaggtaggcttgcacatcaccaccagatccaaggagtcccctcttatccggtacacatatagacctaaattaatcaaaaagcctactaaataagcattgttaaattttgataaaagcatatacgtaaataatgtaagttgctacttctattttatattataagacgctttcattttctttatttgaccaagttcataaaaaatataaacgttttcaataataaacaaacatcgtatcaaaatatattcaatgtttggtttaactaaactaatttggggttataaaaatgattatatttctctataaatttgattaaaattttaaaaaaatgacaaatcgatttatatttagaacggatcggaggggccgggtatgcgaaattggtaaacggtacatcgacaaggcatgttttccatggtcgatggcaagctagagcctagaggtcatggtgattgtaacggagactgtaacggtgattctcatgttataagccattcacaccaatttctagctagtttcctatgcaagatatattgaatcaaacgactaaaaatcatgcactgcaggttagaactgacttgacaattacaaatgaattgccataccgcaagtcattcgctatcaaggatttaagctcaccatatagtcaatcataatgacttgaaaggtcccattcacaaagtcattatgtaaactatactcatttgatagtaacctttttttaaaaaaaaaatcagagacattctagaatctaatatacaaccaagataaaaaataaagcagccagccaactttttttgagaatttgttgttgatttttccccctcagccgcggagtttaggaggaggaaaatcagctacaaagtgctcttctagactttgaaagacgatacgtattggatctatcagtaaaaaaagtggaaacatgtgtttttgaaactccatcaggtcaggtgcaaatatatactacatcaggtattatatagcgtgagtgtttaggcactaataaaaaactaatcagttagtaaaccgcgagacgaatttattaaacctaattaatccatcattagcaagtgtttattgtagcaccacattgtcaaatcatacaacagttaaacttaggccctgtttttttcagcttaagattattataatctagattattgagtcagattactataagctagattgttataatctgtagtagaataagctgttagttgtttctttcctagattattagagcctagattattgggtttgcaagtctaaatagggagtggggtggcatgatgggtaatttttcacccaataatctagaaaaagctcacctaaatgagcttatcaaattatagcaagctgggtttcatactataataagctacttcaataagttgtctgtttctttcagcttactcctaataatctggattataataatcccaagctgaaagaaatagggccttaaaagattcgtctcttaaattagtcgcaatctgtgtaattaattatttttagtctatatttaatacttgatacatatgttaaacgtttggtgtgatagggtaaaattttttttggttgagatctattcagggcctaactgttcaaaaattttcacaatttgaccatttgcaaaaactatttttacaaatgaaccgtccgcaaaacttatttcaaaaataacccttttgttcagcgccaaatcatgtggcgctgagcttagacacctcaacgccaaatagcgtggcgctgaatatgcgttggcatgctgacttagtctcccatccgcgatggcacgacattcagcgccggttgacatggcactgaggtatctaagttcagcgccgagtgatttggcgctgacaaaaaaaaaaggtcatttttaaaataagttttgacggcggttcatttataaaaatggtttttgcaagggtcaaattgtgaaatttttagctaactgttggtatataaacataaagactagaaagcgtcttcaaaggaagttactccgtggccacgtcaccggtaatctaataatgcacgcaaaagaaacaaaaactaagaagtctgaactagtagcagaatactagatggacggctggcgttggagcagagaccgttgactacagatgtgaaccgtcggatggtggctgcctccctcacgacgtccccatttttgcttacgcggcaagaaagaagggaaggcaacttggcatccaaggaagatgcgcgccaaacgctcaccgccagcgtggccccgcgtgcgggtgggcccacatgtcggtgagcggggtgtagggcgtgagcggtaggcgaagtaggaggatgggacacgacaaaggcgtggacctcgcggcccaataattccaccgccgcacgcctctctcccttcctcccctccttccttcctccccgcctcccgctcgttgccttcgccgccgcctcacgccgccgtgatttgagttaggtttttttttttttttgctctgaccagacttgccggcgaaggaaccaccggcgggcaccgcctctcctcggcaatcgttgccggggataaagtggggtcgttaagggagcggtaggtttgggggtttgggattatagatcgaggaagatgaagcaatccatatcgtctatcatctttgtatctactcacgctgctgctgctaactataggtaattattatccatcgatcgattcgtcaccctaatcctcccttcatctggatctgctttttttgtttattgtttttagcaaattttttcgtctccctttccaatttattttattttgtgccagccgatttaggtagatttaagattccctacctgtatacttccttcccaatttattttattttttattttgtccagccgatttaggtagatttaaaattccccacctatatacttgtacgattgatttgctataaacttaatttttctacttatcatatatgaattcgcgttagactcctcttaaatcactattttagtcaaggggttgcccctgtctatgcttgtcagttttcgatgttaaagttaactgaataattctatgaagttccgatgaattttgtgtcatgctgtatataactttggtaatttccgcaacatgctagtttcattcaaaactgggaatgaacagccccacatgctagttcgtcgccacacaatcacgctgaaggaaattttcttgttggtgtttgtcttgtatttttttttctccaataatctattcctactgcctaaagtaccacacaaactacgtttatgctagtaacagtggctattgttttgagcgactttggcatgcagtctgtcgtattgatgatttaaaatattgtgtttttgaagtgttctctaatatctggctttcattttcaggatcatttcgcttctgcctctttctgacccgactctttttggtttttgcctcgtcgataatgaacttgagtacactcagaagcttgcctattagcttagtgtaaatagtaggcttgttggagtttagtttgttagaaattattagtctctggttcatttcagctagcaaccatggctgcgatgaacgaaaaggtattggataaatgtggaagaaacataagtagcctcaagagaaagcgggacaacccagctgcacgttgcgctgatgccggcaacacctctaaattgcataagcatcccgccgataactctgttgttaggttttatgttgatgaaggtcacaaggcaaagatcaagtgccatttcaaaatgcagattatacagagttatcagaatttcatgactagtgctttacctaagcgaattctgcttcgtcaaggtggtgaatggaaagactttccaaagcaaattgtcaagcttgcccacagtgattttaggactaagaagacaatcacagaaggtgaacaccagacccatctttttttgctggattttgtgcacatgacattcatagactcaaa

SEQ ID NO: 67658 - DNA, 1035 bp, Oryza sativa
ctttggaacatcagaaagttcagcagaaagctcgaattttgaatctagcactgatgatgtttccagccctaagagagccaaggctgagaggagtgtcgcaggaaacaaaactggtggtgtcaaagaaactattggagagaatgagccacacgccttgctgcctattccctgcagatctctaccacaagataagctgggtgaccattcacgtgttcaactagctatttctgctgttcagaaattgttgctgcagggtctgggcactgttcttggttccaaggacatcgttgggatctacagaacaccagcagtagataaccataaagaatttcgttataatcttttcaaaaagcaggcagagcatactaaatgtaagcgtggcaatgcaaatgtccgctatgcctggcttgcttgctcaaaagatgctgtggatgaaatgatgttgaatggtgtcatgcactttgagaagactgttaagtgcccagactacggaattggcacaatccttgctccagcaaattgctccaatacctggtatgctcctgatctatgaatcatccagtgggccaaacctgttgtgattataatgatcatctaagcctgctattgatacttccagtctgtttttttcttatcttttagataaattgttgctcacatgttgttaatattactgacatttttcatttatttgctgttcacatgtttttttttcttatgatatcatcaaattactacttcaattatatatttcttttgttcccaagtttttattttcctaaccattgcgaaattcaatatttgtattactttctgcagtgtgaattactctgatgttgatgaaaatggcattgtccatatgatgttgtgccgtgttgtaatggggaacgtagaaatagttcaccatggatctaagcagcatcggcctagtaacgagtatttcgatagtggtgtagatgacattaaaaaccctcaacattacattgtgtgggatatgaatgtgaatagtcacatctattctggggctgcaggaat

SEQ ID NO: 67659 - DNA, 847 bp, Oryza sativa
tccagtaagtcatttatttactacttaatgtgtttcacattctttaacatggccaaaatttcatgattgtattacactcatccaaaacagggagtaacagatccaatgctttatatcgggatgctcttcagcatgtttgcttggcatgtggaagatcattatttgtacaggtataaattctcggttctccatggttactctttcttttttgctcgtaattaatactggtgttctgacattttattcatatgaccagcatcaattaccatcattgtggggcatttaagacatggtatggcataccgggtgatgctgctcctgggtttgaaaaggtggctagccagtttgtatacaacaaggatattttggttggtgaaggagaggatgcagcatttgatgttctcttggggaagacaacaatgttccccccaaatgtcttgttagaccacaacgttcctgtttataaagctgtgcaaaaacctggggagtttgtcattactttccctcgttcctaccacgcgggtttcagccacggtatgtatctttcagtttgtgcatgtgttataacgccactatcatatgcatagtattctaaggaatgtttcaactacccaggcttcaattgtggcgaggctgtcaactttgctatcagtgactggtttcctctgggttctgtggccagcagacgctacgcgcttctgaacagaacacccttgcttgcacacgaggagttactttgccgttctgcagtgcttctgtcccacaaactgttaaacagcgacccaaaatccctcaataaatctgagcatccacattcacagcgttgtttgaagtcttgctttgtgca

SEQ ID NO: 67660 - DNA, 2513 bp, Oryza sativa
cagctgtggaatacagtggaaattcagattctgaatctgaaatatttcgagtcaagcgcaggtctggcgtatcagtaaagcctgcatctgatgccaagacatcaaacttgtctgatcaacaggtacgttaaattttcatcttttacacccctttggcttatcatcaacttttaggtactccctccggttctaaattaattgacgttttggacaaggttgagatcaattttttataactttgaccatcaataactttaaaaatatttagtttaaagaaactaaaacaacatatatagatttgtcttttaaagcactataataaaagtaaacatgtatttatttattatatatattatagtagaaaaataaggtcaaagatatatcttgtagaccgtgtcattgtccaaaatgtcaattaaaatggaaccggagggagtaattgcactgtttaagggaaaatacttcatgtaagaataaatgacatgctatataaatggccaggcatctccagttgtcgaggtcatttgatagataataatgggcaatcatgtcataaataaataagttgcagctctagttatgtattaattaagttcctgtaccattttacaccaaggtccaagggtctttatatgaaggatgacatacgggcccatagcatttagttgtcctattttagatagtgcttactcttggttctgatgtaaaatactggaatcaggttctcagccggttgaaaaaggtgcgccctgaaatacaacagcacaataagcgaccagaagactatggtcactgttcagttccctcaggtcgtatgagtatgaagaatttgaattcatcctcttcatgtggtgaagaacactgtagtatgaagcggcgtcagttggagactcagcaggatgagagcagttattctgcaaagcagaagtcgtactcgtatccatccaccagctattctttccgaggagagtttgtggaaatgagtagagatgctgctgcagaagtccgaccaaagcgactgaaaatccggctaccttcttctagcacgaacagagtggttgagcagggcagttcagggcaaagatttacaagggatgacaagtcgcttggttgttggcctgcaatttagaatttagaaaaaaatgctgacgcaggtgctaacctctgatggagataaagatttccttgtttaggtggggctgttgactacacgaaatgatagggctgggatggatcgatgaggttgaatataaatgattagcacagaagctgactgactttagaaggctggttaatcgattctttgtgcagcagtgcctccaatttgaggcacatctaggcacggttagaagagacagacacatgacgattcttgttgctggaggttctgggtcactgctttgctgctgtttgatgcctgcactgcaagtgacgtacacacactataggacctcgctctaccctttgattatatctctctatttttcttcttctttgtcagcaaccttagctgctgctactctatagctaactgtattctttcatacgcttgttccatcaagttaatctgctgcttaatgccattgattcaatagtgaatcatcgttctttctggatggaatgcaaatatgcaatggtatggaatgatgtttggtggtgactgagatgttgcaattgaattttcccaaactgtgatgatgcagcaaggtaggctagggtaggcatcatctcatgtgagggaatttaggccttgtttagttcctttttttttttcaaaaaacgttacattgaatcttttaagcttaattagtctaatgatggattaattaagcttaataaattcgtctcgtggtttccagacgagttatgaaattagtttttttattcgtgtctgaaaaccctttccgacatctggtcaaatagtcaaatgtccgatatgacacataaaaattaattttcttttcgcgaagtaaacacaccctcgctacaatgtaaggttggctcgtagtgtctgtcgcacggtgttgcatgttactgcaacgtactgtacaaggccaggccaggcccggcccagcccaagaaagagagggaagtgagagagagatggagggagtcatcttcttcctcctgcggtggcggtgctgcagctgagcctgctgcactcctcaccggctgctgattgtgactgtgagtcatgttggcctccacttgcttctccgccccgccgccctcctcctcctccccgtcaatcccgacccacctcgccactctctgctgctgcttcaggcctcccgctcgcccaccttggcctcgctctcttcttcttcttggtgccttcccaccgccgacccgccccctcccccgcgcctccgtctcgtcatcgaccgccccagcgaaagactacgaggcaagcaaagcaacctgctcttctctccacatactagtatttcatcttcttgcttgcttgctcttctgctgtttagtttatctatctacgcgggtcacagtctctg

SEQ ID NO: 67661 - DNA, 1343 bp, Oryza sativa
tgtatttgttgacgtcgatgatacgtctctgttggtcagagccaagtcggatgggacactgcggactttgatcaatgttaaacaactctttgataggattaagtcttctgagactatatggtatgcaccagtcatttactagcttgctcttgtagaggttttaagaaagttgaccaattctatgttcatcttgcaggttcattgatgaggatcaattggtagtgaatctaaagaaagttgagcaagagctgaaatggcccgacattgatgaatcttgggaatcccttacttctggaatcactcagcttttgacagggattagtgttcatattgttggtgattccacagatataaacgaggcagttgctaaagaaatagctgagggaattgggtatgtgcatctcatttcttaatgattcaaactgcaatttgaattctgccattctggtttcttttcaaccttctagtttatactatacaagtgcaaatggtagttcattagaatgagatttatatagttacatactgagtatagatcaggtatccttttacaatatttgctaccatgcatgaacatatacaattcattgctagtttatcgcatataaggcccctgaaatatatttgctggttgtacctttgcagttaccttccagtctgcacaagtgagctgctagaaagtgccaccgaaaagtctattgacaaatgtaaaaattatcgcctcatttctgttgataaaagttgcaacaaccatgttgttttacaggcatcagaagttgttatgtgtagttcatactgttacagtgaattgacaaaagtgctgttatttcttgtagggttggcttcggaaggagtggattcggtagcagaagctgaatgtgttgtgctggaaagccttagcaggttgcttttgtgggctactcctagtttgttacctttggttgatgtcttgctcagtatgcttaaaagactatttctccctcgcagccatgttcgtacagtcgtagcaactctggggggaaagcaaggagcagctagcagatttgataaatggcagtatcttcatgctggatttacggtttggttgtcggtctccgatgccagcggtaaggaaactaggaaaggaaggctagcattgttctgttcctagtacactactactatatatgtacataatgaagtccattaatctccagaggttactactcctagttactttacctttgatgaggatgtcatatgtacatagatgaagcttctgccaaagaagaggcccgtagaagtgtgagctcgggaaatgttgcgtacgcgaaagctgatgtagagtgaagcttggtggatgg

SEQ ID NO: 67662 - DNA, 2833 bp, Oryza sativa
cgcgccctaccgggacgagctccgcgcccttctggtgggcctggacgacgccgccgtgccgccgcggctgttcgtggacggccggtatctgggcggcgccaacgaggtggtcaccctgcacgagcaggcgcgcctccgcccggtgctccgccgcgcgccacgccgcggcgcgggcgacgccgcgtgcgccgtctgcggcggcgcctggttcgtcgtctgcggcgcgtgcagcggcagtcataggctctatgacgccgccgccgccgccggcggccgcgtgccgtgtaccggatgcaacgagaacggactcgtgccatgccctctctgcagctgaagctgaaccggagctcattcttgcaagcactgcatgtaaaatcaattttttttttgtcatgtcatcaggatcaggagaaattcttttgattgttttatgtaatttatcatgtgtaatctatctccaccaaccaaattaagcaacaaatcagaggctccagatcgagctttgtcacctcgaggttgaattgattgctcccttctttcaaaaacaggctcttgaacacatcaaccgggtattgcctactagtagtagagtactagtaatttcaccactgcatccaggggaattgcctggttgtgagtacagagaaccaaggaaatgaaatggacttctcaaagttatctcttttttttttatgttgattcaattcataaagcaaaagtgtgtctatttgttagtaaaacagattaaataaattctttgatgacctcacttttccatctccctccctctccaacttaccacagacgttgacgctttctgagaagactggcatggcctcctcattcctcaacaatcaaacctctactagtaattcttcacaagtcaactgctttttggttcttgtccaagtttaatacgtagtagtgatcctcagaggttgtcttaaatacgttttgtcatggtttcttagaagatgctttccttttatttactcctgccattcccaaatgaaagtcgttttagccatttcaactcttttctggagcttctaccaccgtcccgtagtttcgtcttttcttccatttatgccattgttaaaaccatgttcagttatcatctaagctgaacatgcctatgaggattcttaagctgtgaattttgcttcttttttttttacaacttgtgttaaaaatcaaggatccaacggggccatcgtttcgcttattctcggaataagcggaacggcatatttgcaaataaaaaataatttgtgaataaaacttttatatatgttcttagcgatctaaaaacaaaggctgaaaataaacttcgataaaaaaaactcaaaattagctacaaatttaaggttgaaaatttaaattttggctgataaacataagcacaaacgaaaagatgataccataaaatatttactcttacatctcataattatactttttttggcgtgaatttaatggataattgtaactctgcttctctcgcttgagtgggccttgttacgagacttggagtgaatcttcctagattttgcaagagtatttggaacatgtctgcatcagaaactgaaatcaggaggttcctgggtggattatgacatgtaactaattaaaatctcagagaaagagccaacattgtgacactgacacctacattaacatagaaacttttttttgtgaccttttgcaaggttcaattacacctaattaacctgatgtagagcttcctcaccatatatgaaatgtttcttttccaagaactgagttagtcaatggctcctaaaaaaaatgaactcgaagaaacaggcaatgcaaaggaaagacctcggcagtcacccttacataaggttttcaaagagtcatgagaaattaaactgtaactttcgtcgaaacgactccaattgagttcacccgagactgtgactccgtccagtgtccacattgctcacaagtagccaaagtaaccgcgtgtgagaagagatggtagacaacatattagtcattgtttatggaggaataatctgaatattctctcccaatactccacccaatccctttagacaacttcattgttaagggagacatttgtgatgcatttcgcattggatactggtgtaattcaatcgaagaaatgggggaaaacttcacacgattgatgcaaattaaagcattacaattgggaaggaaattaatctagcaaagtaattgaaaaattttgcaccatttcacccgcgaaataaagttgagcttctctgtctctctggtaatcctacgtcgataaatgctctgcaaatcctgatgagtaaattaaccggcggcggaggcggtggcggtggcggaggaagcggcggggcggctcgtccgcggcggcattgggcggcagccaggcttgggaagcggcggcaacggcgacagcccgccgcggcacagcgggcaccgccggtgcttgcggagccagcggtcgatgcatcccgcgtggaagaagtggccgcactgcaccacccgcacctcgtcggcgccggcgtactccgactggcagtacgcgcacctgtcctccccttgctcctcagccgccgccgccgcccgcgacgacgacgacgccttcttggccgccgccgccgccgcctgctcgtacgtcatgagcgtggcggccccgagcgcgcgctccacgtcgtccacccgcgccgctgccctcttcctccaccggccgccggggaacgcgccggcggcgagcacgacgacgaccgcccccacggccaccaccccgacgagctccacgcgaagcgccgcgtcggggtccatccgcgccaaaccg

SEQ ID NO: 67663 - DNA, 10947 bp, Oryza sativa
gttgtgaatttccctctgcctagcctagtagctttgtttgccgtacgacgtgcgtgtgggcaagcctgttacggcaacgcttaaacaaaaagctttatttaattaatcttggtttagttatgctaattatctgtactgtttcctacgataagttgtttgtgtttttttacaagtttgactgaatttatagaaaaatatagtagtatttttaacacagaagaaacatactattaaaatataattaatgctaaattaaatgaaattaatttgatattttagatgttgctaaattttttagataacaattactacattcctttttcaagtagataacaccgttggcttttgaaatgatgttttatcttattaaaaaacttagtgtaaatatgctaagatataagttatactgcaagtttattcaatgataaaacatgtcacaacaaaataaataatatttatataaatatgttgaatgagatgaaagtatgagataagagacggtagacaagagataattagtcattgttaagtaatatttatataaatatgttgaataatctgaatattctcttccaatacgccgcccaattcctggagacaacttcagtgttaaggagacagtaggaataataaatattggggaattgaaaatttcacacgattgatgcaaaattaaagcattacaattggaaagaaaatgtagagaagaaatcgaaaactttgacgccaataatttcacccgggaaatgacgtgcccaagttcagctcactctgtctctagctcgtaatcctctaccggcctcaataatccaaaacaaaatgagatctgcaaaatcctgataagtaattagccgacgacaacggtggcggcagcggcggcggacacggcggggcggctcgtccgcggcggcagccagggttgggaagcggcggcaacgacgacagcacggcgcggcacagcgggcaattccgcttctcccggagccaaccgtcgacgcaccccgcgtggaagaaatggctgcaccgcaccacccgccgcaccttgtcggcgccggagtattcctgacagcagatcgcgcacgtgtccgctccctccgccgctgcccctgccgccggcgaagacgacgacgccgccgccgcctgctcgtacgtcgtgaccgtggtggcgcccccgagcgcgctctcgacatcgtcgtcgtcgtcgcccacctgcgccctcttcctccaccgggcggccgggaacgcggcggcgcaaccgcacgcccccgaggcggcggcggcgaggaggaagacgaccgcccccacggccaccaccccgacgaccacgaggtgaaccgcctcctcggtgtccatgacgtccatcatcccgccacaccggcgtacgcgagcaaacctgcagggcgcgttcgcgccgcggccgccgcgtcgtctccgtgtggggcgcgcgctccgcgttcgcggtcgcggcgaggcagaggcttctgggcgtggcgcactcgcggcgagcgccttcttaataagctcgagaagagttgtgataggctagcttcttcttggccaagtcagctgcccgcgacgcgaccacgagcgagagagaaagcgcgggggcggttggggttggggtttctcagaatctttcttggaaagccttgttttttttatgttttttttttctttttggacactgcctagccttgttgccgtggatggggaagctaaataaggtctcgtttgaatcgcacgaataaaaaaaaggaaaaggctacacgtacgaaacttcttttacgaagcatgtacgaagaaaaggtacgggccgtgcagcctaccttttcaggctatacacggtaatcctcttacgagtattaagcacataaacaatacagacgtggtttcgctattttccaaatgatatttttattttgctacaaatttatgatactgagaaaaatttatacatagcatgtatgtgtccaatctcaaaacgagcaaatcaaattatttcattctcatagtacgtaccatcgactactacacaactaaccattgtcctttgcaacatcgaagtgaataggtagtatatcaagcaagtatatatatcgtattgtggttttagctgagcgtatagtggccacctccgcgatggctacgtccaatcgatattttctcctgcggtcctgcctaaatgggcataggtttgattgagattattctatccttgctctctacacctttgctcaagctaagctacgaacgagcagcatgatactgaatgtgtctattttggaatgggtatttgttttttttccccctactagaagaatccagtgtgcttattgataatggggtgtggcctttggtaggcttttagtggtgtggtcaccaaagtcacgtacgtaaggtagttttcgtacaagcttcgtatgaatttcttcgtgtgtatagcaaggtttaaaaaaacgaatgaatcggaaaaacacatgattccaacaggaatggaaatataaaacagaacttgcaaaacacagaaaaaagacagcaatgaccgtttgattagactatagaaaaaacacaaaaatcggatgagatagatagattcaaatgaaatttttcaagagctgtgagctcttattttctcaaaatctctataagattatccatttcataggaatttcaagaatctggatagaattgacctttagttcaaaggcattcatacaaaatttttttctatagaattgaaatcccataaaatttctaggattttccccatatgaaggggcacctaagcctgttacgccaacgcttaaacaaacaaaagcttctctttaattaatcctggttagttatgttaatcatgatgtgttagtgcttgtttagcttcttaattaatgttggtctctatcccgtgaggtgagaccgtgaggccccactggaggaaaagcttgggggcacatttttgcattgtttcctctttttgtgttttcttttgagtttgtaatcgtcttgtttgtagaacgcgtccaagtctacaagtccagtcattttaattattgacttgattattgcaaagttttctggatgagcagctgaacttcacgcgtcgaaggctctgtttgttctgggggacagaggcgattgtgtctcgtttccgcgcgcacgcttttcaaactactaaacggtgtcttttttgcaaaaaaatttaattatgaaagttgctttaaaaaatcatattaatccatttttgaaatttaaaatagttaatactcaattaatcatgagttaatggctcacctcgttttgcgtatctccaaatctcctcaatccccttcttctcaaacacaccctaagcctgtgttcgagcgcaggagaaagagagaaagatagttttgttttctgcgcgcacgcttcccgaactactaaacggtgtgttttttgcaaacaatttctatagaaaagttgctttaaaaaatcatattaatctatttttgaagtttaaaataattaatactcaattaatcatgtgctaatggctcacctcgttttacgtatcttcctaatctcctcaatcccctctttctcaaacacaccctaaggctcttctcgtcattgtgaaatggggtcaaaacacagtcaaagtagtgggacacgagtttgagggttttctttcttaaaactgtggcaaccaagtttgaaacctaacccaattaatggctctctgtttgatattgtattgattggaatgatagtggaacaaacgactgaaatatagtgaagtgtaggataacaaattatctctactattttaaagaggtacttgtcccacttcttcataaaagccgttcccttccatctcatcttccacttcaaagtaaaaacattttctctcccgtaaaaatcattcaccctaaaaaacagacttcttaaacaaaccaacctatataaaaacaacctcatcaatccaaatcatcagtgagcagcaccgcataagacattcatccgaatcatcccgagaagaacccatgtcttgtcgtcttacataatgatactagtacagtactacccatcgttaacactcaccttaacgacttcctgtcagatccgaatatcttgtagtacatttgcagcatattttacgcctcctactcctgtgtgatttcttttttcctttgctttattttctcagctatgtccattctacgtgtaaaatgactaatatgtatgtgtggccaatcaataagaggaaaaaatggttcgccaaaactcctcaatttggatgcacagcaccaatttttccatcaagtgacggcgcaaggttcctaaatacccgttgattttgattttttttataaacgttcgaccatttatcttattcattctttttgtaaatataaaaaaaataaaattaagtctagctaaaagaacattgataaatcaattcaaaaatttttaaataaaaaaagtgatcttatattgaaaagttaacagcgtcgtatattaaaatgagaggagtaacaaaataaagttgcagcttaattggaatgacgacatacacactcaaaatcgacggtcttgggttttcacatggataatattggattatccttggccctcacaatcgaacagagcatgacggttctaacttctagtatgcactgtcatcgccaaaccaactgctaaatggcgagcgtggtcattaatttcctcggagaaaaaaaaagttactactccaaacgagtcagtttcgagtaacttgtggtttttaaatccaaggacttaactttattctacactaatttagagtattaaatatagattacttacaaaactaattacataaataaaagctaatttgtgagacaattttttaagcctaattaatccataattagagaatgtttactgtagcatcacataggctaattcaatagattcgtctcgcgaattagttcaagattataaatagattttattaatagtctatatttaatatttataattaatatcaaacatccgatgtgatagagacttagaagttttagtcccatctaaacaacatggccttatttcctccaaacgagacagtttcgacgccataattgtttcctcggggccatttttactgcagtctgcagagcagttaccgccgtcgacgtgaagttgccagccatggaaggggcgtgcctccgcctcgtcgtgaacccgcagcaaccgacgacgctcctcgccgtcttcctcctcctcctcgtggccgccgccgtcgcgccgccgcacgtcctcgccgccgaccacgtcgtggggggctccatctggtccatccctcccaggcccggcctgtacagagcctgggccgacaaccggacgttcgtcgccggcgacaacctcggtgagcacaccacatacgcacatccaaaatgtccaatcatcaccagtatttattcaattattctggtggatggataatacagtacgtgttgctactacattttgctgggtggtgcagtgttcaggttcgagacggggatgtacaacgtggtgcaggtggggaggcgggagttcgacgactgcaccgccgacgacccctaccgggactggaccgacggccccgccgtcgtcacgctcggctccgccgccgtccgctacttcatatgcaccgtcggcaactactgctccctcggcgtcaaggtgtacgtcgcctcccagaatgcgccctagatgaaccattccgctttgcttcttctgcagtttctcattgatccatatcacagtttctgatccatcatatcatcatcattggtgttcgtaaccattaaccatttcgctatccattcagtatcaaactatttccaagaaagcaatgtgtactctgtgagataacagaaaccatgaaaacaacaaaggatgaacagcaaaggaagaaatgcatatttagatgcacaactctacgagtctcacggtgcaagcatagccatctgaccacaaaaaatgttgagccactgcacacggtgcagtgtcagttgtagcattcacaacataccgagtttctttttaggaggtaaaactctacgagtctcacagcatagtaaaacgtagccagctattactagatacgagtagcattttttaagtcgcaaacaaaagggatacagtcccggcttaaggggtgtaaatcagcttcactatcttcatgttcgccgcaacgggaaacagagcacaatcatctttgggtccaaaaatttacggcaaacctttgcgacgacgttgatttgtgaaccaatgacgagtttcctagatgacatactctgcttactgttgcgcgcactgaactctctgggcacctccaggcatctcatcgtcctcatcatacgcctcctgagcagcttgggctttcctgcgcatctcttcctcaatgttgttgacatcgtgcatcgtggtctcctcgcattcatctatctccatttctgtcagctgggatgcaggcttcggtggaagcacagcctcgagagccttgcattgttcaggcgccagggaatcagggaactccaccgtgaaatgaatgtagagcttccccttcatgaaaggcctctggtacattggcattccctcatcgtttattgccttgaattggtctgctcaaatatatgagacaaggattaccgacaagtacagttgcataaatactacattgctcttaacatctacaaggtcttaccaggcttaacaacttcaccggggtttgacttaatgagcagctgtctgttgtccagatgtgtcaggacaaattggaaaccacaaagtgcttcagtcagagataaggtgtgctcataaaagagatcatcgcccttccttttgaacttggagtggtccttctgctggaggacgaatacaatgtctcccgtaacggtatcaggctgcaagtaaaacattcttcaatatagttctggtcattgagtcaatctatagaaactaccgtaatagatgaaacaatcataccgcctcatcagcttcaccagggaaagtgatcttctgattgtgttgcatccccttctcaacgtgaacctccagaaccttcttctcctgaataaccttctcgcccttgcagcctgggcagcgatccttctcattaatgctctctccagtccccttacactcattgcaaggctgctgcatctgctgtatcatggaaggccccagctggcggatggtgattttcatgccagacccctggcaacctgggcacctcatggaagcaccagacttggaacccttgctgaaatgaacagggagtaatgttcaagagcaggattgtgaaaatgcatagtttactatgctagggcaaaccagacttaccccttgcacttggcgcagaggacattgcgggaaagagagagcttctttgaagtaccattgtaaagatcttctagagaaaccttaagcggatggatcacatcctctcccctcctttgccttctgcccctgctgctgccaccacctgtgctcaaaacataaacaaacgaaatttcattacatcaacaaaacaagagattaacagagttcaacacaatcacacaggaaaatgtattgtcttcaaaaaataccaccaaaagaaggtccaaagaatgatgaaaagatgtcaaatggatcaacatgggatccgcctccacccattccttccttgagggcatcttcaccatattggtcatagatttcacgtttctccgggtcactcaatacctcataagcttgtgcaagctccttgaactgagataaaattaaaacaaagatatgcctaaaattagcctctttcattctacagattatgaatacatggatgactgaaaaagcagtaaacaaaaggaaatatagttgtgatcactatatggatatatgctatattcgccattccatgtcgcattcaataagacaataagcatttgttgactccaatatgcagtaacaaaatttatactccctccgtttcacaatgtaagtctttctagcattgcccacattcatatagatgttaatgaatctaaacacatacacatgtctaggttcattaacatctaaatgaatgcgggcaatgctagaaactcttacattgtgaaacggaggaagtatcgaactcagaagtattatgataaggagcataagaattaaaaacaatatttcatcatgtaagatacagtgctaaacataaaggggcagagcaaaatctaataggatttaaacagacaaaatactcccaacatatagaaacatttaattgaaagtcacattaccggactacccaaacaagcgcttttcctaaacaattaattagcaagtggatttgaatcacagctagaatgagtagtcctatgatcaccaaaggatactttgcctgaagaacaatgccctaatgctaccagttttaaacattccagtacagccgttactcaagatgttatccgatgcgagaattaaagatgcaatcaatggagcatttcacagctaaagatgcttcgctgaggcagaatgagaacaacgaaatatcttacagggtcagtataacaatacaacccagcaatgagctagattcaatggggcatttcacagctatagatgcttcgctgaggtatggcagaatgagaacaatgaaatatcttacggtgtcagtataagattacaacccagcaatgagctagatggttctctgaaaatgaatactatctgaacacaaacagactttgtaagtccatttcagctagctaatgatcttgatagataaccacaacgcaaattaaaaatgatccagcaaacctcaagcgcagcggaaaattcttgggaagtaactagcgcataaaacttgggaaaacgaacatctgaattctgaaagcacttaaagatcgcacggatcgctgtttcagtggtctcctctattggttctattgtagcagaagaatctgcacagtctacttgatgttacgaatccagtctattgttccccccacaaacccccaagatcatggccatgatcgcatcacaaattcacaattcacactaacccaccccctcagcaacaagtaaaaccgagcaaatctttgatcgcccgcccgctcgccgcccaaattccccccacatgaaccgcagactgcaaatcctaccaggcctaaagtaacaaaacgagatgatgttccgcccgccccccgatccatcatccgcgacgggacgggatcgaaccagatcgcgtcggatcgagaaagggagcaagcggccctgagatccggtagaacggaggaggagggtgggggatcgggatcgggctcggaccttctcggggtcgccgcccttgtcggggtggttcttgatggcggccttgcggtacgccttcttgaggtcgtcctgggaggcggtcttggggacccccaggatctcgtagtacttggtgttgtcgctcttcttcggcgcgcgcccgaacatcttggccccgcctccgcctccgccgacgaaaccactagccgctcccgtgccgccgcctccgcgccgccgccgccgccggggaggaggggatgggggatgcggaggaggaggacgggtcaaagttggtggccggagctagcggagtgggaggagagaaagagggtttggttaggtcgatgcgccagtgctaatgtagggagcagagagtacgtaacctgtatagcgaacgcgtatttcgtgttcgactgggctcgagatgggctgtttgttgctgggcccgggcattgaggcacgtgccgttccgtgcgccgttgccagattcctttatcattgagtttttttaccgttgagatggtgcgtatggattttcactttttctttaagtcagaattatctctatccctacgatctctatctctactacttaaaaaattcgaaacatttctattcgtcgttcgtcttataaaagttcccctttcgttgatctttttctgacacggagtatttttctttcattttttgtatggaaattgggtagcgggtacaacacggcgggtttgttgttcgctagaacacataggctcttggcctagtggtgctccttgcataccatctgtgggcttgcatggtctggtcatgcttgttgcatgccatctgtaggcctgctagcccaagtcccatggcaacgacgagtcttaggccatgtttagatagtactaaaacttttaagtccctatcacatcggatgtttgaaaattaattataaatattaaacgtagactattaataaaacccatccataatcttggactaatttgcgagacgaatctaatgagcctaattaatccatgattagcctgtgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccaccttaaccgatcagaaacacatggacccatatgacacacgataagtaccatgcatgttaactctctcctgccggtgtcatgtgctcatgcttcgactcagttccaacagcaacctgcacaagtgccatgtagaacaattatggacgtcaatgtagttcatgtagtgatttgcatcgtacaaatgcagataaacttttaataatttaatgtgtctcgcacaaagtcataaaataggcaatttcttgcatcgcatagtaaaaaatgtataggttttcatgaaaacagtaacccaatcggtacctttttttttttttgaaaccgaacccaattggtacttttgtcctcttatgattttaaaagttggtatttttacatcttttgtttcaattgttcttaatatcttctttgtgacttttggcggtcatacatatcatcttacggtcatatatatttaatgg

SEQ ID NO: 67664 - DNA, 721 bp, Oryza sativa
tgctctaacgtgcgagcagaagctgtcttttacatgtacatcagtacttgtacagtttacaatactccctcccgttatcggagtatatttattttttatttactatgcaaaaggttatgtttggacaatggacacgtgtgcgggtcatgcttccataaatgactttttacctactccgccacaccttttactaccgatggaactgagttttactggtgggtccgtccgagtttcattttttactactaccttttctttgccataaaaaaataaaaggggaaaatggcgagccaccctgccgcgtggggcgtctactattctttctctcctctcgctgttcccgacggaggaagggtggcagtggcacgcacgcacgccggcctcgcctcagcctcgcctcctcgcgcgcgcgcggccggacgggaggcacacggtgcgcggccggccggcctcattcgctcacctcgtaagccttcctcctccctcctccgtgcggttccatgatgcggcgaggcgaggcgcggattggggttggattggtttcttttttttttctcttccaattattgacttcgatgctgcgtgctcgccgtgctgtgctgtttcttccggatttctttgatgcgcgctgcagtgcttaatcgagagggttttttttttgtttttcttcgaaagggtttcaaccgaaataccgaatccccctctgcccccaaagctggtt

SEQ ID NO: 67665 - DNA, 1236 bp, Oryza sativa
aaactccccagatcattcaagaacattaaggttgtgtaccaacaggatggtcttcaatgaagaaggtcgtcttgtttcatttaaaggtgatattgtaatcatcatttattcatccaatgaattatcatttgaagtaatgcaggatatatgcattaaatgaattctctacctccctgaagtttgttgcctggggtatgggattgctgttacttgacaatatttggctcttttgattgagacataatttgactggcatattcatgtcaatatggatgggtcaatccctttttttctataccatcttttgcaattgatgacttaggttattgattgtttgtctacatcaagtacttaaagacctgtgcattgaaacaaactatggtgtaatgtaggaaagactattcatgttctaaacaaaaatgagcatgccttggacatggcagctccagtgcatgacaatttgggtgatccaaatggatatactgatgactattcgttggtgaagaagaggaccaatgtgcttctccttggagatcacattggcgaccttggaatgtctgatggtctaaactatgaaaacaggattgctgttggatttctgtaagtagacttccttatcatcttgctttttgcttaccatttttagatttatcttctgctgcatctatagcttagtttatccccatggatctagactgtagagtactgaatttttactttgatactgtgggcatcttggtgccagtgaaatttgattagttattccgatgcaatgagcgaagttctgaacaatccataggttgcattgtttctgttgaacatgcttttggcctaatatctttcaattgtaagctctcattggaagttctgagcaaatcctgagacttgtcaacgcatgaggaaatacccaaactttaagttgaatttttcattcccagtcatctttattaggcttattgtgttgaataagtgcaattagatgcaccaaattcattacttatgtgcaggtgtcattctcttctaattcaattgctgtacaagattaactaagctaagctgtacaagataaacaaagtataggtttggtccgtaagaactctctctaaagaaaaaaaaagttttttttttggtttgaaaccaaagttgagcaaccacagaaagtccatgtttgtgttctactggctttccttaatcaatgcaaagccaatgttttatcacatgcaactcgcccactgt

SEQ ID NO: 67666 - DNA, 963 bp, Oryza sativa
gacgaggagatctcatcgcatcattctttgtggcgtcttaattctttcttgggtgctttgctgcttctttcactcaacaaaagcttcaggatcttgttctctctatggggcccagctgaggttgaatgacaactagttggggtataagttgctgctgctgtcaggaaggcgcgaatattgtgatcatttggatattcgtgcacgggcaaaacaaatgccttccggattcgctgacatatgggaccggacatgatcatatatatgcaaacatagaatcgataatgacatcatacaaccctcttttttttcttttccgaaaatcttgctagaggaaatcatcgtttcgcggttttggttttagttataagacaaagtacggagtgatggcgctctgttaacgtgaaaattgactcatggacaccgtgcccattagaatattcgccgctagttaaataagagagaaaccatgtgaaaatactaaaatagcccaggacctacatatcaggtccaccatctctctatctctctctacatgaatattaacatggggaggagtggcacggtggtgtcgtcctcgttgctgggcttgcacaaccacttggaggcagccttgtcggcggtcttcatagcatacgccttcatcttgcagcagcaagaccgggtgttttctgtcgcagcagccatggcggcagtggcggcgaggggttggagtcgccgaagccctcgatggcttgggcatgggctacgtggacaagaatgtggtcgagggtgacgtggagccccaccgcaatggtcacgttgctccgtgtgaacctacaccacgcctggctctcggccatcacttgtcggagccgctccgctagcttggccgcgcgacgccgagcgacttccaacttctcctcctcctcccgccgcgtccactaacgtcgggcatactagcgcctggcactgttgttttcgcgc

SEQ ID NO: 67667 - DNA, 989 bp, Oryza sativa
gaagggaaatgggcgttctccttctgattaagtgcccgtgttgcgattgtgagacaatcattaggcgtgcggctaatacgcctgagaataaagggcgcatattttacacttgcccttgccatcaggttagttcttctcttctataatctgtgttgtggtggaaaattttcaattcgcatcggtttgctgaggttaattttgtacattttttgcgcagcgagatggaattggatgtcgcttttggtactgggaggaacaatatgaggagtacttgattaatactgggcatcttgcatctcgtgctgtgcatattcagagtccatgttctgctgtgcgtgttcagacaaatgcaatggttcaacagggtgcacaaccatatattgaaaatgatgcagagcaaattgctaagcagattaaattgcttgttaggaggatgaacttgttgatagacattggtagggatattgttgccttattgagatgtgtagtagctgcctgtgtggttgttgcggtgacaaatatgtatgctttctttaggagtggttgaaatgtgtaatgtgtgaaatgcactaaaaatgcatggtgtgtgatgaataaaatagccagtttcttcaatctgcatctttgtgaatgttgggtctatacaaattttgaaggaatgcttgttcaattcatagaatatttgaggcacaatattgcaaaggcaaaatgaggcacacattcagtaaagaggcagaacatccatttcagatactttcagcacttaagtatcacaaaatgcaactataattctggcaatcagcaagtagccatgcacttgcactacagcatgcagctgatatagcatatttttaatccattatatacatcacagtgtgttgacaaccaacaacaccattttttgtcagattgtcagctaaaccaaaatatattcccagctaactaataggcattaatttgttccaatcccaggtgcaggcttctttttt

SEQ ID NO: 67668 - DNA, 710 bp, Oryza sativa
atttcactgattactgcagggacttctagcccacaaaagtatgaggcgtcattcatgttactggttaattatatagataagcagcatctagcaaaaaatgatatatttcaggtaaacataaatacatatgaaatcagtatttgatactactgttatttatcacaacagttatttcactcagaccatcactttttaaatctatgtttagatagatatattgaataaattgcaaccagagtaaacatgtaacatactgtcattaagtaacttaaatatcagttacccaccaattattaagtagataaaatccattatccacaactatctttcttgattatcacattgacttcctaactaattgactataataacacacatatttaacaaagcattgagtgctagactactaatctactaatcaaagtttacctcacttaccaactctcaaccagtatttgtacagaagtatataggtataccatccaaaattacctgatgagtcaaagcatatgccattgctctctcacgcttagcagcagcttcctgccttttcaatactttagcttgcagttcttcaacagaaccaatactgccacaccagcgttcctgcatttattgttgcagaagtaaacaacattataaaacactgtctgccaagaaacatatttatcccactcatattacttggctctatttttccacacgtaagt

SEQ ID NO: 67669 - DNA, 4297 bp, Oryza sativa
  unsure (1)..(4297): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattatagaaatgcataatgtttggagagacgtgagtgccactcatggaatctgaagagaaggctataatgtcttggcctactctattttataaggtcatatgagctaaaaagctattcaaggttcaaaactggagaatcgttggcttctaaacccgcaagtatgtgccgtatgtcccctgtcatatattatttgctatatttttgtcaaggacatgttatttcctcatgtggtattcttgggtagtgtttggtggaagatgtccccacaataagaccttgttcttgtgttttttttccaatgggcgaaacgacgaggcgaaacaattgctcccctcaaaaacataaaaaaataccgaacaatgcaatgtcttgttctttttttagatgacaaaaaattgcaacagtcatagaactaatcaaacaagattgcaaaatattagattgaccaattgttacagtgccatggccttcaaatacattacatacctcaatcctgattcccccattttcttgacttattcaagggttgggagcttagttgattcaattatttgttcctttttgatcctataggtttataagcgatttttttttttaaaaaaaacaaagaatgcccaccaccaccggcaagccttgcaacaggaaacatcaaatcaaatgtcagtgaatgcgcctacatgtgaagcatgacaaacagtgttgtccatgtaactaaagggaccaccaaacagtgtttggacccaaaaacatctgggaatcaaagttattaccctctttagttcatgcaacattcatatgcaaatccatctagttcatgcaagattttctcacaaatcaattgcagaagaaacctcaattctttcaaaaatatgtgtagcaatcaagcaatagcaaactgctcactaaccatcactccatcagagaacttgctattactcctttctataaaaagctggagatttctcttggtaaaaaaagggtaacaatcaatcagactgtgaaatgatgccttgaaaattctttgagatttcagatttgcaagctagagaaaataggagataatccaataattcccttgtgtttacagatccaacccagctatacatgcatgccaaaattcttcatttcaattaatcacctttttgatttacttatgcaaagaagaaaacaaaattcacataaacttattattattatctgacaaagatgaaaaaaaaaagaagcaaagaacctcacctgaaaacaccgagaatttcagcacctcaggagcccctcctcctcctcctctcttgggcatcgccggcaccgccgtcttctccggctccggcgccgccggatccagcgcggcgcggcctccgggcacgacctggaactggccgccgtcgcgcagcgccgcctcctccggcgacgcctccccgtacagcagctgcgaccccgcccaccacggctgctgctgctgctgcggtccagctccagcggcggcgacatggccgaacccctcgtggctctgcttgaagctcagcatcgccgccgccaccgtcgtcgtcgtctccctcgccgaggagagagagagagaaaaagaaaagcagggaggctcaaggacgcaggcgacagcgacccctccaatggcgtcaagaaggatctcagcttgaggaggaagatgctaaccgtccaaccaccttaagaccaaacgattaaacaaaagcggattaatttagagccttgtgatgatgcgcaagcagacggttaaaaaaattcgcagggataaagaaaattcccaggagccgaagagaaaggggagggaagaacaagaactgaacagatggaaggacatgtatactccacttggcagggtaaaccgatgaaataatctcaaagagaaaaaaagagcaacagatgctcgcagaaagccaagaagagagagagagagaaacacatttttaagcaaaataaatgcttgattaattgttctgaaccaaaaatcaaaggaaccaagaagaagaagaagaggaagaagaaaggacacaccaagatcagcatgaaaagaagggaaggacggcgagatgtatccatatccatgttacatgtatgctatgtcctagagtagtattactacggaagaggattagtacaaaccaaagcaagaacagggcagacagctgagccgagcacagtggatgatgcacgaggatgaggggaagccaacccccagctagccagccagccagccagcaagcaagcaaagcaaagctctcactcacatttcagcagcaggaggccatctaataatggccacgagaggacaacaacagtatcgaacagcaacggcaagagagagagaggagagagaaaatccactgtagatagagatatatatagagagagaaatagagagagatgcagtgctgtatatagatgcagagctcagctgctcacccctctctctctctagtttctctctctctctctagatggccaccaacccttcctcaacggcgatggccatccatttactttgcttcttttgtgcaaagtggtggctgctgccactgctgcttttggatcacaccctctcctcctcctctcttcctacttcttggggtgtgtgggctaacttgggtaagattcccagacgaatcgagccgtgtaattaccaaattagtcatgctgccgccgctggtagctactatcttcttttatctttttttacctatatatagctcctgccattggtgtagcagtacacctctactgatctcattctcgtctcatttcctctcgtggaaaaggtgtaagggcgaatcagatgatcagctatccctctctctgcattgtcactgcacggtaggatccaccttttcgatcgaaatttgccaaaattcgatataaatcgtcgtatcggcgagggtcgttatcctgccgtccatcggaaaggtaaaccggtaaaccctgttgcacggtcatcggctgcgacctttttctccttttctgttttcttagtgttttgttaatttcttcttcctcggaaaatccctaatgggttgatctcgagcatggaatttgttttgataatttgtgcttgtcactattaattaagcaaaaataagaacctcttgttctatcgtacatcgacataggcgagaattatacctcctttacaacggaggaatcttgcgggaactgaaataactccaattaaattcccatgttttaaaggatcaattaatacatgggaaaaatgtgtttacggggatagtgagattaagagcacccgcaatggtaaagtaaggtgctatctataaaagatgtacatctcaacaatagactagattaatagtaaaccacttcaatggtatgtctacatgggtatctatagctctctaatcaattgcctcgtttttctctatagactatctccaggttagtagatagctttgctctctctcttcatttaatttcttccaagtagaaaaatatgcttatatggatctcttgtagagaacctataaataactattgtgggtgcccttaatagtagcacaattaatggtgaagagaattgtcaacgtttagctccctacgagatgtctttgtcatatttcttttggatgactcgtcgtcttacttttatataatttgcggatatacgtcttctaactaatttgatgctacaatgagaaattgtcttattgtccggtactctaggtacagttaggcattgagcatatgaacctacttgggaaagtaaccctctagaattgcacggcatcaaatatattcttattccaagatgacaatgaaaaatgccttgtgcactatagccgtcttgtgcattggaacaacataaacattcgtagcattcagtactccctccttccaaaaacgtggaaagttttagagtttaaattttgtctcatatatggcaacccaagatatataaggaaacatatctaatacacacaggcttcatatgcatgctgcgtgcatacccaataaacaaatggccataaaaatctaaaagaaaaatatataccttcaatagtattaccacc

SEQ ID NO: 67670 - DNA, 7060 bp, Oryza sativa
gatataaatctgttagaaatttgtcctttgttcacttcacgaaggttaaatttgaaaataagatttacgtagatgtataactattgaaagtgtatgtacgattttttttagaattttttagtgatatttattagttggtgtgcatagtgtgtacatatgaagccttgtgtgtttaggatacgtattcgatatataaaaggtaacttttgacgctaaactaaccctaccttggctttactataattggacctacacattacccattccattctaagaaggagaacatatatttttacccctattctttatacattgccatactctaaaaattattacattttaaaacaaagtgaatctgtgatttttttttgttagggatgatgtgcgatcatgagatcttttttaattttgcgtgtatgtggtttctttccttttttttccttgtgaaggagtatttatagtttgagtaaattttacaaaactacagatattttgatctatctatcgataaattacagatttaagacattgtatcacaaattttagatttagcactaaagttatcacaaaactatagttttagagtcaaatatcacaaaactacacatttagtaaaaaagaaatcgaaaactacatgtatggttagcaccatttaatcacaaaactataatatttataactctagtgttagggatttaaactctataatctattttttgataacttcaatactaaatctgtagtcttataatacttagttttaaatttatagttttatgataactttgttgttaaatctatagatttaaactctacacagaactgcaaatcaataccttgttctttggaaaatttggccatagcctttgtgttcactgaagaagatgggcatcacactaattttacagggatgagctggtggggactggggaggactattactacacctttttccaccataatggctttgtttctaaaagcaataactttttttttctacactccaagaagctgtgggacagaagatccaacttcaagccatccgagcatccaccagagaaacaaaagactgtatctcctggagacttttccaatggctcgttggtcctactactgagttttgattccaacagctaatcttccggagaatctgtccatatgcacccataattaaaacctaactgcctggtccaaaaatttagattttggtagcgcatgtccattctttcttaagactatgacaactaggacatcgacatactctcatttagaatgataatagattattacagacagattatcgatttgattataaaagtgaattaaatattttaagaaacaaatttaacaaatagcttaaataagtgatttaaataaattataaaatatgtttttaaaaatattttataaaatattttttttaagaaaacatgtttttcaaagtgtggagcaaataatatgttttaataatgaagaaaacatacatcatttcagcacacaacattaagaatgggaatattcaccccatgcacatgcatttatctgccagtctatgaacttggcaagttgggtttgattattttttcgaaatttagtgcaatcgcatacacgtacgcatgttactccctattcgcattagcacctctgagagacagggttatcgacgaatcttaaaattgatgaagtaaccacaaacgcctcgctctcgatgaatgcgtcgcctttaaaattttttaagggttcatcttagcttcattggtgagtagttgtatgggaggggtggatgttacaccacacctcctagatttgggtccttttcaacttaatttatttttcttaatttctaaagaaaaaatagttagttcttgcttcttcctaagtgtttatcaactttagatatttttttcttgatatgtacatgtaattgttttggagtttcaaggcgcagggggcaatgctatttgttaacatttgcaccccccattccaaaactataaacatttctaaattgtttagtggaaattaggattaagaagaaaagaatttggtgtccctcgataaatgagggaaggttagagatgtgtgaatgcttgaggtaggatgggaagaaattaaagggaaagtggttgattggataagtagtagagggtgtttggttgccgaccacagtttaccatgtgtaaggttagacgagtttaattaacttggtagctgggtgccatagttgtggcaatattttctttcaacaaattagatttcacgtatcaatgagtaaaaaaaaaagtatggaaagattcccttatgcttgctaggtgtgataatgaaattgaccgcctcagcttacacagtgtgatgacttttgttggtacatggacaccaagtgtggttggcaactaaacatactcatagtttgtgaaacaaatatttggatccagaaatatttatattttagaacggaggtaatagataatatttatactatagctagtcttatttctttgctattccttaaatgccatgaatatttttgatttattgggtccaggtctaccatgtcagccacttgctgagggaattaatggaaagcttatttagcaccataccagaaattctttatgttttattttacctttgacttgtatttgtaacagctagatgttgtctgtgttactcctaaataaagtcaaaatattctttagtttgatacctggctttttgaaccgtctttaaagccactgcatatgatagggttttattttctaacaataaacctctcaagaatctcaagtcattaaataatcccatatcaccgctaaaaagtctaacccttctcaaattgatccaaccaccctgctcccctatatatgtcccatcatccatactagtatatattaatattgacctatcacatgatctttagtattctaaatacgatgaccacctagaatattgtgtatataggcaattactaaccgtaatttcaatggagtactactataactgccatattgaaatgatagaagaaaaatagtctcgaaatttcaatatagcaatattatgattgttcacacctaaatttggcatctagaattaaaatagggaaaatgccaaggtttggacattctgccggttttcctctaagagggctggtctgaccgtcgtgtgttggccggccagaccgccgccagtgggccggtcagaccagcggtatgtggcccgtctaaccggcagagtccgagtcagactccattttcgtcgtttctcgggtttccttgctcggaaaggcatgtttcgtattttcatctgtttctagcccgagttggactggaggaggacctgtaaagggtaagaccaacccctatataaggggcaaggccggttcattgtaaagacacaaccaactatcaaccaatcgaatcgttcttttacttttgctttagttctagtttagtttgtccatctttgttgatttgcgctgtaaatcatccgccgccgctgcgagagtgcgacacctctttgtaggtttgtcctgaaaaccttccgttttgcccaagagacgggtagttatctatcagtctatctagatcggctccgctagccagtttaatttatcaaaacccatcttagtttagcttttgctagattgaggtggttggcgactctaagatcactgtaaagcgttaggtggtgcgattgtgcttgttgactttgtcaaaaaaatgccaacaatgattttgttttttttttgcggggaacaatgattttgttatgttttgttatattgcaaattgcaatacaaaataagtgatccgtgtgtattcatattgctgtttcatcacctgcagaatactttcttttaagagagaaacattgcctacttgtaccaatcgagaaggaccttatacgacatgttcaaaagcttggtacagtggtatatatagactctttatttcatatagagactatggccctgtttagattctaacttttttcttcaaactttcaacttttccatcacatcgaactgtcctatacacacgaacttacaacttttccgtcacatcattccaatttcttcaaactttcaattttcgcgtggaactaaacacaacctatcctctaataacaattgaaacggcaaaaggactttaacaattaatgcactaaaatagttttttattattttatttcctttgttccatcctcatacaataaagtttcctgttacatattaagctgttgtcatacataacaacaaagttttctctctttctcctcctcctctcttttatgtcagcaaacttgtttttgttaacaactctaaacgcatgtacttaacaactagagttctgtaacaccccgattttcattcaggattaaaaatcatttaatagtgcattttctagaaattaaataaaaattaaagcaatttaatcaagtgaaataataggagaattaaaattttcccttaaaaatcattggccgagaatattttgcaatattctttgtgccctaaatattctctgaaattttcccgtgaattttcagagctcaagaaataattataataatacaaagttcatccaatcaatttaaataaagaaaaaacaaattaaaattccatcctctccttttgggccgttttcggcccaatccaccccttcctccatcccccccccaccggccaggccggcctccttttcctccacggcccgctcggccctctctctcaaagcctgcatttccccccccccaaccggtctcctctcttcctctggctgacaggtgggacctgcggccccacctgtcatctccttcctacagccactccgccggtaaccgccattgccgcccacgccgcccacgtcgccgcctctcatgcacggccccttttccagtgcgtgcgtgggcgcggtctccgcccacgtccgcgccgttcttcccccactccccgtgaaaaccgccgccaccccgagcccactcacccacgtcgccggcgcccctttcccccttcaaatccgccgccaaccggcctccccgtcgactctcgagtttataaaaagcatccccggcctcccctcttccatttccccatttttcccgagctccccgcgctctctcccgctctccccacgcgagcccaagtgccgccactcaccggcgaccctccaaccggctgctgccgccgctgccgctgtccccgcgccgtgccgtttgcgccgccggcctcgccgcgcgttgccgaaccccgtccactgctccgcttccgcaataaatcacccgggcgccggtttcaccgtgcacccgagtcacagccgcctctcgtcgcctccagtcgcttgccaccgccacccccgtcgctgccgcgctgcgccaccaccgccgaaaggttcgctgtgcctagccgcacaccggcatccgctttgtttccctaaatcgccaccgcaaccacccctccaccatcgacccgagccaccacctccgtgtgccgactgcagccacgtcgtcccgctgctttggtcatcgccaacccacgccgtcgcctccctcggctctgcaaggacaaggagttcctcggccaccgctccccgtcgccctaatcctgctggaactccacctccatcgcacaccggtgagcacccgctgtttttctttctttcggccggtgattcacgccgccgggagtcttctcgtgccctcctaatcctgccatccccttccccaggtcctgctggccctcggccgtacctccgccgcggtcgggagtcgtcggagcgccgtccccgaccccaacccgagaagcgccgccgccaatcctcgtcgtcggccgccttcccgccttcgcctcgccgtccccgccctctcagtgagcccctctcccatccctgccgcctcccgtgtgtgccaccgcatccagcgctgctgccgcccgcagccggcgaccatcgggtcgagcgccgccgctttccggtcggccgccgccgccctgctcgcccgcggccgcccgacccctttgccgcgccgcgcctgcccgtggccgcccgatcggccgccctagccgatctaggccgtccacgtggcctccctgtgccgccccgcgtgggtgccctcgtggtgccacgtgtctgccacgtggtgcgcccgcggaccagcgcgtgcgtggacttggtccacggtgcacccgcctcccgtgaatcaccgacgggtggggcccgcttgtcggcgccaccccttcctctcggctgatgccataaaggatttaattgtgcaataaatcgataataattctagaaattcattaaaatggctcaaaacttctaaaatccatatctaattcattcgaactccaaattgagccattcaacttgcaaaattcatctaaaattgagctctacatgtttgtttactttttatgtactgtttccttggtttttattagagtttttcctcattttgcgtgccagcgtgtagaatccgtcgtttcggaagatcgcggtcgcaaggataagagttcggaagattgtttgaagaagcaaggcaagtcacacattccccttgggcatgttgatccaaatttataaatgttttattgtttgcaaataaatatgcatcgttttgctaattacatgggaataggatttacctatctgcttgcttgtgccatgttatttgatatatgtcctttgtcaaccttgggtgaaaattgactagcttgtgttactttgatgacctagctagaactatatgcttagccatgcttaattaccactagctcagtagatgggataattgcagtattagacatgttagtatcatgatgagctgcgtgctcgagacatccggccatgtttcatggtcgtaattatccaactaaaatacgactgaatggtgggctgtgggtgcatggttttgctggtcgcacccatggcaagtaaggaccggtttgcgggatgcactggaagacatacagcgcttgccacaagcagaaatgggtaactgcctgacttgaagtatagcttttctctggctgatgcatccaggcaagagtgggcgtgatgga

SEQ ID NO: 67671 - DNA, 1581 bp, Oryza sativa
gaatagccgtgccggtggttatgggcgattgaccagaatcaccgtgattagtctcacacttaataaatcgacccaatgcactatagttcaggtgggttggttgggcctattcaacgtggtgtagcgttgatcagtggagatttaatattactttaattactcaacagttttaccgttttgctcaataaaatgttttacaatcgcctttatgcaaatagccacaagccatccttgtatccccttgcacgtctgcatcattggtatggcttgctgagtacggtggttgtactcagccttgctattattccccctttttagaagtgtagtgcttctgagctgaagacaaagttagaagaccaaggcttagaccccagttgagttttgcctgtggagtggagctgaagcctcgctaggatcgcctttttccgctgctgctgcttttgtttcggtgtgaggactaagtgactcttctgtaagtattttacgctttatttacgtttggaactgtatattatattacttgtcgttttgtgtaccctagctagtcctggacagggatttaatacacaaaatagtctggaaagttgggctaaatttctgggcgtgacaagttcacacatgaatccacataaaaaaatagaaatgagatatttgtatatatttaattaaataagattaacagagattcagagaaaaccagaaaagaaaataacatatatctaacatgtttggtaggtgagaaatgcatgccaagaagtcgagtgaacttctgcaaagaattttgcctattttcagagaacaagagcccatgcaaaagcctctatgtacgagcaagtttaatagtacagccaactgatagctctaaaaattgacacatcatctatagccaatcaaatagtcactctatcaactagtctttcaatagctagataccctgcactttattgcgggatatatggatgaatgcatattatacattataaaaatgatagatgcatatgtttaaataatgtgaaaataatgtggagacaatgatttgacattgcttgcatattgagttctaaaaatacaataacattgtaaatgatgtttgtatgatatttaaaatactctagattttttagataatggaattaaatccggcctttgcttcaatgaagctacaaccaattattacaatactctctcaaaaagagcaaatactcaagcaacaaaaataacttaaacaataaagccaacacataaggagaaaacaattattgaaaaaaaaatactctattattatttaaaatagtctagataataattgctagtggatgatgatgttgtattcttgtatgtgatgtaaaatactctatataataattgctagtgctttgggatttattaggagtatagatttatggctcgctactggtcaagcatgcccgtgaataaaatatccctcttgtgagtaagcatggcaataataaaatatagtgctgatggtcaaccttacgatctattcttactaactacaacatgttcagccatataaatgagaaatgaaatgtcaaacatagtaggaaatttaaatgccaa

SEQ ID NO: 67672 - DNA, 2181 bp, Oryza sativa
agatctacaacttttgtattggtcatttttctatatgactttgtttgaacagtctgaatttgaatttcaaattataacaacttcaaacaacattttcagatactaaatgatttcaactgaaaaaatcgtcaataaaaaattggtgtaactcattaatatctataactttttattttggtcatttattcatccgacaaagtgatttgtaagattattcacagaatgtacatatctattatatagttttataaactataagagagagatgtaaattttgtgaaaatgttagtatcactttatcaaataaagaaatgaccaaaatagaaattatagatcttgatgagttatacaactttgttgttgttgactttttcagctgaaatcgtttattgcttcataatattattgaagatttgaaatttaaattttaaattgataaaacaaagtcacaagaaaaaatggcctaaataataacagtaagaacacaataacatgatagagcatgattttagaaacatttaggaaaaagaatcatccaatttggagttcgtatgagtgagatacactagtttcaattttattttcgcatgcgggcgcttaagtgagccgcatggaaaaatcgatttttccatgcgggcgcttaagtgagccgcatgcaaaaatgacatcatttttgcatgcggccctcttaagagacccgtatgggaaaatcgatttttccatacgggcttcttaaggagccgtttgcgaaaatgccacgtgatttttgcaggcgccactagttatggtccgtttgtaaaaattatggggtctcgtacagaaaaatcacttttgtagtagtggatagtccattcctttcttccaacgttgaactctccgtataaatggaatatcatgggcaacagcaggtagtacgtagacggttgccttttaagtgaccgctcgtaataacacttagtacatacgcggttgcctgagacatcacctagaaaatatatatattcacacgggtggcactgtgtagagatcattcatgtataatctattttttctagatggcgcactcgtaattatccacttgtattgttgttcttttcgtctttctcacggcattacttcaagtgtccaattacaaatccactattatcggttttcgcatggattccggtcatttcctcttccataatttctcaattgctccgtcaaagggagtttgccaatctgatcccatgatctctccatttcctgataaacttctccttttttggcccctatgattaagatggttagcaggttaattccctccaataagctcaaatggagtactagtcaaaccccattcttctgaagccatgcaagaaatgaatcttgtaccaccacactgaaactactggtcacttccagcagcaaatcatgcagccactaccaccacaaaaacaaatgaaacatcacatgcaagcaccttgttggaactccagctcagctgtggggcatgatgctgcactgaaaaatcctttctgatgttgcactgaaatcttactatgtctttttcttttttttttttacagtggtgctgcccaggtgagtggccactggccaccattctttccctccatccagccacctttgcaccgtgacgtcaccatcttatcttctccctgttcttaacacccacatgctcacctcatctcctttccaacatcttgtgtttgatactactactaaaatgcttgctcatgtagttagcctataacacttggatttttcagatgtagtaggattcagacagcattaaccagtggagtactactccctccggttcgttattagttggtgttagagactagactgtttggatggagaaaaaaaaagatgttttagctttggtgtgttacgtttggactaatttaccccttcgtgtatgcaaaacacattaagctagccacacggatataattattatgggtataataggaaatagtcactctaattaattactcattagtatccaaactcttgtctaaagcgttaaattaataaggaacctgagggaggagtaaacattccattcatttttaaataattgatgaccacaactatcttattttaaccataaattatatgtaaataattatattataatgaatgaaagttataggttacatttacgatgcttcgcat

SEQ ID NO: 67673 - DNA, 1662 bp, Oryza sativa
ctccatgtatatgcagtggtagcagttctgcatctcctgcagagaacttctgtgcctgtctcgtttctgcaggggtttgctgctaaactaaactgtggttaacagcaaatgttgttacctctgtctcaaaataagtacagccatgggatattcgtgctcaacgtttgaccgttcgtcttatttataaaaattatgaaaaatttaaaaatatttagtcacacataaaatactattcatgttttatcatctaataacaataaaaatactaatcataaaaatttttcaaataagacgaacggtcaaacgtttaacgtgaatagtacaaaactgcacttattttaggacgagggagtattatcaaaaaaaaaaaaaaacaacagatgttgcctgtcggcctgttgctaggtcaggtatcaggtgaacccccaattgtcagaggtggaaaggacagaacacagcttctgattaaaaaaaaacatcctggcaaatgtgttccaagaaattgatacaggaaatcaaactggagaaaggaacactatactgcctccgtcccaaaataagtgcagccgtagatatccgtgttcaacgtttgaccgtccgtcttatttgaaaaatttgtgaaaaatttaaaaatatttagtcacacataaagtattattcatgttttatcatctaatagcaataaaaatactgatcataaaaaattttcaaataagacgaacggtcaaacgttaaacgtaaatagtgcaaaactgtaattacgtaataagtttaatcaacgggtaaatggacaagacgcattggattttacggcaacaatattcagaatatcagaccatcagcagctaagaatctctgtcgcaccaaggattgctgtctgctatatcttcggctagcatgtctgttgccacgttggagacaacagctctgttcctcattggaatattcaccggtcacggttcatttgaaacgcgaaaatctaaacaatttttataggaaacagtataattcctaaaatcctcctttgcattagacattagacctatttcagtgatgtcaaatccattaaaaagaattttccatgatgcaattgcaaacacaagactccaagatagtttaaccatccgatgatcatagacagcaatttctgaaacatgtggcgactggtacatagatgaaagctgttaatatcatgattcactccagaagtttttttacaaacgcgcaaaccggacaaggacctttcttgcgtacatgacattaacatatagcaacccatcagataattgaagttaagtgggaactggaatggaaagaatactagtggaaaatgacgcagaagagcatctccacacaagctaaaatcagatcgggcaaacctaacgagcaataggtacagcatcaggcagggagctccagagaaatagtggcagaagagtatgaacaacgggtgcaccaaaagcctagaagaacttgttgaactggccgctcagggtgtccttcaggttcgagtacagcccgtagagggagtattgccgcaggttagacacctcataccacgagttcagaactgattcgtgtttatcggtgcctgagaaagccagctggatgcctatactgcagtcaacaggtccctggctcttgctagctctgtgttctgaa

SEQ ID NO: 67674 - DNA, 7992 bp, Oryza sativa
cgggagaaggcgaggacggtggctggccggcgctgctagggaggaggccgtcggggtgaggcgggagaagaggcggcgacgtcggctgcgacacaggagaaggcgaggacggtggctggtcgcgaatggcgtggacggcactgtgtcgccgccgccggtgatgcagccccacacgggcaggcgccgcagcattgggcgacgaggagaacggcggagcaggcgagcgacgacggagtagggtgatgacgcgcaggcgggcgaagcaaagcgacagatacccacccacttattcagttttacttaaaaaaaccacctcattgcacacgtgcttaaccgaatcaattcgttatcactgagctagagtcaccacatgctaagttagccaagccaatcttatccaaatgcgtgcattagacttatttttcatatttgattgaacttttttttttcatacagcaaaactcaatatggcaacatttaaactctcaacataattctatttgtgaaatcttaaaaaaaaattgtcaaaactacactttgcaatatttaattttagtaaagaacaccttacggctcacactttatgaaaatatattaattcggttaaacatgtatgcacaaacgttggtttttgcaataaaactgagtaagtggataggtatttacaataaaatgatttatagggtagaatgtcaaacttaaagtgacttatagatgtggtttttatatttttctcaaaaatcaatccttaagtggtttatcctacatggcacctatgtgtgtcccacacatgtctgtaacatccctcatctacgtggcacctaaatttctcaacaatttggacttttcggcgctgttaaattcgttgttagttcagtgggctaattgctgcttcatcacttcagttttttcagtcgcagattaagagttgatcaccttttcaatccgacgaagaacattcaacaaaaaaaaaatgccatcacagatttctagcaaggcagcaacttgtttatactcgctccgtttcatattttaagtcgtccgacttatttcttagtcaatgagtaactttatataaaaatatagtactatttttagcatattattaaaatatatttaatattaaattaaatgaaactaatttgatattttagatgttgctaaattcttttataaacttaattaaacttaacaaaatttgactaggaaaaaactcaaacgacttataatataaaaattataaacggagggagtacagcataaatacaacatcatgccatatttgatatttccatgctttcagtcactctcgtccatggacgccaaacaggtaacacggttgactgctaccaagctgtacattagtgctactgctagccataactgttttaagatccaccattctgaaaaataatcatgacaaaagaggaacaattaaccagatgtcagttgcaaacacccagagaaaacctggcgacagagaggagacagacagacagacacaagccatctactatggttttaggcatatctaaatacaggcagaagttccaaagaatgaaataggtctccttttctttttgcaaccaaaaacttgctgaggtgctaaaacaaaccaatgttcatcccaaactcttcttgcttatactttccaagaccacgacagcaatcccctctaatgtaccatcttctattatatactaaaagtcgtccatgaaacttcctacaaacgctctcaaaccgccacgtggcgctctaataaaatagagaaaatcctagaaattctaaaaaaaaaatcaaaacatctatcccttgattttcatttaaattggtgggtccaatattatacaccgttagataaaattgatcttaaaacaaactaaataccatgggtcccacctatcctcccctcccacacattggcaggtggagtatatacgtacttacacgtacgcttccacccccccccccctctttccttttttcttcttttttccatttatatatataatggatatattttttaaataatcataattttacaaacaaaaaatctaccatcatataacttaagccgatgtactcattactttactattattttcaaataatgcactattttaaaataagttttacacaattatatcgtgtacctatcaaataaacaatatctatattaactaatttatacgggcactccattatataaatcatcagatctactttttattacattggtctattattctcatgtaatgcactgtttcaaaataaagcctacaccattatattgtgtacccattaaattaacaatttaaaaagtacacgatgtaatcatcggatctattatttgctaataaataaagcgtcaaaaattctctttttgcccgttgcataatgcacgtctgcacttttacctttcgcacgtgtgacaaagcatagtgtctgagacatttaaggtgatcacaaccgctatagcactaccgctttgccacatatcaaatcatatatggagatgattaattttgttaataacatgaaaagaaaattaaaggtgtgatgcagcgagagaataattaagcaccatgtgttgtgtttttctcaacactaattagctctgtttaagttgaaaccgagagttgattacataacaattataatgtatttgtgttatgtcgtatttagattttgtactatttgttcgtacatgtgaaaggaatcattatgttataaatgtgagcgcaatattaacgaatatcaatagaactcttactacgacaagggtgataaagggagtttaaggccctctcttttttttccgattccatattttggatttttgtttgcactctttccaagtttctaaatggtgtcttctttacacaacattctaactttttagaagtcaattcattcatttataccctcaaatagctatcacataaattatataattcatcaatttcaactgtcctaaaccttaagtactacatatttttttcatgcgagccatggtgatcagtaaattggtgatcaacggatcatcaaagtcgtaagatgaatatataagagttactctgaacaattgtaaataggtgtcaaaattaattgctattaattagacatctaatggcttgctagccacaaaattaatttctctctacatgtatataaacatggatgaagctagaacaaatattaccatatgtcccatacatatatattgcgtagttaatattctaattagtcatttaaaattccttaaaatactcttaagctgccacgtggtgctataataaattagggcaaatattagaaattctcatgaaaaatatcaaagtatctattataaaccgttagattaaactgatcttaaaacaaactaaatactagacctcgacaaaggtacgcacctacgtgcgcggctacgtacgcctcccctccattttttcatttttctctttcttcttttttttcccatgcatatgcttccctccctttattactatgtcatacgccttcatgagacgatttaatcaaaagaattttgagtatcttgcactcgcatttttaatttgcggccatactacacggtatgtatatacatggacttatgataattaactatcaatagtttataatttactcgagaaaaaaaacatgattcaaaaatcgtaagtacttaatccatctcctactcaaaagtttgtgaatggttttctaagataccttaaaaaaaatagaccccttaaattattataaaataacattatccaaactttagtttgccctaaatctatgagacaaaatttctgaacatacaataatcttatctttcaataatataagtgcccgcgcgtgcgcatacgcgcgggccaccttcctagttacaattaacgcccatattttaaccttatgatctaccccaaaagccataccaatcgctatgtacagtttaggagcagcatagattcaggacagaaatatcacaatgcctattagcagaccgggcagcgggtagggtatatggaagttcggccaatagatttaggaaaccatattctcccaagtcccaacccaacagtgggtatattagggtttaagcctacatctttgaacccaaaaaatgggcatattatgatctttgaaccctgttaatgcagatctactttttttttcttgcagcataataattcataacaaaaacatcctacagaaatcaactaggcccttttattattactatcatctattactctattattattatcacttcaaactgccaagaccgactaagcaaacaaactgccattatcatggcaagcagaacataagaagtgtaactacacaatagccgggcatgtatggaacaaaaataataaaccatcactgcatgtatttacagtgccaccatgtaatacataggacgatcatgctaactaacaccctactattactttccaacagattgtcacattcatacaggatactcacgtagggacaatttgtagtcataccatcctcacctcccagcagcgcattcaattgctggaaaatctctgaataacaaaacagaggggatatgttgttcctcacgtagtagttcaagggcatagatggacactctgtgcttgttcatcacatcacaaccctgcaacaaaaatcagaatgagcatcaaaattaaaatttgtttgtttttgtagcagaagaaaagcatgttttggatagaaacaggttttcttaatattaaaatattttcaaaatgtttcaaaccaaattacatgagtggtatgaatgtcaccagaaccaagaaaatgacagtaatgacttgtatagtaatttgtgtaatgtacatctgacctggttgagaaaatggcacaagaacatatgttcagcaacagcaaaagacccaccggcctctaccaattagcaaatacttctaaacaatctaacaaacagaaacttacagttgcagatacacgaacaatccaatgtagtaagcattccatttgatgacacaacaacactcttgatgtagcatgccactttattgcgtaagtgttaagcatacaaattacagaacaacctaaaattcccgcatttcatactatgtacactccattcagtgacattgtctccaacacaacacctaaaagaagattagatctttttgacaccaccttagcaacagtacatatccatacctcattcacctcagtgtacaaattccgacaccctgaaatgtggtgttgttgctggattagtcacgtaggatgacagagtctgcaatctccatcagtggctcaaggcactcgggagcaaacttgcgggcgaacatgtacgagtatgtcccatttgatttcctcagctccttgatcaggcttgcagacacctccccaggccggtatgtgtgagggtggccctcgacttgatccgtccagttcacccttgtcagagtatacccggtgcagccttcggggtcttgcatatccagcaatgtcgggaagtagtgctcctctggatagcacgagtctctgcgcttgatcaggcaaggaagcttaaacttcctccatagcttcatgtccctgacgaccatgatggcatgcttcctcgtcaacacaaagaactgcgaccccaaccggaactggtcgtccggcacctccgggagcatcacatcgtcgcctcgggcatagtacctatcatgaatcatgtaggcatcgtccattatctcgatgaagctgcggtggcggccatgaggcccggcattgtcggagaggagcgtgttgtacagcgtggggaacgggtggagcgggatgcaggattgcgagaggagagcgaagaactggttggatgggtcgtcgagcagggcggtggcgatgaggcggcgggcggcggagatgagggtgggggaggcgcgctgcgtggccttggccgggacgaatcggccgcggaacgagggcgtcggcggcatcgtgagggcggagaaagggtcggcgtggacgtagaggttgaagaggtggtggtggccgcggaagaacttctcccagagcggggagaagacgaggtcggagttggtgaggaagaggaaggcgaccttgggggcggggcggcggcggaagaagtaggacgcggcggaggagggcgtgggcgtggcggaggagggggaggaggaggagagtatggcgcggcggaagagcgcgaggtcgtcggactcgtcggcgtccgggatggccggaagcgtcttgggcgggaggaggcgcggcgcgaggaggaagatgaccgggatggagacgaggaggagcaccgacagcacgaacggcgaggcgtacgtcgtcgccggcgacgtcatctccgatctcagcgaacccccaacaaatccgaatgaaatctcagcacgcgcacgcagcagcagaaaatgcaagcgagaggattggattggatctcgcgggtgggtgattcttggtggaggaggacgaacagcaactaaatcgaaattgaaaaaaaaaaggattagatttccgcgagggtaagaaaaaaaaggttgggagatgagatgacagcgattgatagtgacagtctctcgaatcgaggggaagaaacgaaaatgctcccagagaattggatctagcgatcttggagggacaccacaaagcacgacgaaatgggcacaagatttcttccagggacgcagccgcgcgagcctctcccaagaacccaaaaaaaacaaaaatcaaaaatcgggcaaaagaggaagaatggccaatgcccgccgcgccctacgctccgagccgatcaaatcccgcccaaagctcgcccatcccggcaagatccgaccgccccacctcacccacccaagaacagccaagaaaacggacgcgcgcagcacccaaattggggaaaatggcggcacgaaaccgaaccccacctcctcctccccggatccaatccagccagaaaccaaatcgagcgaagcagcgcgcgcgcgaatccccggagggccaggagagtgggagattttcgagaggagggcgagatctttgggtggtgggtcgcggacgaggaggaggaggggagtgaggagaggaggttaggacgcgtgcgtggtctgcgtgtgtgtgtgtgtgtgtttgtgtcttttttttttaatatatagtattatatatggctggcgtttgctcgctggatcttaattaaacccaattaagggcgcaattaatcggtgacgtggcgggcaattaaggggggtgtgaattggttgctgttcatctcgcccgtctatttttgggccatggaggttggatcgcgtcctttccgtttgagcacgaatctcgatgcgcccttggttctagaaggctccttccgtttccatggatgaaatgttcaatttgagatttttaatatgtctgggatatgtatattcagatggtaaattgttaaacctcgcagctaaaggtcaaaaatggttgaggggtggtttggtttgtggcctaaataggccttaccaaattttatcagtgtcaaattttggcaagttttgtcatgactaattttggtaaggtaaagttgtgtttggattgaagccaaaatagcctaagttcactattgaaatggcctattttcttaggcatgctaaaatttggcttcaaaccaaatagacactaaacgctattaaaattgttaaatattggtaagcctaatttatgcctcaaaccaaaccagccctgaatatatcttaaatagttgtttttagggttcaattcttgaaatttaaagaaatgggacgctttttgaaacgcagaaatttcgccgagctttttatattttagtttaaatattgtaaaactgctccatttcaaattaaggtctaagaggtttgcgagtatgtcaacttaattttaccgaggacacctgtctaacgtgaacttttttttccctgaatatttgtcatagctgtactgatccatatggaaagggatttaaaaaattttccg

SEQ ID NO: 67675 - DNA, 1093 bp, Oryza sativa
  unsure (1)..(1093): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtttgagtaaagtgcaccagcggtcctcaaacttgtaagggtgtgtcatctaggtccccaaactctcaaatcgcatttacaggtccctaaacttgcttagccgtacattgcctgtccaaaccccatttgactcggtctgctcgctgacgtggcttgccaacgtggaggggaggagacagccggggtggtgcattatgcattaagccccttattttttcgccagccctcagacgataaatcccccactcttttttttcctcggcgcgggaaggacgaaatccccgactcctcgttatcctcggtgtgggaagggcgaagtgggcgacgcaagcgagagaaggtggtgatcgccggtgatctccgacaaccaacgccaatcgatcataggattggtagagagggtgggggagtgattctgtctgcacccatcgacggacgcgacggcagagaatggtggcaagattgcgtcgactaggtggagacgcgcctgtgtacggtgagtaaaatcaagccctaatccttgtatgctagcaggtttagatcgataataggcagtaatgtaccttgctgttggtagaaaatttggaatttgctggctcggttcgatgcatgttttgccgtacggcaaagctagggttttttgtttgcacaagtttacatgctgtatcgtggattgaaggatttgtttcttccttactaggtgatgggtcagatgagttcacagtgaaggttc

SEQ ID NO: 67676 - DNA, 1650 bp, Oryza sativa
gtagaagttaagcaaaagtcaatggcatattgtagaacatgataaagtcagtggcaaatcgtagacgtgtgacaaagtcagtggtatataatggattctctctttgcatttttatccgcctgcaaaattgaggctgagcgaccggcatacgaaatccgttcttttagcagtgcatgattccagtatttgtattccaatttaaaagtactcaatttgcccgttaattgcaaataccacaaatgcaatcctctcggctatagaatctgttctagaatttttcatttattggaaatactgcggctgagtatcattctaaatcctatcatactgcagggttgaaatcaacaaagcgaatcattttcttgtaactttgattgtttgagctacgaagaaataaacgagcaaaaatactaatttatggggaaaatatttatgttattagcagtttaaaagataagactgaacagtagagtatgatgaaaaaaaaatctaaaaaatcatctgtaaataaaattagatctcaaaatttaaattttggttaccgttgaataagatttatgattgactttgatccttatatgtatcacagacgacagtacgtgcacacatgaatattagtaacgggtgagatgtcatctaaatataataaaatttcgatctctcttgttatgcattactagtactcttactatttatatgtatagtactccctccgtttcaaaatgtttgacaccgttgactttttagtacgtgtttgaccattcgtcttattcaaaaaatttaagtaattatttattcttttcatatcatttaattcattgttaaatatactttcatgtacacatataattttatatatttcacaattttttttaataagacgaacgattaaacatgggttaaaaagtcaacggtgtcctaaaagtacagtccaaccgttttgtcccgttgaaactgcttatatagaaagaacaaatattatatagattccagtgatgacagcaattagatagtagacctaaccaagagttatataaccaaaagatgcactgaagctttgcattacattgtgcaaaaacaaacaccattaatggtgctcatctaatatgctggccatgcagttcttgctttaaaaagctcagaagagaacaggattctgctgcaattaaaggttgctggctggttggcgttccactatatcatccactccctaaaatatcaccatcatcttttctgttggcgagttcatctagttaatttgtgtattgggcttacatgcaagatggccccatgttttcaggtggcatgccttctttttatcctttttctactaggtagttgctcagtgcacaagttttttttcctttcttttttatcatgggcattagagcagctataatagcaggctattagccagctataaatatattttcgtgagatgaaagatgagagaagagcagtgagctacagatttgtagtcagctgcagtacggactacaagacgcagtgtatgtatgacaggtgggaccatatattaatagtatagtaagcaactattgtataaattggagttagtagtgggctatactattaaactcgcttttatggatactaatggtttgataatatatagtattaggtgtttgaact

SEQ ID NO: 67677 - DNA, 911 bp, Oryza sativa
tgaaagaaaggggtaagagacagaaacttgtgcgtgtttcaatatattgtatatatgaagaagcttcgttgttgtcatcaattaatataatatattagtgtactcgttgtttttagtgattatttaccaaatatagtgaatccaaaatactatgtgcatgttccaaaggagtatacaacacaatttgcatccccctttaaactttagaacttaacccaaatctgcaacagcaaaagaaaaccaaacctccaagaactcaaagagcttcaccactccatctctaaaagtgattttagcatcagccacagattgccttatagcttcatatgtaagtccaccttcgataaggagagcatgtgtcttctcccacctgtagcaagtaatggcatcaggactgattagacttcgtgaataatctgcaggcaatgtgcctacactgaacattcaatcatggtatttgctggacaactgatgaatggcatggaaatatcacaagcgcatcaagattgcacaaaatctgaaaaaaaaaaaaagaaaggcttccactccgattgcaatccatgcaacacatttaagcttgacatatgaagaagcataagcatcaaaatcaaatgttgtatgcagcaccactctcacttcgtcatcacttaaatgctaaattcccaaatatgtccaactgggacttgagaacttgaccacaacagaatccacctgatcggtgtaccaaaggataatagggtggaaatttgcagcactactcactaaactacttcctcaccattcttccatgagcttggccttctcggggagcgggatgtcggggcagatctcgatggggtggtagtgctcgaacagctcctccctcttggcgtcgtactcctcgttcccctgcctcagcaacccatggctgc

SEQ ID NO: 67678 - DNA, 771 bp, Oryza sativa
cctaaattttggtagaagtttgagagtagaaggtttaggaattaggtttaaatctaggatttttttttgggatggaaggggtatttgatatagcttcaattccatcttttctagagctgaagtccaaccaaaccgtcatagctcgcttaaaagacaagtggaacatgttagaattctctcgcaaaataaactgaaaacgtgaggtggggttcatgtcaaaattaaaagttgggagctatgccaaatactttatccaccaaaagattttttttacaaaagaaaattttaatctattattggatgtgaattagggcatgtttagttcgtgaaaagaaatttttggatgtcacatcggacatttgaccggatgtcggaagggtttttgatacgaatgaaaaaactaaattcataactcgcttggaaaccgcgagacgaatcttttgagcctaattaatctatcattagcacatgtgggttactgtagcactatggctaatcatagactaattagactcaaaagattcatctcgcgatttcccctctaaccgtgcgattagtttttttaatctatatttaatgatctatgcatatgtccaaagatttgatgtgatgttttggaaaagaaattttgagaactaaatcaggccttactatatacatctactcctaaattattattattattattttcaaccgagagtagtacaatgggaatgacgctggtaacgtggttataaaatagtctaccgaatgcttgcggaggcggaggac

SEQ ID NO: 67679 - DNA, 747 bp, Oryza sativa
aagcaccatcataattcaaaagccccatgggaataagttcagttgttaactgaacctctgaaaacaagtagtgcctccacaagaaggatcagaattctaacaacttgatgctctgttggaagcatatataccatacgtataaacaatagcacagaaacaggtccaaaacatagctaacacatgtgcattactcattgattagtaacacaaggttcttgatggttacaaatccggcacttgagaaaaatatgtaggagcaaacacctatttatacaaaatgcaggcagaaagctcctaggcctggacaaaaacctatagtagttagttcatattaggcaggatacgagcgcaaacataaaggacacaaaatctccagcaagtatgcatgcagtggactgatgtcaggacagatcaccatcaggaagctatacaacagcaacagctggtgctagcgcgatctccattgccggtggtggctcaggccatgagaactcaaaaggggcttcgatggttagaatttgaggggctgaggtaatctcctttggggatgatgcagtgtagtggaactctatttgaagccggtggtgcaatggcgtcgacgccatcaggcctttcttgatgtcaacctgtagttcccggattgggatggctgccaagaaactcttgatatactccttgcatgattccttgccctttgaaaccagtatgttctcttcagtgccatcttcactgtcctgctcaaccgag

SEQ ID NO: 67680 - DNA, 2287 bp, Oryza sativa
gacagtttcaagatcaaagtgcttgtcaggaaaacgctctcgtacatcagattctcacaaaggtttctccactctaatgatccttcacggattaaactgtcaaattgtgattgtataggcattatatcctggtttgattggaaccagtccgcaataacagccacaagtgctgtgcaagcactctccccagcagcccgctcacttctctggtctattgatgcaaagaaaacatgggaagagagcttcagatggccatcacggctaactatctctttcaattcccaattcccaacaacgaagttgtcatcaccaaattctgaaaccataccattaatggacccatcttcaccccttgatccctgcaattgaaagatgtacagttaagaacatgtatcacagacactcaaaactagttctatgatttagaaacaagccattatttaaagatgcagatgatgaattgtaaaatttacctctgaaacagatccatcagaagaggttagcagccgtcgatcatagtcaatatcatcacctccctcttctccatatgctttcttcaacagaggttcgcctttgccttcagtgatcgcaaactcaacttcctctttctccaaggaaggatactccgttttacagttggcagcatggtttcctcaacagttgatgatggctttccctctacatggtaaccggcatcagatttgcggtgactataatagatccagtcctcatgctccccatcaatctttgcatgagcataaactaggccgcgacatagttgacagactgcagtgagccataactgaaggacttcctgacagttgaatccccaacttcatcttgctgtgccctgtcatccaaatcgtcatccagagactcgatgtcacatggatattcagcaccatcactgttaacatagcatttttcttcactgctttcatcatcttgggatgtcttcttggaccttcgtgtcgacaccagatcagtgaggattttcacctttctcagcccggctctgataactgaaacctcatcttttcctactggagcagaatcaccagaggatggggataatggagcggccatagcagacctttgtgaagcatcagatgtttcctgaaaagcccttaattccaccatacccagggtgagctgcaagaaagaaaaggttttgattgtcagaccagatggaattcgaacacgaattgtgaactaaagcttgttagcaccacaaacttacatgtagcgagggagctgactcagctgaaccatttggcacggacaatgggagaattatctcaatattctcttcggcggcggatgcataatctgctaggttaagggaagcagttccaagaattgatggcttgatctttggtcctctgttggcagcctaaatcgagagagaacaaatgaaagtcacagtcagactcgctagcagaagtaactgaaaacaaactcatcagcagaaatcgctcaagaaaaaaatgtgtagaacaaaaaaaaatgcatactattaaatgacacgtttccgatggccttgacaagaaccatcttgtccacatttgttcacaccttgttcgcattctcatataggtacaaggttattatcaagaagttctaactggttcttattaacgagaatatctcagtgcagaggtaagaaatgtaaaattttccattatacaaaatattttgattattacgcgattcatagccatcaactactattatattatatatccattcattcttcagaaccaaaatgaaatctttttcccatgtaagacgaatctaaaacacacaaatcatatcagcaaggagaagcaaaaaaaaaaaaaaagtagccaataccctatccatagaccagacaaattaaattaagtaaaattgataacatagataggtaacagtgcaatttttggagcacaataatagagggaaaaaaagaaaacaacaaaaaagaatttcaacaaacaaatctattctgagaaagtgagacaagaaaaagacaaaaagaaaaaaaaactatgatgccaaaaaaatccacataaataataattatagtcttgtctctaaattcatgtgaagaacatagacggtctactactagtaggaagaagaagaaaatgctcacagtgaacacggagaaggcgagctcccatggctggaacgcggcgtgctcccggtgcgacgcggcagcgagcgtcaccggctctcgaactcctcctcccacgcagccaccaccacgcccggcgcgtctctggcgcccgcggcggcagcggca

SEQ ID NO: 67681 - DNA, 2358 bp, Oryza sativa
ttctttaaaggctgcgtacgagagcagttataagctaaaaactatggttgtgtttagtttcacatcagaattggaagtttggttaaaattagaatgatgtaacggaaatgttggaagtttatgtttataggaaagttttgatgtgatgaaaaagttgaaagtttgaaggattattttggaactaaacacggcctataagagaaaaaaaaaagaccatcatttttcgtgcgtacgttttccaaacggttaaacactgtgatttttaatatttttttagaaaagttgtttaaaaaaataatattaattcatttttaagtttaaaattatcaatacttaatttgttacacactaatagttaacctcgttttgcatgtcttctcaatcttctctatttcttttcttctaaaaatggaatattctcttcaatagaaaataccgttttgatgcctgataaactgaaaaaaaagtttttgagactaggtatactactttcgataggatatctctgaggaagaaaaaaaacttattaatacagctacagtatagttgtaatataatatattgtaagctacaacgcaacttttatataatttggttggaaataaacaagaaatgtggcacgacgagtagcttggaaggctgacacatataaacaacagtaccttttttaaatctctgatacaagaaaagaaatagcccttattttcttgaggttgtaaaaaaatgtattgtttttttttctacggcgtgaaacatggcattggtaaaattgatgaagtggatatagatgctctggctactccattattgtccttgtggtttgtggtgatggattggcctcgccaagaaccaagcgttggtaaaagggcaaagagcgttttgtttacgtcgtcttgcgttggtaatcaccacgagagcatctactggactaccactactagcagcagcatctaccgatggatcccaccgtttctcgttactggttggtaagtaataagagtagtttaacactatttatctttaacgtttcatcgtttattttatttaaataaattttatgattactatttttattattattagatgataaaacatgaatagtactttatgtgtgactaatttttttaaaatttttaataatttttttaaataagacggacggtcaaatattggacacggattttcacctctgcatttattttgggacggagggtagtacgtgtgttggtggtgagcttcgtcctgtacataccgccgtaccattttgaaaatgtttttggattcattcgagattgccaaattgtttcgaattgtttggtctcacactccggatctgttcggcagttgtccttgttaattctttaatctgaaggcacaatcattggtagtacctctgtaactgttcgatcagtgttcagaatttgagatggttgttttatcttgaaaatatatttacttgaatttgttgaacagcttgcaatagagtttcaggtactagctacatatgtcttgtttcaggtagctctaccaatttgttgggagaagatacagttattagaagctctcctaaaaccagggtcggccctagggggagggggggttaggccgtgcggccgcctgaggcccccaaaatctagggccccctatatacacatatagtatactatataattctagtccatgggccatgtgcctatattaagttagacaactgaatagcccaatatagaaaatgaattttagtccatcgtcaggcctgtctcagcgaaaccgaagcgatcttcatctgactctcgtcgcttcgcctcgatcacatcacgccactcgcgtcgtgccgtctcgatcacatcacaccgctcgctgctcctgcgctctcggcgacttctcgacttctcggcgtctcgcaaacagaagcaacaagtcggcaaatcgcggctcgccagtagccacactcgtgtcgatcgtccgccgatcgccttctctgctcgttactgctatttatttctctttgaaatttcataatattatatatagataattttatcacaacgaatattcaatgttgtgtgtttataagactatataaatatatattagtttatgtatatatataggggcatctatataagtttttgccctggggccccaagaccctaggaccggccctgcctaagaccatcacagtagtatagccatctactagctccaaatcatctatagccaatataatagccaattcatacaatagttgcttactatactattaatacatggtcctacctgtcatacacacattacgtcttggaatctgtgctgcagctggctacagatctgtagcctgctgctcttctctctctt

SEQ ID NO: 67682 - DNA, 983 bp, Oryza sativa
atttccattagcaagaagacttaagtaaggggataacaactggactagtacgcatatctagtggttaattaccaaataattgttaaaataagtctattgtttcccaattggccattttttttgaaaacttgctatagttataatataattaaattgcatacaactatatattatagttatatatactatagttctttttaaaagtattttttttaaaaaaaaacttatgacagtgcaattaaacattgttaatccctccattctaaaatgtattgtatatcatagccttttacacgggctctagtgaggcaagcccatcgctgcgagagttcggtgactcgacctttcctcccccatcttccccctcttctataaggacatcagccagaaagctcgcgggggacaattatcgatggcactcatgacagcaacagggataggctagctcacaatgaagagattttgacactccaacctcctcgtcataaccctcctcacgacttcattcaccacctacaaatcttggtcgtggagggccctagagatggcccggttacaatgtgtcctccatatatccatggtagacaagtcagcagagccaccttcatccttcgcaaactcacgcgccacccttttatccttctttcgcagccactaagcttgcctggaaaaggaaagagatgtcggtgctgaggggaaatgtgatggatggtaggtaggtcttggtagcacacattaacttaggagagacaggaggggggggggtgagagacaagagaagagggagaggaagtcaacaacatgtgaatcctaacatcgaattatccatctttgttgacataagtgtgctaggttagaccgaaaccgcctagcttgggggttgagggtgtaatttgctccagtttaagggcgtgagggtgtcaaatgtctggtgttgtaatttaatattataaatcaaactattatagtagttgaggtgcact

SEQ ID NO: 67683 - DNA, 11640 bp, Oryza sativa
  unsure (1)..(11640): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgattgctaaatcctccatgggttggctatggcatcgtagattagcccaagttggaatgcggaatttggcaactcttctaaagggggaacacatcctcgggctcactaatgtcacatttgagaaagatcgtgtgtgtagtgcttgccaagccggaaaacaagttgggaatccacatcctatcaagaacatcatgactacaacacgccctcttgagcttctacatatggatttatttgggcccgtggcttacataagtattggaggtaacaagtatggttttgtcattgttgatgatttttcccgcttcacttgggtgtattttctctatgacaagagtgaggctcaagatgtcttcaagcgcttcgccaagcaagcccaaaacctctatgatctcaccatcaagagggtacgaagtgacaatggaggagaattcaagaacacacaagtggaggtattccttgatgaagtgggaatcaagcacgagttcttcgccccctatgatcctcctcaaaatggcattgttgagaggaagaaccgaactcttattgaagccacaagagcaatgcttgatgagtacaagacttcggatatcttttgggcggaggccgtgagcaccgcatgccatgccatcaatcgcctatacctccacaaaattctaaagaaaacttcatatgagctcttgagtggtaagaaaccaaatgtttcctattttcgtgtctttgggagtagatgctttattttgagtaagaggccttgttcatctaagttctcacctaaggtggacgaggattcttacttggctatgagtcaaatgcacatgcctaccgtgtcttcaacaaaacctctagtattgttgaagttacaagggaggtgacatttgaagaatctaatggctcccaaggagagcaagttgttgtacatgttgtaggtgatgtggatccaagtcaagctataggtactaaggccattggagacatacgaccagtcgagacgtaggatgaccaagaagatagggatcaaccttcgtcattgacatccaatagccctacatcgagtcaagagtcagttgacccggaagttccgggaccagatgatcggaacctccggacctccccaggccaggaagtttcgggtccatttgccaggaagttccgggcagaggacagtcaaggcgtgcctacggcacaagtggatgggattgatgccgagggcactatagagcatcctgatcaggctcaggtcccctcggtgcaccatccaagaatacatcacactgtccaaagagatcatcccgtcgacaacatacttggtgacataagaaagggggtaactactcgttctcgtgtcgctaacttttgtcaacactattcgtttgtctcttctttggaaccaaccagggttgaagatgcacttggtgatccggattgggtgatggctatgcaagaggagttgaataacttcactcgcaaccaagtatggacgttggtggagagacccgaccaaaatgtcatcggcaccaagtggatcttccgcaacaagcaagatgaacatggagtggttgtaaggaacaaagcccggctagttgcgcaagggttcatcaaagtcgagggtctcaattttggtgaaaccttcgcacccattgctcgccttgagtcaatccgaatccttttagcctatgccgctcaccatgatttcaggttattccaaatggatgtcacgagtgcctttctcaatggacctatctcggagttggtctatgtggagcaaccaccagggttcgaggatccaaagttgccaaaccatgtgtacaagctccacaaggcgctctacgggctcaaacaagcccctagagcttggtatgaatgtctctgagattttcttttgaaaaatggttttgaaattggaaaggcgtatactactctcttcactaaaaaatttaagagtgatttattcatatgccaaatttatgtcgatgacataatatttggttctactaatgcctcttttttgaagaatttagtagtatcatgactaaaaggttcgagatgtatatgatgggcgagttgaccttcttcctcgggctacaagtgaagcaagcacaagagggcactttcatctctcaaaccaagtacgtgaaggacattctcaagaagtttgggatagaagatgccaaacccatcaagactcctatgcctactaatggccacctaaacatcaacgacaatggtaaatgtgtggaccaaaaggtatatcgctccatgctaggatccttgctttacttatgtgcatctcgtcatgatatcatgcttagtgtttgcatgtgtgctcgctttcaagcggagcctaaagagtgtcatttgattgccgtcaagagaattctaagatatttagttcatactcctaatcttggcttgtggtatcctaagggttgtgactttgagcttttgggctattccgattcggattatgccgggtgtaaggttgatagaaaaagcacaaccgggacttgtcaattccttggacggtcccttgtttcttggtcctccaagaagcaaaattccattgtcttatccaccgccgaagccgaatatgtcgccgccggttcttgttgtgcccaactcctttggatgaaacaaaccctaaaagattttggctacaacttcaccaagatcccactcctatgtgataatgagagtgccatcaaaatagccaacaatcccgttcaacactcaagaaccaagcacatagatattcgccaccacttcttgagagatcatgaaaccaaaggagacatatgccttacccatgtgagaactgagagccaattagccgacattttcaccaagcctttagatgagcaaagattttgcgagcttaggagtaagctcaatatcttagattctcgcaacattaggtgatgggtggttggctaatttatagccaaacatatgtcactaaaaaaaatgagcttttgtgtcttgagatcacttcttgtgtagaagatggtcttgataccaggaatacagctcaaacattccctttttttatccaaaaacctttttgaaaatctttgcgaaattcctttgagtgccttttattgcgaaaatttgttttttatcttctccttgtgatgtatatcgaccatagttttgtactgattgcttgttggctggttatatacatcacaagtctttgcatgtccatagtcctctattcctccttttgattccttgtttctaccatggttttgggcctgactgctctttatctgtcaggccggaagttccgggcctccctgtccggaaccttcgggtgtcgaggagtatatattctcagggggagttagaaaccctagtctctctcctcattcttctccctccccgacgccagccctagccgccactacagtgccccgagtggtgattttctctttcctccaatcaaattcgattattctctgtggattcatctacattggtggctgggaggttctttctgtgatcgattcgcagtttcctctctcaaggtagcacttttgatcttctcttttggttcatcatgtttttgccccgatctctaaatctgtgaacctaggaagaaaaccacttggatagtcttgtttctgctaccttgtagatcaccgatctataggatttgttcacatgcactagctatttttgaaacctctgttcctcttttttgccggccggaagttccagtgttcttgcacccggaaccttcgggcgctatccagccagcctgccattcttgattctctcaaattttgcctaactactgcactccaatttgttgattcctgttgcagtaagcactatgcctcgtgagaaaagacagaaagcctctcaggatgtgtccggtgatgagagtcctcctattcggtttcctcatggttgtttgggtaaagagaaagtggttgagggcggcagtggcagcggcactcgtacttcttctaggtttaccaggcaatccagcaaccgtctagttcagattcgggatgttgacagtggtcaaggatgtgatgctcctaatacaagaggtcgtgggagaggtggtggtcgcagttctggggctggaagggcatctcatgatttccctgttggatctcgtgagaatcctgttcggctctacaagactcttggatttgacaccactcctatgcaccacattggaagacccaagtccaactaccttcatcagcttgccaagtgcagaagggaccgtttgattgatccagagactcggcctgaggagtcacatgatcctcgtttcaggactttcactcaattggattggtataattcaatgattatggctagagaaaatccagtggttgagatgaagtggattgattgggcttacatgaggaagaagaacaatgaagtgttcaaccaagtgatgcaagtgtgccacaacaagaatcttggagatattcttgccttggagtatgattggaatgaggaggtcattgcacagttctatgcgacagcattctttggtactacaaggaagggaaccccttatgtgaagtggttgactgagggtgttaggcacaagatttccatggcacagtttgctgagatgttggggttagatgatgaggatctcaataggcccaacattcatagtgaagcacccctccccatgatcaagaccaagttcatgtatgcaaaggatgctcctaggacttgcatgggatctactcatggattgcatcccaactataaggtgttgtactccatcttttgttggtctttgcttccaaaggttggagatgctactgctttgccatccaagcatgctcatcttcttagtcgcatgcgctacaatcaacctcccttcagtgtgatgaaattgatttggtatgagatcgccaacaccattcttgagcctaagcggggttgcatctatgctcctttcattatgaagatgattgagacaatcaccggggtattctacatcaaagatgggcaccataatccttttcgccctcgtgctccaccttcctcttctccagtggtccctcgatctattccttctacttcagctggtccttctactagtgccccaccaagttcctcgagttcttctcccatcaagaaggcacttcaggcaattttctatatgtgtgctaagactgccaagaaagtgaagaagatcgaaaggcgttagaaggaagatagaagagaggctgggaaagaagtgtcagatgattctgaggatgaggtctatgttgatccatttgaggcttatgaggcagcccgcaacgttgtcggtgaaggtccatccaccttcttcaatgaagaatcttcccattctgatgatgatgatgatgatgatgatgatgatgatgatgatgatggtgatcagggtgacactgaggcagctgctgaggatgcccccactgatgttaatgagggtgacaccgctgctcagtccgatgagtctcatctctccggcgatatcgagattgttccctctgatggagatgagtgatcctcttcttctcttcatagtttctcgcctttttggtaccttgatgccaaagggggagaaattgtgaattgaagggggtcatttaaatcctttttgctgccttgactgttgtctggtcatttggccggaagttccgggtcctatgatccggaggttccggccaggcagatttcctctctattatctctctctatatggacatgtaatcgtattctattatggttggatgtaatgactgttagatgctttattatcctttatgtcagtaagttagaccatatggatgttgcattttgatgtgatgatgtgttcttttcatctttttgagtgattgccatgtcatctagtctttctttttgcatcactcatcattcaagcactttcatctgcatctcttctttgataagggtagtgtgaggtttcttttgagctttccttcatcctatgcatattgttttcatttctagttctttatatgcctatctttagggggagcttcacacttctctcatcacccaaaatataaattctattatctttttgtttgctttaaccatgttgtcatcaatcaccaaaaagggggagattgaagatgcacttaaaccccctggtgggttttggtgatcaataacaaggtggttaaaggggactaacgtgtttatcaagtttattcataggagttcagtcctaaagcaagttttgatgactaagaatgcaaggagacccccccccccaatttgaatcttcctaagtgcgaaaaacaccgaaggtgattagactaggtttttctctttcgaaattgagtttaggaaaaaccgtactattaagaggggtttcaagtgtggttctagggtatacaaagtgctcttagtcatatccataagtcaaaagatttttggaatcatttttgaaaaatgattttctccccgggacagaaagggctacccggaggttctggccggaacttccgggcaccgtttatttgcaaaaaatttcctaagtgttgcccggaagttcctggcacttttgctcggaacctcctggcaggtttccagttcaaacttgtgagtaacggctagatgacgtcacctagccgttatatatatgaatttcgtccccaggtcaccttttggccattccacttctgttcattcatgttctagggttttctagccactcccaagcttcctttgcttcctccactcaaatctagagactatcttgtgagattgagagattagatgagagtgtaggagtgttttggagatggcttgaagattaggtttgattgagaactttggataccttgtgggctgtcacttgggcttattactcttggagatcttctcctagatggttaggcgtcgcccgtgagcttccaaagatcttgtggatgtcccgggaaagtttgtgaaggttttcctcacctccacaagcaaacgaggtaagtgagtaaagtttcttgtgctgagttttcagaggttgtcctaggtagagcaacttgcacttgtggtcttttctagaaggaattgtgagttggatcttggtggtcactcaattctagaaaacaacctagaagtgttgagttgaagactgtggacctcttctgggatgaagcataagtgaggcaaggggttaatcgagacccggctctttggagcacctcaacggagagtaggatccgtgtgatccgaacttcggaaaaaactcgcctttgtctctcgtgtgcttgatctgtgtttgaatctgctggtatcttgtgattttcatcttgtgcaaccctgtgcctgattttcactagctaggacctgttatacttctcatatttcgtttttctctgttgcccggaagttcctggctcaagaactccggaagttccgggctgctcatcactgctaggatgttccggtgttcatcactaggaggttctgggccctgtcaatttaaccgctgcgtttgttgagaaaattgcaggaaagcctattcaccccccccccctctaggctacatctctgcacgttcaggggagagcggcatcggcttgacggctcgctaggtttggcgatagcgcagtggtccctggctgcatcgaggcatggcgagaggagcggaaggcgcgcgacggttggcttgccggcgaagggcggccatgcgggcctatatgggtgggcggcggcgatcgaacggcgctgcacgctgcgaggagcggctggtggctctacttgctaggctggcttgaccggctgggccaaggcaggcccggtggcttgggccggataggagagacagaaggagagaaaaggaaggccagacgaaagaataggaggtgaagtcaacttctagcagatggggttagggtttggatgggctaggctggcctgaagtggaaagaaaaaggtcaaagagggaaaactgggggccaaaaacagacttttcctagaaaggtttttcaacaaaagatggtttggaatttatttcataaattggactttttgataaatactttattaatagtatttgcttacgaaaataatcagggaatcaacccttataagggatttttagaaactaaataatttgaaattttcatttgtaaaataatcgcttaaagagatattaattcataaaagagtttttttaaggaacatacatagcatttacttttatttgaaaataaatcattaattaatattatttcataatcatggttctttaatgaacattattctaaattcaaaattgaatttagaatttgaaaataaccttaaactttatttaattgaggcactggcacaacaagaaaagaaaagaaaataaaatccaacaaataccaatatgaacgaactttgacaaacatttctttattattcccattttttgtttctggattttaaaacttgaaaatttcagggtgctacaaacacctcgagcacctggtccacaaaccccgtgaggcgaggtgttcaatgacaacggtgtatgtgccggtgttcggaagtgcaccttcatggaccatggaggaggttgtgtgcagcatgcccaggatggcagaggcaagtgagaggcagtgagggaaggggaaaggaggcaaggagggaccgaaggttggggaacactacaaaggaggcaagggtctggaagagttggagccggttgtggcaggagggtcgtctccgccaacgagtccatggccgcctaagctagctccacttctcatataactgctaccatcaatcctccaccatgagctcggtgacgctgtggctaccacccttgacgacctaggggaaatatgggaagacaagggagaaggaagcgagaaggaagaagactgagacattgattccgggaaagaggcgacagagggcgggagaagggtattcaggacgagcggcttgcgacctgtgggcgataggtgcagctctagcgatgacccccagcagcaccaacaccccaagtacgagagagacactatgcatggacatgtggcagtgggtggtgccaccagtcctccttggcttcctcttactctgtcctctctgtcgcctttggggcattccctgcggcttctccttctcgttcctctccggtagttcctcctggactaccgcggtgtccacctcctactcttccgcaaccatggcaccaccgtgaagctcgccgtcactgacccatcgagacgcgcctgctaccctatcaatgtgcccaccaccgacatccttgtcggcctcctctcctgccaccggcgcagtctggttcacgcactagcgcaccacaccccttgtataagagggagcagtagtcgtggccggatgggagcggtacaaaattctaccttcgagtacttgggatattagtgatacacaattttacataaagaatatgataccttctagtatctcctcaagaaaattttattagagatgcaaataaacttacatatactaaagtacaattagcaatcacttggtagctagaaacaagttcaaaatatggcaccaaatcttcatagcaaaactattgtgtttttctcttcgataatggaattaaactcagcctctacatcacatattatccgcccaccatagtattaatctagtttagttcatgaaccgattgctaatggttcgatcgagatgatagatatatgttggttcacatgacggcgcaggcgttggggttgtcgtcgctgaagagggtggcgaggcgctcctcctggctgggggtgaccggcagcacggcgtccacccggcggatgtgcccgttcggcgccttcttgtcgtacgccgccggcggcgccacgtacgggttggtgtaggggacgtacggccacagctcggtgcgcttccccgtcgactgcgcccgccgcagcacccgctgcgtgtccaccatcccctgcaccgtcaccttctgctgcttcctgtttatctccaccgactgcacccctgcgtccatatatatacgtactccataataaactcaccgcctcagctagcgtacataacctgacatctctgtgacgggttatagtttgaaaccttacattggaattgttacatatgtcggttccaaaccaaaacccgtcacagaaattaaatccccatttgtagaagtgtttcgaacactttttttcttggattgaaacaaattaacctagtcgatcgttttggctttcgcaaacggtggtttttgactaattaaatttggcttgtgtggagaccattatatattgtgtcagagagttcacgtcgtagtacctttcatgttggcaagggtgttcctgaccttgagctcgcagccgtcgcagtccatcctcaccttcagctccaccgtgttgaactgcctcttcttcttgtggctagtcttgccgctgctgccacccagcagcagatcagacaggtagtgcagcgtgcctcccatgcttctcaactttgcctctaatgaaagttactaatcaagtgcaaactctactaattaattatagaagaaacttttccctggaaagagataagagatcaagtactgtaatctctagctagcttgggtaatttggtgacatgctatttgtaatggctgcttatatatagacagaggatgcagggagagaatcagagaaggcaatttgtgcacatcaaggtcaggatgcagtgatgcagctaaggattagtgtgtgggagttgctggcaaagagctttctctgagatgcctttgttccttcctacctttgctttgctttcctttgcttcctcctacacagctcactgcacacgctgacctgattacacattttgccacacatgattgttcttatataggagagttccagctctcaaatgatataaagccatggccgaccactgttgataaagtagagatgatatattcgccccctgtacctgctcattaatttgaaaggcttaacaacataaaacaaacaaaaagaaaaatagaagtactccgtccagtcaaatatcaaatatttttactagagggagtatctcctcatccatgcttaccttgttttgtagtacagactggaatggccgaaaaacaacatgcccacatgcacgtgcaaaatatcttatttcaatacattattgtgcagtttgaaaacattattgactggattattctagtggattatatgtctacgtaattacaggaataaatatattaacaaaataacaagtaaaaataaaaaatagcttaaacaattaaaaaaaaagaattcagggcttcttttgaaacacatgattgagaaaacgaatgcaaaacaaagtattataaaacataagagaaaaaaaatacaagaatgatcgtttcagtaaaacacagggaaaaatagaggaataggatgaaacacatatactcaaaataaaattttagatagattgaagttcttgccaactttcttccaaaatatgtat

SEQ ID NO: 67684 - DNA, 12938 bp, Oryza sativa
agtggatcccccttatattcagccaatttttgtttagcttgatgctacatcatgcgaaacaactctaaatattgaccaaagatacatatatatatcttaaaaattgaatagcttccaatttggagatcaagcacggtcgctttaaaacttttgtaaaagcttaattagggttgcaaaatatactcctaccatccattcaaaaatatactccttccacttctcaacctggtctttcaagtcaaaattgtgcgcaaagttttgttcgtcatatttacgagagaaaattgcacgcaacaaggtgcttatatatgtccagtgagattccaaggagaagactttgcagtgtgttgagcgcgaaatttggcattgaagaagagaaaagaaggaacaaagaatatatatcaactcagcttttctcttttgttctaatttgactatatatgatgtattagtaagatcttgaccatctaaacgtagatgataagatcgaactagcttgtctagatgggacttatctccttaatgcctggctgaagatactccgaaataatggatggccaaaaatttatgcgtagctgaaaggccaccaaagaatatattgaccctagaggtgctacgaagcatgacaaaatgttggaaaatcatatgaactttaaaggaatcactgtccttatataacatggctcattgtcttggggttccttacatttgtcgattgagggaaatcaaaatataaccacgcgtaaattttcactcatatcctaattaaatgttttgaattaaatagttattgtgattacactattcatttactctctccgtctaaaaataaatcaacttttctaaagcatgacaaaatgtttgaaagtcaaatgaaccaaaggaatcactactcgtgcattatcttgggattcaaaacatttgtctattgataagaaatgaaaacataactattgcaagttttcattcgtttcctaattaaatgttatgaattaaatagttgtagtgattacatcaaacaattattctcttcatccgaaaataagtaaacttttgtatttgaatctgaacataattgatttatatacaaaagttaaattattttaggacggatggactaccaaagtatacaaggtctgtttccattaattttcttgttaattttcacgcgcttccttgtgttgttaagttcatatgcaccctaagcttcattctcattttatacaaaagagttaataataaatactcctacgttggagtatatggacatgtggaaccaatccacaacacacaccatatataccaattatatggttgtgaggtactacaaaccatgtacgactgcaaataacgaacccagggaatgatcaatgatgaacgtggaatatgacaatcgaccacttttacgagaggagaatatgaggctagcttaattggtgacgcactgtagatcgagctggaaattaaacagtgacctactacctaacttggaacaagtaccttccgattattaggccccacacacatcacaatctatagtcatgctaactaaggaattcgtacgtgtctagaattaaccattcgaattttgtgattgtgattgatcaacacacttgacacatccaattagttatgtactgcatgtgatttctgcatgcttaattttttttattttggggtttgatctatatacatttataatagaaaactctcaagttgaattaaagttcttctcatgaacagcacattattgtcaatctatccaatttttttcagctttccccccttattaaaaggtaaataaaagctcttttttggcaattgacttttgcttgaagttggttgtttttcatcccaaaactttcaaaaatcgaaaaattaacactttacaacatactgtattatttttagcggtttttgtttgaaaacaaagcgagttttttaagttcatattctttctgtgcacattttgttgatgtatatgttgcttttagggccacaactatgaaatggaagtagtagctaaaaaatattcgatggtttttctcccccaaacttttgaatttgtgaccaccggattgtcttgagatttgggcggcatacaaggaaaaaaactgcaagtcatccttgggagggagtcaaacccacaacatgtggcttcaaagcttgtgaaggtagccacaacttccgggggtaaattttgacaagttatgtataaactagattgcaattatagtaattattgtgtagttataatttaattacatttcaaatatgctatatacttatatttggtttaatgttgtttggctgatcttcaagtaaattatcgaatgttgtatggctgatcccctatgaaattacctaattgaagttcatggtagggataaaccactttcataccgattaaaagtttaaaacaccataaaatatattatggatgttattatttttttaaaaaagctaaggatgaaaaaaaaattggttctgtgttggaagtgaaaaatatattttgagcaaattcaattaccaaacatagacttttttccaataaggataaaatgtgattatatatttctgacctctggatactgtgcacacacaaaccaaccaacaaaaaccattgtcccctgtttgatcaggatgatgacttgcatattgtagcatccatcttgacatcgaatccatgataggtaggaaccacagctgcatgtatctcactactactccactcatcaacggctggcttttgacaattaagcgacgatccatggagcgcgaaaatagaaccgctcttttggaaaaaaaagaaagagagatcgagatcgcgtactgcgggtctgtttggttgttgcctaacattgccataactcagtttgccataggtgtggcatggcaaacaaagtgtggccaacaatttgttggccacaagtgtggcaatgtttggctagaaaatgagtatatgacatgtagacccatgaaataagaaagtgtggcttgccacaactgaaacaagcaaccaaacgctaagctaacaatctgtagcatgcctaacatgtggtgtggcaatgtgtggcaccaaaccaaacagcccctgcatgcatccggtggcaacgacggctctgacgacgactcgagaggatattaatattagtaaagccggtggctatatagcagcgcattatggctgtccctcttgcccatgatcaatcattgtgcatgcatggcttggcttcttatatactccctccgtttcaaaatgtaagactttctaacattgtccacatacatatagatattaatgaatctaaacacacacacacatatatatatatatagattcattaacatctaaatgaatatgggtaatgctaaaaagttttacattgtgaaatagaggtagtactagcttaactggtgccctgaaaaaaggttgatgcttttccacagaaaaaggagagcttggatcgatcctttgaggcatctggccaatcttgttctggcttatgcaacaatcagggtgtacacagacacaataattaactttggagctttctctaaaaacacatataaacgcatacactcaaatacacgcacacatcctatatatctataaagtttatcctcactaagtgtagtcaatactatttctccattctctcatacaaccacatcaattcatttgtttttaaccattggatgattgatctattatcttcattttttctcttatgaattttgttggatgacctacatatctataaagctcattcacactaagtgtagttaatgatatttctcttttatctcattaagtcacattacttcaattgtttttagccgttggatgattgatctatgattcaaattatcttcattcgtttcttctcctatgaagtcatatcactttaattttgcttttggatgatcaatctatattatcttccttcgttttccttagttattgagccatatcacattatttctgcttttgaatgatttaaattatcataaactatgtcatcttaattatttatattttttttcaatggtcaatcaaagatgaaaattatataaagttgatgaagttatgtcatccagttatcttatatactccttccgtcctaaaatataacaacatttacccctcaaaatttgtcctaaaatataacaacttctccaccaacattctcttcccaaccaatcacagctctccaccattcacttttcccacctacctccactactcaaccaatcacaacactccactattcacttctatctactttcttaataaccatgttcaactctaaaaatacttatattctgggatgaaggaagtattatttatactattattatatagaactctcacagcaacacgcagggtttcatctagtttactgaagggtgtcgagtctacaatttaattaaatccgagtagacagattctaccataagaaatttaatcagttgagatacgctcactcatacatttaattttttcgatgcaatgttgtgttgggggattatgcccaagattgtcataattaaggatattactagagcggctgtaaataaaagatattttggcaaaatgcatgaaaatcgattccgtgaattggatcctgagataagccttcaaattgagccattgaggtaacaaaataagtccaattttcatttatgatatttggatatatgcaattaagttcaattgaattggggatacgtctatcacgagtcttgatagtactagataacagatttagttataatttaacgacgtattttgagaagctgggaaccatcacatgaaagatattaaaccttcattcacaaatgtgcagcaaaatcaaattaatcccacatctaataacacatgttttgtcttttaggtttaaaacctaattctcctttttggacagcaaggcaccagtggtctagtggtagaatagtaccctgccacggtacagacccgggttcgattcccggctggtgcatgaacttctatttttttgggttctagcttttctttagcgaaaattttgacgaaaacaaacaaacagccacagtttcagtttttaacagaaataattccggcgaaaattccgaaagacatctccagcccaagctctacataatcgtaccaaatatttgtgaaaagaagtagatgagtgagaattgaacactgtgggctggttacagatgagcgtacgagtctatcttgctagcttgcatctttggttatattaatggaacttataattatctagtatcatattatgtgataatataatattatgacattattcggttatatatatatgtgctaaataaactataaatgatatgaagtaatataatcatgtattataattaagtatgtgatattataatactttatttctgatacgaattttcaccttaacattatatttctttttcgacaatcccatctccaatatccaatagatctgttcagattatattctcgagaaaaaagtaatgataaaaatggaagatagatttgttcgaccattctcatatatatctagccagtcttctctttctttttctttcactctcgtaatctattattctaaagctggcagtgcttgctgccatttgattggtccgattggaaacacatttatacgtcgacacgtgtccagctaaaattaatgcttagtcgcgattcgtggggaagcagcgcgaggaatcgcacggagcaccgagcggcccatcagttcaaccacagatgtcgaaggctgcaactgcaaagatggttggcaggctgtcgcaggcctatcgagtctaactgggcacctggatgcccaataaccacacatgcacatgtagtccagtccaaataggtgaatgcttttgtgtctatgcttgtggtatatataaaaatatttaatttagatgatcacaagattttattcacataccaaacttattggtgtgtatatattagttattatgcaccctaggcttgtgcacacatatttcctttttaaaaaccaaaattattgatgagtcaatcaattgataatttatttttcaaaatatcaaataacaaatgcaagtaaatgtcacatcatgccaaacgtatatatgtgcactcaccgtacatactatgtgctgccctcggttacactcatttttaatttgtaatattaagggtacttgttttggtaacataaaaacatgagataacacatggaataagtgtccaattgcttggttttcataataagctgaataaaaatatacaaggtaacaaaaatatttgcctaaggaaaaaatggatttatcagcttttagcgaggctaaaaataggtataggtgattcagaaaagaattggcattgtgccacacaaaaacactatatttggattctaattggacaacattagtagtttcggctcaatttggagcacttaaaacgtaagagtttatagattatgtttgcacaacgccatatctcagacaaaagttaaatttgaagtttgtatgataaataatagtgatttaaaattatatattttatctaggatgggaacaaaataattcatcgaaagataatcttaaatctgaagtagtgccaaacaaaggccataatatacgtgggctaaaattagctagcgcgtcaaaggacgcgcctattttctagtgttgtactgaagaggatgcccaaattaatgagcataggaagtccatgccctttttgtcccgctctcgcgagcttatcaagggatacaataataaacttgttatatcttataatacaaattccatgcaaacaattgaaagaagaattgtgccacgtggcaacaccggtttcacgggatggctcgatcctgctaattgcgcgcgtgcaagctatgtgatttctcgcgttgctgccgtacggctggcaaagctcaggcagctattgcttcctcctaccaccggatattgaggattaaagaagtaatgatacatattttggttagagactaaaagaggattaacaagatgtaatcaaatcacccactaaaattcctacgttgcaaacatccatccttttacagttattgtgtttccttattttgtatccgtattcatgtgatttatattatttctttcctgtgttttcctctatggaaatcatataaccttttctctttggggcaatttcattcttacccctactttaatgtttaatattgatgttgcccagtattttagggttatttttttgcccatagttttttgaaataaagataaatttagtccctacttttgatggacagattaacgatgttaaatctttagcgagaaggcattcaatacccttactcatgttgcaaacttcccctgtttttgttcatgattgagaatttgcccacatttagcacatgaaccttgcaaattcgataaacttttacccaatatgataattttaacataaatatcaacaaaaatttgcttcaaaatttgacatcttgaaaaaaacaaacaagtcaagcaaatctattgcctacctatgccaagctgtcgtcgtcgtcgcctcctctcataaaccgccgccacctttgttgcctcctcttcccaccgagccgccgccacctcctccccacgtcgagccgccaccatcacctccccgcgctaagccgccgttgttgcctcctccgatcatcgagccaccaccgccatcgttgacctgacctgttgtcctcctccccgtcgcctcctcgacacgtcgagcagccgcacctcctccctacgctgagctacagcagccgccattgtcctcctctctaccatggcctcttgtgcaatgcctagcctcctcctacacgttgcaactgggttgggtggcctacacttgctcgggtcgtccccgttgcctggccggcccacggacactgccgccactgtttcacaacggggattcgggtttaggaagggaagagttgatgccaagtgcccaagcttggagggacaccaagcggtacatgcatattttctaggggtaaaagggtcaatcaataatttaaaaaatcattatctctttctttctctaattctttaccgcactaagtccaatcccactcacttccatcaaaaacaggggtaaacgcctcattcattgaaaaaaatagggcaaaaaacaacaaccctaaaatgtaggcaaaaaacaacaaccctaaaatgtagggtaaaatcggtattggacatcaaagtaggggtacaattgtacaaacaaaattgtccctttctctgttctccctcggtccaatgcaacctatatatgtcttgtgagggctactttgaaacgaagattgagggatgaataggaaaaactagaattctcacaaaaaatcaagcgcaaaacaaagaattataaaacacataaaaatatatgaaataatcgtttgattggaccgtacgaaaaatgcaagaattagatgagagagataaactcataagagacttcgcatgatattgaacctcatgttaaaaatactccaaaacttgtatgaattggggcattccttagaaatttgataagactcaatagttttcaataatcctttggttcaaagaatcatatagaaaaatttcctatagcaaagtttatcgtttctatacagaataaaagttcatatatttttctttcaagtaaagggaccctaattagttactccactaaagtcgaatgagctgggttcactttaccatgcgtggcgaagccacgtggtttttctagtttttctagtgaataccgtattcctcgtttggtgcggtctgtaatacaaatagctttagaactttaattactacctcatagtgttttgtatatgtttagttgttggcttttcggactaacaattgatatgaaaccttacgatctattaggaacggccatttattatggctatgctgaacgacatggtatttgacaaaaaaaaaagttgggttgatgggatttggttgctatggcatgtcaacatttggagcggatggtcaaagaatgttttacatagagcataaatgtaacactccgggtatcttttacctataatgctacacactacggaacaaaaaccactaagttctaaattcattaaaattttgacagtctcccctgtaaatatggacatccacgacaggcagttacatattaaataattaataatatcattcccacagtacgatccatccttataatccacagaaagaaacaaatagatatctgaaagattattataataccaaacgaggatatagtttaaatgtcattatagacctaagcaatatagtttgatagtgtgcagataaatgtgtatataagggtgctacttcccgcccaagcatgcccatctcaatgtgtatctaaaaccaaataaacacaaaagtgagtacataaatactcagcaagtacaatataacacatacacatattggaaataaagaatgagcagaaagttttctttctttgaaaaagaaattgcaaggttaaagaaaatagtagttcccatttcgggcatacatgaaatgaagtagtagtttctatcccggacaattgtgaatacagccgcgcttacccataggaacataaataaaaaccagatagcacatcaatgactcgcatggaacatgaataattgaaaacggaacaaagaaccaaattgaaaccatatcgcacatccatggcaaacataaaacttgaattatttaccaagaaccaaaatacagattattaaaataagaataacatcgtaaacataagataaacttaaaatctaaatggcatgaacaacagtctgcacataagcagccacatatcacatatagaaatacaacagaaataaatagatagagcaaacaattcatgaatcacacaactagttcgtcacgcacttgcctttaaccttgacgataacccgatgaaccaccttccacaccagatctctccacacctatggagcaaaactacgaataaatccttatattcaactaatgatagttacgagatatttactaaaatcgaaacttagaacatataaactttttactgatttgtattaaacaacctatagtagtttcattactgttttatgcgtaactcgcaaaccatctaatgaaatctggcaaccaatataacttcggtcatctagacaaaattttctacaactttcatgttgggcgaaaaatcagtttactacttttctaggtctcagattaaggaaaaaagaattggtgtcactattttcatacccggcagcagtactgcttttgttgtttctcctaagccgtttaccggaatcgagcaaaactagcaccgttagaaagatatcgatgatgaatacaaactttatttaggacaactaacctgaatcccgatgttttaatacctttcaaaatatattttccagcctgcaatcaagaacctcaaaaattgcacgagcggctatcgaatcaatttatatttgaatcttatacttctaaggagtaaacaaaagtaccgttgcagcgaggacactagaatttgagaataaacccactagttacgaaatcaccgaaatccccaaaattgctcggcctttaccttcccttcttcctcctgttctcttgcttcctctgcactatgcacccttctcctctctgtccgatgcagtagcagcagccccacgaaaccattagtagcagcaagaaacaaccaaagccacagccatagatcagatcgacagcagcaggagctcaccgggaagaagcaaaacggaaaggagccaccagttgcgatggatgacgatggctgcggatctccagcaatggccgtggtggcggcgcaaagacggcggtggcaaccgggacgacagcagcggcagcaacagctagcgcaggagtggtggcggctagggctggctgtagtgatctctcgtttttacctttttctttttttttttgttatataaagagactaaacaggagatctaatggcccacatcgtttcaatccttgggacttcgttcgaactccaattactatgaacttatattctattttgcactactcaatgagctctacgcatccatggttcctaatcgcctattcgaacaacggtttcatagttgaacttttgcatttttgttgtaatatttcctgaaatacactaattcaaaactcaggatattacaataagcgacaatctagtctacggattgatggtccctagcatttcttattcgtcctggtttaaaaaactattgtgtgggtgaggtcgggagcatttgcagtacacttttatctattggaattaaaaatatatgactcccacatgtaaaaagtgtacgataaataatagccatgatcacgagttgaattggcaatgaggttttggtcttctaaacaatagatagatctaattttctccaactagtaacgagacatagtggattggtacgtaaccttctttgaggacagaatcctatatttatgggagaactaagttgctggatttctattgcagatctaggtgccaagcggcagtggcctggtgaagacgggtgcccttgaccagtagtggacacgcaattgggtggaggaagccgttaggtggccatcccggtggtggggtgcaagggagtaagtgaagatggatcctaacatggcgtggatctagaagtgctggcagaggatgttggagttttcaggcgggtttcgaggttgtcacataggtagcgctcaacgccgtcatgatcatcgctaacctatcactctactcgctagcgttatgcgcggtgccatgctggtagatagtgggtgtgtcatcttcggctgtcacctataggtattaagcctgataccccctaggtatcacggctgttacccacatatattaggcttggaacctgggtctgatataagggtttgataccttcaatattaggtccggtacacaagcacctattggtacccatagatatactagcttggtactacgttttgtacaatacatgctattatcatatcttgtatcttagactagccaaaaaatatcagagggtagtgataaatgagattattggatttatcggaattcatcggtgatagacaaaaaattttggacaaaatttggaaaaaaaattgaagaaaatttgttaggaaataacatagattttatccaatccattttttattaaaaaacaacacatatatattctgtaaatgagataatatcaacattttatagtgcacacacagcaagcaaatggaaccgaaaaaaaaaagagagaacaaaaatcgtggcttcgcttgaagcaaactcgaaacctgttggttgagagctaccgcttgtaaccaaggcatcaaagcaacttctatagcaactatcgaggctgtcttttatattatagcaggaaattcaagatagaagattttctcggagggtagtgataaaagatgtggcttccctctacgtggtgtacgcctatttgcttccctttcaccggtggccctatttcctgccttcctgggccttgcccctagtcttctgatcatctccatcgtagaagagtttcagactccattactccgttctctcggtgacaaaaatgaaacaccacggctaagaacatcaatcctcacgcagttgtgaatggccattgtttcctggtgatttatgtattcaacttagaagctactctctccgtttcaagttacaaaatgttttgattttgatcaaaatcaaactatttcaagtttaactaaatttatagacaaatatagtaatatttataatactaaattagtgtcatcaaatcaataattgaatatattttcataataaatttgttttgtgttgaaaatattactattttttctataatcttggtcaaacctaaagcagtttgactttgaccaaagttaaaacatcttataac

SEQ ID NO: 67685 - DNA, 2767 bp, Oryza sativa
ttatcctcaacaaacaatcattcacaaattaagagggaaaaaggaaaaaaagaaagaaaataattcccacggcgaccaccacggccgccatccgtgccgaccgctgccctcctcgtgtgacggctccaccggccgccgccgtctgccactgctaggcacggccctccgcgccggtcgcccgcggaagggagtggaggaggaggaggaggagaggggataaggaggatgcgctggaagagataagatcgaggttgggagaggaggcacacaactcgatttttttaatcttggtcccagttgttataaccaaccgggactaaatatggatctttagtcccgtttggtaacacaccaattgagactaaagatcatctaagttccgtggtagttttaaaccggggcaaaaaagatatttagtcctggttaatattggaacgggactaatgtgatttttggccaacccatcagttctctactcaagaggatctccttgtaccttgctattgcgatcgtatcctgattcctgaagagcttgcacctgcagcagcagacagacgctgtgcatccatgcctccatgacggctatgagaggcgagggtccaaccgattatcagcgaaaaagttcaggcagaaactattttggaaggctggagactcgattttatatttatgtttttcttcggtggaggagggccaccagtagaacgataacaaatgggcgtatgccacgtagcgggaacagggatgggaacacaaaggcacagcccgagagaggcgtttttgttggaccaattttgcacctatccgataacagcgagaaatccgttcgttttcgcagcaaatcggccagtctggactctggaggctctcgctcgctcttatcgatcgatacgaccagaccggaggccatctcactccagagctcgcgggattttttgacttgaaaatagcgtgatcgcctctcatgtcatgcagatatcgtgatgcgtgagaagaaaccgtctatcctcctataaactctcgagcatgcagtccgttgtgcattcgtgcaacgcggttaagttagttgttgttgcgatccatagatagagctaaacccctaactagtaactacccagagagaactgataaggccagtgtcgagctagccagctgacggccgccacagtttgcttgatcaaggctgatcgatcgatcgatggacatcaccggcgcgggcgctatgggaggaggatccacggccgccaccgccgccgcggcggcgggggccgggtggaagacgccggtgtcgatggtgctggtgcagctgttcatcacggggcagatcctgctgtccaaggtgtccatcggcggtggcatgttgatcttcgtgctgcttgcgtacaacagcttcttcgccgtcgtcttcctcctccccttcgcgctcatcttcgagaggttttaatcttctccggtttttatttgtgtgtgttttaaagaaattttacgtttcttaataaagtacctcgaggtacctaaatattacactaaatattacctaaatccgaaggtatcaaattttacaccagaaaatatgtacatcctgataatttctcaggatgatgaaattatccgtgtttttatgatcagcttgccgtgaatatttgcagatttcgcatcttcagaatatttttttctcttcggacaaacattttacaaaactaggatatcggaatgagataatttatggtcatccattagtgactcttttctaaatttattgaaaaatcattttgtaatgtcaataattataaaatgtatgtctagtttaagttgcgaatcaattgattcaataatgaataacaccacatgtatacttctgatcgaataaatggataaccctggaattaatcacccgctaagaatactgaatgtgattgtaattaagaaaagtaattagcagcggctgtatgcattctaaaatcgggtttcatggtgaaaatttaatatgctgctaatttggttttgtgtagaggcaagtggagggacatggattggggtgcattcggatggatctttctcaatgcgttcattgggtatgtacgacatgtgtatctgaaccttcaaattcagtcaaactgtccataattatacttattatttaggaacaagtccaaataacccctaaacttggaactgaagttcgtttagcaccctaaactttaaaaccggacattcaacccccctaaactttataataccgtttatataacccctaagatggttttgcatagtagggtttttatctaatttatatataagttggatgagtttgatcacatatcatactctttggagtaaaattttgacttaaatatttatttttctacttatgagctctcacttacaaacaagtacgtacatgataatagtatgatattactgaataagaataaattgatgagttgcaactgatgatatgcaaatgtgttatattacttatttaaaattgttcgtttaagcttccaaaatatacaaaaccatcatccaaaaccaccttagggggtgatatggatggtatggcaaagttcggggggttggataactgattttaaagtttagggtgctagacggatttccgtctaaagtttatggatgtatttggactttttcctattatttatttattgtgtgtgttgattcgatcgatagtacatgaagatccattcgttgacacgtctcacctctattattactcttcctatcgttttttcataaaaagagagta

SEQ ID NO: 67686 - DNA, 27370 bp, Oryza sativa
tgtcctttgtacggcttgtaggttgcaactcacctacgtgagagaaaattgtaaaatataccaataagctagctgtgtagaccagacaattttagataattagttatttggaggatttttttaaaaaaaaataattggtttgagactactgaggaagcaccgcagcatgatattaatatatgatgatatttcaaaaacatgcatgattgtataaatatgccagctccacctcctaacaactctagatatgaaattttctccaatgcaacgatagcaaacccaagtaaattgggagggagaaggataaatttacactaacttagcattagaacagagtgctcacttcttggttcttaacttcatcacttcccttatggaaaagattgatttcacttgtccttccagttccaggtctgtgttggacttcggattgccctctatttccatctaaccatgtgcattcagacaggcttttgcacataggattcaattttacagaacaattatgtaacactaaaagcatatataaatttttagatttttgtttgtttccctctgtctgtgcatccaggcagcctattgcacatgtaattcatctttgcaaaaccattatgtaacacaaaagcatatattttaaagcagaggttgataatattcttgattatatatactctgatatttctctcaaaatagttctggcaaagcacagaagaaaataattacacatttattaacattaaaatgttttgactatacaccttctgattttggttgtattcgctccttcttaaaatagttaccttactacaaatgttactatattttaaaacagagggagtacacaagcacataatttgttagaaggatttgttgcacaaagctgcaaactctagatatgtgcttcaacaacaaaaatgaactcataaatctgctaagagcttccttagaaggataacagcataaactttgatgaaagatttttttttcaaaaacaatgatacaaatatagaccattagtctgttcagagttgttgtgataaataaaaacttagcctccaataataagatatttatttactgataatagtagcaatttggtgaaagactctactgcatatagagccacctttatttaaaataaatagaaaaggcaaagatgaagacattgccttatttattgatagagaaggggaaataacatcaacccaagcaaggataaacactaaaaaaccatcaatttgattatactcaataaccaatttcttgatggctatttattacttcctgagacaaattatttttagtttttcttctgacatgccaaaatatgcaggtactctgtgccaatgagcctctactactatggcctcaaggataccacatcatcctattccgttatctttcttaatataactcccctgttcaccttcatcctctcacttatgttcaggtaagagtctcactcaactagttgttgtatacgatgtactacttggtaactataggttccaacaacaacagttccatatcatgcaaaaaaaaaaaaagtcatacgggtaaaattcaaatcgtgtcgcaaaattaatgttccatctcattgaaacatatgtatgaacatgattataggttggaggcattcaaacttagaagcatacctggagtactgaaaatagcgagcatactgctttccattggagggacaatgcttataagcctttacaaaggcaagtcattgcatctctgggattctatcatacaacaccaaaatgaacacaagtcagcaaccaatcagctaagaggaacaattctattggttggcagcagcttcacctttgcttgctggtttcttattcaggtaatcataaacattgcttctaataaagtatatatatttagggtaatttttacttctttgagaaggtattttctagtgtaaaactcggtaccttgagttacttaatttcttaatgcccataaaaattctcatatatctatatattacagtaaattttatccccatacaatgacatcttataactattgtcacagtcaaagattctcaaagtgtatccatacaaatattggtcgtccatggtgacatgcttggttggagtatttcaaaccgcattggtcggaatcatattaaggagagacaagagtgcatgggagctaggatggaatctcaaccttgttaccatcgtgtacacggtataccttcaaccttcctaacccttgaaattaatttagtgagctagaacaataaatatattttataaaataagtttttttttctcggtgttcagtgatgcttaaaataagaaatccatttgcaaagaacattttgttttctgttttttggtgtccactaaaacttgaattgtattaactaacaagtttagagttatggtattattttgggaaagatgaaattttagggaatgcgtaggggactgtcttagggatttgacatgaaaaatattttggtgtagggggcacttgcaacagccgggaaatatatattgaattcatgggcaataactaagcgaggcccaacctatcccacaatgttcagtccattatcagtcgtcttcactgttgtgttggattcagtccttctaggaaatgatattacaattggaaggtcagttgctttcatttgtgtctatcatgcatgtttaatgttgcaaaaggaaaatatatttgatcagttaatgtggcaaatgtaatcctttgccaaactgaataagactaagtttacatagcaaaaggaaagtaaaccttggaaatttcttatgcatatttccaagaaatattatacataataatcagtacaaacaacggcaaaatggagaatcaaagaagtcggtgatgtgaatagtgcaagcactttcaacaattgcagcttgtccttttcaattcacttttacgtttacaaaaattgtgaagcacacaaaagatactagtataacatagatgactcttggaataatttcacacaaccacatgtgttatggtgcaagttatgaaaaaccacaagagtttaggactgcacataaccacaacaattatggtattaatgatttacaaaaccaaactcttacacaaatttagccattcttatgtgaactattccaccaatgattagccacactgaccatgtgcataagaatagctaagtttattaatagtgtgcttttatgaaaaactaatatcataactgctatggttaagtgccaaatgtcaaacatctatggttttttataatgcagaccataaagcatgtggttttgtgaaatttactgttttactttgtattcctcgaaactatatgaagtgtatttgcagtacagtttattttttgaccattggcagcaatagatgtaattgttctcctattctcaatgtgcagtcttctaggcacagcattggtgattgtcgggctctacctttttctctgggccaaagcacgagaaatacctaagaagtcaacatagtatattctacacaagtcctggtagctaaacaacacataggagttatttatgtacacaatgagatgtatacagcacagttatttaaatgcgaaagtatcatatacttgagacggatagcttataatgtttgtttatttgttgttaatggatactattgtatttcataacactgttaaaagaaaatattgttgatcagcccctgtcctcttactactatttctttacacctataaaagaacatgttggtggccatgaactcgtgatttcctggccatgtccaatattacattcgttcacttaggccatctttggaaactacgaatagcaaaacaaagttagaaaaagacaagatttaggtagtttgcacatgcaaaacataggttaaatccaaatttaaccgtttggacaggctatagaaaaaacacatgcataagagaggtaaaactaaagaaaattttctatgagaatgaacatcaattgaataagagggtggtgaactatgaatccaccaccaagtttcaataaaatgatctcaaaggttgaagccaccacacttagacatcatggcaacatgacttgaaggagcgatgagccatccgtgtcaactgcgcccgctaagcaatggtgattacttccgtatttcatagtcgatgttacaaaatatggatacacaaataactaataatgcagtattatatatttatagtatgcaccatcattattcacaactcataatcaagtgtaaaagaagcttagaaaataaattaaaaactaaattatacttgtaacattaaatagaattaatgattgctttccgtagcctaaaatccaagaaagatgtgaatcaagatttaatttagtattgtgcaagactggcacactttaaccatagcaactttgatcatgtttgatcgtcgcatttcactacatgcgacaccataacggacagccagagtccaaaactattcccctatttctattttggcaaaatttgccacatgacatctaaaaatcatgtaatttgttagaagacataaaaaaacgcgacactgccaatggacactacaaaatttgtgtaattagctttaggacacccgaggcaatattttattattttcggtgaaaaagaggagagagaaatttcaaaaggacggaaatgccctcagcctcagtacctgaaatccccatccaacttcaactgcggcggcggcttcggctggttgcggcgttgggaagcgacggcggtggtgatggctcggccggtcatggcgcaccaggagctcgccgcgctgcaggaccagcaagaccatgagttccgcgctgcaagagctcgccgcgcacgccgcgaactccggcgaaggcgccacgctgccgccgtggtgcgtctcgaagctgagccccacggcgccgtcgccgccgccgcaggccgcggtctgcaggtcctgttctccacagacccgtcgccatggatccagctcaaacctgcacacacatcaacaagaaaccaatcaacggcaacaaatcgatcaaatgcaatgcacaaatcacaatggcgatggagccgctcgccaccaccacccgctgctgcagccgctctgcaacgccgccaccgcagccacggcgcagagctcggccaagtccgcaccaccgacgctgcagccgcactagcagctgcccgctgccgccacgcatctgtccgccacaatgcacctgtccgtcgcgcctcgccgtcaccggcggtgagaccctggcggagcgccgcctctttttccgcagcgcgccgagccatcccggctcgggccgtcgcgccgttcctccgctccgccgcgtgcgtgaggaagaagaggataggagagagatgtggactccacttatgattaccaaatagtaatcaccctactaattacaaataaattagtccatgactcgtagacccatgtggttaaaaacctattaaaaattagattaaagataggttgtcgatgacatgtgggacccaccagtatttaaagaaggaaagagaaagagcaatccgggcatttagataaatatctcacttttttttttacctaaaaataataaaataatacgaccggtgtcctacggccaattacacgtattttacgtgtcctgtggcaaattttgccgtctattttctatgctccacatttcattaggcctaacagttgtccacaccacaccaccgccacgtgtatatatgagtgtggaatgctcaatcgtccctgataattgtgccaaacaagaaatgtttttgttcgtgtggttacacttggatgagggctatccaaggacactgtacgtctttgtaatgtagggcaattgagaagagaggtgcttcttgtcacgtattaatgcctggcagtttttaacattaatactaaaaatctcgcaatatgtgaatcttcttttcccgattcgtcatgcggtgcgtgagtttatgaccccagtgacccttcatcaccctagtgaccccaatgacccgtccgaaaataagcgcagccatgagtttccgtgttcaactttgatcgttcgtcttatttgaaattttttttatgattagtatttttatttttactagattataaaacatgaataatactttatgcgtgactcatgtttttaagtttttttaaaaaaaaattcaaataagacaaataattaaagtttaacacagaaatttatggttatgcttattttgggatggagggagtataactatgtcatgggctcatggctgcccctaccctagaacatgtctgacaaactgcccatgaacaaaacaatgtaatatcagtattgacaccgtgtttagttgcaaacttttgtttcaaacttccaacttttccatcacatcaaaactttcctacacacataaatttctaacttttccggtcacatctttccaatttcaaccaaacttttaattttagcatgaactaaacacaccctgagtttccttgcaatcatgtaacttttggaagagcgaacaacaaagcagtgctaagagcatctccaagagactctccaagctaaattttggccattttagcaaaaaatctcactccaacagtctcataaaaatctcactccaacagtctctctactagaatggctaagccaaatagctggctaaattcctcccctcaatggccaaacttggccagcccaaacagcatagctattcgtgggtcccacgcgtagagttttctctcaccctgcactacccgtgtcctgaggttaggatgcggtggtgggacggcacgacggcgagcattgccaaggcctcccgctcgccggccgccggcatcgagggcatgaagggagcagcggcagcgagatgttgtcatcgcccctcttccttgccgacgccgtcgcctccgccctcgaccgcatccgacgtcgccacccgcagccctcccatcgtcggccatccagcgccgctgtctccatccacgccatccagcgttgcccccaccgcctccactccacgggtcgtcgtagagagccaccaccgccgttgctggcctagagaagaggaaaagggagagagaggaggaagaaagtgtagtagaggctgacgtatgggtcacagtgtcataggctcataatggagagtccgagagtgtaaatggagaggctgttggagcgaggaatgagtttggcttgataaatcaactggagagctagctatataggtgtttgaagagtccgatttgaagaggttgttagagatgctcttagaccatgataatattagcagcatggataaaatgttgtcgattgaaaacctaatcaaaagattctcagaaaataaatatcacaggagagaacttgtacataagcatcccagtttaacgcaacttcaccataccaccacaacttaatgctcaaggcaaattccatgataaaaggtaacaaatggagattaatatttaccagttagcaaaacaatgaatatcagcacctagaaatagcaacaatccctgcccagctctctgggtagccaaatttcttttttgaaatatgcttccatcaccataaacaaaataaaccggtaatctgaaattaatcaaaaacatcggaattctgttcagtttgagagtagtctcgtagccaaattcagatgaagcacaacgctaacagagtaacaggtaatgaacaaatgaagtctaattttagtattactgattcagaagagaacagagagagagagagagagtcataatcagacactacaggggcaaacaatgattctttttcattgccttcgcatttaaagataaactggacaggaggataaacagtgagattatgcattaccttcatgcacacaaatattctcttgacagaagcctactcatatctacaatttccaacctctgcaacatgccatttctcaaaggtacacatgaaaactgaaagcagttcatcaaaatgaaaattgtagaaatataacttacggttacctgccccacttttctatacattgacatccattatgtgtatcatcagctttcatgttgcttggatgatttagtaaacatcatatatgctattctagctccattttggatttgtgggacaaaaaatagaatatggtattcgacaattcaatccttcaatggttcacaaagataaggcaaacaatcaaactaatccactctaacattggctcattatgatcaacatcaaaagtttcatgttggacttgctatacagctattcgtctcaccattatttttctcatgtgtcatcatggttgttccttttctgtaacatttccttcctcagatcttctgccttaatttcatttccatattttgagtaggcctcaaccatgatattatgtattgcattactgggtacaacattattttgcatcattttctgatacagatattccatttcatttaatctccctgcaccacctaatccgctaataagttgatggtatgttctcaccgtagatttgatgccatacttatgcattctttgctgaagatccaaggctttatcaatattgcctctgtaacagcatgctgatattaaagtattatagctgacagcatcaggtatcaacctgtgattacttaagctgttaataatttcctcagcttcagatatctgcgactggttgcaaaggccttttataagcaaattgtaggttactatacttggagatattccgttactcttcatcttctcaactaaaataaaagcctgatcattgggaccatgctctacgtatgcatctatgatagcattgtacacctgggcatttggtaaaacatctttatgaaacatatcatccaatatagctacagcttctgggatttttccattcttacaaaaagcattgacaattgaaccataggagacaacatttggttttagcccattctcttgcatttcggaaagaacaatgaaacatttctcaagttgcccagtccttccataagcatcaatcagcgtattgaaagtttccacagttggattcactccattgtcctgcatctccattaacagatcttgtgcattggtgattctttcagccttacacaaaccattgattagtgcattgtaggtaatgtgatctggcttgatatgccgcgacttcatctgtccaaaggttgagaaggccccttcaagctctccagtctggcaatatccattgatcagagtgttatagatcacccttgttgggactaaccctgcatttaccagtgactgaagaacctcttcagcaattgaaactttgccatccttacacaggccattcaacaagatactacaagtgtaatctccaattgtcactccattcttcaaatattttccaaacaatgaaagcattgcctttgagtcaccatttcttgagagaccatcaaataaaatgctatatgtgaagccatcgggcaccatcttttgtgatgccatttcatccaacaaggctgacgtctctcccatcctgccagcacggcacagaccggacaggagcacattatacgtaatcgcattcggcttcaagccatgacacaccatctgatcccgcagcctgaaaccagcctccaggtcgccgcccttgatgtgcccatcaatcatcgtattgtatgtgatatgattcggcagcacggccctctccgtcatttcatcgaacacctcaacggcgtcaccacccctccctgccctccacatccccgcgatgaccacgttgtacgagaacgcgttgggcggcggcgcgccgtcgcgtcccatccgccggagcatcccgacggcctcgccgaggtcgcccgccgcgacgcacgcctggacggccttgttccacgcgaacgtgtccgggcgcgccccggcggacgcgaggatcccaaacgcgcggcgcacgtcggcgtggcggccgagcgagaggagggcctcgaggaggaggttgcaggaggagagggatggcagcggcgcgcgggcttcgtcggcgaggtcggacagaagccggagcgcgccgtcggggaggcggagccgcgcggacgcgacgacgagggcggaggcggcgtcgcagaggaaggaggaggccggatgagggtctccaggcgaggcggatgcggatgcggatgcggcggcggcggcgacggcggcgagggcgtggtagaggtcggggacgacggaggcggcgggcggctgcgcggtgaggaggagagacttggcgaggtcgacggaggcgtggaagcggccggcggcgaggagggaggcgagctcgtggaggtgggtggcggcggccgccgcggaggtggagcagagggagcggcgtgggaggaggaggcggcgagacatttgggaggagcggccttcttcttcctcatcagttcctctctctccccaaaggtttttttggagtttggtggggtataggctgtgttatcttcaaactttcaaaaattgcgtgacatcaaatgttttaactttcgaaaattagtctacgtttaatactgtatctgtatacgtaaaaaaagtttgatggagaaactaaacacggccttaggccgggggttctgcagtgtagtgtccgacttttatggcttttttgaaattcaaaaaattgataggatttgttggacgtagtttgtcatttcttgacgtttttattgtttagtaatatcgccaccatcaccacttcattaacaccacttcggtgggagatggggaactagggattggtgtgctagcagagcaaaagagggcagcgaggcgattttgccttatgctggctagggagattgggatgggtagaagatggatgggggaatttaggggcggcatgagtggcttcgaccttacgggagctccgaggcattttcgcgtgcattgggcaagatttggcggctaggagagggaggcggtgcacaaagctgtatgcggacggaagaggaagacaaggcgttgggtgcggcgttttcgtgcaggagatcgaaaggggtagaggtatttttgcacaggggcggagctagagaaaaaatgagggaggtttcctgactttctctgtgtaataccggtatgtataattctaaagtgatattgtactaaatagttgcgtacccaatacttataaacatcatctctctaattgatggcgatatacaacaagaaaatgcatagaaaaattaaaaatatgtgtatcataatgaagaaaccatcttataacttgccacttgcccctccgttgaatgcaagcaacaaacgctaacttaatcaataatcatgggttatgggtagtccagcaaaactgaaagaggggaacaacgtgacttgacttaccgattagattttgaggctgcggcctgcggaggtggtccaggtggagtaggtggcaaacgacgaactgctggccgacgtcgggcatggtaggggtaggcgataccggcggctggcacaagggcactagggcaggttgcactgccacaggcatccagggctgatccaggtgatacggacgtctccgtgtcgggcaagatcagcggtagatcgagacggcgagagattgagaggcgagggatgagtcacgcgttttgatttttggaagatggaacgatgccgccctgatttctggtcgccgattcgccgccctggctccctgatgagttgtcgcgcgcgcatggatcgatcaaaacacgtgcagtgcgactcctcatctcctctcggctaggccttctccaccaatatagaatctatgggctggccggctgggccttatcgagtagaagttttgggctagacaaatggaggggttcctcagtttgggctagaggggtgcccatgtggtggaggtataggggttacaagctatttcgaattttaggtcgggttcctgggcacccccctgggtctgttgggctccgcccctatttttgcatgcgagagaagaaagaaaaccgagcgaggcggcagtgtttgcttcggcgcgcgagggctgagaggagaataggggatccatgtgtggcgaggtgggcggaggggatcgagagggttctatgtgggacccatataaacatattttttttatcatatcttatggctgcacgcgagcgatacagttttgggagctgtgcacgcgtcggtgctaaaacaagcgcccacttgtttctttctctatgattttctttccttaatcccagattaagctgattaacaagttttggagctggcttaataatgctattttactgctctaagggcctgtagcctagtggttacaagagcctcagtagcaccttagatcctgggttcgactccccgtggaagcgaattttccaggatttaacggctttgtgctttcagtggtaggcaacgtacccgtcgacagcgaggcgcccatggtgacttcgtcaatctccaagatggatttgccggcccagtcttcgaaaatgctcacaggggtagggtttgcgtgcgttcataggggtgagtgtgcgtacgttgtattgtgtaattctaaaaaaataaaataaaaactaatgatagtcatactagcaaaagtgatgaggtggcaaataaatacgtggacaaaagtagcgtgtgactaaatagtgaccaagtatacataatcttctatactactccctccgtcctaaaatataagaacccatctgatcctacgttcttatattttaggatggagggagcaataagcagcacctgcttcttccgatcgaagtagtatccaagtattttcaggatttttcttgaaatcatttgagcattggaagtatttttaacaattcaaagatcatttcagtgattattttaattggaaaaggtttttaaatcctctcctaagccgttgggttgatttcagcccaacatctctctccctcgcgcgcgtgctgtgcagcccaagccaagtcgagctgctctgatctgttctaagccatccgaaagtctaatttgcctccctccttcaatcgggccgaggaaatgaagcccggcaggaagtctgttttgcatccctctgctacagtgtcgcccctaacctccagccggtcgatctcctccctgccgtgcccgtgtacagcgccgcctccccaccaaattcgtcctctccgttgctcctctttccaaattagttgtgggaatatattcctctcgatctcctctatcttgtccccaagaaacccccttaaattccatggtatatcgcgtggattcgacgcggttttgagttcctattttccggcgaaccctaactaatccgtcgccgattccatccgttcccaagccgatctctccctcttccggctataaatagcatcccctaaccgtcctcttccatttgcctctagtcccaagttgagccgtcgcccgtagcgccgccgccacgttgtcttagccgccgccgtcgctggcgatcctccggtcgcatcgcgccgccgctagcgccgtcgccgttgccgtccgtcgccgccttcgggtgcgcacggagaaggagtacctcgtccgccccttcgcagccgccgaagaccgccggagcgccgtcgtcgttgttgagccgaaccgtgccgccgttgaacctcgtcgccggtcgtcgttcgtcgtcgttcgtcgtagtttcttgcaccggtgagttcgcgtcgtcgtcctcttcgcgtaggtgtcctcggatagcccaaccgagctctcttttgccggtggtcgcgtggaagcagtgccatggccggcgatgacgtcagcgatgacgtcataaatccatttttcttagtttctttattagatgaaaatcgattagacttcggaaattcataactaaatcatcgtaactcggatttgagtggttcaaattgctaaattcatctaaaatctagatctacatgttaaaaatatccacatgtactgtttatgcttgttttttttactgttttgttgattttgttcttttgctttagtttccgacgttccggaggagagcgttttcgttgaggaaggttcggaagtgtttgcggaagatcaaggcaagtcacacagatcccaaacaaccctttgagcatgttgaacctgtttaaagctattgtttatttcaacttatgcattattttcgaatgtcaccgggtggtgagcctttcccaattaattaatagccgaagatgactttattttcctatgggttataatttgattagctagaaccttatatattggtttggttcagttaaatgctatatatatatatatatataattgcttagccatgcttagaaacattagctcattaatgggatgaatcatatatactacattattattcatgattatatttaatggtagctcacgatggttaaccgtgttatgataattaattgataattaaaacttgataatggtgggttgtgagcacatggttttgaaggtcgtgttcatggcaattaaggaccggttcgcgagctactattgtgagacattaaccgtgccaactacaagccagcgtgggcaacgactttaccttttgtataacatgattcattgcggggtgccagactgtgaagcggtaagaagtccgtgggggtcgccggggagtccatgcctctggttatatttatagagggggtgattatgatctaggaatggtgcactgtggtgagttgtgttgtgcaggggtattgtcacagcctctattcgggtactttccagtatcgcgacgcatggtagacataatgttgaggctgtgtcttgtgggtacagtggtacacctctggccagagtaaaactattcgaatagccgtgcccgcggttatgggcgagttgagcaatgtttttcgtgattagtctcacatctctcacaataattattgatgctataactggtaataatttgcttagctcctggtttggagttagatctatgcagccgggtttggttgttcaggatggttgggcctgagcagcatgggtgtgctgttcagtgttgattaaaattgatgattactctattgttttactactcttaaatctttgctaaatgctgcttttgcaaatgagactatattatgccatcatttggtatccttgtgcacttgtatatttgctgtgtggcttgttgagtatgtcatatgctcatttttgtaataatcaatcaacctcagttgaagaaaaatgatctagaaggagaagacatttggcttataccccagttgagttgcctgtgggagtggagctgaagccatcgctagaccgttaattccgctgttgtttttcttttcttctgtaattatgtaacgttattattatgatggattcgtatattaaattgtcagtttgtgtacctcggctaatttctggacgagggttttatgcacaaataagttcgggaattactagtgaatttccgggcgtgacataacctcctcctactaaataagtacatcttctgtcccaaaataagttcattagtaaatttatatatccaacgtttaaccatccgtcttatttaaaatatttttattgttattagattattaaacatgaatagtactttatgcatgccttagtttttttttataatttttcatttttttttaaataagacataaacccacaaatattttgagacgggggtgctgacaggaagaaagatgcaaagaaaatgataaacgaaaaacatacacaaatatgtgtatagataatctaatagtaatagctaactattgtacacaatacctcttcttaagttaactctattgctgatgtggatgtttttagctaattactgattacagtacactattaactttgctctaagagcactccaatacagtgacgacctcatatgtcacgtggaatatactactatcatatatgagccattcattgagacaacaaaggctactttacgccttgtctagattcaaagtttgatcttcaaattttcaattttttgtcacatcgaaattttctatacatacaaacttccaactttttcgtcacaccgttccaatttctttaaacttctaattttgacgtggaactaaacacacacttaatgtgttttctttccatatatcattacttgtacgtcagccctttcaatgttccttttttttttgacaggaaacaataggagaggctcctactgtgctaataaatatattaataatataaggagtttatgtacagagaaatatttacaatggaaatagagaatttacagaagaattagaaaatagagtcaatccatgattgataggaaggtttatcctcctccagtcctccttcactctttgcataagaagagtgaaatcctctctgaaagcatacttctggttattgaaagatgaatgaatattgtcaaagatgagcgtatttctttcggtcgatatctgccagcaggccgtgcccaccacttcaacaaaaaacggcttgttaaaattaatataagctgtttcctcatcccagttgataccaatgaaattgcagcacaccttggcataaggacaaccaaaaaacaaatgaaccatatcttccaaaacccctggcatgcacattctacaggatggaccatcttataatcaaataagttttagacctatggactttgaaaaaaccacggatgtacatgtcagccactctttcactctcttttcacccctcacctctaatcccctccctatataggtcccgttctaagattttaattttcgtggcacgcttttcagattgctaaatggtgtatttcgcacgaaaactttctatatgaaagtcgcactaaaatatcatattaatttattttttaagtttgtaataactaaaactcaataaatcatacgttaataccatctcgttttgcgtaaaaaaaacttaatcttcattttcatcttgagaagaaaagaacaccaccatagttcacgtcctttcccctctgctatcatttcctcctcaccactgccccgctgccccctcgaatgaggtggtagagcccgcaccatcctcttcttcatctggtgctgcaaatcaatgttatctctttaatccccttctccttcaagtactctagacaagtcgacgagtcccccgcctccatcgccaccaacctccaggaccgatgagcggatctagcgatgtggttggtgagctctgggaccaacaaacggcatgactactcaatccaagcagcgaggcgagctgatgctcgtcagagttggccgcaccagaggtggtcgaggacaacctccaacttctaaattaggcgcaaatgaggggatgagctcgccggcttatgagtggcaataggctcctctccctcctctgttgccctcgttctcttctcctatcatgttcaccgtgtcattgctgttcgggtagggttaaggtggagataagggtgtggaccacactacgggagcatgacctcacctaatacggtgtcccgatgcgttcgtcccctaaggccttgttcggttaatcctcataagggagggatttggaattattatatggtgtgtaattattccccctcaatcccctacaaaccgaacaacacctaacagggacatggatcattctcgaaatagggttcgactcctacgtggcgagcctatgcctcgtcttgtaggagcattgggcaaggcgtatgaaagcacaaattgcctgacaaatcggcatgttgcaatttgcaaatatttgcccacaatttccgttccgcagttatttagcgaatccgcttaaaaaatagccagctcaacacatctcgcggtactgacatcttagacactttcgccatccctttccactactgctactattgcacagccgcacaacccgacatcccctgctggcacaagaacagattaattttcggctcgatcgacgccatcttctattcattcgatcttgcaatcacaaataataaaagcagctcaacgagcctagatccaagatcgaaaatccttcggatggatcgcaaactgagtcaccaaacgcttctgatcttgagctacgagacatgtcccagcatttgaatcatatttgaatcacaaattttgtagtagtatgtactacaagtataagtaaacaatccaaaattgttgtgtgttgtagcgttgatccgtcacaatgaacaaacaaatcccctatctaaccaagcgaaaccacgcgacaaggatcgtgtagagtggatcggagcggcagcgaaacgcgggcggctaccgtgccggcgccggcgcggtcgccgcgacgccgccggcgccgcggcggcgcagcgcgttggtgtagttgatgatggagttgatgcgctgcagcttgaggtcctccctgaactgcttgatgaaccgctcggcccgcgcgttcacctccgccttcccttcctctacctcctctgcccgcgcccgccgcggcttggcgtccgccgccttcgccgccgccgcggcatctggtgcggaacgcggcgagcgcgcctgcgcctgctgggccagcgcgtacgcctcgtccaagctgatggactcctcctcctcctctgcttccgcctcttcttcctcgttcttgatcgccgccgctgttgcggcggccacaggcgagctccgtggcgccgccatggacggcgtcgtcgccgccacgacctccctcaccggcgccggcggctccggccggaacggcgccgccgcgacggcctccaccaactcctcctctgcctcacgcgggtagtagaagtaatcggaccccgacgagacgtcgccgtggacgtggagcggcgtggcgctgtagtcgccggagaggtactggaaggggaagttggcgacggaccggagcctctccatcacaacggtcgacgcggtgcgcgccagcctccgccgcgccgccgacgacggcgtcgaggtcgtcccgcccacgccctgccccagccacgacacgacggcgatggcgccgacgatgacgttcaggaacacgaaccacgccgccccggagctgagccacgacagcatctgcaccaccgccatagacgacgacgacgatcgatgatccaatccaagaaactcacctcacagctgagtgagctcgatctgttcgaccggtgaatcgaatcggaggaaaggcgatgatgagatgagatgggtgggtgggtagcgagctcaggtgagctgggcacatggttatataggcaggtgagtgtgtgtctgttcgtggagaggtgggtgagaacggcaggagaagaaaggcggccccgcgtcgcgtcgcgcgccgccgcgtccacggttggcatcgcgtggctcgtagcggcaagttggcaaccgctttctgctattctatcagcggcagagagcaaagctgcggaccatgcagcagcagcggcagcggcaggaagattcatgtgcgtgtacaggtgaaagtagatagtactagcgtgcaaggcttgttctgctctaggagttaatgaactggatcatgcagagtcttgaagaaaaaatgaacttgatatcaagccagacgtgacagccagcgacatgtcggtatttagctggtttgatggagtatttaggctctgttcgtttcgtggagttcccaactcccccatctcattttccgcgcgcacgcttttcaaactgctaaacggtgtattttttgcaaaaagtttatatacgaaagttgcttaaaaaaattatattgatccatttttgaaaaaaaattagcaaataattaattaatcacatgctaatggactgcttcgttttccgtaccggagggatgggtacccaactcaaccaaaagaacagagcctagggtgtgtttagttggccaaagaaaatttggggtgccacatcggatgaccagatgtcggaaagcgttttcggacacaaatgaaaaaaattaattttataactcgcctggaaaccgcgagacaaatttattaagctaattaatctatcattagtatatgtaggttactgtagcatttatggctaatcatagactaattagactcaaaagattcgtctcgtgatttccatacaaactgtgcaattagttttttctttttatctatatataatgttctatacatgtgttcaaagattcgatataatgtttttgaaaaaaaaaattggaaactaaatcaagccatactagttttgactctgagttgtcgaggctttgaccatttggaaaatctaattagatacatatcattagatttgtaatcaattgaactcaactgattatattaattgtctagtagtattaaatttaaattaaatttgtctactagtaattagcaagagggagataactaatagagattgagtaaagctggtgagttttcaggagcggagggagcaatttgcaggtttttttggctgttcttgtgaaactactgaatttgtttttacgcgagtcaaacaactcaattagtattcaacatggaaccgtgttagtactcaacagggaaccgtgttaatatataggtggcgtttagcgtagtagcgtactactgtacactattactctctcgttatcatctacggagtacagctgcatggccatccaggtggaaatcgttgggaatcgttatcttgcaaacaacttcacctgacatgtaaatttaaaattaattgttacctactcgtaggttcttctgttcctcatttgactcgtgacctgcaaagttcaaagctatcatgcattgtatatgcccaataccaagatcatgatggccggtgaacccctgtagattatttgcaaagttaatccgtgtctatcgagtgaaacatatactattctgctacacgctattcgcctgtcaattagctagtaacttttccccgcaaaaaaaaaaaaggtactaaccttgatactttatgctactcgtctgcttgatgctaaactggtgccttcgtgcgaggaaaacgtgagttgtctaatatgctacttgctacactactttattctaagtatcatgcttaaattagctagagcgatcatcgatgggctcgccttgtggacgtccacacacaccaccccagcgaagatccccatgttcctaatcaattaattcctgattaattaattttcccattttttctttctcttcatttcggacggcctttcggttcaaagtagagtcctccactgcagcaaatgatcggctatcgcctctccacttaaatcaaatccctttaatttctctttacaggaaagatacgttgttgagaccagcagctagcggaaccggccggacttttgcgatcggatctagttacaaatattgtttgattaatgtattacacgtgtgttgatctgtctatttgggtatcgattaaaatcttaatggccaaagatatatttggatcattgggtatatatgttgttgtaatcatatcattattaattgagacgacatatattattttcttgtaaatatatatggaatattctgcatccccgcactttcaggttataaaattgtactggatttcataatcagctgttagccatatagttacatgtatcatttacatgttcatgctccgtaagttttctaatattcaaattagaggagaaaaaacagaaatggtagaaattctgagaaaaaaaacaacgatatctaacttttaatctgcctaaagtttcttacttatccagaatcttaatactagagcactccgtataaatactaagcaacggacccacaatgataagaatatatcttacttaaataagaaaaataaataccaaagaaatcataaatactgatacttatataaaagaagtatccatcgagttacaagatcggagagaatgccaacaactctaacactcatccgagattccaatggagagagtgccaacatcttcagcacttctccagaactcccctagaaggaattccgacatatggtgcattccttccagcgcttcccctcactctcatcctatactctaaattctaactctactagagtgtaatctaaatatgaaagtgagttgtactccacttgagttgtgttgtgctttgagaatgaagtgataactccttttataagctctaacgacggttactatggcgatagtgaggtcggttcacccacaaccatcatagggaaccaatcaacatcctccacgtggaaggtgggggatgagtggctgcaagggtggtttagccgaaccatggttcggccgaccccctagctccaccatatcccctctcctttggcctggtcactatccagtcccctctcctttggcctgttcactatccagtaggaccttatgacagtgcccattggttgacccattttgaggtgatttggtcagcttgtaggccttccattccgtatacatgcgtctgattggctggagctgtgtttcttcgcatggcgagtggtaattttcatacaaaatccatgcattcacatatttcaccaatatttgtggaaatgatatttcaccactaccactaagtgtgatattttatttcaattgcttttatgcaggaattggtgatcagatttgacatttaaggatcgtcaacaggttttcctcacttccacaagggaagaagtaagtcagtgaaacccgagctagtttctaggagtttgcttgatagagcaagcttctccaaaggaaggtctaggtgttttatccttggaccttggtggttgggagatacctattagcctttggtcgttccttggagactaaagttttttcctggttattagcttggtgaggcaagggaacaatcgagatcctgctccttggagttccttgacatagagtatctcttataccgaattccatgcggattcacgtgcaaatagcccctccacgtggcattgtgggatttcagctttcgtccctctccttagccgtcacatcgcggatctcgatggatggatatcgctgcggtggacctcattctaaaaaatgaagtttgagggggtttttatgcaaaagcgcttaattcctacccttcccgtggccatcctcggtggggctcctcctcctggttggctggtcctcgccgccagcctcctcacctctcctccccggtccggtgcccccctctcctgttcccctctccgccgacggtaatagctcggtagggtgacgagcgaggaaaatctcgacggcggcaacctttcctccaccactacctctcccaactcgccggtgaggagctctcctccctccctccctcccatctaccggcgaggccctctcctcccacgcgctggcgcgccgccctcttccctcccgtgtcctcctcctcgtctctggatggggcgaagagctcggtggcggcgcgcgtggattgggagtagctcggtgtcggtgacgagctccggtgatgccgccacctctaccctcaagctcggcggcgtctgcgcatcgccgcccatccacctccctccttgccgatgcattcgaccctgtgggccagcggtcgagcttggcgccacgctcgactgggagggccgggcgcgggggcttggcttcgatgttgaggtgctcaatccactggcgtagccgtcctgtgcctcacgccctcaccaccaccacctccattctccccactgtcgcgcgatgatgacctgtgcaatcaagaaaggtggtagggatgcgactagctcaaaccacaacaacgagaaggaagtagtagaggtgaggtagctctgcttgtcatagtgtccttgaagaaaccaagatgaatggaataggaggctgctgcttgtcgtccaatgtccatccgcaacctgcttgcttggagcagccaccgccgccgctacgatatgctcgctgtgtgtcattaccgccttaccagcaagcagttctgtaaggtagtgtttggttggatggtttcggtgggtcgggtcggggccatccctttttttttttggagctgtttggtttgaggattaggtgggttgggttggttaaaaaaggaagagtaaatttcatagaactacagatactttgcacaatctatcacaaaactacagatttaagaacttgtttcacaaaactacagattcattgtattcatttaacataaaactacatgtactttgcacaatatatcacaaaactacagatttaagaacttgtttcataaaactacagatttaatatcctcatttatcataaaactacaagtttagtgtctctattatcacaaaactacaggttgtagcattgtaaaaatctatagttttgtgataatggatacactaaatttgtagttttatgataaatgaagacactaaatgtatagttctgtgatatacactaaatctatagttttatgaaacaagtttttaaatctatagttttatgatagattgtacaaagtacttgtagttttgtgataaacggagacactaaatctgtagttttgtgaaacaagctcttaattctatagttttgtgataatttgtgtcaaatacctatagttttgtaaaatttacttaaaaaaagaatattccaccaatattcgggatgaactgaccacccaaaaaagaccggaccgatcgaacccacctctctcccgtcgcgcacgtgagttgcacgcgcccgcgcgcacgagcaggcggtggcagctcgcatcctccctccatcctccatcctccatccccctcctctctgaatctctactggtcaacatctcgcccttggctgctgcagcaacaagaggaagaagaaccggcgcccccacctggcctcctgtgtagagtaaggtgatagaggtttcagatgttttgagaatattctctgctcatgaacgcatccagtaactgctggaggagtgtggagaaggcaagcgattgatgaatccggtggctgggaggaccgatctactgcagaagatgtggacctgacactgggagcaggactactgagctgggaatttgtctatgttggtagccttaaggtatttttacttctgcagttaaatactaccaatatgatggcatgccaatccatgaacaaaaacattaacatgtaaatgattgaagcacctgtgtttggttgccctgcttgtttaattgtgcttctccctcagttttgtgcttgccctgggctacttgctgttcctaatgctactgcttttaggtactttactgctgctatattgctcatcttaaagatcacaaaagtaacaaaagcaagtactttttagttcttaacaatacagcactctgcatgtaaaatggcattggatttttcccgttcccctaatttttttgttcggaactgttgatgcatgcacttttcttccaattgctttcctgttctgacatagagaactggccttgcaagctgcggtgctggtttacaattcgttaatactacgttggacggttggagtaagaaactggtggttcacatcaatgtcaatgggggagaacactttatttgattttaggaatactttctttcctgtttttatttaagtgagtacaaatcaggcaacatgtatttattctgaaaacccaacaactaaacatatataaaacactatgaggtggtagaagtactgaagctatttgtagaccacaccaaatgaggaagatggtattcgtagaacaagtttattattgttccaaggagatcaatatatgacacttgcccacaagccttgttcccctggccttggcctaggttgataagctcgcgagagcgggacaacagggcatggactttctatgcttgtttgagcatatccttcagtactacattattttttttgagaaggaaagaaaaaacaaaaataagtctggctaatatatatgagaatggtccgaaaaatctatcttccattatcatcattacttttttctcggaaacataatctgaacagacctattagatattggagatgggactgtcgaaaaagaaatataccggtatcggttggaaggtgaaaattcgtatcagaaacagtaaatgtcagttctgcaacaaagaggaaagtgtagagcatcttttctttcattgtagcattgctaggtttgtatttggaacgctttcaatagtgtttttgactgtaggatgctgaaggcatacaaaattcgtatcacaaaaaagcatccggggcctttttgtgattgatgcttttttgtgattgttgctgaaaataaattactaacaaaataaattatagacatgtggagggataaaatgaagataagtactttcattactttggttcattggaatttagaatttgtgtgcacatattcgactttcaacttatgtccatgaactcattttcttgcagccttcaattgatctgaataaagcttatgcccgaaactatgtcatattttagagcaattagatattgtaagtaaattaaattcacattacagatagcagaaattggtactgatttgttatgtcgttagcattatttactctacttacggattgtttctgcattttctcagcacacaagtggaaaattaaatctggaaatgcatgcatcgttttgtaattttaataaatttgtaaactaataattaacctatggagagcttcctcgtacatttgtaaactaataattaacctatgtagtgccgtcaaaagtcaaaactcaagtacggttgaattagtaccatgcttaatcgtagcttcatgcactttttttattaattttggcaatggtctctatgcgtactcttcaaatcatgcaatgccatgatactaaataggaaaaagtacgaattaccctcccccgaactatcgtagttgtccgaattaccccctaaaccacaaaaccggacattcttcaccaccaactatgcaaaccggacgaattacccctctcgaccaaatccgcggtggttttggtctacgtagtatatgtgtggcagtccagccagcattctatttataaaaaaatgtaggacccacctgccatatcctctctctctcattctcagtctcactcttcccctctctctcatgtgcatggcagcaggcgggggcggcggcacgcacgcacacggacggggggctagaggcggcggcgtggccgagacgcacacaacggcgacggcgcgtggcgcaggcgaggctcgaggggagatggcgacggcgcgcagcgcgagtgacgccgacaggcgacacgacggcacggggacaggggccggaggcggcggcgaggaatgacgcaagaacaccccctccctccggggatacgatggcgatggcggccgcttccgccttagccatgcaaggcaggccgcctctgccgccacagcggggccggcggcgccgaagcgggcgctcgtgctggtcgcggatggcacagtgctggtggaggcggtcgccactgccgatgtgctcaaccgcgccggcgcgtcgaggaggacgagcgcgctgggcggagggaa

SEQ ID NO: 67687 - DNA, 4474 bp, Oryza sativa
cgcgtcgcctcctcacaccccgccgcactgtgcgtgccgatgtcctcgccgctgagtgtgccacggccgcgccgcagtcatagcagccgcctccggcccccgtccgcgtgcgtgcgcgccgcctccgccgcccccgcctgatgtcgtgcgtgtgacagagacaggggaagagagacatagagtgagactgtgagagagagaagagagaggaaaagagaggatatggcaggtgggtcccatatttttttataaatagaatgctaactgaattgctacacgtacgccacgtagaccaaaaccaccgcggattgggtcgagggggggtaattcatccggtttgcatagttggggagggggggggtgaagaatgtcgtttttgtggtttagaggggtaattcggacgactgcgatagttcaggggggtaatttgtactttttcctattgaatattgaacattgaattctgaaactgaactggcattattttgaagaaaaaaataaagataagtataaaaaaatcccaatcatgttatcttattaaagataagtgatcagggttcaagttgatatggaaccatattattaaatgtttaattttgattattttcctagccatgtactgaagtattgtctaattaatgacaccggaatatgcaatttgacctctttgaattacttgacatttgaattttttctaccttagccatgacggttttgtaaggttgccttttatgatacctgtatagttagatgcaatctttaaccaatcgaagtagacgtttttgtgtatttttattttttttttacttttcagaaataaggaagaaacacaaattggaattgcaaaacttgatgctaacaaagcatccgaatagggcattacatttttttttcatgttagcaaatatcaatggtgtaattaatactactcacctgataaatacataaattccttggcaatgctactaccgagtcattttttttgctcgtgtgcatgaacattttattttcctcttctgatctcaagtcccaacccctattaatttatttctttaggtttctgcttcaacgtgttaagaaataaaaaaactactgatcataaacaaggctatttgataaagcagattaccctaatctaaattgggcgcggcaaggccgcgcgtctatgcatagtcagtactatagcctcactaatcctcgtcgaggaatctccttgccgccctagaagtttgagattgtgcctgactgttttggagtctgttcagcagctccttcagcgcctggggattgacgtcggactggagtcggctcaacatgaaatcaagcatggtatgatagtcttcttcacggagctcctctccattcttcagagtaatatcacacaatgtgtccagaatctgggcgtgacaggcgcaggctttttgtagagaactttcctttcaaagagagaggtttctagtgatccttggatccaaacgttttgtcccttgtggctttgcccatctcttgtattctgatcggagtcttgggtagttacgaggatttaaaatccattgctagtgtttccaggaacacaaagtatatgatacttggatctgaacgttttgttctgtttcttggaaaggctttctctgttttcaggaacgcacattcacctcgcgacatcagatcctttcaaagaaaactttacaaagacattggatgagagcatgttagacctgaaaacacaaactttacaaagacattggatgatagctagggtttcccttaccgtaaaccacgcggtaaccattggatgataacttcactcccccgcggtaagacagaaccgcgtggtaaccgtcggaaaccacgtgaaattcgttctcaaatatttgaattaaaaaatcgatggtttcagcgtggttactgtgcagtttcgcgtggtaaccacgaatatcgcgcgattaccgctaattgtgtagcagaacagagaagctgttagaaaaaattgaaaaaacatttaaattcatgtagaaattgggaataattagaagaatatagaggaaacttgcaaacataacttttggggtgtaaaatacaaaaaatcaatatgacctttttctatattatggacttcaacgcaattcaacatttcgtagcataataattcgacaacaataattcaacaacctcacatttgaaagcattatgatgtccacatgaagctgaaataatagagtccacaatagagagagcaatagagagagatgagaggaccaggagatattttctccacttataggccttaatggactggacagtagtacaagataagaccttattatttttttcatttctaatgtactttcggtttttccctcaaaattgaatttatctaattctttttcaaaaaaatttcttcaccatccgccactaaaaatgaagaactatatccacgattttttttcagttttttcagaattttgaatgtgggcaaaattcaccaaaccctaccaccggtaacccctaccgtaccccgcgataaacgcgcagttatcggcattaagagaaaccctgatgagagcatgtttagccttctccgttttgtagaaggaaataatataaaaatagctcctatataaagatattcatttgtttgtaatccaattgtgcaccaccaccgacaaaccctagaataggtgtagaataggtgatatttactggaccggcggcgtctcctcgagtaaaggcttccacccaaattgcatgactaacaggtcttacgtgtaaaggatcatgtacccatgattcaaaatttccttgccaagcgacataaaacagattacccgaaaaggcaaaaatgttataataaagacattcctcactaatatcatcatgacattggaaattaactaatatcatcatgacattggaaattaatctcaaaatcatgtgcggtagcgataccaacccaacaaaataaaaccagtagctagtgggggtccttagctatgccttggcactactagaaaacagcttttcacaggcggcctaaacaggtttttgcaggcggacgagtgcaactgaacgattgtgaaaatagttacttttcacaggcggacaactagtccgcttgcgaaaatagcacctggcattaaaaaaaaaaagggcagccaccgcccactgccgttccagccaatagcagtagctttccattctcctcccattccctcatccagattcaacatcaaaccaaatcaaatacacaaaaacataacagattaacagacatcgtagtggttcacaatcaaatcaaatcacaaattttccatggatgtcgtcatcgccgtcgcacggacgcaccccgccgccatctgccccgtgccgccggccggtccgcccgcccgccggcctcccccctccccccttcggccagatctgggagggagggagggaggggagccgccgccagccgcctcgcgccgtcccgcgccgccggcctccccccacccccctccggccagatctggagggtagggagggagagaagccgccgccggccaccccacgcccgacgccgttcgcccttcacccgacgccgtccgcccctcgcccgacggcatccgtccttcaccgccgtccgccggcctcccccaccccctccggccagatctggaggggagggagggaggggagccaccgccggccgccctgcgcccggccgccggtccgcgctttgcctgacgccgtccgcccttccccaccggcctcccccctcccccctccggccagatctggaggggagggagggaggggagccgccgccgaccgccccttccgccgacggggaggtgaaggggaggggagaggataagaggagaaggggagaggaaagacacttagaaaaatatcagcccacgtgccacatatatataccacgctaattttcgcaagcacactttatgtggtccgcctgcgaaaatagcaggcaccgcttaagtggtccgcagcgcccttcaccccgatttgcatttttgtaggcggctatttggctctaagggtcatgcccgtctgtaaaaataaatacctaatattggcgaaaatgctttttcagtagtgtggctaaacctgggaaacacacaactcatctagttaaataacatgtgcactaaccctcttcctagcttcaaaatgggattaatcggtgctactctagttagctaagcgaggtggtattattgccgctacaggtgttactgctttctaccttgccgagctgctatgcagctgcaactactgttgctcaacactagttggacaaaggcccaaagcctctgttgctgctgaaggcgagctaagcagcccactacctcaacataccctcatccttttttctcttttttttttcatcaattatttttggggcacaccacggttttactttttttcaagtgcaagtggcaaaagttattgccgaatatattagaaagat

SEQ ID NO: 67688 - DNA, 32157 bp, Oryza sativa
cggcgggtcgcggcgcgtgggagacgctgggggcagccagccagcgcacacccccagcaggccgacatgccgtcgacccggagccggttgccgccgcctgctgcctcacgagtcacctcgcgccgcgacacgccgcgagcgccggtcaccgccggccacctcacgagtcgcaaccgccacgccacctcgcgcccgcgagcagcgacgcctcgcgggcgccagccatgcatcccacgagccacaaccaccacgccgcctcgcgccgcagcggcctccgccggccgtaccgcctccgcaacacgcttccagacatcgccgtcatagatctggcgacagcggggccggatctacagcagcccaattaacctgaaggcctcgccgccgccggcgaacgatgcatcccccgcgctgagaaggggcaccaccgcgagaaggccccccgccgccatccttacacaatggatgccactgccaggagtaacatctctttcccaaatgaatggaaccaagatacattaattattatttggcagtaggataattacaatgccagatatattcacacccgtaccatattattattagcaaaaatacaaaaagaatctaatcctgatatcaaattgttcccttgaacactcgactgaattttcaaaattctctacatcatctccaagaaaattccgaatgcatacctccttcacatatgcatacggacgagacgatgatgacggaacaattagaacgaagaaacacctaatcctagtctgcaatgcgacgactcggccatttgagtcgcatcacctgctatgatcttgccattgtccagctccggcagctcctctttaacaccaatgtcgccgttcacgtccaccaccgtcttgacaacgtcgacgatgtcggcgttcacgtccaccattgtcttgataatgtcgatgttgctgttctcgtccaccattgtcttgacatcgatgtcggcgttcatatccaccatttccttgacctcgatgtccgtgttcacgtccaccgtctgcacttgctcctcctcctgccgaaggtcgaacacatcgacgagtgacggtcccgactttatctcgaaccccttatcatcaatctggttgtgctcatccacccctaccggcatttggtgatcggatgtgagctcaaccttgtgttcagcatcatagttggtgtcgaaatcaaaatgctgcattccatcgacattgatgtcgagatgcggcttgctactgacgtcgtcaccggcggtcgagtcgtagtagaagtaatcgtaaagctgctgtggttgaccgtgatggtgttcacgctgactctcgtcctgattatgatggccgtcggcgtgtaggatcgcagcatcggcttcttgattggcatagagcgcatcaacgacctcatgctccgcactgagtaggagaggctggtttgacgaggtgacatcgagatcggcgcacgcgtcgtccaacacgcctgccggcagcgcagcggcgacgctaccggacgcgccagcggcagccgcctgacgacacatcgccagatggtggagtacggtgttgagttcggccgtgtcgagctcgagctggcgctcgagatcgcagatgacgcggcaacacccgccgacggggtcgtgggcccgcatctcggcctggtagatgagcgtgcgcatggcgtcgtcgcacagctcgggcttgaggtggcggagcgtcttgaggatgttgctgacgccgaagaggcggtgcgcgttgaggaagcggcgctgctggtcggcggggaagtagggcgccatcgggcagtccgggttgcacttgcgccgctggtacttgcacgccgcgcatgcctgattcgtccctccccctccacctccaccaccacctccaccaccaccacctcctccgctccctccgccgctggcgccgcgatgcgagccgccgctgccgctgccgctgccgctggagtgcggaggacgggcggcgacgggaaggctctggcgttggtgggaggcagtggtggtggtggtggtggagacggggttgttgttgttgttggtggtggtggtggtggtgttggtggtggtgatggtggtggtggaggtcatggcggcagccgcggcggcagcggcgacgggggctctctggctcgccaggtcgcgaggtcggaggcgacggtggagggctggccctggcgtcgtcgtaggaataggagaggccctcagcagctgtccatgtcatccgccattttctccaccactcgtctccatcgatcgccggatgcctattaaaagtaaaacggattttcgatcgagcctagcatcgatccatgcatggtgcagttgccaacagctggtgcttaactgtgtgcaagctgtcaagagagcactgatatgatcgactcaaaagagctgcatgaaaagccatgaaaagggatatgatcggagagggaggtcgatcggtttggtggctggtaggcctagctaggagatggagttgcttgatcgattcagaatttccatggatctcgaatgtgttcgagcattgcggggatgtcacactcgagagtttgttgctacataaaaaggtttgatgtgtcaaactgctactaccattagaattagaatagctaagactgcagctaacgatgttaagccagaagtttagctagacttttccttaaagatttaacagtgtactctctccgtgttgaaaaatagttgttattttggacgagactatgttaaacttatttgaattttgattacgaataatttctaaaactagaaagatagcccgcgtatgcgcgggcatcttatttaactgtgctagaaatttgattaggaatgtttatgattactctattttaaacatgtttaatttttcaataatttgtgtggtgtttctctgaatgctagtaaccatcgctggtgtataaattctaaactaaaattatttaaaaccatgcaaattaggttttataagaaaaatatatatgtgaaactatatatcacttctacaaaatgcacttcttttttttaatatttagcatatcttatttttgcacattctaaactatgagtaacaatttttcttttgtatactatatatgtttttatgaattttaggatatattaattgaagatattttctattaaaaatatggctaatacgactacatcatctaactaaatgaactgaatatgttgaaatattgatttaattgtaagtatatagtattgcagtatgaatttatggtttagcagtaaaagtttttctaaatcagaaacagaaaatatattagaaaatgagacttttatcgttctcaagttatagtttagggttgtatacttcgaactgatattatgttagattttatttccaacataatgcccaaaatgtcaaattttatattatattttatttagaattttaattattttcattgtatcagtactcctaaatatttgaacattgctatttagaatgggttttagattaaaaaaatcttaaatttagaaaaacaaagttcagtcttcaattatttttatcatgttatttttttttctagatttctatttcatcaagcatcccttaaatgttttggtctctgcaatttggtatagaaatataagtgggttaaggccatacaacttggcatgggataaagttatcgcttaattgttttcaatctattgtctataacaaatagatcctagacagggtacacgttatgacataaaaaatgatataattaaaagctttttctctaatccattagtgacatcaaatatcataggtataatttagatgttatgatcatcttaggaacatttatttatctctaaaaagatcatttattcataaaagcgcatctaggatgaagtataagagaaattaactacttccattgttgaggaaagtatatcaatatttacatcaccaaattatttttattgaattcagaattgaatatgttttttataatataattgttttgtgttgaaaatgttactatgtttttataaactaattcaagtaacttgacatagacaaaatttaaaatgacttgtaatctgaaatagaaggagttggaagaaggtcattagatatttagcatggtataaataataggttgactgtttattaaaaacataaggtgggattttttattttttaattagaaattttagtattttattttatttattggaggcttcaaggtagatagatgtggtccacaatgtactgaattattgatttaattgaaaattgtaatagtttagaaatgtcatcaattgaatataagatttaaaaatttatgattattttaaagtctaatttatgttgtttctataagtgctagcttgagaagaaagagaagagaagcacatgacagagtaaaaggttgctagatttgttaggcggagtctatttgtaggtgtttttttttctcttaaatataattttggatttagttgctatggagataaagaacagagaatgaatggtagggaaagaggaacgggagaaatgggagggagggagtttttggattttcgtttaaagatagatctaactatataagatagtggatccattagttcaagtggaaaccgatggttggatattttgttttcatttgtcacacttatagagtttttcaatttattagagtgacacgtggtgatcgatttagaaacatttatgggtgtaccattaggcctagacatttgtagttagaggagaggaggaggaggaagaggaagagatgggggtgaatgaggaagaagagataaagggaggaggagatagaacttattaactgatcctgtgcgcctcctcctcctcgatctcgcgcgcacgcctcgccctctccacgtatgccgatcatttttcccggttgataacaccaaccgtcactaaagataatagaggagtttgacaccgcctgccttttttttaccgggactaaaaataatctttagtcccgattgttgttaccaaatgggactaaagatcaaaaagtagctctaaacttttgaaccgggactaaagataatcttatatttagtctggttttattgcaaccgggactattaattgtggaatttggtcgaccgatcaaagatggtttttcatctttttccagaagtgcattgatcaccctactaattagactaaatataacccaacctaacatggctaactaaataaataatttttaagacgtcatctttccgactgaatgaaacaaaataataaaataataattaatacaagctaactccaaacctaaccgctacatgcaaatgtccaatcctaacactttgctaataaaatattaatccatctgctaagagcaaggttaatagagaaagcttatcgtcggcaccaaagaagtccagctctgctttatagctaaccatatacatgtagtgcgtatattagtaatatcctcatattatctctaaaagctattttatcttttaccggacccacaattctaatttgataggctcatacacagaaattatctcttggcaggcacgtgttaactagccatttgctttcttcacctaggcgcttgtgctcagccggcgcttgtgcaatcgctcacttgcctctctctcatctcatctccctcatccacgtaggacttatttgacgtggcttggctattagccagcagagctggacttattatacctgctctaatattcaccatgcttcccacacaatgcgagattgttatctgattcaaaccatgcttcccacacaatgcgagacagggattgtgtcatattcagactacgcttgatgcataatgtaagacaaccggtggatatattgccttctattgtgtttctgaaatttacagcttatgattttctgaaaaaaagcatgctagctagaaaacttttacacaatgtatttgaccacttccatacctttaataatgacacccatgcatatagacagcgagtatgtataattaaaataatctttacacattccaacgcacgggaatttgtttctagtatgcatattaattttaaaatatacttcaataaaatcgaatttctataatatagaaaaagagtgatgaaatttatttttttaaatgtggttttctgtaaaacgacaattattttcaaacagaacggagagtaatagtttagccctccgtccatgaacaatcacagttccaaaaatttttttagataatatcagagttgctaatttaatcatcgttaaccgttgttgggaatcttctcgcaggttactgcccggccggccgtgattaaactaaacacggtccaaataaaaattaattctcacccacttgcatgaattacacatgcttaagcttaattaacaaccacgtacagcttagtccgtgtacgctgagagagagaagtggagatccaatgcgattttccactccagatgatcagcatgtcatgtgtctcacgcgcccgcgcgcactgcttcttctcgatctttcatttgtttattgttcgacaccaaccaaaccatctctcacagattcttaatatacagaggtttcgaggacgagcagatcgctgcaactgcaagaaagcaaagaccggggtgtagtgagagtgtgtgtgacaagatcgatggccgcggttgagtcgtcgtcgtcgccgtcgttgtggtggtggccgctgccgccgtggctcagcccgggcgccgcgtggttcgtcctgttcaccgtcgttgtcggcgccgtcgctgtgtcgtcccgggcgcatgagcaggcgccgccgccgccgccgtcgtcgaccaggcgcaggctcactcgcagcgcgtcgtccatggtcatggagcggctacggtccttctccgccttctccttcgtccacgcgatctccggtgtgcaagaggacgacatcaccgtaggtccaccgacgtcgccggcggcgtcagggaatgcagaggcggcggaggagaatcccattggattggacgaggcgcacgcgcatccagcggtggccgccgttcggccgccgccgccacaagctgctgctgctgctgctgccaccgccggcgaggtggctgctgctgctacggcggaggagaggccgaggaagaggagggaggcggcgaaggggaggcgcgcgttcgcggaggtggaagggaaggcggaggtgaacgcgagggcggagcggttcatccggcagttcagggaggatctcaggctgcagcgcctcatgtccgtcctcaaccgcacccatgcgctcgccggcgccgcctcgtcgtccgcaccgtagcggcgtatagtagacggtggcgtggctgccggccggccagctagctgcctgccacgccgcggcaacaccattgtactgctccatatatattccattttgctttgcttaattaggatatctaatttaaccttcatcacatgcgaaaagcaagagttatggtatatagttgttttttcttgtcgaggtcagcagggatgaagctagcgctcctcaaattttcttttctggaatgactagtacaagacggtacgaaattctagtgatagagtagaaaaaaattataatattacatcctgtaggtcgtaaccagaaaaaacaaaaaaatgtactgccgcccacacaccgacaacgccaaaccacaagtcctggagaagagtagcaccggactggccgctgctaaactaacaacagaaacaaccgagatcgcccaaaaccctacccttacaaacaacacaaaatccaactttatccacgtctttaggatttagcgagagagggtgagagagaagatggaacatctctccccctaggccctccgccgtggccaacttgtagtatttaggacgccgccacgagaggaagaaatttagagcgtgcttgcgccaaaagtttgggtggttttggtaaggggatgcctagatgacgtctccaaggagagaagcgatggaaacaccgccgccgccgtccgtcaaggtctcaagagagccgagactgggctttcgcctggcaacaaccgttgaggggtgagacggcacgacaacaccctcaggaggggaatgacacttgaacgccatcgattgtcggtccggccgaggccgggctgggttttcacccgccgtccaccacctgccaatctaccacagaaactccattgctccaccgccataaaaaacctctgccggcgcgtcggtacactgcaccggcgcccccaccggctagtatccgcgtgcagccacctcaccaggctccgcctccatgacatcacctcctgctgcgtagccatcacgcgtcggccgtcctcgatgccgccgaccaagcctacacgcgcttcatggctgccggccgcaacttcttcggtgagctggcgccacctccaccgtcacggagtcgaacctcgcccgccgccgtgccaccgggcaccgccgtcgatcgccagcagtagaccccgccaccggtcacttccccgccatttctaggcgcggatctagcggtcacttccaccgccgccatcacctccaaacgccgccgccacccccgccaaatgccaccgccccacggcactaccccgccgccaacttccttcctaccagatccggccggaacgcacaaatctgggcggttccaccgttccaaatgccgagcagccccctacccctgcgtggtgagagaagcgaagccccgccgcccccatccttgcggtcacgcagctttgccgacggccactcaggcggcggcgaggcagaggaggagggaaggagaggtcggcgatggcagccaagtcgcctcccgtgtcgcccgagggggatggcgacgcgagggccgttcgctcctcaaatttaacggagatccatgggtggatgtccactcaaccaaatatctatgagaaaactttaaaaaaattgataagataaattaatgtgtaatatattacttcacaagtatgtaaattcaaattcaacttctagtgtaaaaaaaataagaaatttaatacaacctttacaagttgaatttgaggttgctttgtggagtgatatattacccattaatctatcgtgtcaaattttttgaatttttttttatttcgtggaggcaattgaagggattgccgatttgttaaacggtgtacacattagtagaggcctgtggatgaaatcatcacggcaatgccgcaactctctaatcgatcgatttcatctattattgctgcatgggtatccgaaagattactttctcagcaacctttaccttctaaaaggattgttttatgtatctctctgacttgtatcagtttaaagcaacgtacatgggaatttatatttccctactcttattaatatatataagtcgaatattcaaaaaagcccgcatgccatccaaaaacctcataaaaaattagtcatgtaatttaaattcgagctattcaaataaaaatatcattgtttttattcgtatatgcttttacttgtatagcatgtgacatcagcgatccagaagtttcatagggcatgtcttatagtccctccattagttttttaatagataatgttgttgacttttaaatacatgtttgatcatttgtcttattcaaaagttttaaagcatccatgcctagatccagtagcttgaaaactggttggcgtcggatgcagccccaggagtgaaggtttgccggatctggggcatccgtggctagatccggcatcttgtcggctcagttggtgatgatgggtgatgatggacgctccatttatttttggagggtgtcggtggctgcggtgtaggaaagtaggtcaccttgacacactacgttgggctagggcagctgtaaacacacctgtgagcgagcacaactgacagtgggactgctttaacattggcagctcggtggaggctatggtgaaagcctagacggcaatgcctgtgggcgccgttctcttcttggaggtgacatttttgtctcctcgtcatgctgtgtttcgattcttcgaatgaaaacctagctcaaggccagcaatgacgacgtggtttggcatggtgtccttcttgaaggcatcatcgagaaaatccttcatatctttgctagtgtgggagtcttcctttcttctagcttgttgcatggccttgccgtttatgtgttgagcatcgtttgttgactgtccttttccgttgctatgttgtttaggttagttgaagactttgttggagttgtgattttcactcagttttttctaattaactatgtgctgtaaaattcagttccctttttttcttaaaataggatacattcttctttatttaaaacatcgggaatgggttgaccgttcgaaaaagaatttataattgatgatcaggaaggtgcagattgaagacgtatttcattatcccctatcccacaaaagcttgatgaggcacgatcctaaacatgcatatatgttgtcatatccctattatcataaatatatgtttcctttcactagggttatgggcttgtgtcaaagcagaccttaggaagattcaaatacattattgttctcgtctctcccaactaagactcaatacctaacgagatctcattttaattaggttccttttgtagtttcccagagaagttggtatatagaattgttcttgccattcctaatattttacctgattttttattgtaaatttgcgtacagatatattgaaaagtacaattgaatttgatatgcaatttttgctatgtgtaattatattttgttcacacagctatatggctatttgctccattataatcttgatacaccacaatataacggtgcccatatttctattttttaacaaaaaatatttttcttattttacacctctaagctatttcattggagcacttaacctctataaataattttctcactcattttataccccagactactgaaagtcattcaacttactcactaatgttatttcttctttttttttctctctctctatacaagtcgaattttgcattaaaatttggtgtgattgatagatgcactatataatattttttttggaatttttatttaaaaactagaactcatttaaacattgaggctttaaatttcaagtcaacaatcatgaaaatttcgaaaaatattttacaattttaataatgatgtcatctatagctctaaaaatttttagcttaaaataaaaatcatatgaagaaaagaaaaggagagatatcattaagaagtaaagtggcccatgtttaatagtttatgaggtataaagtgagcctagaaaatagtttaggatattaaatgctttggtgatatagtttgggagaggaaagtagatttttttttaattaacatgttaaattttaggacgcatattaggcttttagaaactcaaactttgcatatcttgaccaataattagttgcagctaataaaagtcatctgtagcctataggttcatattttagagagttttacaaaagaacaactttttacgagtaatcgtaaatcaacacctaatgccattgttactctaccgtagtagtatatgttgtttgcattaattcatacctaggaagttttttttaacgcaaaaggtagagagactctaccttataaccattgtattaatagctaggaagtactacaacatagatgcctgtttcttcgcttaagatggagaaaagcacaaagccagttcgaaagaacactgtcacttatccttggctttccttgtgcgcctgagtatcccttgctgccagatcacttaattctgcaacctggtaatatatataggtatctctgtaatcgctggctggcgactttgtcctctgattaattgtgcttcacggaaggaaggaaggagactgcagatcacaaccctgcactggctagctatatatacacatacgcgcgcaaatcattaagttcaggacagatactaacaataacagagagagagagagagagagagagagagagagagagagatcaggattaaggtaagctgagggagaggttgcaaccatggcacagcggttgctgcacggggtgatggaggccaaggtcctggaggccaagctgtcgtcagtgtcctcagaggcatcagattatggccatgggcagcccaagctggctgcctatagcaaggtatacatataagattcggagagctctgataacttgacgctgtttgtttgacatcccgatctactttcgttcactcagatgatctcacatactattctagctcacaagtatcaattaaagcaaattggcaacaggaaattgtcaaattatcaaatttttctaagagacattgtttcgcttggagctgactgtaagacgtaattgcttattaaggaccaataaataatttatgaataaaatttaaatatatatgcattcttagtgaatcaaaagcttatataaaaataacaaaatcaattataaaattaagattcaaaatttaaattttggatatggctaataagctcaacagcaaatgaatagcttgtacgatggcacttatgtataataacaattatagctagccaacgaaactacatgctagacaatttcactgatgtgaaagagggagaatagagataggaggggattgctaaacatttgcctgctagacgaagtactccctccgtcctaaaatattaaaatataagtgagataggaggggattgataaacatgctccctgtcctgattcgtagcacttaaaaaatgtcacatccgttcaaaatcccttatatttggggacggagggagtatattttaagaatttaagattgtctcagaaatattgtatttttagaatattaggtgtcacatcaatcatctcttgtttgaaattatcttcattttacccctaactacctcccacatccaattcattatttaatgaagagcatatatgtcatttttcttcctaatactttaccttccaagtgttagaaatgcacttgtaacataataacagatatagtactatatgaaacacaattttcgagggaaacccagtttcagcagaaaacatgtctatcaatgtagctaaaaataaccatagagcccattgaaataaataaagtgtactcttattggtgacagtaagtgcatttccagtggatagttttattttgtggtttccaatagtgcaacataatccattgaggcttgtaattatgaataaaattaaatatctccaatacactgtttcatttcgtggtttccaatgatttagtcacaatggactttcattctatttccaagatatagttaagtgcgtaaggtggtgtttggatccaaggactaaactttactccctgtcatatcggatgaatttggagtattaaacatagactacttataaaactaattacataaatgagagctaattcgtgtgacaaaatttttaagcctaattaatccataattagcgcatgtttactatagcatcacataggctaatcatggattaattaggctcaatagattcgtctcgcgaattagtccagcattatagaatgggttttattaatagtgtacatttaatatttataattagtgtctaaacatcttatgtgatagggactaaaaagttttagtcccatctaaacagggtctaaaccaagtttcatctagatgaaacccacttcttgtttctcttcataaatttcttgagtttagtttatatggcattggcatctcatttaataagattgaaaactattatgaaacttgcaccgggaatggcctaatatccattgagccaactcttgtgtgttattttaggaagtggactctcttaatgagatggaagacttaaggttgactttggaagtgagtttggaatatgatttttcagggtgcgcaaaatgtattaagccattagtgtataactaattgagtatctattatattattagaacaggtttgaaaagaggcaacgcgttcggcgtggacgctagaaactcccacattaatcagagaaaaagcaagttaagtatgaatacatttacaaatagctaaaattagaaatattgaaccaagagtccatatagaacactactagagattaattaaaattcgaaataaaaaaataaaaaaaaattgaaattagaaaaataaaaataagagttcaagtagaaatataatttagaaataactaaaattcggaatgaaaaataaagaatgttgagagaatagtccaattcagaataaaaataaaataaatttcaaaatagaaaaataataataagagttcaaataaaaatacaatttataaataactaaaattaaggataaaaaataaggactattgaaagaagaccatctacaacacaacattatttaaattttggacaaaagaataaattctaagattagatgagtgaaaatgagagttcaagtagcaatacaatttagaaataactgaaattcagaaaaataaatagtgcaagaacagtacatataaaatatagtatgaggctaaataaaattcaaaataaataataaaataaataatggaattcgaattaaaaataaaataaattctggaataagaaaaagtaatataacagttgaagtaaatacaatttataaataaaaatgagagtaaaaaatagagttttaaaaaacaatagttcatctagaaaataacgatgataaatgataataaagatgaaggagtaatgggcttataaagaaatagagtagtgatggtcgacgggacatctaaaaatataaaataaaccccaaaaatgattaggttcgatttttagaatcccaaacgattaaaaataggaccgatgggtaagccattaagcgacatgtatgcgacggttggtgggacttctaaaagtaaaaaaataaaccctaacaataattatgttcgattttaaaatgacaataaagaggggatgccatagaggaatacaatgacgatgtttgacgtgacttctaaatataaaaaggaggccaatgagacaataaattctaaaagctataaggtccaatttttaaatgttacaagataatgaatgtatatccattatatatatgtatgtgtgtatgtgaatcaaataaataggtaataaaggagtaagggatagtgacaggcgtgactattaaaaactactgcctccgtttcaggttataagattttctaacattgcccacattcacatagatgttaatgaatctaggcacgcatatatgtctaaattcgttagcatatatataaatttaggcaatgctagaaagttttataatatgaaacggagaaagtattaaattagaaacccgagatgataacatacgattttttaaagtcctaaggcaacattatagctatttaacaaattgtaagtaaaatcgtttgtaaaaaatagataacttcgtataggtgctagccacgcaattgcgcgagcaacccagctagttaattattataagttaaaaataagtttatttgattcttaaaagaaacatctatattaaaaaaagagcaaatttcacgaaactatatgtattttgatcaatctatcataaatagatttaagatattgtataaaaagaaactacaaattaacatcagttttaccacaaaagtacaatttttgttacctcaataatgctatggatataaactctaaaatttgtagttctttaataacttcatcacaaattaaagttgtagacttgtgatacaatgctttagatatgtggttgtatcataaatttgatgataaatttgtagttaaatctatagttttacgatagtttggttaaagttcctatagttttctgaaatttacttaagagaaacattgtttagcattttgggaagcgtgtgtgctaacgaaaatcaagcaagctgccaatacgggaccttagttttggttgggctgaactaaatggatatgcccttataaattgatagttgtttattctctcacagtgccatataattaatggatatctcaattatttcaagtccttaaattaatagctgatctatggtgtattctgttcctcttatctccttaagctacatcataattaatctaaggaacaaaattgaatagaacacgtaaagccaaacccattcaccacgtttaccattttgtcatttaacttaagtcacacgcataggatttcgatctagtgacatattataaccgtgcaatttgagaaaagaaatcgacttgtgcttgtaccagagtcagaagctgccgaggacaaagctcttgtcactaatcatgaagctgccgttcatcttcacctgccaggttcgaaaactctcctgtcactggtcatgaagtagccacatacgccatctaattgtccattattaattattgtacttaattatgcagtaatgcttctgtaactaattccagctgatacttgccagtactatcttccttcaattcgttgtttaatagatatatagcatcgttaatttttaaagttacctccttcattccaagataaattaatctaatataaaatatgacacatcttaatttacgaatttggacacatataatagtaagttaatttattttaagaggaggaagtacatcaaccattaatattattaaaattgtccaaatagaaaagaaatgtgctttaaatatatttaatgataaaccaagttaataaatagtacgtactattttaaatcagacgaacagtagttgtacataaaggtcgaaggtatttatgtattgaaaaaacggagtaacttccttgtaaaagaaaataatgatactggttaactgatgcactcgcagaggttcgacaagtccactgaccaagcgcaccacggcgacggcaagtgcctcgtctacgccaccattggcatggacgcggcgcgcgtcgcccggacgcgcgccaccgaccagccgcagtggactgaggagccgctccacgtctactgcgcgcacgacgccagcgacatcgtcttcaccatcgtgacgaccggcggccaccgcgacggcgatcctgaagacggcaccgccgaggaggtcgtcggccaagcctacctgcccgcggacgacgtcggcggcggcaaggagatcgaccggtggctcccgctctgcgacgagaagaggaagccactcgaaggccttgacaaggttcatgtccagctccggttcaccgacgtgatgtccgacgtcacgtcgcggtggggcaagggcgtcgatggtcccgtgccgccgccgccgtacaccgggctgccccgcgctttcttcgggcagcaccgcggatgcaaggtgaccctgtaccaggacgcgcacgtcgcgccgccgctcgccggcagcaggtgctgggaggacgtgttcgacgccgtcgccaacgcccggagtctggtgtacatcgccggctggtcggtgagcaccgacgtcgcgctggtgcgcgacccgaggcggcccgcgcagacgctggggcacctgctcaagtcgaaggccggggagcgcgtcgccgtgctgcttctggtgtgggacgatcgggcggccaccggcctcggcgcggcgcggcgggacgggaggatgggcgcggcgcgcggcgaggacacggcgagctacttccgcggcacgggcgtgcactgcgtcgtgtgcccccgggacgccgtgttcacgcaccaccagaaggcggtggtcgccgacggcccgcgcggcctcgtcgcgttcctcggcggcattgacctctgcggcggaaggtacgacacgcaggagcacccgctgttccggacgctcgccaccgcgcaccgcgacgacttccaccagcccagcttccccggcgcgtccgtcgccaagggcgggccgagggagccgtggcacgacgtgcactgccgcatcgagggcccggcggcgtgggacgtgctcgacaacttcgagcagaggtggcgggggcagggcggcgccggcggcgaggccctcctcgcccgcctcccaaggagctccgccgcgcgcgaggcggtggagcaggacaaccaggagtggcacgtgcaggtgttccggtccatcgacagccgcgcggtggaccggttcccggacaccgccggcgaggccgcgcggtgcggcctcgtcaccggcgccaccggcgacaccgtggagcgcagcatccaggacggctacatccacgccatccgccgcgccaagtacttcatctacatcgagagccagtgcttcctagggagctcctacgggtggaaccgtgacgtcgccggcggcgccgccaccgccaagaacgccgccgccgccgccgtggcgccgcacaccatccccaaggagctgtcgctgaagctcgcaagcaagatcaggtccggggactcgttcagggtgtacgtggtgctcccgatgtggccggagggcgtgccggagagcgccaccgtgcaggccgtcctggactggcagcggcggaccatggagatgatgtacaaggacgtggcggcggcgctcgccgcgaggggctcgacgcagaaccccagggagtacctcagcttcttctgcttgggcaaccgggagccgtacgtccccggcgagcacgcgccgccggagcggccggagctcgacagcgactacatgagggcgcagcaggccaggcgcttcaagatcaacgtcaacgccaacatcatgataggtactcccctctgtcccaatctatattacgtcgtttagtttccacataacgttcttcgtatgataaacttttgaataaaacgaatagttaaatacttaaatgttatctaaaaaatcaatggcatcataaattttaggacgaagagagtacattatatggaccagggatattgacaagatatggacatttgacaagaacacgatgatcaaaacgaaaccgttgacaatcgatcgccatgatttttttgcagtggacgacgagtacatcatcgtggggtcggcgaacgtgaaccagcgatccatggacggcggcagggacacggagatggcgatgggcgcgtaccagccgcggcacctggacaccccgaactcgtggccgagggggcaagtgcaccagttccggctcgcgctgtggcgggagcacctcggccaggcggcgttccaggccgccgccgccgccggcgacgacatgatctacccgtcgcgccatgggtgcatgagccgggtgaaccaggccgcgcggcagcactgggacatgtacgcgagcgacaagttccaggggagcctccccggccacctcatggcgtaccccgtcggcgtcggcgaccgcggcgagctctgggaggccgtccctttcttcccggacaccaacgccaaggtgttcggctgcagctccgacgagcttccaccggtcctcaccacatgaacttgtgctagcctccaatcacaataattaatatatatatatatatatatgcagcgaaaatgtattgcttgttgtacgaaaatatatgaggtggtgatttgtgaataaaaccatggtgtatgaaaatgcataaaatgcttctgctgcagttgtaaacatgaactgtactaatttatggatttgtgatatgagctatgaattcggatctggcgcctctgtgactgatctggctgcggtcaaccggcagcgtgaagatgtccttggagggcgacacgatctgagctggtggaggctacaacagcaggaaaactgacgtaggtgatggcagcgggcggccggtgtggttgacggcagcgagagacctgtgcaggcaatggaggctggtggaggccgcgcggtgtcttggcgatggccggtgacaccagctgctggcatcgacggcgggcgcagttgcgactccaacagtggcggcgacaccgatggtgggcgcgacagttggtggttgccatatgcaccaacggtaggccatggacttcgatggcgagcacggtgcactaaaggtgtgggagcagcggctggagcctgggaacggctggtgcaacagctgcctagctaagctgatggcggtgggtgactttctatacttagtgtttctatagggtggcatgtttgttagaatcatatggtaatgggaccacctatacatttgtcgacaaattttctcctaaaaatttgatagatgtaattatagtataatcgtagtgtaattacactgtaacttgtatgtaattacactgtaatttgcatgtaactacagtataacttgtatgtaagtttcacgtaattttgaatcgttagatctattacaagatttgttatagtgaggaagaaaaaaatcacagcacacacatatgtgaaaagatttgttcccacgacctccattttaccgaaataacatgttacagagagatttttgaaagttacattatagttacaatgtaattacatgcaaattacagtgtaattacactacgattgtactgtagttacatctgtcaaatttttggaagaaaatttatcgataaatatatagcaaaatcgtatttactaagcaatggcctaaattatgtagagaaggacttcgtaataatactgtatttttacaagaaagctaattggcacgcgctagctggcggcacggtcccacccccgcacggcgttttttttcccttttttcatgatttttttcttttgtttttgctcttttttctgattattttttaaacatttttagcacacgtatttttaaatagtttgtgttaaaagtatttaaatcatgacttgaaaatttttcaaatcttaacttaaaaattttcaactctcgagttgaaagtttttgaatctcaagttgaaagtttttaaatctgggttgaatattttcaaagttgagttaaaagtttttcaaatttgagatgaaaagttgaaagttttcaaaatttgactttaaaaattcaaaattcaagttgaaagttttaaaatctgggtttaaaattttgaaaatttgacttcatatatagattttcttttcaatttgttatttaaaaaaatctcgcgggaaaaagaaaatcttattatctactaccgtcattatctcaaacggttattatctaagactaatagattagtctaactaccttatcccaaagaaacacgcgccggcagacgcgccaactagcgatccccgtatttttatctcttttacctagtgagcagattaccattttattgtgttcaaaaacaaaattgttccttagcggtgagggagtaatttcttgggttatggaaagaaatagattgataaatagtgaaatgcacatgtacttacatatagttacatagattaacaactatattttgggagggaactattgggtgtggaaaatagagttgggcttatgactatattgttgaagatcaggcccaaaacatctatattggcgggctcaataagaagacaacataaaaggcttcccagccttctctttttgaaatttcaagttaaaaggaaaaaaaagtttatagaaacctctctttttctgaggatgctctatgctactacttcctatcaagtagataccaaaagttggtgttaatattgagcactccctggaaaatgggaactaatacttataatagtgattagtacaaaagcatcagtaccagactctcagttgtcaatagcacagtattcatgatcattctaggaaagaatcatatcgatcttgtttgaattaatgattctgattcatgataggcaggtgcagaggtgctggcgttccctgcaggatattgcaatgttttgtagctgccaaatatcatcacacagcatgacaaccttgtcgctgcccaaaaaaaaaaagcacatactattagcatatactccatataatataagactgactggtgaacctatttgctataaataccctactaaacttcgaagacttttccatcaaaatacccttcgaagccttaaatcttcagccactactacgaaaacctttttcgtggcggccattttagattttcgctggcggaatttggagccgccacaaagcaaaggccagtgaagatcacgattttcgctagcggttatcgaccgccagcaataattcattttcgtcttaagacgaccgccagcaaaaatggatctttgttggctgtcgtcttacacaggccgccagcaaaaattcattttcgctggcggctgtgttaaatcagccaccagggaaaatatattttgggaaaaaaattcgcatgcagctgcccagccgccagcgaagatttggagaaaagcccattgattcatttttaaaattcaaatccacatctagagatgtagattctaattcatatacatatggctgctcatttccaaattcaaacacaatacaaaatcatcattagcacaaaatcatcattagcacagatgtacacagatcaaacatcacaacatgcacaaaacatctgcatcatctagatcatcaggaaacatgcaaaaaaaaaaaaatcctaactgagctcgtcagatccgtgccgctgccggtctctcgtcgtcgccacctcaccgccgccggtggggaggaaggaggcgcaggatccgctccccgtcgcctcctcccccgcgccgctgacgccgagagccgctgccgccgccgcccccttccccgcgctactgccgaggcctcatcggcgtcggcagcagatccggggatccggcctcccccatcgtcgcggcggtggatccggccaccctcgtcgtcgtggcggcggatccgacctcccccgtcgtggcggtgacggctccggcctcccccgtcgatgtggctgcggattcggccacccccgtcgtcgcagcgacggatccaaccacccccatcgatgtggtggctggatccgaccccgagcctgcggtggagaggcgacggcagcccccggcggcagtggaggacggagagggagaaggagagaacgcgagtgagaaggagagaaggagagactgaggtaggggtggtaggtggtaggtgcggtgggtttatatattcgccttaaaactttttcctagcggtcccttttacctaccgccagcgaaaacgcgatttttgctggcggacacttaaaaggtccgccttaaaaaatagagttattttttatggcagacctcttagcatggccgccagcaaaaatcggttttcgctggcggtccgtaaccccctctccccttgttatatttttgctgacggtttttgcgtatggccgctagcgagaattatagggtaacgccatgaaaaattatttttctagtagtgagccacatcttgagcaaattgaagctaagagcattggttgtccttaataccgattttggacagttgttacaaagagtttgataggtttgccttttgaaattggacaagataaagcttgagtgaaataacaacgaaagtattggctggattgttgccatttcgcatgattttcaagtatccgtagcggaatgctagactccgggtattggctggattgttgccatttcgcatgattttcaagtatccgtagtgtatattttagtggaattctagattccgggataccattattagcgttcatgacgggatcctctcccaatctcacgtggctatgaacaaaaaatgacactgagaacacaatatttcatggcggccattacggcgcagagacaaccggattccgcgcgaggtagcggtgtgatggcgcggtggcggacaccaccgtcgcactgcgcagctgcccgcgccagccgaggacagcggcgctgcacggggcttggttgtcatcgctgaatcaaaaggagaggtcttgcaccaaggaacagtgcaggctcggtgtcggagccgatggatatgggttgtggtgacggctaggatggaattgtcataggagtggatagacgtgacggctgggacaaaattgtcgtaggagtggatagacctagtgcgaggaggattcggctaccaatgacgagctccagcgtggggcgtggactgtggaggacctacttgcagaggacgcaaccatcgacgatgagctctggagtgccgtgtggatggaggacctgctcaacgaggaggacgtggccactgctgacgagctctagcgtgggggcatggacggtggaggacctgctcctcgtgaactacatttgtcgcccacgtggagtatcatctgatacctcgtaagtatcaccgacacttcatacaaatcatctaatacctacaactatgagaacccaagtatcatgtgatacctcgccaagtatcacctgacatctcataggaatcatccaatatctataagtatcagaatccgatatcataagtatctctttgtacctcgtaagtatcacccgatacctcgcaggaatcatatgatacctcgtaagtatcgacgagtatcaggtggcatcaacggatatcaacatccggtaccaataagtatcagtcaatacctataagtatcacttgatacctaaccagtatcatcttgtctgaacgggttcgttgtatagcagcctcctaattaattctagcccactccaaattcaaagaaaagatgaaggtaaaatatatgtactctttgtgttgcatgaatgtactggtgctaattgtacaacttacggtcataaatatttaatgctcgactttttccatagctatcaaaatacaactctgaccacaattttatattggaataagttgataaaatctactaattttatcatattataatagtacttgtcaaggaaaatctacaaatgccattattattttgaacaaaggaattattacttctggcctttataccaactaaagatacatcaaccaaatttatatatactaggatttgaaccctggtaaattgagccatgtatccacgacttcactaccacactaatagtgaactaagcatttaaaagttattgaccaaatttttgttctaaatacgagttttgctaagctcaactataaatgctactgttggtatcctgtagtaagaaatgagtgaatgggcctggtgggacacaagaacatgcagagggctcaaaacttcaaatgctcaactaccatgccagatattgggccagtgacagataagttgattctcaacttttcacataagaaatcatcttgctcttcttaagttccattgatgcacaaaacaagaaaggcaacaacttttttagaagactaacctttacttggatacttaacttggatcttgcatttgcaatacaatctaagttcatggtaactagcctgtcctttctttgatgtatctcaattctcaggtcacaactcacaagtacagcttggcaagcttctcatcctttggattgttcatgttggcctttacggttgttggctatcaccatccaaacccccaaaatattaaaagaagggcaattttgccatggataatgactacctgttaatttaggcggagtagtatctttcccctggtgttattgtgaaatgatgtacttcgaatgatactactctaaagtggtgaactttggacggtataggtccaatctttcattcgattaattacatgtgatacaaatcatattaataatagtttaattcgactggcaaaccacacgaaattagtttaactcctatgtttaaatataacaaagtgtttgaaaataaaatatatatagtcattttctccaagcaatccatgtattccaagattccaactactaatttgagttgtcttacttagaaatatatagaaacagcatagcccaaagaaagttgtgcaagaatgagataaattggtactagcattttagcagcatgtaaaaaattatgagtaaatttcagaaaaccccatattttgtcgtcaaagttgtggaaaaccacaggtattatgatgtgtggcacatcacaggttttatggtctgaatgtttcataaaactccgcaatttttgaaatcttgataaatttcaacatatcttaaacaaaattttggaagtagtaaaaaattaaactatcgatcttaatcaagaaattaataattaaaattttcatttgcactctatgttttaaaattttaagtaaattcgcgctcaaaatgcataaaggtggggttttgtgaaattttaaaaccataatacctagattaggtgtcacatttcataatacatgtaatttttctttaattttgaccataaaaaaattaggttttatgaaatttacttaaaaattaatgtaagtattcaaaatcaagctagtacgtaccatccaatataataccaagtacaccagatccagtaccaacggctacgaccagatgtccctttgaaggtacgctcgtcgctggctcactgcacatcgtaggctgtcttgctgtagctgggcagttgtacagcggacaaaaacgtactctcctctttcttccattcacagaaagattgaatgaatgaacacagtggtccttccatagccacagacagtacgtctgaagaaaacaagacagtcaatgagggcacactgggtagttgctggagtaaaattcatcagttcttggacccagctctgattcacaaaagcctccatgagaactggtagtacacagagctgcagaagcatccaccactgttctggaatcttggatgatcaggtccctggccacataaccaccaatgctatctcaaattccactgtgtggcttaaatggcttgctgggagaggctgttaccatcaatgaacgccggccctgctcaaccacatcgagtgagtacttcatgattagtgtcttctcaggctgtctgctaggtgctagctccctagagctcactgacatcaacatcgatcaagcctccccccctaactcgtgcatttgtgaaggaggttaggatgcagccatcagctctgagtagacggtccatttcattgggggaggggggggatcggagtcaccacctcctaactgagttgcttcattcagtgatggacaacctagctgagaggacaatggggaaatcagttttctgacgaatcacaaattgcatcctgaacatctcacttaaacattattgcaagctgcaatgcagacagatacaggtaatatttgcaccctctgggctgtcctgtgccgtgctgtggatgtatttcgaccacagcttctcctgattgttgtctacaaaataagcacagagaagagagcattcaacagcaatgtggttttaaataacatggcatcaaactattaaaaatttgtagtcatatgatcacaagagggatgcaagacacaacttcagtttaatgagttcggtttcatattttctgctcctatgttccagtgaagtacttagaatcatcaggcaagaaaattgaccagcgtcctttgtcccttttaataactatgttttaggcgaaattccgaactaaaaacgaaaaagataatcccttctttctgacgcacttttcgtaaagatttgaactgtaatacagcttgatgaggacattcaaaccaacattacagtaacaggtaatgaacaagatacacaagtaaagccaagccaaacaccatttacaagaaattcaagtccgattacgcgcagtcaggcaaagaagctacaacaacagatttacgcgctactttctgagatgcatttccatattgatgagaataatatactacctaagtcatctacacttctcttactcaggtttacgtgcgaggatcctccaaagggagtggtttacgagaagaacaaggttaccacaagctaatggaagcctctgcttccaagaataactcagctcagcctgcttcgaatgaccaagcatgaaacatatggatggaaagcctatcaagtttacttttatatgcaacaaacgaattgtcatttggacttctaaggagggagttatggccattctactgaaaacagtccagcaatcaaagagccgcgcgagaagctgaagaaacctctcgatataccactataatttgcccatttacctcccaacgtgatgagttgtgttaacactctgttgggagggttgttaccactataaatacttccttatagctaccatttcagcactttttgatcactggataaaccaatacattatattgcagctgagttgccgagtgacttactcctatattcttgtgagttcatcctgggcttgcaagaggtccctcctggatcccctaatttgtgcttttggcttccgggtctcttgtgtggattagtttcggtttgtggttctgtggtcgtttggagattaggtcggagttcaggaggcttcggatcgtccctccccatcacttggtcgcaaccaaccttaacaggtataaagctagttacccctgctgttcacggccaattacctgtcaatcgtcaacctactatcgtgaagatcgggccatcctagcatgttcgcaccacagctggtcctttgtatccatcgtcttctgaaggcttctgcttgtgccctgtgtacgtttgggggcaagttgctgacaaaaaccaaagttttcgggttccagttgtatgaatgatctggtaggttctcatggtcccctacaaatttcaagctatttaattgcatagaagaggttgagatctaccctcacataaactgagaattgtatgcactacactcagaatcttaacaggtacagtaactgtctgttacatgaaaagaaaatccaacattattaaataattctcaccaattcccttgaaagaccacaaacctcactaaactgctggggtcattcttagtctgctcacacttttcagaaaaacacatgaacaccatcgtggttgcaaaggacgaaagaacaaaacagaggatgttatgtattatagatagctgttatactccagattgttactattatagtttagttctcttcttgctggcaccaaacaattttggtagttgatgtcatggccataaatgcaagctcctctctttatgaacaccgtttcaaaggttatttggatgtctaatgacatttttttaatacacggtactttcaagttcatatcaataagttcaacaaatacggtccatccatatctatcatctttacctctgacaaattatctatcatctttacctctgacaaatacggtcctaagcttctaaacggtgcgatttttataaaagttttctagaaataagtttcttccaataatttttaaaacaacttttacaactttgtaatagataatttattcgtttgtacccccaaaatattatcacaaaatcagataatccatcatccactcagaactaaagaacaaagaacagggccaacaatgccttcatctagggtgttgacagtgttgtcatctgcgcacttaaaaattatagcgttttgtgatctgcaaacttcaaagttacaacgtgttgtgatctacgaactacaaacttataaccaactgactgactatgcaatattaccattatagtatgataatgacaacacatatgcttccggaaatattgacaatgcaatggtagtacagtaccattttctgtactatggactagagaacctagctttactagatcccagattagtttcgaacaccttttcttgtaacacatgacttaaccgatgtttatctttactagcatggaaaagggaggttaagatctgtacctttctcccgagtctctctcctgcccagacagtcattttatcagcctgaacattgtcttcctttgtaacaatctctctgattttatttgttgaaagcaacatcaatttgaggatagcgaaggtagagcaatatctcagtataaactgctgagcaacaatgctgaaaacccctgttccgccaaaatctaatttggtctaatgatgaaaacagctgatgacagcaataattgtctccagaagccctaatattagatagtgatagtaatgtggaggcgtggagctcaataactgagcgaaaagttttaacaaaattctatgcatgctcaaactttagtctcatgagtccattaagcacaagttaggacctaataaaacaatttcggttcgtcttaatagaacatgtctttttcatttttttgcacctgtcacagtcaatcaaccaagactactttcactgtattttaaactattttcacttgagtcatgagctggatctgaaatgcttatcatataacctgttttcccatgatgtttcattataaaatgtacatataaatttgttaggtccctaggaaaccgtttatgagtagtagagtataagctttctaaggcacatcttcagtgtatattctattgggattctgactaccattgcactataaatctataatataaataacaaaaatgttgcctccggcactaatgcagtccactttcatgcttttgaggacccatcctctttaacaagttttcaagcattctgaacataacgaatagaagtgcagacattaaggctttggacctttcgtactgaattggttatgcagtcaatttgaatatgatgcaaatacagaagggaagtaaataccttggctttaaactgctactccctccggtttcattttaattgacgctttggacaatgacatgctctacaagatatacctttgaccttatttttctattataatatatacaataaataaatgcatgtttacttttattatagtgttttcaaagacaaatctatatatgtttttctagtttctttaaactaaatatttttaaagttattgatggtcaaagttataaaagtttaacctcaaccttgtcgaaaacgtcaattattatagaaccagagggaagtaacccatatgggcacaaaaatagaaacattaattagagttcaaatgagagtaagaaatgacagataggcatagcatgtccttcttactattgttacatgtaatcaaggggtgatgggcatattcacagtggtttagctgtagttagttggctgatgagtccataaatctaagtagtactcgaagtttgctgcctctgcattgaatagcacttaatggtatgggtgagctctcttgaatgcatgcacacagtggcactcccaatctcacagtgctgcatctgtctacataaacgattggaatgcatttgggcaagactgtgaggcagaacagaaatcagagaactgaggacagaaggcaagtaggaagaatctgagctgtctgaatggaagggaaaaacaactagggggagaaaaggaaaggattatccaagctttcgtgtatcatccgagtgtcccttgtatgcaatgggtttgatcaatagaggggtcttcttcaagatcttggccttcctctgcttcatcagatcatctcaaggtacattcaatctatttcagttcatatgttccttaagcgtcagcatgaatcattttccttcgacttcctttccactaaaacgaattcagtaggattttatgatggtcaaaggctggtttctcagagatgctggaatttgatcactcaaatttcaataagctgcttctatcaaccatagctttcatcatgacattttcatatttttatagcaaaaatggagttcagaattttggctgacactcagaatcataaccatgccatttgcaaccaactcctgtttatattactctctgatttcactatttttcgttggccagaaatcttaggtatagagcgatgcaataagaaatttgcaggaagaggagagggcgaaaaagacataccttataatctcggcctgtagtgaatattcagaagaaacctgatgaatggcaatgcagcatttagcttaaaccgattgagattttcttatgtataaagatataaaaggaagtgataaaaaccgtacctgaaactgggtagcttcagataaaacatgaatacttgtatttgcaggaagaaatcattttaccacattggatctccctcccctactgaaggcaagcagtttctccagaatacagcatgaggcatatgactacatcattgttggaggtggcacagctggatgcccattggcagcaacgttgtcccagaagtacaaggtgctcttgctggaaagaggagggtctccttacggcaaccggaacatctcacatcttgcagaacttccagatttgcttggcagatgactcgccaaattcaccatctcagggatttatctccactgatggtgtcatcaatgcccgggccaaggttctag

SEQ ID NO: 67689 - DNA, 3464 bp, Oryza sativa
ttaaccattgtcgaagaagtagcttccatagcgtgcataataacctcagatgaaaaatcagctgacaacttaaggcaaaaaacagggataattctgaaatatttataagaagcttagccaatttatggtgtctttgcatgtcgcgttctctaaccagcattttatacttgtgtcttaagcaattaacataagcttccactctgaaggtctacagatagccaatcaaagaagcctaagttgtaccggagtcactctaactattaggcagtgtattggctacttctccatgttcatgaacttactagtccaaccaagctatctcagtttccatttatacccatcaaagtacaaaaatactaccttgaagacagtcataatgggcagaccaaaaggcaaatcagggaacctacccataacaaattccaacatgtaccacaacagatcccataactgtacctcactgggggaattattatagaccttatgccttttggttgagttgtgaactcaggacaagatcttgaatcaaattggagatactccagtataaggatcgcaatgttggattgagttatagaattgaatatcctatcagattctacaaacaatacattgttccaaatttgcatgcttttcaacaaggatattttcgaattgtacttcagaaggttttagttttgccccagatgtacaaataatagccgatcccatgtataaaaggtgaagccttgcaagttgcaacttaaaggtcagctgcaagtaactattgtttttctagggaagtgaatacttattttcaattactaggattggtataattgtgaccatgatccaaaataatctgctagaagcccatgaataatatgattatatcaaattaagatccttcctatgttcaaatcagttcaataactgtagggcataagacctgaattgagattacaaacaattggttaggaatggcttggcacaattcattaatatatgccccttttttgaaattttaataaagtaagaatgtaattgttaaggtaattgctgaaatcccaactataaggttagcataagatgtgctttgcgcatagcgtgagcggctctaatggactgatattctcatgtcaatattacttttagtgatacagtaatgctaataatatattaagaatagaaaaaagggttcactgatgaatgtgcttgtcctgtagctttgttcaagacgcaggctgggatgcagagttggtaaaccaatcatacccttggatcgaagagaggattgtttattggcccaatattacaccgtggcaagctgcactgcgggacgggctgcttgaagcaggggtctcaccttacaatggatacagctatgatcatctctttggaacaaaggtcgggggaacaatctttgatgaggctgggtacaggcacactgctgctgacctccttgctgctggaaatcataacaacctcagggttctccttcatgctagtgtgaccagaataattttcaacacagaacaaggtaagaattaatccaaggcaggcctagctcttataatccctatccactttaacagcagacgcgatagtaacatcatctcttgcacagagcacaggaagccaaggaccattggtgttgaattcaaggatgagaatggggggcagcagcatgccttccttacccgaaacagagacagcgagattatcatctctgctggtgcaattggcagtccccagctattgttgcttagtggaattggacccagaaaggaacttaaaaagcataacatttctgtagtccttcgcaacgaacatgtgggtaaagggatgtcagataatccaatgaattccatctttatacctaccaaggatgcccctaagcaatcactgattcagactgttggaataaccgacggcggggcgttcatagaagccagcagtggtttcagccagtcaccagatagtatccagtgccaccatggaatcatgtccgctgaggtttggcatcaatttcaaagactttacttgcataaaattttgaattctttataagcatcatggggtgttggtgtatatcatacaaaagcttgtgtagttgtgtacataaacaacatccacatcagcactctcagaaaacaacacacgctaaattagcttgtcaaaagccatctttagtttttggtaagcaacttcattaagcttatcttcaggagcccaggattaagatatcagaggaacccagaatctaccaacatgtacacagaaattcatctcaatggttttaaactagagtaaattaaggttttaaagcagagtttcttctgggattatttatggacaaaaaattgtaataataagaaacttctttgaatttgtaaaagccaaaaagaaaaaaacgttaagcttatttacttttgagaagcatgctaactttcaagcttatcatccctcatgaattttgtcactgcaatgtagattgggcagctgtcaacgattcccccaaagcaaagaaatctagatgcagtcaagaagtatgtacataaaaaatataacctacccaaagaagtattcagtgggggttttatactttcgaagattgatggtccattgtctactggtaatctagttcttgtggatactgacatcaatagcaaccccacggttaccttcaactacttccagcacccaaaggatctcagtcggtgtgtctatgggatcaagaccatagagagaatactgaagacaaaccatttcactaattttaccctcaatggtggtggatatccaatggaagtggtgctcaacatgagtgtaacagcaaacataaacttgatacccaagcacacaaatgacagcacatccatggagcagttttgcagagacacagtggtcaccatctggcattaccatggcggatgccatgtgggcaaggtggttgaccaacaataccgtgtgattggtgtctcaggccttcgtgtgatcgatgggtcgaccttatttaggtcaccaggaaccaacccgcaagccacagtcatgatgatgggcaggtaaaggcaaaaacaaactatagtactctcctttaatctacaaaattaaatttcaagggttgatctttcttttgtcatattgtctttcatggtcagatacatgggagtgaagattctaagaagaagattaggacgagctgctggagtataactgattcttggaccttattgattatgtaagaatgtgacttaggaaaagaaaagtatatagtaatttttgaagcaattcaatatcatatcaccacagaaagaaaattaggagttttcgtttgtgttctagatgtggaaatctatggcatgtaatatcatctattgacaccattgtttctgcattatgaacaagtaaattatattacattgtaattacatgaactgcaaagttctactacctctgtttcacaatgtaagtcattctagcat

SEQ ID NO: 67690 - DNA, 8726 bp, Oryza sativa
ctagaatgacttacattgtgaaacgaaggaagtattcatcaatgagcagcatgtcaagctatgtagaaatgtagactagaaaagatcatattttaaatctatgtagtaatgcaaaatacagaaaaaaaaaaggttttattatgccattacttgaagtctgaaatatccaacatacgtcatagttaatatcaaaaggggaaaaaaagatagaaacatcatacctttatctcatcaacaaatgctaagaagtttctttccatgtctcccaaaatcgagtcccactccactgaatttcagagcatgtcccagagaaaagctgccacagaatgaaacgagatcatcacaaggccatcaaaagcagcacgacctggctatgatcgaagacggaagggtcaagataatagctgcctacagcgcagctatccgttcctgcttgctccgcgtcggtacgccttcgccaccgaaccctcccgcggtgcagcagcggaggagccacggcggcgggatgatcgatccagtcggtgaggtgtggtcggggcattacagcaaacacctggtgggcgcggcgcaccggtgctatgcgaaatcgccaaccagagactagagcccgcctccttcgcatagcctggcgtggatggtggaggcgaggagctatgtgaagaacgcagaaggtgggcacggcgggcagagctgatcggcggcggcggcgccaccggcgccggcttattcatcaaccgaaaaaagaaaaaagaaaaataatcagttgcggggtccggctgcagcgtagcgtgcggtagaaagccaccattcgcattatctgtcattaaggggtgaatagtagatacgaacagtgaaaatataatacatgctacagtattttactatagctatagtagaattaccttaaaaaaagaattaaatagtgttcgatggttctatattggtctactgtaaattactgttgattaatcccgtgcatttatgctgcagttggaatgacaaaggataccatcccgacagccacaatactatataacattagctattttctaacattaatcaacagtaatctacattagaccaatacggaaccatcgaacaatattttcatacgtttctacagtaattctattgtagtataccttacattttactattcatcaataacattcaccctctaataaacattttactattcgtcaataacattcaccttctaatagcagagggtacataccatttagttttgagataaaatgtgagcatgatgagtgaaaagacaaaatctgtcaaaatctcaataaaattcaaacaaaacttggcaaccaaaatttaaacgattcttttgaatgttttaaccaagtgaagtagacgaaaattgttcatttttagttgaaattcatttggtttatggaaaactcgttgcttttcctataaatagaataaatgaagaataaatgttacagaattgagagaaatgctaaagaaattatgaaggaatcggaaataaaaaatgcagaataaattttacaaaattgagaagaatggtaagaaatgaggaataatcagttgataattagtgttaccatcctgtttttctctgattttttttaaggctaccttggtgatttacacattgcccctttgtgccctcggctcctcgtgctcgcgcgggttaccactcgtatgaggtgcgccggtcaatccgatttttaggccaagtgggatgtgcatgcgtgccggtccccgctgttggttggtactggtttcatcaataggctattttgtaaaaaaaaaaatctcgtgtttgcatgaaatatcatatacgtcctaggacagcctaccacgctgttatgtttcttccaaaaaaactcttcgtcttttagagaaatacaacaggaagaagaaaaaaatcttgcttataaggatagagctgtaatcattaaaattacaggggcattcttgaaaataaccacatctgaagttgcatctatccccctagtgggttttggtgattaatgacgaataaggttaagggactaatgagttttattgagatactcaggtgattagtcccaaggtaaacttaggtgagcaagagatgcttggagacctccccccccacaacaatcattcaagcggtattagaactcgaagggtgcataggatagtttaattttgcaatcgagtcttaggaaaaccatactattaggaggggttccaagtatggttctgggatataaaaagtactcttagtgagatcttagtatcgaaatatttttgggagctatttttggaaatagccctgccccggacagagaaggctggccgaaagttccggtctctggacccggaagttccggaccttcgagagtgaaattttcctaagtattgtccggaagtttcgggtgtcaggaagttccagactccttccagttcaaaaatgtgagtaacagctagatgacgtcacctagccgttatatatatatccagatctcacccagctcaccttttggccatttttacttcagttatttcatgccctaggtttctcttgaagttgcatttatccccctagtgggttttggtgattaatgatgaataaggttaagggactaatgtgtttattgagatatacaggtaattagtcccaaggtgatcttaggtgatcaagagatgcttggagacccctacaacattcattcatgcggatttgaagctcgaaagttaataggatagttttcatttttgaaattgagtcttaggaaaaaccgtactattaagaggggtttcaagtgtggttctgagatataaaaagtgctcttagtgggttcatagtgatagaatatttttgggagccatttttgcaaatgggtccagaccggacagagaaggctggccggaagttccggtccctggacctggaacttccggaccctgcattggatgaaatttgcctaagtgttggccggaagttccgagggtcaggaacttccggacttcctccagttcaaaaatgtgagtaacggctagatgacgtcacatagccgttatatatatctagatcgcacccagctcattttttggccattccacttcagttctttcatcccctaggttgttctagcctctcccaaggtccctttgcttcctccactcaaatctagagcctttcttgtgagattgtgagagtagatgagagtgtaggagtgatttggagaagctttgaaaactaggtgtggttgagcactttggatatcttgtgggctgtcacttggggcttattactcttggagatcttctcctatacggataggtgtcgcccgcgagcttccgaaatcttgtggatgtcccgggaaagtttgtgaaggttttcctcacccctgcaaggaaacgaggtaagtgattaaggattcttgtgctgagttttcagaggttctcctaggtagagcaacttgcggttgtggtcttttctagaaggatttgtgagttggatcttggtggttattcaaattctagaaaatgacctaggagtgttgagttgaaggccttggacttccttcccgttctttgtacaagtgaggcaaggggttaatcgagacccggctctttggagcacctcaatggagagtaggatcccaagatccgaacttcggggaaaaatcatctttgttccctctgtgatgattgtgcatgttactgtgattgtgcttttgttctgtcatcctgtagtttatttcgtgcaaattagctcaactccctgttagatcttcaggtttttctgttgcccggaactagttatctcgtgcaaattagctcaactccctgttagatcttcaggtttttctgttgcccggaagttccggtgctaagaacaccggaagttccagactgtctgagcagaccggaagttctggtgttctacaccaggaggttctaggcctgttgaattttaccactacgatttgtttgtgattttcaggaaagcctattcaccccccctctaggctacatctctgcgcgttcaacatctacccccaaaccctaccctgaccgtctcccatctcctccccaccacgacccacccagatctggatcgtctgcctttacgtggtgactgcatgagcgtgccttcagcacccatccaccatccaaacaatctgacggctcacatggggcacgccatagctgacataaccagccatcgaagcccacgaaaacctaacaagaggcagcaatgacatgcccacgcccatcgccgcctgcgctggggattggcccggagcttgttcgatggtatgtgctgccgtcagtcgagtgacctgaagcttttccagtggcacacgccaccattggccgctccgagagccgggctggacgtcgtgttcaatctccgccagcggatcttccattgaggacaagtttatagcggcggcagcgtagtagcagtcggaggcaagcatgacaaggtcttctcgttgtgattccgcagaaaacctgattgagggcctgtttagatcaatttgctgcggcaaatttttttgtaaaagatttggcattgcaattttacaactaggtgtttagatccattttacccaaacagtggtctaaaaaggaaaacttttgtcattttggagagtctaaacaggccctgaatgcatacgtaatgcgttacttgctacatggtcgaatcagaacgcaaagctttgcttgatgcttggtgtaactataatcgtgttatgctactaccaggattcctaattcgcgcgtacgcgccgcgggcgagcacttccggcccacacggcccgtacgcgcggtgctgccagcgctaatcgagattttttttcatagcgcacgtttaatgtaagtaactgtttaaggataatgataataattaatgaaagatttttttcttttttgagatttttttactaatagatagaaaatttttaagttacatttgaaaacttttgacttaagatttaaactttgaagtcaaattttgaaaactttcaactcatatttgaaaactttcaactccgatttaaaaacttacgactcaagatttgaaaacttttgactcagatttgaaaactttcgactcaggtttgaaactttcaactcaagatctaaaaactttcaactcaaattttaaaaattttcaactcaaaattgaaaacttttcatattaaaatcgaaaactttcaactcaaaattcaaaaactttttaactcatatttgaaaactttcaagttgatattttgaaaactttcaaatcgtattttcaaaattttcaagtcaatatttgaaaattttaactcaaaatttcaaaatcaattgtttttatttttttattgataaattactgtagcattttcgttaatcactagtcagacgttgttgttttctttcgagaaaaacgctaagcgctacttaaagcgaaggtccacgtgcacgcgacttaacgtcctcgcgcgtgcgcgcgagctagccaccccctgctactactcgatcttggtgcatccatatttttcaagtttcacagacagcaagcatgctgaattgtttccaattgctgcatccaatcctagcaggaagatcgtctgccttcacggggtcgtcgtccgttcccggctgctggtggtggcgcatcctgacggacgagtccccgctgtggacggcggcggctatagcgacaacgaggacgctgcgtggggtttggtgggctggttctattggttaggaatgagcttaggaatattagtaggtgggcacacacccagagtaacataatttaatctataacctctacgacggattaaatttatcacacataaatagattagggacttggaaaaaaaatctcgtttcacaaactttatgggtaacctcaccacccacaagaataggtatttacacacaagatgtatctatccaaccaaacaacatcttctgcatgctaccattccatccgccccatgctgcaaccaaccaaacaacatctcatcatatccaggttcatctcatccaagcaaccaaacgcctgcatgtgtatcccctaaaccaagctaaacttagcctggatgagggagatgagccagactagagggatacgagcaatcaaacacacccatgagccaggctagagggatacgagcaatcaaacacacccttaactgtttaaggatacgcatcatgcgatagccgtcggatacttggatggcttggtgcagtcaccccgtgaaggcagactatcttgatccgccccacccgtggatagactgtctccgccgccgtctaccctccccgcgacgccgacttccactctccccccgccgccaccttccggcctccccgctgccgtgcgccaccaccgcccctcgctgccgccaccaccaccgcctcctcccaccctcttcctccttcccctcctcacctccgccctcctccgctagattgacgaccgcagcaggtgcgcctcctcctcccttgatcagaagacgacagaagaaaagaattaaggtaggatataactataagtggccaaatgttacggcatgaaaccaaatcgctccaaatgtgagctgagtaatgtaggaaaggctgttgctacaaccagcccgtagctcctcatcctcctcctccgtcgatttgagaacagcctagctcctagcgcccgtcagaccagggagcagcagcgtcctgttggcccggcctcgtcccagcgagccatatgttacgactcgagatctcagcaagaagaattagagatagaatctggaatttagaaggaacaaagaagaacagagcagatacagacttggagagggggaaaggattggtatttagaatatgtttgttcaatacagttcacctctttcagtacaagggtaatctatttatagaccttgcccgaagctactggacccaatccttccccttcacgtgcgggttgtcacgcctctcccgtctgggccgagcggtagccgacggcccacttgatttgatccttcctcccgcgcctgagcctgatgacgaatactctggtgtgacattcctccctccttgagaaccagcttgaccccaagctggtgcagctggaaacttgtgacgaagttcctcaagattctcccatgtaatagctggagaagaagtacccttccattcaacctgaacttgttcaattagtttggcaccccgttgacgaaggtggcgttccaaaatacgatgatgaacagctaacggaccaatttcagaatctagtgtgggaagagaagcctgaacttgttcagctggtgccaatgccttcttcaattgagagacatgcacaacaggatggatcatacttgtagacggcaaatccaacttataagccacactgcccactcgttgcaagacttgaaaaggtccataaaatttgaaagataatttccgattggccctggtcatgacagattgctgcacatatggttggagcttaaggaacacccaatcacccactgtaaagacacactccgatcgatgtaaatctgcttgatgtttcatgcgttgctgagcccgcagcaaatgatgatgaatcaaagcactcatgttattgcgatcagtcaactaggaagccaaactcacaggagcatcaacggcagtaatagttaatccgaaataggatggtttatgaccaaacaatgcttcaaaaggagtcatagcaatggttgaatggtaagaagagttgtaccaaaactgagccattcccaaccaatgcttccactgtttggggcaagagtgcacaaaacaacgaagaaatgtctctaaacattgattaaccctctctgtttgtccatcagtttgcggatgataagaagaactcattcgcaattgagtgccagctcttaaaaataactccttccacaaagtgctagtaaatacccgatctcggtcagaaatgatggcacaaggcagaccatgaatgcaatgtatgtgatccataaaaagttgagctacagacaaagctgtgtaaggatgtcgaagagccaaaaaatgagcaaacttcgaaaatttatccacaatgaccaaaataacattgcaatggtctgataatggtaaaccctcaatgaaatccattgaaatgacttgctaagcatgatcaggtacttccaaaggttgtaatagcccaggtaacttgatatgctcagacttagctcgttgacaaacatcacaagcctgaacaaaattgtgcacagattgccttaaacctggccaagcaaaaagttgcttcactcgatgataagtagccaaattaccagagtgtccacccacagttgcagtatgcaaattggccagaatttgctgttgcaaagatttattgttaccaatccaaatccttttcttaaaatacaagatattagattgcaattcataatgtgcatgatgctttccattattaagcagagaagtaagaatccactgagtgtcagaatcagtagcatatcccagaggtacctcctgcagccaagcaggaatactgacagatagcgccgaaatctccaccatatcaacaggagattgtcgagataacgcatcagcagctccattttccaaaccctttttatagacaatgcgataacgcaaccccaataacttggtaagagctttctgttgccaagtggtggacaatcgttgattatctaagaaggccaaactatggtggtcagtccgtattacaaattcag

SEQ ID NO: 67691 - DNA, 2948 bp, Oryza sativa
  unsure (1)..(2948): unsure at all n locations
tttcagagtaacaaaagcctcctcatcgaacagatgtccagacaaacaactgtcccttcctcaacaagtagtcaatggtttacaaataatcccataattgcgcacaaacttgcggtaatagcctgataacccaagaaaactgcgcaattctttgactgatgtaggagtaatccaattccgaacagccacgattttgtcctcatcagtagctactccattggcactaatcacatgacccaaataagccaactggggctgaggaaaagaacattttgattgcttaaccttcaagtgattatcagataagatctgcaaaacttggcgcaaatgcacttcatgctctgccaaagagtgactgtaaacaaggatgtcatcgacaaacaccaatacactgcgacgcagatatggagctagaactgagttcataatactctgaaatgttgctggagcgctagtcaacccaaaaggaagcacacgaaactcaaaatccccatgatacgtcttaaaggcagtcttatgctcatcatctggatgcatgcgtatttgatgatagccggaacgcaaatccaatttagagaaccgacaagcacccgctaattcatccaagagttcatcaatgataggcaaaggatatttgtttttgacagtaatcgcattaagatggcgataatcaacgcaaaaccgccaagaaccatctttctttttgaccaaaagaaccagagaagagaaaggacttgagcagggtttgatgatacctctgtccaacatatcaacaacttggcattcaatttcatccttctgcaatggtgtataacgataagggcgaacattaactggttgcgcaccaggaattaacggaatggtgtgatcacattcgcgaacaggaggaagtccttgtggttcttgaaacacatccgcaaagctctgtaacaattgctgaatattgtccggaattggcaaatcagaactagactcagaatcaagggtgtataactgaactagaccttcaatagaaccggactgatataattgatgtaattccaggaccgataagacaggattagcaggtactgatggaaccaccccacataaagtaatcagctgaccatccaatgtaaaccgaattgttttctgctgccagtcaatatccatagggctataccgctccaaccaatccattcctaaaatcatatcataactctgaagtggtaacaccttcaaagcagaacaaaaatgatgtccctgaactgaccaagaaacattagccaattcagtttcacaagacaacatttgtccattagccaccttaacttgaaaagaaacaggtaactgtatcagattcgacaactgaggcatcactgaagaactgatgaaactgcaggaactaccagagtctactaaaattagaatatcatagccctgaataatcccttgcaaacgcatagtttgagcagtagttgtaccctgaatagcatggactgacaaagagaacagagaatgaggctcagtatcctctcccgaagaattaccagaatcactgtcattttgttgcagtagagcaaatacctcctgaacagcattcaattgcacagaacctgaacacttgtgagatggtgaccatttctctgcacaaatataacagagaccttgggctcgccgatgagccttgagagctcgcattctatccgcaatagcagtagtcttgacaggttcagatgaagacttgctagcccctgcactagattccgacaccttggtaggaggaagaggaagaggataagctcctttaatccgcggaacatgatcacccaatttacgaaattccttgggcttctgagtctccatccattcctcctgtaaacaagcaatagccagagtagtctctaggtcgcgaggacgttgcatcataacagcatgacgaatgtcaaaacgcaacccttcagtgaacctatgcacaatcatgagctgattgtacataggatcataagcaagcaattgattcataacatcatcaaaacgctcataaaactcctccaccgtcccggtttgcttaatctgctctatctgacgaatcaacatctgatgcctatctcgatcaaatttcctatccactgctaagcaaaaatccgaccactcagaaaaccgcaaatgagccttcgacgagcgtaaccacgaggctcgctcttcccgtaaagtaaatggtcgccaccctgacccaaagtattggatgagtaccataaaccccaaagtaatgctcacatctcatacgccaattttgtggatctaccccatcaaactgtggaaaatccaatttcggaatccggtgattatagcctcgatcctcagaacccccaacttcatcccgatgcaatgaatcacaagcaaagtgatggggaaatggagaattagtcgtacccgtgacaggaggtggcacaggaggaataatcactcctgttgccttcccccggttgttgattgcaacgcggtggccatttgagccagaatctcccgccgacgtcgaagcaacgaacgactccggcgtgggaagtagcggtggacgttgatcgttgtcgtcgccttgcttccgcgtggagatggcacctacctgcaacatgttcgacgaattgcccaactcgccacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 67692 - DNA, 713 bp, Oryza sativa
aattcctgcagccccgccgtgcggccgggcgcaaggccggtccggcagaaagtgcggcggcaagccccggaacgtcaagccttcatccgcgaggaggtggctaaacttttggaggccgggttcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcggattaaagaatgcaggtcctacttttcagcgtactactcgaatttctttgggtagccaaataggacgtaatgttgaggcgtatgtcgatgacttggttgtaaaaacgcgcaaccaagagaccttactctcagatctagcggaaacttttgagaacctccgctccgcccgcataaaactgaaccccgataagtgcgtgtttggtgtacctgcgggcaagcttctcgggtttttggtctctgcccgaggcattgaggccaaccccgagaagatacgagctatagagcggatccgcccccc

SEQ ID NO: 67693 - DNA, 769 bp, Oryza sativa
tgcaaccacctttctcccaaagagaagttttttcttactcattttgttcgtcttttggttttttcttctgcttcagcgatgtcccgtcgcattcctcccgccaccccaaatccggccagtccgaggccgaagatccagcggccgcagaggagcggaggcgagagtctgaccggcgtgaagccgcagcccgccttcgggaagctgaagaggccgcccgggaggccgcccgggttcgccaagcggaggaagctgctcgggaggaggccgcccgggctcgccaagccgaagaagctgctcgggaggaggccgcccggtctcgccaggctgaggcgacagctgctgctggcgcgtcacttgggcctactccctcgggcggccctcaggcgacatcctccgaggcggcttgcgacgaggccgcgggcgcatcgcctgggcctacctcaccgggcgacgcccaggaccaaacgggcccgggggacatccccgagcccagtgcatcctccggggggccaagccacgtcgccttttctccaaggcggctcttctcctcatcttctgtcgccccgctgagcgccgagccccttctgcaggccctggccgccgcaaacaccgcagtgctggatgggttcaacacccaagtggaggccctgcgtgcagaacgagcggagctcgaggccgcatgggcgcgtgttgaggaggggcggcgctcggtggacgccatggtggaggtgggccgtaaggctcaccggcgtcatgtctcggagcttga

SEQ ID NO: 67694 - DNA, 717 bp, Oryza sativa
gcgctttctctctctccatggagtatgtctgcttgaccatttgctccagatgagatgagattattgtcatctggtctgccttttttccggccctcccggctacaattatcgcggtcgtctcagaagactcggcacgcactcccatgctcaaactccggcttgatccgcgccgcgcggggtggagagtttttttttcctttccttttaacgccttggacttggacctgatcagagagtgctgggcttatcagctcagaagtgagagggaagaagaaactgagttcggctttactccagcttcttagtgaaggcccaaataatgccatcacaagttgatagtttttgataaggaaaaagtatatttggactccctcaactaccgcctggagtatgattcatatcctccaaccataaaaccagatatatcggctcctccaactatcaaaaccagtacaaacaatgtccctcgatggttttcgaggtggttttggctgacgtgacgcctacgtggtgatcttaactcttaaccgagtctttgtcatacgtgacgcttacgtagcattagaataaaaacaaaaataaaaaaatgtgggatccacatgtcattcacataaaaaagtattgtgggaccactgacatgtgggacacacatgtcatcctccctctccttcccttcttcctccccgtctctctcccttatctctttctccggagcgg

SEQ ID NO: 67695 - DNA, 732 bp, Oryza sativa
attcctgcagcccttttgaacataataaagaatattttttaatttatgttggatgggaatgatgtctgaatttatcttgaaaaaaattctatagtgttctaattttgttaggtttgtaaattattttctgacagaaattacagtgcaataaaatgatatgcactttgaaaatcatatcaatctgcacgcaaaaaaaagagagaagaaaattgtatcaattttcaggacaaatatgttttcatgacaaggaagcatgatttcatttgtgacagaaagtttttaatggaatgaacatggtttctgccagccttttcaagagactgagggagggagagagagagaaaaaggagaataacaagttgctcctcaattatagggttgcaatgatatatattacctttaaactaaaggtctcttagccattgccacatatgtaatgtaatttaaattcaaatggatattaaaggccattccaagtcacattccgcgttctcgtggtcataccgcgtgaacctagtgatggagaagagatcgaacccggtcatacttgggcgctagcttgatgtaagtcattgtcacaactaggcgagtcgtgttctataacaatgtagaatcgaagtaaatcaattcttgaattgtctcgcaaaaaaaaggggtgatcttgagttgaattttatcaattttaggcaaaattgggtgaacaaggaaaatagaagagatcgataaaaaaga

SEQ ID NO: 67696 - DNA, 1282 bp, Oryza sativa
attcctgcagcccagatacgacgaccagaaaaacaagtcatcctatagagccgtcatcctatagagccgagggtggtcgaccgacctagaacaagggccagcaatcaggctggtcaccaccttagccggagggcctttggaccccttggaagggtcagccaccaagttaaactaggccagccgaccacgtccaatgccttggccattaacctaatttcaccaagacaagcctagccggagggcctttggaccccttggaagggtcagccaccaagttaaactaggccggccgaccacgtccaatgccttggccattaacccaatttcaccaagacaagcccaagtgaggtggtggaccaaccgccctatgagtgggttggctggccaagcctaatccaaggagtgacttcggccgctcaatcgggactattggtgacacctgctgacctaagaaagaggtccaacgggtgccacgtatcccgatcggcatactcaggggtgggcatttgttgctgaccgagattttggtctacgtaattcgggtaaaaaaaaacttcggtcttctaaaaatgatgcctgaacttggcactgtagattttgcgatcgacaattcaggcacccaaaatttcggtccggtcttcggtcataaccgaagtaaccgcatgttgttgagaaagggcccggagcatggtctagtggaggatgggaggcaaagacgggagatagcatctgtggatgacgacttgtcgaagatgaagggcgctggtctagacttgctgaggattagagaaggtggaggcaagctcctcgtagtgtgaaagaagctctaggggacttagggctgagtgttccgtttcatcggtttaataaaagttcggttttctagctatgacaaccgaagtgtttatagaaaaaatagaaagccgaaccgagtaaactgagtaactttggttctgttgttcggttttaccgaacaaatcgtgggaacacgttggcaagaattccaaagcacaagatactcaaagaaatcacttgatgacacatacaatggcagatcaagagacaaggagtttttctgacctcacatagcaggagtcttggaacttggagaggtttgggcaactagtagaccatgaccgagctatgtggtaattgtatgcgcagttgcacagggtagtcgtccaaaggagctgggggcggcgagcggcacggacccgtgaaacggttgcggcggtagggtagaaatccggccacggcttcgcacgattacgaaacaacgatg

SEQ ID NO: 67697 - DNA, 5950 bp, Oryza sativa
  unsure (1)..(5950): unsure at all n locations
aataagctcctttttgaaccagatctctttgattgtaatcatcaccagtcaaagaaacagtacttaggtactatgtttctgtatatgtttcacaactatcatcatttcagtacttttgccagtagaggcagatagtttgttccatcgtgcttcttatctaagttcgacatgaaaagctagatgtgatctgtttggaaatgtatgcaggtctagcccctccctttcccccttcgtttgtttctaaaacagtagcacaatactaattatagcgcttcttgcttggctcttaaggatgcctgtactgtagatactctgatcttagttttgttgctctcctgtaaccaagtctgtcagagttctttacatgttatcattttgccttataccttatatgcaatttattaagggtgttcacctactgtacttttgcaccattgctcttttctgtgattcggttgattgaagaggtgcctcattagaagtgtgccaatggcatatgtcgacacctgggaccactagtaagagctttcacctgtcacaatttaatggtgttctttaatcaatgaaatgaactatcaggaatatatctctctttttgtttcactgtcactggtgatgttgcacttaactcccattaagagctttctgtgatggccactggtattgcttaccattacatgctactgtgctatgtttctttttccggaagtaagatcctcatgagatttatggtagatgggcgatatgagattattttatctttgttatatgatgtttatgacactcattttaccagtcataaagctgttgcatctactgctgtgttagtgctgataagtgatgggtatggagcatgatacgacaggttatatttctctttctacttaccatagtttatttttctgacgtatctacctaacagatattacatgttgttgctgtttgtagttgtactggagggtgggctgtcgtgctttcgacatataaagaagttatcaatagagaatctaaagcattatcccatgctgatcatcttttgcaaagtggcatcacttgtgggagcgcaggcagttgtaaagactgatcctggtagcagttctagaattgtaagttgcatatgacctggaactttctgatctatctttcaacctcttcaattgagttgcctctgcatctgcaagcatgccttgcctgttcaacagtaggattgcagtgagttgtttgtatgagctaacaatgcagagtcaacaccccagggtataggtgtctcttaattgttattatgatcaggtcaatagaaaaaaagggataagagtttcttgttgttcttttttttttgtttgtttatgtaagatggatgtttttttttcttctattaattttttgtggtaaataaggaaacagttttatttttagaatctttcaattgtcaataatattggacccttttaattttctgaccctttttgctgagaagagttccttttccaatcttcttgatcatcctttgtaaattggtcattggtaccatacaaagcaaagtacaaatccggttggaaccaagccatcccagttgcatgggttacttatcttgtaaatgtaggttctttgtccaggcaccatgagcttagtgaatgaagggattcttgtgctcaagcaatctcctcagcatcaattctttcttgttgtccttggcatctgtgttcatcttcaagttgccctgcagccctgcacaatacaattttctttctcatcaatgctcttagatgcgcagttctcgtcttttttctgatgcgccttgccggcatcctaatctcaatattccttgcgcagcacagaagctttcagtagctttcacagaatatatgctgcctgagcgtgcaaataaactatcgtagcgacgactatcttgcgcttagtgatagttactgttcagggatgctttcttgatcaactagtctggtctagtggttatgtgatgctcttgtagttcatgggcactgggggtttggggaagcacctgaaggattcattcctgatatggtatctaatgccaaatttgcactctatatgttttaccttgtttatgactgcgggtgtagtaatgttctctgatgccatgtggtagtagctagatttgtttgaacgtaatctaaggttatataagattacactgaggcaatgaggggggcatctttgatatttcttccttgggagtatcgttggagcatatggaatttctactcctggtcagtgcttttgggcttcctcactttttcatattccaatgatcagattagcattagtcgttgtcatgagaaatattcctcttagaatgtgagcagttgtgccacatttcgcttcctggtttatcgcaggattggaggtgcactctctccatgttaccaaccacctgctgaaaacttcgtttgtgctatttcgccacattgcaaatgtgcaaatcacttggtacgggtggcagaaatttcatcagtcaacagtcgtaattagatcgaaccttgtgtcatatgcttagtccttctgcctcatttgtttcactgtacttgtattaacagcatagcttgtggcctatggacaactttttgcagccgttttcatcaattgaactgaagaatggactcaagccatccaggattccagtcccagatgatgctggtggagcaaagtcaagaggtctcagtaaggaatgctttctttgccttcccattccatctctgatcaagtgaccatttgatatgatccactgagaaaaccaccacattcttgtaaactaaacagtatcacacttatgcaactcaaatcttcttcgcaggatgatttttttgcgctggtgaaccggttgccggagaggggcagccgaatcttttgccgccgacctgactgacggtgcaaatccccggtgcgggatacggtggaaggcgatcggccgaacccggtctgctccacggctcaattcattcattgtcaatgcgcgcatctactgaagaagctgataagctgtctggctgggctaaccgaaagtcgtgtgcaaatgcaatggcatcgtcagctcgtcgcggtcgtggatggcgagttggcgacgcgttggtgcgtggccgtgcgtctgtcttttgcttcgcacgatcatcagttttgcagttgccttcatcgtggctttatttgaccatgagctccggccatctgaatccccaggagcccattgatacgtgcacctaattaagagccacatttgcatgaagcattggagggggcaaatcctgaagctttcgtttttgcagtggtataaagcagctaagggcctgtttggtagagttccaacttctaaatttaacttcaggagttgggtctggagtagagttgtggagctgcctaaacccagctccacttctctagttcattttgtgagagagtttcatccagctccactctcattttaggtggagctgaaactgtttggctgggttctagctccaggagatgtggagctggagctgaggctctatctcttgttttttttcttcttttggaaagctaaattccctattgtaaaaatgtgagttttctaactgccaacaattatagttaactacagtaacatatttcaaaattgaatgttcttctaacatattgacgggtaagccttcttgtgaaaacatatataggccttgtttagttacaaactttttcttcaaacttctaacttttctatcacattaaaactttcctacatatataaacttccaactttttcatcacatcgttccaatttcaattaaactttcaattttggcgtgaactaaacacacccatatatgtttgagctttctgactatcggcagagcccctcagtaccgctgttacaattagttcagttttcacaacttccctattggtttttccggtgcatatctttcttcggagaaaacattccttcccaagtttcaacttctgtatgggttggttttaaatcttaccgtagattatttgaactgagatttctcgctttctactccacgtggatcaaatttcaacacaaaaactcgctcatcgtaatacatactcagtttttgtgctgaaaactgagtaactttgatccacgtggaaaactgaactcagttataactcatcgtagctttgatgtattacgatgagttataaccaaaagtataactttcagctcaaacttatttggactaaaaatgtagactaggtttctttgggccaacagtgactacgctttcaggagtggtaatcctcctgagggcactattgaggtacccctcctctctcagcaaggagttctgggtgaaaaccttgtccagtctttggatggacgacgacggcgtcattcggcgtcgcgaccttcgtgagggcgtcgttttttagagtctccgctccgtggtagtgttgttggctcggtggcgatcggtctcgcatagcgacgaccggttcggtgctcgacttccctctctgtggcgtgtgtttgggcggttggcacttggttcgggacgtgtgctctggtgcacatccttcctcgacagccagttatcgatgtaaaacttttcttgtaacattttctctttatcttaataatattggatgacctccttcggtcattccgaaaaaaaaaaagttcagttcggatcccataactttcaaccaaaagatgaatagagttctctgtacatgaaaacccgaaaactctcaatcatgatgatcaaagacttctctgtaccaaacgagcttaaagaaaggtaggagctcttgccaatcatccaagaatcaaaataatctacattatcttctctaaattaatacccataccaataccaattaatttatatcaaactatgcctgagcacctcgtacattcgtaacgaataataacaggatgaataatgcaaagccagcattgatcccagagacactaaactcggttcttttgatcacaaccacggaccattgccaagtccagagttcaattaaggattgctgcatggtaaaagttgaaccggatttagatgcgatctcctaagatgtcgtatcatttatatataaaccgcctaataaaccaggggctagatgatagattattaataaacttgcggctgttgttacaagtaagcagacaaacagaacatctcatgaagcagaaaaacaaattattccagtccacaaaggttcatctcaacatctcaggaaatttaatcactttcgaagaaaggataagtagtgttagccatggcagattatcacaatttacataatcttagcatgaagtagctccatatatagaagaaattccatcaaaacaacgttgtaaaactaccagagctgtagactttttacccacatgtttaaatttcggcaacacttcaactgcttcaaaaactcagtcttagctgcacttccctactcatgaatttttacaagaatctgtaacgccttgtttgtaataaataatgaagttgatttatggctgatggttggcaattagctaacaccatcacttcctgaatatgccaatcatgacacatgagtggtgtgccattctcagagccaagacgaaatcaatgtcccaacatgcagaaccgactttagctgcagtaagctgaagcaaagcaaatgagcacagatgatatgacaatgcctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 67698 - DNA, 2993 bp, Oryza sativa
gacttaggttactcatgatgtgtatatgttaaaggtagagaacagtagaagagatgactaatgagcacatataagtaactccttaatcaaatggttgactgttttatactaacatattcaaatggcttagataagagacgaccggtaaatatagatatgcaactcctctatccaacggttcataatatcatactgacataatcaaatatgtttcgatttacttgtgatgtgtatctaattgaaggtggagagaaggggtagaaattactaaaaattaatgtggataagtaactgccttatccaatgattgatgattttatactaacatgataaaatggcatagtatgattcatgatgtgtatttggataatggtgtcgaggaggggtaaggatgactaatgaatggggataagtatctccttgatccatcggttgatatatttgtattaacataatgaaatggttcggcataagaggcaacttataattacggataagtaactccttgatctaacaactagttttatgctaacatgatcaattggataaggattactcatgatgtgtagctaaatataggtggagaggaggggctaaggagatcacagatgaatgttgataagtaaatgcttcatccaacgtttgataagtaccccaaggcagcggcagcaacactgcgagtccactactcatcccagtgccatcaatccatccatcattgtctcctcctaacacagatcacactacacaaagaacaacaagtagccacgagctcttctttcttgcagccgttcttggctgcctcggttgctacccctgatgcgccgcgtaatggaaatgaggtctcgtgatctcgtcgccgtcttggctatgtccagcctactccttctcccactactcgtctcctcggtgcccatgtcgggtaagcttcgtcgtcattgatctcctggagttcttgatatgtgtttttactatatgctaattataatttgtgccttgattcattcttgcaggaagcctgcacttgagcagccaacagcaacacctgtcgtctccaaacatctctgcagatgtagttaatctttctcaagtcctccaatctctatattcccctaatatttaaatttgccggcctgttaataaaatatcatagacagttcatagctaccttcacaaaccaattctaaaatgaatatgtacgttctggaggctaaatactgaaacaaatagtaatgttgatagtgattctgaacatggctttgtgtatgtccgtgcaggacatggtggcggcgacgacgacggacgtggaggtgaatgactacccagcgccaggagccaatccccgccataaccctaaacgtccaccaggaagagaaatgtccgtccagggcatggtggcggcggcaacgaataatgtggaggtgaatgactacccggcgccgggagccaacccccgccataaccctaaaagtccaccagggagagaaatgtccgtccagggcatggtggcagcggcgacggacgtggaggtgaatgactacccagcgccaggagccaatccccgccataaccctaaacgtccaccagggagagaaatgtccgtccagggcatggtggcggcgacgaccgatgtggaggtgaatgactacctggcgccaggagccaacccccgccataaccctaaacgtccacctgggagagaatgaaatcaatcaagctgctgctggaactagctagcttgtagtttcgcattatctctgctagttgtcagcaactctcataattaataaagtatctaattacataagttgagtgcactactacaaatcaagatttttcgaggtggccaaaatgcaattttgcacattgccagacgccccgtctgcgattgaaggcttgtgaaaatcgacggttttcaaaggtgggcaccctaagagatccgcttgtgaaaattgatttttcacaggcgacatgcttaattcacccacatgcaaaaataatttctagtgtaaaaaaaaagaaaatccagatttgaatatcctctaataagaaaattcacagttcaattccaccatcacaaatttaaaaaacatttggcatgtcaaatgcaattccaaaaagggctttgtcgtcgtatcccagcgtcggagtcatcctctgcagcgtcttcttcagggagaagccgacacagcacaccatcattggcattggcgaggcagggcgaatgccacctgacggagcgtggggctcctcaccgggagaccgcgcaggtccccctttgccggttcggccgggggcgctaagtgaggttcttcgccctcgatctgaggaacgtcagcgagagaggaagtgcacaagacacgagcgacgtagacaggttcgggccgctgagaagcgtaacacccaactcctgtgttctggtggatctgtgtgtgaaggaatacaaagagccagagagcgagagagagttcaggctctagaaccccttcgctagagtcccaacccctctttctcttttttctctttttttcccctcctaggcctgggcctccttttgatctggtcaggggtcaccacatgggcctctagctgcctaagaaaggaaacatgctttttacaatgagggctagtctacagccggaagtgacctctgacaagcagagcacacgcctcctgccccgcttgccagctttcccggtggacgcccatttcaaccttcattcaatggccagcgacttccttgccatgcttgcactgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgcgatctgactggtctgtgaccggtcacacaccgcgaccggtcacagaccggataagcgtgcgcggcgccgcactaaatgcggcgtggc

SEQ ID NO: 67699 - DNA, 1889 bp, Oryza sativa
ccccccccccccccgacggggtcaggccacgtgggtgaccgcggctacccaagcctctagtcacgatacccccggccccatgtcaccgacagtagcccccggcgttacgccatggtgatcgcccccctcgagggaagcgctcgggcgtgacgccactccttaggcccggtgacaggtggggccggtccctacaggtgggcagaaacccagcggtcgcaaatcgcgcgcatcggcaagggaaaaccgaccgacaataatgagcggcctctttaagaccgctacattactcgagcagcgcgcgaatcggaacgagccggctcgtttcgcctggagacatgatgatggcgcttttcacggttggcgagcgtagttaatgcgcgcacgatctgccccatctcaaccgccacggccgcacatctgccgcgtgcgccgcaaacgggcgagtggggttagtggaggcgtgggcgcgagaaacgagggggcgaggtagtgggcgcgggaagcgaggagccgggcatagcgttggcaagggtgtaaagacgccgaggaagggattcgtttccttcctctcgctactcttccccttgccttcgccacttgcgctctaactcttcgtttcctgtgccctacccttgccgcactcgctcgctctcaagctcctcctccgccggcgtcatggcacggggctccgcaccgctcgacggtagcgtgctgccgccttcccgcatcgtaagcgagaggcaggccgggctgccgcgccgattcatgccggaatctgccaccggccgggaggtggtcgcgctgggcgagggacgcccggcgccacactacccggggcggtccgtcttcttcctctctttcgcaatggcggggctggtcccgccattctctatttttttcatggatattctggagttttatgatctgcagatggcgcacctcacccccaacgcgataatgacgttggccatcttcgcgcacctgtgcgagatgtttatcggggtgcgcccatctctccgactgttccggtggttcttcaccgtacagccggtgtcgccgccgacggtagtcggtggctgctacttccagccgcgggggcaggtgctgaaccgctacattccctgcgtcctccgcaaaaagtgggacgactggaagagcgattggttctacacccccctcgccgacgaagcgcgcctccgacttccgagccagcccccggcgcaggcctccagctggcgggcggcggtagatctgggagacggctacgacgccgttcttgaccgcctggtgggtctgcgatcccaggggctcacgggggccatggtgttcggcgactaccttcgtcgccggatcgcgccgctccagcggcgcgcccggggcgcctgggagtacaccgggcccgaggactacatgaggacccaccaggggcgcaaatgggactgggaccctgaggacttcaggatggtgatccaacgggtgctgaatctcagctccgtggaggcatccctcatcccccaaggggtcctccccctctgctgcgatccagagcgcgccaagatcctggccataatgcaggtggtcggggcgtcgggggagcgggccccccgaggccacgatggcgcgggcgggagccgcaggggggaacaatctaccccgggagggggtcgtgcttctgggccccttgacgggggcccggggggcagccgccctgccgacgcccgggggaagaggaagcagagggtacccctcccccatctcctccccgagggggcggggcggtgcgtgccagcagcaggcgcccggagggtgccctgccgacgccccagcccgagggggagcgaaagaagaaacggctccgcaagatgggggggaccgagccatgcgggggg

SEQ ID NO: 67700 - DNA, 14296 bp, Oryza sativa
gctggacgcgagagcgcacagcggcggggcggccgcgggccacggcgacctagccgcatgcctcgcagccgctgaacacaccatcgccgagctgcagggcgcgctggactcgtccgccggggaggtcgaggccctccgcatggcgagcgaggtagggcccggcatgcttcgggacgccgtctcccatctagaccgcgccgggcggcaggcggacctctgggcgggcggtacgcgaagtacgccgccaaccaggggggcctcgcccagcgcctctcagagatggccggggccctcgagcggctccccgaggagctcgaggagacgatcaagtcatcctcgagggacctcgcccggggggcggtggagctcgtactggcaagctaccaggccagggaccctgacttctccccatgggcagcgctggaagagttccctcctggaaccgaggacggcgcgcgcgcgcaggtccgggacgccgctgaccacatcgtccacagcttcgagggtacggcccctcggctcgcattcgcgctcgactccgacgaggagggcggtgacgacggtgcggacgacagcgacgacgaggccggcgacccgggcgcgtcggagtgagcccccaggcccccgccaatcttaataacttttccttcttcttccgaggccttcgggcccccttcttgtatagactgatttaatctgcaatcaagtaaagaggaaatttctgcgtcagttctgtttgttgtgtgtatgagacgaggatggtttgtgccgcggtccttctgtgtcttggcttgaacaagggctcgtgcccaggtcccagcctcaaacggcgcgggtcggggctagtgcctggggagatcctcgtgtcgagactggccaggccgggagcgcggtgaccgagggttatggatgacccgattgtgggcctttgccgattcccccccggagttcaccacgccccggggcacggctcggttctgggccccggttggcgattttagccggctcgggccaccgagggcagggtcgagcacgagcgtgctaattcaagccaagattcttcaaaaggaaacgatggcacaaacacagtcctcaggaaatcaaaaatgcttttattgaaatacggaagagaaaaaaggtaagtatatgcatgtggtagcccccggccaaccctgcacgcccgggggggtgcggggttggcccgagcctgagacatgacacccgacccccactaggggtagaagcgacgaaggtgctcgatgttccacgggttaggcagctctgtgccgtcgcccgtggccagccgaacggagcccggccgggggacgccgatcactcgatacggaccctcccacattggtgagagcttgctagtccagcacgcgtttggacgcggcgtaggacgaggtcgtcaacgcagagtgatcgggtccggacgtggcgctgatggtagcgccgcaggctctgctggtagcgcgcggctcggagggccgcgcgccgccttcgctcttccagatagtcgaggtcgtctcgacgaagctaatcttgatcagcctcgcaatacatggtgacccgaggggacctcagggtgagctcagatgggaggaccgcctccgcgccgtagacgaggaagaaaggcgtttccccggttgctcggcttggcgtggttcggttcgcccagagcaccgctggcagttcctcgatccacgagtcgccgtgcttcttgaggatgttgaaggtcttggttttgaggcccttgaggatttccgcgttggcgcgctccacttggccattgcttctggggtgggcgggggaggcgaagcagagcttgatgcccatgtgttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcaacatacagatactcgaacccgcccggggcccgcctgaacggacccaggatatcgagcccccagacagcaaacggccacgaaagaggtatggtctgcagggcctgggccggctgatgggtttgcctggcgtggaactggcacgccctgcaccgccggaccaggtcgaccgcatcgctgagagccgtcggccaatagaaaccctggcgaaaggccttgccaaccaaggtgcgtgaggcggagtgggctccgcactcgccttcatggacatcggcaagaagctcgacgccttgttcccgaggaatgcacttcaggaggactccgttagccgcgcgccgatagagggtcccttccaccagcacgtagcgcttggagatgcgccggacgcgttcactcctttcgcggtcctcgggtagagtctcatctgcgaggtacgcctggatctcagtgatccaagcaatcaatctaggggagctgggagcgctcccctcgggtcccgaggcttggactccgacgggccgtgggggccgttcaggcgcgtccgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcatgtgccaaagctctatcccgtcgaaatggcgctccatacgccgtacctggcgcacgtaagcgtccatctgcgggtcagagcactggtactccttacagacctggttaacgaccaactgggagtcgcctaacaccaggaggcggcggatccccagtccagctgccactctgagtcccgcaaggagtccctcgtactccgccatattgttggtcgcccgaaagtcgaggcggaccaggtatctgaggacgtctccgctcggcgaggtcaacgtgacccccgcacaggcgccctgaagagacagggaaccgtcgaactgcatcacccagtaggcggtgtgaggcagctgcgaggggcccgagctggcctcgggggcggagacgggctcgggagctggggtccactccgccacaaagtcggcgagggcctggctcttgatcgcgtggcgtggttcaaagcgcaaatcgaattcagagagttcgattgcccatctcaccacccgtccagtaccctctcggttatgcaagatttggccgagggggtaagacgtaaccaccgtgacccgatgcgcctggaaataatggcgcaacttcctcgaagccatcagaatagcgtaaagcatcttctgggcctgagggtatcgggtcttggcgtcccggagggcctcactaacgaagtagatgggccgctgcacctttcggcggggccgatcctcttcgccaggggccgcatctccagggcgctcttcgtctgagaggccacgcggggcgcactcggcttctgtgccgacgacctcggggtcagagggcgacaggcgcggccttcccgcagtggccctggggccatcctgggggtcgggggtgcctggcaccgtcggacaagcaggtggagggccagctccggccgtcgggggccttgggccgccgtttggctcgggggcctctcctccctgctctctcccgggtcgagccgatacagggtggggatgcgcggagtgagggttgtcctcgtcgcgctccacgaccaatgccgcgctgaccacctgcggggttgccgccaggtagagtagcaacggctcatctggcttcggggcgaccaggaccgggggagaactgatgtacgccttcaactgagtgaaggcccgctcagcctcctccgtccaggtaaacggcccggagcgtttgaggagcttaaataagggtagtgccttctctcccagcctcgatatgaaccgacttagggcggccatgcagccggtgatgcactgcacatccctaagcttgctggtggggcgcatccgctctatagctcgtatcttctcggggttggcctcgatgcctcgggcagagaccaagaacccgagaagcttgcccgcaggcacgccgaacacgcacttatcggggttcagctttatgcgggcggagcggagactttcgaaagtttccgctagatccgagagtaaggtatcttggttgcgcgacttcacaaccaagtcatcaacataggcctcaacattgcgtcctatctggctactcaaagaaattcgagtagtacgttgaaaagtaggacctgcattctttaacccgaaaggcattgtcgtataacaataagttcctatgggggtaatgaatgcagttttttcctcatcctccctagccatgcgactctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctctcacggatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccatcgcccagggcaacctccttgaccgggacctcgtcgcacgtgaccatccgctgccttggggcggccgggacggaggtgctgagcctctcgtcgccacccgcgggcttggacgccgcggcgaggtggtctgcgcgctgctccatacaagcaagcgcgactttgaggtcgccatggacggtgatggggccaccggggcccgacatcttcatctggagataggcgtagtggaccgccgccatgaacttcaccaacgcgggcctcccaggaccgcgttgtagggcagactgaggtccgccacatcgaagtccacccgctccgtgcggaagttggcggaaccaccgaaggtgaccgggaggtcgatatgacccagcggccaggtgtgccccggcgtcacaccgatgatcggctgggacggccggagcaccatccccggggccttgatggcgtcaaaggctgcgggggaaaggatgttgagggctgcacccccgtctatgaggacacgccccaacttcacattgcaaacggtgggggaaaccaccatcgcgatctgtcctccccgggcaacgcacggcgggtggtcggtctagtcaaaggtgagggcaacctccgaccaccgcacccgccgtgtcgcctcatgggtaggggccgcagccagaagctctcgcttcatggccttgaggctccggcgagaagcgtgagcgcacgctcccccatcgacggtggcgacggtggcctcaggctcctggaaccccaggtcatcgtcgccatcgtcgatgtcctcggcggtggccttctgcttggcctcacctcgccggttgccggcgggagccgccggggtcttgccctcacggcgctcctgtctcttctcctcctcccacttcctcgtccgctcagccaaacttttgaccgcgcggcagtccgcgaggtcgtggagggaggtgttgtgcacggtacaccacttgccggtcgggcgctccctgctgggagcgccggcctccttctttttgtcgctcgcaggcctcccctttcggggggcccgcgaagcgccctcgacggcgaggacatgaccctcgtcgtcggaacgggccgaccccttcttcctcctcctgtcccgccgccctgaccgagcggcggacccgggggcggccggagctgccacaccagaaccggaggagttccaggcccaggcctcctccttgcgagccacacggtccgcgagctcaaaaagctacgcggtggtctggggctccttggaggcgatcttctcgagcatgcggttgtgccgcacgccccccctgaacgcgtagatcaccgcgtgtgcggggatgcacggtatggtgttgcggacttgacagaaccgctgaatgtacgagcgaagagactcatcgtcccttcgctgtaccgcatgcaagtccgcttcttcgcctgggcgcggatatatgccctggaagttcgtggtgaactactggcacaaatcctcccaagagtggaccgacgcgggtggcaagttcattagccaaccccgcgcctgacccttcagggccatggggaagaaattcgccatgaccctgtcgtcacccccggcggcctcgatcccggtcgtgtagatctggagaaactcggcggggttgacgcttccatcgtatttttcggtgatggtgggccggaaccttgggggccaacggacgttccgaaggctcgacagccggcaccgccaaccggggacacggggggccggcccccgtgtccggaccgaagtggcgctccggacgaggaagcgccctccgttgcgtgggcggcgcgacgaacgtcgcgccggcgctcgatatcgaggcgggcatccggccccccacgcacatcttcttgggtcggaggcgttgacgagggaatggcggacgaacggcgggttacggccgccgctcgccgcgccctccgcctcgacgacatggagccggcggcggcagcgccagaggcctcggtggcggaggaccgcccgccggcgcctaggcgctgctgcgccgtcatgaccaagtcggccacgtcatccagccaacgtcgggctggagtctctggatcggggacgacgggcgggtgacgcaggagcgcacccgcagcctggagcgcgccctggggcgtgccgccatcgccgtagacgaggcagcgacgcgccccgtctcgccgtcctcccccgtcgcccgcgggcggcgaagtcacggatcctccgacctccccgagcgcctccccccgcccaagatttcggcgagagggggacggtggggtgcgagcccgacggcgcgggttctgctccccgtcgtcaccgctagcgttcggagagaggctgtgcgccactgcccgtccggccattgggctgagcgggagaagcttggcgcacacgaaagaggacgagggcttagaaagacacgcgcaccccctacctggcgcgccagatgacggagcgtggggctcctcaccgggagaccgcgcaggcccccctttgccggttcggccgggggcgctaagtgaggttcttcgccctcgatctgaggaacgtcagcgagagaggaagtgcacaagacacgggcgacgtagacaggttcgggccgctgagaagcgtaacaccctactcctgtgttctggtggatctgtgtgtgaaggaatacagagagccggagagcgagagagagttcaggctctagaaccccttcgccagagtcccaacccctctttctcttttttctctttttttcccctcctaggcctgggcctccttttgatctggtcaggggtcaccacatgggcctctagctgtctaagaaaggaaacatgctttttacaatgagggctagtctacagccggaagtgacctctgacaagcagagcacacgcctcctgccccgcttgccagctttcccggtggacgcccatttcaaccttcattcaatggccagcgacttccttgccatgcttgcgctgaagcctggaatggatctgaccgggactgacataccaactccaggagttagcacgccggctccggctagggacgagagccagaaagctctcatcattccgacgggacggggcgaggcgtgtgacaggccgcctgttgccacctaacccgcgatctgactggtctgtgaccggtcacacaccgcgaccggtcacagaccggataagcgtgcgcggcgccgcattaaatgcggcgtggcgcgctcgtccatcctgctataaatgcggttaggtgagccccgctgtgctcacctaacccacacacgtggcaccaaaaccacagggggtcggggcgccccagccctcggggccgaaacgggggcgccccagccctcggggccgaaacaggagcggcccgacccctcggggagacagagggaggggtggccacgtcaccctcgggcccgaccccccccccccccccccccgagggggtcaggccacgtgggtgaccgcggctacccaagcctctagtcacgatacccccggccccatgtcaccgacaccacccataaagaggtctaaattattttggtcagaactatattggtcacgagaaggtggtattatataggtcatgaggaggtgttaccatatagttattattaaaggtagagaggagaggatgagatgactaagaaatacagataagtaactccttgattattttatactaacatgatcaaatgacaggttactcatgatgtgtattagttaaaggtagataagaggggtagagatgactaatgagtacgaataaataactccttaatcaaatggttgactgttttatactaccataatcgaatggcttaggataagagacgactagtaaatatgtatatgcaactcctctatccaacggttaatcaaatatgtatctaattaaaggtggagagaaggggtagaaattactaaaatgtaatgtggataagtaactcccttatccaatggttgatgattttatactagcatgatcaaatggcttagtatgattcatgatgtgtatttggataaaggcgtcaaggagggatggggatgactaatgaatggggataagtatctccttgatccaacggttgatatatttgtactaacattatcaaatggctcaagataagagatgacttataattgcggagaagtaactccttgacccaacaactaattttatactaacattatcgaaggagcgattctctggcagcggggaagtgtagacccctccccaaaaataaagatccgaccaggagctagttgcgcacgatgctccagaaaacaagtttgtggggcccgagcaccccaccaagcatatgaacacaagatatttatacaggttcaggccactcagaggtgtaatacgctactcatgttctttttgttggtatctatatctggagaaatacaaactttgcctttttcaaaccagacacaagttagcccttttttctagcatgtcccttttctattatagtacaaggaggggctcacggtgctaccattctacatcctttttgcattgtcattcaaccgtcttgtcaatgccgtttggtttccttcaaatgtccccgagaaacctacctaaaaaataagattatagtgccccaggctccaagaataagatgaagtataaaaccatttctctgcttccaaatgtgccaagcaccatataaaaatttctccacaaaatgagatgaagtatatgaagcttttgctgcttgaagcatatctcccaaattgaaattctagtgccagactataaccacctgaagccaacattctttgctgaatgcacattcaaagaagagataaaagaaagtttgtattcctgtcacatagggcacaaattaattcacttcttcctagggcacattcaaagtccctggcctatccccttccacctagggatgaaaatggagcggatagtttccgtccattccaaagaaaaatagggatggcaacggggcggggcagagccgggttgggttgtaacggccccgctcccgctccattgcgggtccacccggcctaggccctgaagtggaggatgggtcgaaattaatccccaccgccggcccccccgaggccccgccactcgaccgggggcccgctgcacctgcaggagaggattcttggaggaggcggctggtggatgcgccgtcgtgtgacaggaggaggaggcgccgccaagcggaggcggcggcagcggtggcgcggcgacgaacaatgacagcgtggcaacgagcagaggcggaggcaagaggcagcgcgacgatgagcagaggcggagtggaaacaacggcgatgagcggaggtggaggtgacgcggtgacagccagccagcggcagctgtggaggatgggtgaggggagtgggagtaggggatgggggattgggagattaggatttaccttttatatgtctcacttactaggccaactgggcttgtattgttggaatggactacattttgagacatatctcatatcccgaggccccatcaggtcacacgcaaccgcgcaggtggtttacaatccctgccccagccccggaaatttgcggggccccgtccccgctcaaccccgggtgaaaatcatccctccccccaacccaccgtggccctatagggtccctggccccaatggggaaattgccacccccagagaaaaatgaatacagataccttccggagcggatagtttggatacatatattttcttccggataagaatacggatattgttaaggttatagataaggcatatcctatgatcttgggttaagctcggcaggacctaccatataccaagggcctgtttgggggagcttaagattctgagaagcagctgctgataagctagctggtgagaatctggagaagctaggaaacccagcttctggcttctagttcattttccaaattttataactacagattttcataatctgggtaaaaactggactgtttgggggagcttctggcaactagagattctaggagaagctgcagctgctagaagctcccccaaacaggccccaagtcttatacgaaatcatgcctcgcatacggaaggtgttccagataaggaagaagaagcagggtttaatattggaaactataaggagtactcagattgtatacattcttgtttccctagttctacatggacaagggaacatttgggtataaatacaagatccctgggaggagaaagtggaggcccaatcatcaatacacgccgccagacacaaacacagagataagcctagatatacccaatctggagccgcagaggctgacaagagggatctagtgttatctctgatctcgccaagttcatgttcgaggaagaagactacctgtcatcgaccatgtgtggagatccacgccatcaagttgacgatggctagataggttagcccaaatattatacttactagaaaaaatgcatgtgtgtcccaaatattcgcatggattttttttaaagaaaatcatgagctgcaattaggagttcaactttcgtctcaagttagcatccaagtttctttataaaaagtttcttatacaatttcttttgtattttcaaaagcgaatgaacttaaaaaccgactcaaacaataataatgcactaaagtactggcaaaagcatctttgatttttataatagtagagaagagatgccacgctattgtctcccatcagtaattttcagtttttatttcttttcacgataacaggaggtgaacagatatatttgctcgttgggatctattaattatacttgactgggctgaaaaagaaacgatgcagcgatgcacaggcaggccatctccatcagtatttccttccaatctaaccaggcgcacacctctcccatcgccacggagtacaagccaagtccatctcgcttgatcgtggcaacagtaaaaccgaatcggagggggcaaatgtgctgcagacgaagcaaaagtgaaacgcatgcgagcgcaggaaaaaaaaagcaacggaagcgtttggattcatgtcggcaatctttgaatcggtgatacccgacgtatcaaagctatagaacatcttttataatactctctccattttttaatatataacgtcgttgactttttcttatatatttgaccattcgttttatttaaaaattttatgcaaatgtataaaatataaatcacacttaaaatactatgagtgataaaacaactcataacaaaataaattataattacgtaattttttaataagataaatggtcaaacatgtgagaaaaagtcaacggcgtcatctattaaaaaacggaggtagtagtagagaagagatatagatagagatagagatagagatagagaagtagaggtagagaagacatagagacaataaatataataaaaaatgaagattagaaaaccaacttaaaaactaatttaaacacggatgaaatactaaaatcccggtgaaaatatcagtagagaagagatagagatatactactatataattcacgttgcaaatctgaaaaacgaaggacgtccatggctgctggacagctcgatcgatcggcacgtaccaagaaaatgtaagactcaaactccaaactgtcgtacatatatacgtgtatgtgacctcatcggcataaacaaattcgacgtccacgacacctcaccgtattcgtatttgatacaaatagttaattaattttcagcgatataaacggaccaaatggttaagcgactaaaaactcactcaaatacggataatgaacaaaaatctcgacaaaaacatctttaaattttataatagtaaagatgtgatacagatatataagagcatcattggcttcagccaacaggagtagagctattacctatcagttaagagatccgaacttgtataaaaattcttttatccatctctttatctcaatatcgtgtatatattggtcccaacgatcatcatactatgtaaatattgtagtcacgacctattccgccgatagatatggtatcggggtttccgacagataaggatattcgatgaccagtgctattcggatatctgctgaagtcgtgagacatacaccatttctttataactctacgaccttcaatctacctttttagattttaatagtagctcatctcttaacactaatacacactattaatattatttaaacttttaaatattttttataaattatactatattttatataaaacaagctaattatatatgatgatatttgtttttattagaagttaaggtggttttcatgttccaagaaaaaaaaaatatttccgtattcgtgtccgatcatattcaatcgttatttgtattcaagataattcatatttattttcgtatccgagctattcgtattcgttttcatatctagcaaaaaaaaatgaaaacaaatatgatatgagcattatccgtctatattcgctccattttcatccctacttccaccaccgccactgcctcttctctcccagcaagtaggacaagcgttcgcaaacggacctggccatgcgaaggtcatcctcatctgaaccttcgctattccattgccatcgccgccacctccattgatctcttcaccggtgaagaagatggccatcacctcccttgtggcagtgcatctaactaacaagcaccttggcgacgcatgtggtcaacaagctcctcggcagttgcacatgtcggggttgcacagagcaaaatagggcggcaggctccctaacggcagatcggattggggtagtggagcatctagtggcatcatccgtagtaggtgggcccttcttctccctagtcattagccatcctccttgtcctctcttccctcacccccagtggttaccattgtcttctttctagcctccaccgcctcctcccagctctaaatcaaggccccacctctcgtagcttagagccatgggctcatccaacacgatcggcgagacgtagcttcaaacacatgattgccctcgtcaaacaagacacatgtgctctctgcaagtcagaagtagctctaaagggacacaacttgactcgagctaaacttgcagctccaacgtggccggttaaagccactcgccacatagacgtgttgcgaaggctctatagccccaccagagtccacgagtcatgaccacacattgcatccgtcaccaccttcttctaattaaagccattcggctaggatggagtacacctttttttttcctcctcataagtcataactagatggagtactactgatgtgaagttgaccttttaagagagagaagaagaacaaaatggaaagagccattgcctgcctagctagcatggtccaactataaaaccccaaggcggcagcagcagccagcaataaacaccatcagtacaccatccatccatccatccatcgtctcatcctaccacagatcacacacaccccaagaacaccta

SEQ ID NO: 67701 - DNA, 1784 bp, Oryza sativa
  unsure (1)..(1784): unsure at all n locations
acttgagcagccagcagcagcaacacccgccgtctctgaacctctctccagatgtaattaatctttctcatcccctgcaatctctgaattttttccccctccaatttaagtttgtcgactttgttgctgcaaaatcacaaacactattcagaatacgggcagcacagtgctcaaaccagttctgaaacgaagccaaattctgaatcaaactaatagtgttagtgacagcaactctgaccatggcttgtgaccgttcttgcaggagatggcggcggcggcggcggcgagagggctcggcaggaggccggcggcgaggatggacgtggaggtgaacgactaccccgggtcaggacccaacaaccgccatgaccctcccaaaggtcctgggagagcatgaattcagtcaagctgaagctgctgctgctgctgctgctggaacagcttgtagtagtttcatatccctgctagctattagcaaattcacataattaatccagcgtctaattacataagtcgagaggctgtatgtgtgatttggggtgtaattagtagagagcagatagctagcaagttacaactgcagatcgaattgagaaaatattcagggatgaagactgtaaagcttttgctagcttgggcctcctctttgcagcagtagtatagtaagtaaactagtaaattaattaatcagtgattttgtcgacatgcatatgcacatgagcacatcacgttgggatgtcaatataatacaggattaattaatcggttaatcagatattggaagcttcttcctcctctcactgtcgagaccgtcgtgtcgaacgattcaattcaaaatcaagtgatgagtgagtgtttaaaggaaaatatataatctcgtcgcgatcccaagctgatcactgctactgcgactacggccactccaatcagttagcacactgattaacgctgcgtcgatcattggtgtactataatcattgctccctctgactaacctcacgctgcatatgcgtctgccgttttctcgaactagtaatattgttgtttaatttctggaaataacctgttgagatattcccctcggatgccacaacacaggggcatgttttaagaggtactccctcaatcccataatatgagtaactttagagggatataacatatcctaatacaacggatttggatagagagcctatccagattcataacactagaatgtgttatgtctttccaaaatcctatgtgcttccattgtttgctctacaattaagtgaaaaaaaattaatgaagcaaaaaataaaaatttataatagacgaaaaaaatgttttctagtgttttagacaccttttgaaaccgaaaaatcaatgggtaagatagatgtgataatagagatagcaacaaggaagagggaacggagttagaagaccgagggatcatattcttttactcaatctcaaagcaattctagaggttcctttcgaatgtactccctccgtctcaaacaaagtcaaaccctgngtttccgtgttcaactttgactatccgtcttatatgaaatttttttataattcgtattttcattattggtagatgataaaacatgattaatattttatgcgtgacttgtctttttatttttttcataattttttcaaataagacggatggtcaaacattggacacgggaagcagggtttgtctttttttgggacggagggagtagtaaatttacaagagtgattcagacatatttcgaattactacctccgttttttaatagatg

SEQ ID NO: 67702 - DNA, 13226 bp, Oryza sativa
taaattataattacataatttttttttgaataagacgaatggtcaaacgtgtgagaaaaagtcaacggcgtcatctattaaaaaacggagggagtacatattttgaatatgtaattcggtttagcttttcagtgacatgtaaaataaaataatccaataacatataattaatcaagtattaattgttatacggtttagaaaaaaccttttaaaaaaacacatcattttacggtttagaaaaactaacgaaaaacaagaaagttatcgtctaaagttttagttttagaagcgaacgcagctgaattcaagtaagattgctttagcatttttctattctgaaacaggtcttgccgttaagaggtggctgagatttagcatttcgttgctatatagaatccatttgctgcatttggatgaggaagaatccgcacaacatttgctagcagcgggcaattgcaggagaggctcttaccggcacgcattacgcagtttcgatggagccctttgactttgtttgtacccctatatgcgccgaggaataaatgatcgctagtacgctgacaacaacaatggctgcaacgaaagtgacgtggccagtgcttcatctgacgcgtcccggtagaagaggaagccaggaaggaacacttccggccggttgcagtctcatgcatcatctcagtatgacaccgcgggtggcaactggtgccaggcaaccatggaaaattatgtacgataaatcacttatacagtgaatacctaaaattattattagattaaaaaaataatgaacttttgagatttgttcacgttatccgaagtaataattttactcatggatgtgatgtccacatatgcagtttccgcaaccacgacggtttcatggcactctgttcctcccccaactatgccacaacagctagggcaccgaggcggctcgggagttggtgttgcctagatccggcctctcctcgaccggtactgatgaggagactgatggacatcaggaggccggcgtagtagaggacgtggtggcggtgtgcgatggagtggcacacggtagagttcagacacggaggaggcaatgagggagagccggagagggccagagccactagatctgatgcctcttgggcagttccaatgccctcccgctgtctggatctaaagcctcccgggctgttgcgaacgtggaccgacgatggagatgatgtgcattgggaccagaaacgaggcaacggggtgccgccgagcaagggtcgttgtatccgcagcaggggaagggtggatgcggtgagcaagggcctgcgacggcgtggtgacacggcatgagaggagaggggccttgcggtggctcggagacatggtggatgtgaccctgtggtggcatagcaatattaatgtaggagacagtggtgctcgttgcttcgtgtctacagaaagggtggcgtagacttttggggtgagggggccgcgggaggaggggtgctgcaaaggagccgacgaagggtcatcgatgcagtggagctccttgtccgatgagaaatagcaggtggagtagcatcggtgtggcagagaagggcatatggcagaattcggtttgtggtgcaacgtcgaggttacaacaacaatgagaggtatgttataggcgccttgatgacatttcatgttcgggctgataacggtggtgctctaggcaatgcgatccctcttgagggcgtacgttgttgtgatgcctccttctctctctggcggtatgagtccaagtttgacaagcagcgggacctccttggagacgtcatctaggagatcctgcttttcttgcctgttccatcttcgatcaattcaattttcggcgacatcttggatgttaccatcggatctattcgagagagaagcagaacttctcatctctcgtcccctccctcgacaattctttctacatggtgatggccgagagcccatatgtatcttttattgggctagcggtatccagcctcgcatagcatcgacttgattggtgtccattcctttccctgtgagagtgtataggagttgttagcacacaatggtgctttttttcccctccttgattattgcctcccgcggtggattgatactgttcgttcaacaaaaatttccaaaattcgaaaccaacgtcgattcaacaatccgtgacaatggaaactaatggctaattaagaacagttaccccactattggaacccctatcattaagtgggtacagtacaatgttttgtcacgatagttacgcacgcacagtacgcgtgtcacgggccaccgctcgccggcgcgagcgcatgcagcagcaagcgtgcgcgcgtacaaaaccgccgctgtctggcttgtcgatgggcggcgatcgatcgcccgactttgacacaaagactagattcccctgcgacttccacatcgaaacgacgaaaccacacaccgctacgcactggagaagactaatatccatgtcaatttctgcacgatttcctcgttttgctcttattaattaatcctccgatttcttcatatcatatggttccgtccatagtggtgggcagaactgtggatgtatgtaaggctatcttgttatccaattccatggatatagttagttaattaatcacacgcacgtgcggcagaagccatggacggccgtgtgtgagtacgattcgcctctacccccatgcaaattaatatggattattaccttattttattaatattatgcgtgcttagccagtaaaaaaaagtgttggatgattcgatgcctggagagcaccggattccggaggagccgtgcactccgcgagcggcggcagcagcaacgccggcgcgcgcggagcgcgagtatcatcgtggctgcttcctcccatcgctttccagctcgacgtacgtacgtacgccgcgttggcgacgtggtgtataaaaaaggcatctgctctacgttagatcggatatttgatatttggacactaattaaaagtattaaatatagactaatgataaaatacaatctataatcttagactaatttacgagacaaatctattgagcctaattaatccataattaacctatgtgatgctacagtacacatgtactaattatgaattaattaggcttagaaaatttgtcttgtgaattagcttttatttatgcaattagctttattattagtttacgtttaatacttctaattagtgtcaaacatccgatgtgatatagaataaaatttagtcccagatccgaacatcaccttagctgcggggcctcggcctcctctcgctctcgttgtgttacacatcgtttctgccgttctggctaggggtcgatggggtctccgcgcgcgacgatggtgacggcgccgacgacgagtcgacgtcgatttttctgttgcccgctgcggctgcgagtgctctgtgggcggcagcggccagcgccggggggattcagatcaggtgaagttgtatattgactgcaactttagcagtcgcgtgatccaccacgtacaaaattaatgtaacggccaaacgttaaggcaaccctgcacatcgtcatctacctcagcccaacaccaacacaccaaagccaagaggccagagcatgtcgacacgacggcgctgtgctaccggaccttgcggccggcgcgcgcctgagcatgctgctagctagccgctccttgcccggcgccttaccgccgctctcgctcctcaacatgccaaccccaagcacccgcttgcccgcttccgtcatcaactatatattcatctccccatcaagcagaccttgaacatatgctgatatgcgtgcgtgaagtagaagctcaccattccttaaaaataaaattgaagcagaacacagcctcaattaattagcagcttattaaattcgccttcatcttcgtcatgcatctccatcgatcgatcgatctccaacctcacagatgcattactatctcgattgagagcggacggatccgtagtaagaacccagtgctgcccggattaaggaacatatatattacattcctctttcatttcaccatgcacgggatcctcaagagctgggcaactcattttttagttcaccagcctttccccgaccgccgttcgctggcgcgctactgccggccagatcagcccctttgtgctcaagtggagccatgacgaacctcttttcagtgaacaccgtttgattcaatttggacgctatggatgacgcgactgccaaagttacagtcgatatagagactgcacctgatcccaatccgcggcggggttggatggggatgatgtcgcggtttggtcgctaaagattgctgtcgctgctgttcgccttgtaggcccaggcctgtaaaccagtgttcggcccagtgccagtggcacttcttcttcttgcgaatgggttgggcggccatatgccatgggccaccacacggaccagagagtggagtgccggtacaaatttggtggaataagtccactttgacttcctgataagtgacccgaatctaatccataaccctaaccctaaaaccggatatcttgacccccgaactatttaaatcggtacaatttgattcccttggtgatttttagagaggttttgctgacgtggcgctgacgtagcggtgttgaccagtctatggggttgacatggcgcttaggtggcatttgaattaaagccatatatgcgggacccgttagtcattcacacacataaaaaattgtgggtcccactgacttgtgggccccacatgtcatcctctctctttctttttcctcccctcttcctcccttctctctttctttctcactgtccccttcagccggcggcgggcataggccggagtggtggtggcgggcggcggcgggagctgacgtaggagctagctggagcggcggtccccggagtggaggagtcgacaatggcgaggcagcgctcggtgagatggggtcggcgtcgtggaggaagtcgaccgacgagggttgtctttggccaacgacggccggcgcatggggtcggcgtcgtggaggaagtcgaccgacgagggttgtctttggccaacgacggccggcgcgcgccggcggaccgcagcttcggcctccacctcagtggcggccacctcacggcgccgaggatggcagccaccggggagagatggagctcgccggcgctcctctgctaccactcaaatctgactgaggcatgtgttagattcttaggattgctatgtgagatctaggggttcaactctagcttataggaataatgggtgattgccttggagagtgaacggtagagaaagagagagagagaacccatacctttgccggtcttagagcttgacacagccatggcgatggtgcggtgatgtgagggcgtcggtgaggacgacggtgtcggtgtcagtgatggtggtggcgacacccggcggcgggcttcccctcacttcagcgcttcccagatcggagggacttctagggtttgtggggagtccgtgtgtgcggcgaccaaccttggttcgcgcgcccgccagctccctctctttatatattagcgctgcgtgagaggggcccactgccaatagatcggctggcgcccccgatcagggagcgtaggcggagtggggaatcgttttcccgattccccccaggatcgcaactaatattctcccattcgatctccgcctttcttacttctcttactcaacatttacttctcaatggattgacgcatagagtacgcttcatcatgacagtcaccattgaaccatcagacgcaacgactacaatgcacctctccatctcgaaataaacactaggccctttcttttgtaatccaaggataataggctttcctgtaaaaacccatgcctgccaagtgttctctgaacacactgggcggtaagccttttgcatgcagatctgctaacatttcctttgttcttatatgctcgagactaattgtctgatcctggattttcactttcacaacataaaacttactgtcaatgtgtttggcagcaccacttgacttattgttgtgagtacatcttgaatggcctttgaatgctgtcgaccactttcaactcgggaacaaacttctttaaccattttttgcctgccccgtggcctcataactagctacaaactcggcatacatcgtcgatgatgctacgacggtttgcttggagcttttccacgaaatagccccttttgcgagagtgaatatgtagcatgatgtgaactttttatcatctacatctcctgcaaaatctgcatctgaatacccttctatctctagggaatcagatcttctgtacgttagcatgaggccttttgtgccttgcacaagctttctttaccattcttcagtgacctaatcctgaatttcctttatatctgctaagtatcccggtaacaaatgctaagtcagggcacatacatacttgagcatactgtaagcttccgacagctgaagcatatggaaccgctttcttttgatcgaactcatactggttcctgggacattgaaatttcccaaaactatcgcccttgactatgggagcagatgtaggcttacttgcatgcatagacatgccttttgcgataatcctaaccccttttcttctatctcggtgaatctctattcctagaacaaatgagactttactaagatctttcatatcgaaattcgaggacaaaactttttcgtctccaatcaacatcactactagtgagtaggatgtcattaggacttgctgaatatacacttgctggtcaatggagggtctcgtatgacgttggggttaagttctcatacacacacgtgacttttgccaaccaaagggtttgtatgtttatttctttgttgtggatggcctaagagttaacttttgtcaagcatataagagagcttcacaagttggcaatttgatatctgacacctcaacctaagcatccaactgtgatatttataagggctaaaaacaaagaagcaagagacaaagcggtatggactatgatcaaactaaatacctgtgccactgcaaaagttcaggcaactacactggattcaggcagctgttttctctcaataggataaaatgcacagagcttattgcttatttgttaaaggggaaaagcaggataattcatatagaaataagttcttctagctcgggaaataggatatggtcatacacaattgttacctactacaaatagcagtaatttcctcgtcccttgtataaggaaaacaaattgagacgataaacgtcacaggggctacttgtgttctttgaaactcctggtgatgagactaattttagtacatagtagcatccagcagttttacagcagaaatagcaaaatgaaatataggaagttgagttataacttgagcatttctttcagctcaaactagaaaacttggcgcagctttgccgcgccctcacagtgattggcctagtgttcttgcagagtggccttaaatcaggaaattatgtgcatacacagttacatggtaatgcatttcgtttccgaaaatactccaatatctgatgttcattaaaatgtttgaaaatattaaattacacagctcacatgtgtatgatgcttccattttaaaaaaaaaaaagcttataacaaaagacaataagtataactatacaagtcatcgttgaggcacatagaagaattgcaccatatcttgtcgtaccaactttgataaaaccaataaaccatagcccaatcaacctcattctcattcatcggattcatctcagcaatcttagcgtccattttgggatcaaaataaatccattcctgatatagagtgcacatcataacggcatagcaattgtatgcattgatacggactttagtgtacatgatatgttcgtagtaacgttccctcaaaatattttcttgcagcacccctgatacagcctgccatgtagatgcataatctttatgtctcgatgctcacagtaaataaacgaactttttctagaaaacaaattgagtaaagcagttataacttgatatattgttatgttcacagacaaagcaaaatgagagaaaaataaagtaaaacggtaggacttgatataccattagtctcacaatgaaagagcaaatctatgaaaaaaaagggggggcaaaagtcagacgatgcttcttgattatgcatacctaatgtttttttagcaaatactacatcaagataattgtatcagttactcagatgatcagatcacatgatccatgttctttgctgatactagtgttttcttttataagaagttgttaaccaaatattgaaagaaatatttttttttcggttgatgtggtaacgctatctgtgaacctaaagttatatacatgcatatatatgtgtaacatggttgcagtgcagtgtaaagctaagttttcgctctttttaagactaagagaggaggaggaaaggtgacaaattgaggttatatttggtgtgtcaagataaagtatatggagcttggatcaaagcaagacgagttccaaacagagggaaataatttctcgtctttacttggtcttgtccatactatttttcctggttacaaacatgtatattatttcacttcacagtcaatgtgacctttgacttgaattagtacactttagctctagcttttatcatgtggataagaggaggacaatatcagattctttgcatttgagctaagaatctcaatgttctcactttgtgtatgtgcacagacacagtgactggctgcctgctagcccatctatgacaaatggattgaaagctgcttatcataaagctagttgatatctctaaccaaacatcgtatagctatgttcttgatatactgcaatataaataatctgaagctacacgactggcgtttgttatattaagagcaacaatgcaaagatatgtagggcaaccgatccacagtatcttcgcatcaggatacttcagcagatgagctgcctttgtcttggcaagctgctccacagttgtcaaagaaccaatatcaaaatgcaatttcaatatagcagcatcaatgaagacagtagaaaaggagagagaggaaatgatgggtgataagcttaggctgttcttcagagtgctactaacaggcagagataaagtgcagagctgtagaacatctctttccgctgaagattattaagaacatcaaagtaaaatgtgaaactggattaataaaatggatactgaattaatgtcgatagtattgagagatgatgatgctagtctggaggtttcaaaatgttacagaagattaattcaatcaaaggacacatttgaacttcagaaaagatagctgaagagaacatttgcttttcattcctcaaagatcaatttatattttgaactcatgaaacagtaaaagctgaagtactcctataacacatttaacctgtcatgaccaaagtagcaactgagaagaattcagaaatcatggtttgcaaagaaatagagcatcaattcaccaaatatactgaacatttcaacattggcacaataacaactaacttcaatgcctcaaggaatattcactgtaaaatgaagaacacttttcttctgtgaggaataaaatgaaccatatttttgtgaagctatgtttagaaaattgcatgatatattgtattgccaatattctatttcttaacctatccaactaggtcaaagctagttggataggtcaaagctaggtcaaagctataactatacaagtgaactgacaacaacaggaataatgcctgcgagtagctttaactgataggacctatactgaactaaattagtttgatgacataaacttggcaggtcaagatactctctgggctatcataggaagaaccaaagagtataatctttcttacaacaaagctatgaccattgacaaaagataggctgctctagttgcataaaaaactcaccaacaaggataatcatataatagactatttgtcatatttcagacaataatagacatatatacatgttttttccgatacttctatgatatcatttgtgtctttgtgtattcagcttattattttttgcatttacatcgttgacctggttctggttactaaataggacaaattttatgcttgtagatatatatgaaatacacctaattgaacttgatttgtgttgaaagtatagcacagctagaaggcagagccaaacagagatgtaattaacatgcctgggtccagattgaagaccctatcgaacaaatagaggaaaggacagaaaggggaaaaagtaaagtctaagcgacatatggcacgaaaaggaaatccaatttcggtaagacttgatctgaatcgtagttcagatccaagtcggttcagtgagggcaaccgcgaaagtcaccgaatgggttcggtccgtcttttcctgatctttgtttgtccccccaaaaaaaggcgtgagaggacgttgcagatgtccgggacggacacgacttcttctaacgctagaagaccacaggaagaaacccgggaccagagcatgtcgtgaaagacgcacacggggcgggcgtgcttcgttgttcaaagatgttccaaatgattggtcttctgccaccctcagctgcaccacccttgtactgcatgtcaagaatggccaactcatcagatttcagaccaagacaaaacatgtgagtgtgacaattaattttgacaaccaatccattccttggagccaatcttatcaatattcagtagcatcgtgtatcacgcaaaaaccaccaagagcaaaagaaaatcctttttttcttaattatcggtggaaattaatcacatgtggcgtgaacacgtaggggaccatgtgagggaactcctacatcgcggcgtccaacggcggctgccatagcgtggtcctcggcactacgccctttgctgcacggcgaacggcctccgtctgaggcggccggcgaatcaaaaggcggctgggtagacgggcacggcgatggatgtgaattttctcctcccccatccccgcgcacagcaaccgagctcgttgccctatctggcgaggatctgcaccgccaccgctcgaggagcccctttgccatgccgccgccaagcttgaggggagaggcagcgtcctcaccggagctcgtcgctgacaccgagctcctcttcacatatagcgacgaggaggggatcagaggacagaggactgaacggcgcgccaacgcgtgggaggctcggcctcgggcgccggaggcggagcagcgggaggaagaggcggcgacgtcggcgtaggacggcgggtcgaataacaaggaggcggcggtgacgtcggcgcaggtcggaggggagagcggcgaggtggcggataagagggggtcgaaggtggaggaatagagtggtggcgaaggggagagaagggcctgactttttttttgcaaaaaaatgcacctaaaatcttctatattacaacgaggtccaccacagagatccgtcactgtacatctgcgatccgacggctataggagggggtctaactctggattcgtatgacgctacgtggagggtctatttgcatgagaatccgcgaagatttcgatattgagagatagatagctttgtaagcactaaattgatcattgtgggtaacttaagaacgggcggctcctgaatgggatctataatcaacgtgttggttcctactaaagaatcttaacgttcaaaccacataaaccacctgtgaattgcacaatggtgtatttgttgtccactcctgaagtgtcttcaaagacctgaaaatcaagtaacccaataataaaacttcaagtgttctgaataatgcaacaaccatagggttaatgcaaatcaaaatacaatcccaagaaaacaatattttcataagaatagagaagtgatgacctgcacaacagcctctttcaccatcaacttccagaatttggccacaccgagtggttccatctcccaatcggatgtttacaatttcctagtactttgcgccatgaacatagttacatgaagaaagaaatgttcagtataacttgctaggagtaccatattagtcagttgaaaatttgtaccataatactaacacatacctttactttatccaagataaacagaggtcctggcacaccagacacaatcgaacatttctattatcgagaaaaaaaaagatacatgaggtaactatctctacctttttattatctccttaaatcccttgttattctgtctctaaatccaagatgcaaacacaaatcaattagtaaaaaaaaatgcattcattgccagaatcatctttttttttaaatgaacccattcccagattcataatttcaaaagagaattttgaggccaacaagagcatgcacttactctttgaggcaagcgatacaattggcatcaatccacacggactacaattttctcttcagttgtgcctcggatggctgcagcaccagtcatcccctaaaaaaacagcaaacaaatcatggttagagaagaggatgacatgggagagatgaaaggagaatgattgaggggaggcaaggtacagtcgatagtctgagacgacgaggagaagatggaccggaccctcgttgatggatgtgccatggatttgtgtcctcctcgttgaaggctcaagaagacacggcgacgtagagcaggttcgccaacacaccacctcgtggagggatcaaggcaccgcctgagacctagtgttggatgaaaggggaaaagggtgtgcggtggggaggagggatgggtagatggcgaaggggatgccgccggatccagagggagaagtggcgccagccacggggctacaacgacaagaatggaaaggggaggagcgggtggttgacgtagactcgaaaggagaaagaggagccgtgtgcgagggaggcggagcggcaggagttggaggagacgcagggggagggcggcgttgtggagaggtgaggacgggaggaggagcaggcggccaggatgcgggagaagaaagggaaagggagcaccgacgccggctctgccgccaaggtagggggatatgaagggggaggaggcaccgggccattgcccgtcccatgtccactccccaccgcctgtcctactcgtcccgcccgtaacacctccttcttagccgccgtcaccaccggtgctgct

SEQ ID NO: 67703 - DNA, 6956 bp, Oryza sativa
cggcggggggagagcggacgacggcatcgtggggaggacgaacggcggagacaggtccccgccgccggtgcggggcgcggtggggaggagatggggagacggccgggtagggtttgggccttggttaattggatccatgccactgcaaaagtgcaaatatggcatatcaaaataatgccactcttattcgtcatatcggctacgtactactgaaatctaggaaaattggaaccatgccactacatcacattttccatcaaaaatccccgttagccccaaactgcacgtgggccccacatccctcccctctcttctctttccccttcctctctctcctccaccgtagatgcaacaggaggtgtcgtcatcatcgtatgagggaggtccggctgcgcctgcgtcgtcgtcgtcgtcaagcgccgaggatgtagtccacctgtgaccgagcggacgcagtgaactgcgccggcggccgccgccgccatcgcactggagcgaggccgccctcgtcgccatcaggtggtcgacgtgcacagcgaggacgagggacgccagggtcacgtcaagggcggatctacccattaggcagggtgggtcgaccgactcagctacgacacgtgtcaccccacaacctctagacctacttacctccttatagtagtcatgggacattaaaatgtataacaaggtgtaaacacccaacagattaaggcaattatgcgaatgaactattaatacgatatgtgttgttttcgattgctcttatcgagtgtacatcttcgttctctgccccatctttcgattgccgccggagtgctgcatgaggttgcagatgaactggtctaggttggtcttcatctcggtgtgactaccatcggccgggagcttcccttggaggaaagcggcaggaatacaagattaattgtataatgttaacatccacaatccaaattaagcagaaatttggattcacatgaacaagaacgaatcagaaggaggataggttttagtgccttggtgaccaatgcttgcgctttgacgaacttgtcatcccagctgaatatggagcgcctcgtctcggagccggcgggcaggactgcgccagtatcgtcgtcgcccactccccgggcgaggtccccggccatcgcccccgcgccggtcgccaccccgcccaccgccgcaccgccatccccaacactcgttgctgcagctaccaacctcctcccggcgcgcttgctttctgctcctgaaccgaagaaaggaagagggagagagatgacggaggttgacaaaaaactggacggaattggcatagttccaatttccccaaattccagtggcacatagccgatatcgcaaatagtagtggtatttttttaatatgcagtggcatggatccaattaacccttgggcctttgaggtagatatgactgcttttcatgaaagcccgtgtctttttcatgtttatagcactacccctataaacagaattttcttttcatcgggtgtgtttagttcacgctaaaattgtaaatttggttgaaattggaacgatgttatggaaaagttgaaagtttatgtgtagaaaagttttgatgtgatggaaaagttgaaagtttaaagaaatagtttggaactaaacttggcatttgtattgtatttctattcaaaccgaggggttttccaaataaaacataacagggtgtcagtcggttcgaggatatatacgatattccgtgaaaagcgaggagtttttttttgcaaaaatactcaacataaaaaaactcaaaaaagggggaaaaacgcagcatacacactactatcatcgatattttgtttgagatgtgcaacagacaaagcccgaccgaagaaccctaacaatggcgtcgaagctcgtgacggcggtcgcccgtcaagcggcggccacatctcgcgccgcccgcttagctgcggtggcgcgccatgacgcggcggccgcatctcgctccgccggcttagctgcggcggccgcatctcgcgccgcccgcttagctgcggcggccgcatctcgcgccgcccgcttgaagcctcgtcccccactggacgacgctgcccgcctctccttccgctacagcagtgaacctccaggtaaatcataaccaatccctccctgatccctccctgtcctcatggtgcagctctccaatttagcatagtctagataggcaggcagggggattaggatttaggaggaatacacccatctctggtctgtatcaaattcattcaattgttgcatgctattcgtacaattcactgttttcttgagcacttttactgatgtaatgtttgcaaaatggtgattggttgtgatatatagatgatggaaagtgcgtgacaaaagaggaccttgagtcggacgaagccgtgtgggccttatttgagcgctattgcaagtcatacaacaggaagtatgatcatgctcagatggttcgccgcttccgtatattcaagttcaatgcaaagagaacatattgctggaaccagtatcttcataaagacgtaaaggaattagctcgcgccaaaaaggatagggatttaggactacctgtcgactcttggtacctacaaaaagagttaggcgaatacgacgatgggggggagccacttactgaatattggcggaaattttgatggaaaaccatctgccgctggtgtgtcctgcatcactccacatgttactgcagtaagagcagtttgctccccaaatcacttcactgtaataactagtagtcctttgacgttccgtgtttcttactaaggatgcgttcgtttgggtgatagggagtgagaatgcacatcgttttccgcacgcacgcttcccaaactactaaacgttgtggttttttgcaaaaattttctatatgaaagttgctttaaaaaatcatattaatccatttttaaaatttaaaatagttaatactcaattaatcatgagttaatggcttacctcgttttacgtatctttctaatctcctcaatccccttctcctcaaacacaccctaagttatgcttgtgtaccatctacttaattatctaagaggtcatgatatcttgcatatggttccacgtatgggagtgtgtgcgtgtctttttttttttttagcctttttggtttacaagcacaagttttctagcagaccaagatcaagtgtgatgattctggtaatgtatgcagctgtttgtgcacattaatttgttgagcatttattatgacgaaactaaaggttagtatatattgttatgtctcaaaaaattcaacagtttaaccgttatcatttactcattgttcgttcattgatgtatacaatatcaattatatccagtggtaggacctttattaactaataacacatgaatcttacttgaatatatatccagtgatggaactaaaatttgttatttggattagttggcacattggacaaacgaacggctgttaactacctatgtgaaaaattacttagattgatcatgtggctgttaattcagtttatctagaaaatatttttgcaacctacttgtttggtgcttgcattgtttggcaacccaatgagcaagctctaggtgcgcagccttgatctctagttacatgtacagtagttgcgctgcctcaaggcaccatgttaaatgcagaaatctagacaaaattttgtaatatatcctgaataacttcaatgttcagactctttcctatgattcttttgcaatgtaaagaacttcatcaagttgtatatataaacgaacatataatccaggacaacaagacacattctttctgatctagatttgtgcacatcaactagattcaattcatatagaccaaaagaaggaatatatatatatatatgcttgtgtacaaagaaaataacataaccagtataggagaataagcccacaaaacaaaaacaaataatatagttagaggcattaactttgagcatactctctcttaagtctcaactttaattggtctgttgtataaatggtcagtaactggtctgttgtacttgtactattttctcgatgcaaccatttgccttgtatggcatattgtatatataaacaccatggattggtgagctagcctatgttactacatgtgtgcttggcattgactgggcgctttgagtagggactgaaaggttgattgtttgaaccgtagctcggatggacgagcgattggagaccgtggatttgtagacctcatcgagatgtaaatccattttagtctggccgtttggacttcagatgaacacattgttgtttggttcattttgtttttaagtaaagactgaattgccgccacaagaacaacttgtgaagtgggtgcaaatatagatcatataaaacttgaaaattgctgaaacagaccattgtgcgctagattggatttcctgtttattttactggtgacaggtcgttattgctgtgcatggagagtttgaaggtcagtttcaagtttatgaataaaagtttttctttttcttttttgtttggaacaattaagctcttattattctcttactgtctgcaataaacagttgataactccagcaaactgaagagtaatgttgcagcatctaagacttttgcatgtctccatatcctaaaagttattctgatgagaggcatgttcactgacagcttgatccatgtgtcatgtatttcagtgtttaaaaaatgcataccccaggttatgtttgccattagagcaagttcaataatatagccaactactagctccaatttatctatagccaatttaatagctcattcatacaatagttatatactacactattaatacctagtcccacctgtcatagacacgttgcgttttggagtccgtgctacagctggctacaaatctgtagcccgctgctctcctctctcctaatttatcttcttaaaatatgtttgcccgctgctctcctctctcctaatttatcttcttaaaatatgtttgcagttggcttatagcctgtattgcacctgctcttatatacttcgcttattcgggtgtccccttgtcgaatttgcctttggtgctagtcaccacacgtgggcgttatatttttaatttcttttatcaggaccgggctgccacgtgtgcgacacgtaagaccaaaactgttccgaagtttgtcaggggtaattcgtccatataaaaagttgagggtgcagtttttgaattgagggggtaatttcaactgccacaatagtttagggggctaatttgggctttttccttaataataccttgatagtagcatcttctcatgacctttatagttccacctccccgtgacatatattgttttgaccaaaataatgcagacctcattgcggctggcattcgccttccaccgtcaacgccagtgatggtgtgctgcatcggcttctccctgaaaaagacactgcaaaggatgactctgccactgcgcaaaggatgactctgccactgggatgccaccgacgaagttcttggcggaattgcatttgatatgtcaattcttttttaaatttgtgatggtggaattgcattctgattttcaaattggaggatattaaaatctagattttcattttttacactagaaattctttttgtatgtgggtaaattaagtgtgccacctataaaaaattgatttttgcaagtgggtctctaaggatgcttgccttcgaaaactgtagatcttctcaagccttcaatcataggcagggtgtgtggccatgtgcaaatcgcgttttgaccacctcgaaaaaaaatcttgtttcgtaatagtgcacttgacttatgtaattatatactttattaattctgagagtcactgacatctagcagaaataatgcagaactacatgctagctagttccagtagtagcttgattgatttcattctcttcttggtggacgtttagggttatggcggtggttggctcctggcgtcggtagtcattcacctccgcattcgtcgttgccgccaccatgtcctggacggacatttctctccccagtggacgtttagggttatggcgaggattggctcttagcgctggatagtcattcacctccacgtccgtcgccgctgccaccatatccctgcatggacatacacaaagccatgttcagaatcactatcaccaacattactaattgtttcagaatttagccttcagaaagtacatattcattttagaattggtttgtaaaggtggctatgaactgtctacgagattttgtagtaacatgccaacaaattaatttaaatcttacgggaattcagaaattgaaggacatgagaaagattaactacatctgcatagatgtttcgagatgacgggtgttgttgttggctgctcaagtgcacgattcctgcaagaacgcatcgacacgcaaattataattatcaactagtcaaaacacatatcaagaattccaggagatctatgacgacgaagctttacccgacacgggcaccgaggagacgagtagtgggaggagcaataggcaggacatagccaggacggcggcgagatcacgaggcctcatttccattgcgcggcacatgcaggaggtagcaaccgaggcagccaagaatggccgcgagaaaaaagagctcgtggctactacttcgtttcacaatgtaagactttctagtattgtccatattcatatagatgttagtgaatcgagacacatctatatgaatgtgggtaatgctagaaagtcttccattgtgaaacagagggagtatttgttttttttgggtgtgtgtgatctgtgtcggaggagacgatgatgtatggatggatggcactgggatgggtagttgactcgtagtgttgggagaaagctacccatcggacgtccgatgaaaaaaaaacggatggtcaaatattgcagttgg

SEQ ID NO: 67704 - DNA, 1689 bp, Oryza sativa
gtgtttagttacatccaaatgcccctaacttttcatcacatcacatcacatccaaaacttttctacacacgtaaacttttaacttttttttcaaacgaactagacacaccttattccgcgtgaccgttataataaaccagcatacattgagtgaggaactttgacaaaaaagaacacactgaactcccaaattttgccacggaggatctagcataacttgtcagagacgagatgtgattagcttgccgtattaagacatgcacgcaaacaattacaattacatgacagaaaattactgggtagtttattccagaaaaagcaaagaaaacaacaggaacatggtaaaaagtactcctacagaaagaatggaagaacaagtaaaagtgctgaatgaatgggttaagacaagaaaaaagaatgcatagtccagccgaaatgtcaggttggttgggcctggcagcaagcataaaaacctaacgtggtaaatgtcatgtcaggttggttgggcctgccagcaagcataaaaacctaacatggtaaaatctcatatcaggtagggttggtcctgccagccagctcaaaaacgtaacatggaggtgtatttcttatactatacaattgtatgctaatcacatctggtttattcctgatcatcgtcagtccttcaaatactcacagacgatggaacgtaaggaacaaaacatggagtacacccttcattggttaggggcccaaagttgccagtaacgaggccttcaaggtccatggcgacgacgcgctcctccaagggttcccagacaacgacctctgcggcgccttgtgagcggagcaacatagcccttttgccaaccttctccccggagaatgagccgacaactgtccagagtgcagcaaccttatcatcaaacagtcgcttgtttattttaagcacgcccaatgtgaggaaaccgtcaacatccttgaagcaggtcacagtaagatctccctccatttgcccaagctcccatacggtatcttggtttaccactcgaggggcagggatgactttaaggaggtccttccccgggtcatagcagaggatagacccaagggaagtgcgccagaaggcgcagcccagtgtaccaacaccagactccgccttcacctccacagcaggaggggcatctttagcaatagtccacctcccagtcctggaggagtatgactcagatgtccagacgctgcccttgaggtggaaggcagcgacgacatgataatgctcaacagcaccgtcgaagcaggatgtcaggggttcctcgaatgtgatgacaactgctggttctccatgatcacaactgtggcgtggtagctgaacccacttgaaggtggtcgtgttggttacatagtacaagcctgttgtctttccacagacgcagacaaggccacgcgtggatgcaaggaaagatacgggctctggtaatgcagcaaagcgtgactcagggtaaagaagcttgccgcagcgtatggtgtcaaatgcgagatacccaggctccttacataatgtgttgaaaaagaagcctgagagcggcctgcacagcggtgagagaaaaatttaaaggaagagctacaaaatgacactagatgtttaaatcatcacaaaatagtcagtaaaggatctcctatatctaaggagaattgcatcaaatgctg

SEQ ID NO: 67705 - DNA, 3346 bp, Oryza sativa
tgcagccctgaaatgtaaatttataattagttcagatttcatcaatataaaatgcatacctgtccaattaattctacaagataaagcagcaacttccatctcatccagaatttcatcaatataaaatgcatacctgtccaattgattctagaagctaaagcagcaacttccatctcgtctagaatatcatcccttctgttagctctactttgaattatagcacaatttctgttagctctaccttgaattatagcacaattttctggagtgttaagaccacctatataaacaaaaatatataaataagattaacaaaacatacaaaatgggactatctatcctattcataccacaaaactagttaattaagtcgtatatcattgaacattgaaattaacatttatagcgcctcaattcaatccctttatcaactaacaatgagaaattgtgtcatgcttgcatcacaaacaaggccataatgttattttaccatgtcggtcaggaggcgacggcgcgggctccgaccgttccgtcgatgcgcctgtgccggcacaccgatgagacgtcggacgccggcggtcggacctcgatctgtcggtcaggaggcgacagcgcgggctccgaccgttccgccgatgcgcctgtgccggcgatatggacgtcaggaggccggcgtcggaggcccgtcgatgcccctgcgccgacgggcggcgggagaatgcccctgcgccggcggccggcaggatcgaagcgctccggcatcgtcgggaatgagcctggcggacggtcgctggcggctggaacggtgggagagaagagtgggtttttatagctatctattagggtttcttaataagcgctaataatcagaaaaaataatttacgacgctccattatccgaagcgttaggcgctaataagtaataaccaggaaaataatttatgagccccgctaatatcgaggtttatactccgtaccaagcaaggaaatgaatttaggttctgattgattcagcttagaattattataatttggattattagaagtaagttgaaacaaacatatagcttattatgatagattaatataatatactagtaaaagtgtccgtgcgttacaacgggaagcgtacagatcaaaaaatatgcaattatttaaaatacaaattcgttgaaatttttggtatttttaagtaggtatgtgtataattaaataaatttacaagtaaagcaaatgcgagaaataaaataacatggttaaatttaattttattaaattctccatgattagtcacactctttagaattttattggaattttcataacttaattgctaattttaataatacaaacatcatttaacaaattgtttaattggaaaaagaaagaaaatcctttcttttaggtttgattcgaaataaacacattcaataactataattgtaaatgcttctaaaaaaagaagcactaaaaatgaactacttctctttttcttcggctagagggacctaaaatagacttcttccagacccttgccggtcggcccacggccttttgcgcatgcgcgggtgcacttcccctccccaggccgcaaccttggcttgggccggaaaagtggcctcgctctcgatcccatttcgggccgaaatcggcccggtcgacgctgtccgtccgatctctagggttttgatcggacggccaagcctcgagatcggggaaacaaaaccccctcagccgccgaaactgatgaggacatcaacaccatcgatacatccacgtccccccatatacagcatgatggtcctattacccacgttcgtgcacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgccaacttctgacggccgccacgacttcatgcgaactccgatttgggcgtgcaagtacttcatggaaagcttatcaagtctattttcaaatggatccagccacatgtccatatctgttctggagcggccgcaattgtcattttactcccgactattttttgtccatggtgctgcgtcacctcttttggcccaatgggctgtgtatccatgttgggcccattaggggcgcgtcctagggttggagcacgaccctatggtcgttcttcccctctttttatacctctagtcgccgccaagaacaggcaggttttgatgatagagatagcttcttgctaccggctcgcagcgcgcgtgttggctaaaccgcccgtctgcctgtaatcggaaccccaccatattgtgtttgatagtgaaactttcatctttatctagcaatctcagcgcttgtcctacttgttcttgcttgttcttcgattgcttgcaggacgagtgccctcgtggccgggttgacgcgcaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcagaaaccctagcccatttccttcccacctatctctctcttcgccgccctcccctcagcgcctctgagcggcggcggcggtggtaccccacgagcagcggcgacggcgcccctcctcccgcgagcggtggcgactgcggcggcggtggcgcctctccccccgagcccaagcggcggcggcggcgccctcccctcgagcagcggcggcggcgacggcgcctctctcaccgagcccaagcggcagcggcggtgccctccccccgccagcggcgacgacggctcccccatcaccggcggtgcggccgtgtcctccctcaccaccggcagcgcggcgacgtcctcccccaccaccggcggcggcgcccggggaggcgtcggcggctcgccagcatcccaacggcggtggcgcccctcccctctgtcggatccagcgggaggggagctgcggcggcctggcgtccctatgacaacggcggcggttcgacggcgacttccccttcgatttttttttggatatatttgtgtgtataatacttcctccgattttattttatttgtgtgattgattgaattccgattaggatttttttttgggtggtggtgatggaattccaactgggatttggggggaggcgagggggacgaaaaatcactgcacctatgaggtgacgaccggaaaaatacgaatatttatatt

SEQ ID NO: 67706 - DNA, 3331 bp, Oryza sativa
atacgtggttataggtggctatacctgctcttaggaactaagccacgtcactgtctaatcctcaaccattcgatctgatctgagcggcgcacacgagtcagcccatgtctctttctagggttttttctccttccccatctggatcgcatcactcacagccgccgccgctggtagggtaggtagaaaaagaccgaaccgaaaaaaccgacactgagaaattcaatcattaatttggtcctatgtaatgaaagaccaaattttgttcggtcaaaattcacttagtttactcggttaatcgaatagaccaaatgaccgaattaaaaaaatgtctaaatgcaatctacaatccactaagttcaataggattaaactctaattttcacttccctacttcttctaggcatgcaacataataagagtctttacttctacgtgttcacgattttttttggtgatttttgtgttgaaaatttccattatttctttgcaaatatgaaaatgttgttgaatttcggtcaggaccgagaccgagaccgaatttgtctatcctgacatttttacattgaaattcagtctttacttttcaaacaatgaaatgaccgaagacgtggtcgcggtcgcctccccctcgccatgctgcttcccccatccctcgcgcacgattctataagaaggcaaggcaagatagcattgactgttgcatcatcgggaattgtatccttgttacttccaggtggccacacgcctcattcccagaataatatctatggtttgggtaggtagtatcatcaaatcgattaaaaatacttgatctcctaatttaatcggaacatttctacaaatagatgatactaatacagttcctccaggtgaatgtattagcatagctttatctaaattatctttaggtaaagactgatttcaactggcttttgcagataaaaaggaatgagaggcaccagaatcaaataaaacagtaactggtttagagtttatggtgaacatacccatcaatatattaggatcttgttgcgcttcttctgctttaatatgatgtacttgaccacgtccaagattaggtccactcttaataattggaggatttttctttataaaacctgtagcagatggtttctgataagaagtttggccacccatattttgacgattagggcaaagtcttgcaaaatgtccaattttcccacaaacataacatggagagtcttccatttttaatccaggtcttggtagtattggtggcatgcctggtcttgcattgggtaaagatggcttaaatagataaggcctccgaacttgtagtgaacccctagttggtgattgtcgttgtaaattcattcttctcttacgaagtccttcgaccattctacgatcattttctagcctaaccactttattgactaggctttgaaaattttcatgatcttgactaatcattggtcctcgaagttcatcacgtagtccttctataaacctttcaatcttttccttttcatcttgaatatcagaggcagcatattgagcaagttgcgtaaatttattcaaatattcttgtactgtcataaagccttgcctcaatcttcgaaattcattctttttcattctaatcacagctgtaggtataaaagcatctctaaaagctgtagtaaattccatccatgtaataatatgtgtaggatcttctatagaagcttgatatgcttcccaccactcattggctggtccttctagttgatgggttgcaaaggttaccttctcttgttcgcttgttcggaccaaggttaatttcttttcaaagcccttagccagtcttcagcatccataggttcttcagatttagaaaagactggtggtttaattctcataaattctgcatgtgcgctgtaacctttacttccttgattttgtgctatggcttgtaataattgagtttgtcttgccattacttctgccaaagtggtaggatttggtgaagggatttctcctgtttctctttcacccgtactgccattgcccatactcatctagaaaatggggtaattgatatcttctcaaaggggagtcaacatccataattaaacatagcttttatttatggacaagttgtacatgatgtatgctacaaagaaacaaaccaaagaaaaccataaccacaaagaaagaggtaatcacacatagaagttagagaggagtaggataactatctattctacacttaagacctctaactatctataacttctatttatctagccatccaccactgccttctgcgggattagtaaacaatgatgcaggtgcgaagtgtgaaaattcatgaggagatgcagaagttgatgcagtaatattgggagcagagcatgagtaagggtcttcattattttcttgatcattagtatgtatagaaagatgttcttgtgtctcaagctctcgttcttccggatcttcctcttcctctggagattcagtccagattggggcagtatttaactcattgatatgaaacacccgatttggccttagtatttctggttcttgactaggctcactgatatccatagctgaatgcatttcttctgcttcatcatcagaatgaataggatacaacggtggtggtgatggtggtaaacattgtaaaactccctcaccattatcatgaggatttggcccatctggttcaccttcacgtactggtgagatatgtccttctataccatcatcatcatcatcatcatcatcgtcatcactaccatatttgggatttgatgaagacaaaaggctgctcctgcaacacaaatattgaggatagaattttgtttttctctttcctcatataattcatgaagtatacgatatttgtgtttaagaacattttctctgcattcagcttcttcaagacgtttacgttgtacgtccatatgttccagagcttcttcatacatgtcatccgcggcttccatccagatagacatagttgcttttactggttgttcatgataatccacattctggagggtgcaatagtcttcgcccggctctcgcataggatgataagaatagctgagagtgttgcaacctgtcttggtaaatatgattgagacgtagaaaagcctccctggacacatcatatagtgcagcttgcacggtatcccgcctatgacgtgttcggaagtaatacatatcacgttcacctcgtggaggattgatctttacggtcatatcatattcccaacgttctccccgttgataagcatgtgaatagaattccggctcctcatttatcttcagtttagtcatcaaattgattagttga

SEQ ID NO: 67707 - DNA, 3554 bp, Oryza sativa
attaatgtatcaatccctggatcagtaaaaattgatacatacaatataactggttcttcattgcatacgttaaagtcttacaatactaagggttttacaataataggtactcacctaagctaattaatatacagcggaagtttctatacattctaactagtgaggtataacctttagggattttctaaattatcagggtcttcgtagtaatagttataagggtcctcctcttgacccagatctgaaaaaggggttataagagcaaggatgagtattcacaatactcagcaaattatcatggaaatatgttatgcattgacatataatagggttctttgcaaaaagcggtattggacaatctggaaaagttatagcagaatttataaaacatataaactttagatttctaaccaaggtaccatatgagtcccggtactcaactccatgagtacggctattcgaatagtttcaaagatattctactgcagcagatgtacgctttacccgcagtccatgacttgctgataatcatcggctttagtcatggctcagtattaagtcaataacaattatggcacttattccatgaacttatatcctcatatgctctgaacgtaatgttaacagcagcaagaggagttctggcgttcccgaggtatttaaggggaactgatcgtatgacaccacatcatctcgatcagggtttagaaatataccatatagtttatacccgagtatcacaaaccatttacctgtacatggtaatggttaaagttgcccttcgcggctatagttgcctcctgcgcgaggacttaaaaataagaaccactatacagaggtgccatattgctaattaacataataactaggtctgtccccattctagaaactgcggtcgtacccattcgttcgacataagtacctggtaaaacttatatcgattgagacaatactagccacccggaaatcatccaaatcttacgtattgtcccaatctaagtatagggtattttaaccagattgtaagcaaaataagcaatactaaattatttgggtttctatgattaatttatgcatagaaaatagaatattgaatagaaggctataaataaataaataatttgtaaaatataggcttaaatgatcaacaggtatatggtaacttgccttgctcgatgtcctgagattgattgatattatctagagtgtcagaggaatcctcaagacctagggttagacatataaaattcaaattcaaaaaggagtttaaataaaatgcaaaaatagcaaaaaggggcccaatagatagaggatgattttagaagaatattggtccaagttttactgaaattggatctatattttaaaagatatgggcttctaaagtttgaaaatcgaataaaagtgaaatggtactgtgtgtgggtcccatctatcagtctctctctcttctcttcttctacctccagccgttccccatttcaagccggcggcgctagggttggcgactgcggtggcgctagagggagaaagtggttgtggccgaggaggggagggagctagggatctccggcggcggcgagcggtggcagaggagttaatttgatgcgtggacggcctagcggctagggcggcggtggcacggttaggttgtgatggtgaccggagtgatgagagttagacatggttaggggaggggttctagagcatctacggggtatctagagggatttcggcagcttgccaacctttggcaaggtgcggaacatagttgccgacgagcgcctacataggcggcggccgtgctcacgtcggcagctcagagggtgacatgatagtgcaaagggattgctcaaatggaatctaggtagtatgtaaatggttgaaatggaagaactcaccgagatcggttgaaacgacggattgcggccggaaaaacttcgcggcggcgaagaacagagcagcgcaggggcggcagtgctcggcttggtgcggcgaggtaaaactcgacgtagggctttggttagggcttagtatactagaacatggtatgatataggtgttctaagtgttatttagggcggaggatggatggagaggggtggagtcgatcacgcacaaagtgttcgaccgacgggcgagggtggttgatgagatggattggtgaagcagagcttcgggattatggggctatggttgttgatgatcgatgatggacagggaagggattggggtcctatttatagggctaggaggagcggatgagctcgggcaccgttatcgccatggatgagctcgggatttggatgaggcaaaggtggcagaggctgagagagggcgggaaagatcgatttgagtggcgggaggccacgtttgaatacttaccggcgaaggattggcttgaccgcgtgttgattcggctggcgacgtgttggcgccaatccgagcgcgacgcgcggcggcggcgagggtgaaaacggccggctcaggggtgaatggtttgaattgtgagaggggataccaccgtctatctccaatccaaccgtgcggcaagaattggcgcgattcaccccgggtagaagcgaaatcgcactcggtggcggcttggacgggtgcgcacggcgtcaagcggtgatttcgtgcggcggtcgtcgtcccggctttgtcatcgtcgagattggtgcggcggcggtgggctgagggcgtcggacgggcgacggtgcgccaaggcggtcgggcacgcgcgatcgatcccgagatcaacgcgcggcggctcagcgcgcggcaaggtcggctgccagagagcgcgcgtgaaggggaggagaaggccaactaaaccacggtttttgagtgggttgtgatcccctaggaccaaacctagactttgcacaagattgggttgaaggtgggctgctctagttgggctgggcattttgtcgagcaccttgagtgtaatgaacagtaaaaatcagaatttttgaatatttccctagaaaagatttgaattcaaactaagagtttggaaaggtttcactagggtttagagtatagtaaatctccactaatattgggataagctaaggaaataatctatggtttgaatttgagagaaattgctcaaattcactagggtttagaataaagggaataagttagagtaaattggttgggctctaatacttgaaccaattttaaataaaaaatcaaatagatttttgaaccaaacaaatttaatcaaaagccagcatgatgcagttaattttagtttaaaatttgaggatgttacatgatgcaaaaacatctctcattgtttgggatgaatctcatgttaatcataagtattgctttgaagcattagaccgcacactcaggacatgttatctgctaccagcctgcattcgacatacaaacagtttagcggttttgggtggagattttgcccaaacacttccatccaatcatccaaaatgtaacaaagaaaaaaaatgaaatcatgccttgttttaattcatattgatggagtacttcatttaaccgaaaatatgaggcgacca

SEQ ID NO: 67708 - DNA, 1533 bp, Oryza sativa
ttcatcataagaacttgctgttacatacatagcaatactatcacagtgctctgctcttgtagctagtataattgagcataaggagagaaataaaagtggtagatacatgtcttatgaacttattatgatcggtcgccaaatcaaaagtagcctgctccttggttggcagctgttaattggattattatgcaataagtggccatttcctcttgggtatataaataagcgtggtggatagacttctatctgataactcgtatataccttgttgatgaccagacctgtcaatttatactctggctgttatttgtgctatggagtactatgtaacatggatggttttctggaggaagcaatcccattgctgttgcacttacattttgaaaaatgtttgctaacagtatttgcaatagtccaccaatatatgagttattcccttttgtccttttttcattcttttttgtttcaagcagcactaagctctaaacctgatatgttggtgctgaccactaaacctgaaatgtcagcttcatggtggcatgaataacttctacgttatgttattaaattgaggtgatggtgttatttagacggtaaggtttctggtgttttcccccccttactgcttaggttctggtgagatttgataattttccactctttagatttctgttatgatgatttgccatcttggcgcacacatcattgactcagaggaccccacatgtaattgccatggggtggcaagcttcaatctgaagagtggcacatcatcaaatctgcctcttttatgtgaatgggtatttctcagtttgttaattgtacttttctatgcttatcttgttgcatttctgttctctaatatatccgcgtgctttccgttgtattcatattgagagtgccataattaatatgctgtcttccgttagttatcctgtggtacaactcaacatttgcaatagcttgttcatacatcattgaattatttataacctatggtacaactctagatagctacaatctttcccggcctacataatgtatttacagaattaaagtagttataactttggaagaaattatttgtaagctcatttcttctccttgattgtattacatattgtcagctaatcaactccagctgaagccgttcaagtcaaaatgtctataaccttgatcgttatcatctatattgtgagtatttagatcaagattcttccctgaactttgttgatcaaaatctagtagcttgctttctctttgatagtcaactgtttgtcttttgcagcttggttcatcaagatatagcttctctacatttatttctttgcttcctgatgttgaactggttgtgctgcctccgccattcttttgaggcgtgatatactcatgtagaacctctgtatcactgtcacttccctctgatttgtgatactgtttaccgctatacagatgacccattctacgctcacttaagcttctgttaagggaatattgagattcttgatcttgggactgttttcggcaaaataa

SEQ ID NO: 67709 - DNA, 740 bp, Oryza sativa
gaggaacaggctgtccgccagccgctgcgccgcggcctcggcctcctcgagagcttgcccccgctcggtgagcgcgtcctcgcggaggcagagtccggactcctcttcggcgcaggcggcctcgtgcgccgccagtgttgcctcccgggtggcaacggcggcctcgcggtccgccaggtctctctccttcacgtccagggcgtgggcgcgctcctccagtgccgtggcgcgagcctcaagggcctcttcgcgctgccgggacgccgcctcgttctccgccgcccgccgttcccgggcagcggcggcgtcaaggactccccgggcggcgtcgagcttctcctctagctccgccgcccggctcccgtattggaggcggaggtcgtcccgcgcctcgtcaagcacggcggtggcgatgagggcagtctcccgctcctcctccacctccctggcgatctccgccaggtccctacgacgggcctcgagctgtgaggcgtgccggcggtgtgccttgcggcccgcctccaccatggcctccaccgagcgccgcccctcctcgacacgcgcccacgccgcgtcgagctccgcccgctccgcctgcagggcctccatctgggcacttaaccgtccagcaccgtgctgttcgcggcggccaaggcctgcaggaggggctccgcgctcagtggggcagcggaaggcagaggggagagccgcctcggtgtgggtgccgcgcggctcggccc

SEQ ID NO: 67710 - DNA, 14909 bp, Oryza sativa
  unsure (1)..(14909): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatgttgagttgtaagttaccagaaaattacacttgctgcagtgtgggcaatgtgaagagcccctttgggacctggccagaaagacttccagaaactattgaactgagtgatcaaaacatatagagatgagtatgaaattgtcatcacaagacgacacaaaatttaaaattccaaaagttttggataactcacacagaagcaagagatgttaaagatgtgaaccagctgggggccactgaaggatcaaatgtgttgttgctcaaatccctggcaattcaagagtggaatctttagttatgcagacaaattatatgattggatgatgaggcatgggggtggttagtttcttacacaacattcaagttggtcatgttgctgagatctggcactgatccagttagcttgttgtttgctaagttcctgcagaagataacattttcaagagaggtgcctcaagtgtcataactcttcctttaagatcagatgtcacttacagctcattcagtttgaccaaactgccaattgtagcaggtattgctcccgtaaaaccattcctatccaatcggctgtcaaagatacaaaagcaagtcaaagatatgaccatttttttttttggagaaaataaaaggatgagttccacctatgtgaactttcaagatacttacagaacttcgagtgtactaacagtcccaacctcagctgggattgagcctgagaatttgttgctatcaaacaaactgacgagatagggagagatgttagcaagatatatctattcggtattcatattagacatgaaaatttgtcgatcccttacatgtgtatgagagtcatattggagttgaaaagtccagtaagcgttccagttaactggttcttgttgaaatggctgttcatcaatttgaagtttggagcaaaacaatcaattgtaagtacttacatattctgatatttctcaattgataataccataaagtaagattaaaattacttacaagtgctgcgttttgacaagttggtccaggcctggtgatgttgatgttgagatggggacagatccagtgagttgattatcagccaggtctagccataagaggtttgtgagtacgccaatcgaagacggtattccaccactaaacttgtttgaattcaaggccctatagagaatggcacgaattcattatgtcaatccactcaaaagaaaagaaaaaaagggtttatcatctgaaactgtggaccaggtatatccacttacaagaacccaagtttccgcaggttgcctattgctattggaatgtttccagtgaagctgcaaccagctaagatcctgacaattacacagcatttgtgcacatcagtaagaaagtttggtatttctgattggaaaaagtagtgttgacaacaatgggcagtgcggcgcatacagtgtcgtaagctccccaaggttcccaatctcagctggcagcggaccaccgagattgatgttgaaggaaagatccctgcaagtgtttctgttatcagctactactactagactatttcttcttagacaaattagttgtactccagaactttgtcacggatcatttcatccaggtacgtttgctattgataatttaacttcaagtgtagtatcttgtttctttcttttggtaagaaatgagcctaatccatgtcacattgcgaaaatagtcaaagcttcagatatttcatccagatctatttactattgtaacttggcatcatatctttgtttctttcatttggtaagaaatgaacctaatccatgtcacattgccgaaatagtcaaagcttaagattggtaaacatgaactggtcagtgataagcctcaagaaaaaaaaaagcagagttcataaactagaagcaaactgttctgacaatctgccccttgactggttcaatcagaagttcctagcctgattgcctgaattcacaatctgaactgctacagaagcatgaacaaaatttcgaaaatcccaagttcatagcctgcaaaatcatgctgttttgaacttttgctaagctgggtgatgaactgatgatagaagaaggtgcttacaggtacgtgagctggccgagctggccgatgctgctgctcagtgttccctgcaggctgacgcttgacagcctcctgcaaaaaccagagacatccatggcacgatttcagaggaaggcccatcacatgatattggtggtaggaggagaaggagatggctgtaacttacagcgtcgtcaccctgccgttggtgcacatgatgccgtcccatccgccgccgcaggggtcgccggagttccagctcaacgggtagttcgtccattggctcttcagcccctcgagcgccgcagctgcacgcatgcatgcccaagaagaagatcatcaacaccagcaacaaaaaccaagcgattcttctccgggcaagaagatcctgcctgactttagaatcatctatggaagaaacggaggtgatcgccggcggcgaggcaagagcactcaccgtcctgggcgttggtctggcacaacaccgccggcacgcccgccgccaccaccaccagcgcaagagccatcaacacccgcggctccatcctgcgccgcgccgtcgccggcgaggcaagccaccgggagagctagcacacgcttgtgctctgcttgaccggagatcgtggaggaggaggtggaggaagaagaggaaagagtccgcgcaaggtgcggggaggcgacgacgcctcggtgtatatggtgggcgcgggggccggggagtgatggcgccaccaaccgcggccgggttgaagtcttcccttctctcgccgcgccgccgggaagaggtcaacccacccgcggatggatgatcagagtgtgagctcctcacgcgttcagacagccagacatcctccctcccgcctctgctccttcctcgcgccgtttggtcaaagagccgacctgcttatgcttaatcaatattagtacctctgtttttaaaagataacattgttaactctttatcacatgtttaaccgttcgttttgtttaaaaaaattaattagttataattttattgtaagttgttttatcactcaaaatactttaagtgatttatattttatatatttgtataaattttttttataagatgaatgatcaaatatttgtttaaaagttaacggcgtcatctattagaagttggaggcagtgctattgaaaaagaaaaaaagacctgcgctaatatagagtaattagtgtcgacttggattagttaaccatttaacctgttgttcagtttattaattgatctctctcaatcaggtcggctgttggtgtcaggtagccatcgcgggcatgatttcttattattttgtgtgttggccgtcgggcgcgcgaaatgggatcgtgaggcttaatccaacccacattttgatattcctttttgttaacattattatactagtactggtatatctatatcttaggaagaaggtgcctaggttaatgtgcaggttagtcgtcgtcttggattgtactcccactgtcctattctattttaaatacaaccatgagtttccgtgctcaattttaatcgtccgtcttattcttttttttataattagtattttattgttatgagatgataaagcatgaatattactttatgcgtgacttatgtaaaaaatttaaaaataagacggacgatcaaagttgagcacggaaaatcatggctgactgcacttaaaatgggacggagggagtacatttgtgcccgtgcagttgatagttgacaatgcaggagaggaatcgtcgttgtggattctgtcctaatctgtccatgtaatccacggttaagataaatgcatcaagtacaaagaacagaaagagagagagagagagagagagagagagagagagagagagagagtatatgattctaggatctcttatgtcttcttgattacgacgagaatccttgtggtaaatttgtaccttagttgttgtgagtacctttcatcctcttaaaattaggtcaatctaaaattagcagaaataacttccggatcgaaacatagaaacaccttcattaatactccacatgtgctcataggtcggccggacacaattaaccctaattaaatagggttaataaatacttcttcaaccgcgtcaggctcgcggtgtgaagtttgcagaaaagggcaagttgccaattggggtcgtcatgccttatctcgagttttgatttgctcgtgattttttgcattgtgctactgttgtggacctgaaagagagtggctgggaaagggagagccttggtcaaattgccgcacgttcatgtcaatcgcgatctttcactagattcatgcaaaaagcggcaaacgagtgcatgcttagctgatttttcaattcttaaaaattacttaattctcaggaataattttgcactaaatcacggaaaggttggacaatgaaagcggcgaagaaacacacggaattagttctaaaaaaaagttttaaaacttaaaatcagctttggctttgtaatgctttcatcgccctgcatggacgtgaattcttattattttcgaaccttttgtagtttttaaaataaatgctcctaaaacttatttcaaatctaaattttttggtctaaccacgtcatctcgcactgcttgacaaaacaactctgctacgtctcccataatggctataaagtgggctgttgtctcgccaaatcaatctagctggattgataaaacccttgccacgtgaccaacagttttagatttgaaaataagttttgaatggtttatttctaaaattttaaataaaaaaggtaaaaataaataaataaataatccacggggaagatttcaacaccatctcaaagcagactacatgaccccgtcccatagaataattccagaggtccctagttgacatttcccattgtcgtgccgcgctttgcaaacaagaaaaccccagagttgatggagataaaacgttaagcaacatgcttgacaaattcagatcttaaccacagctaccacttcacaatgttttcaacgtttgcaacagggcacgtctaaaatgccaaaatgtgtcattgctttgcaaaaaatatgaactgatgtcaccaggagactgtcaaaaagacatcgaaatcacctagtcaacaccattctcattagataaaactcataaaagccgaactgtgacatcagtgcaaacacactagaggaattcataattcaaatggtatacgtatgcctgggggaaaaagctagctgggttgaaagttccatgaagggtgtgaacattagtttttgatttgatctacaaaatatgacatggtacaaaagcctagtgccgcctcgctttagactcgctcttcgcgagaatcattccagagagcttatcaacctcgtagagaaatccagcagaaaacaggaagctgcagccaaagttgataaaaattgattaacacattcgcaaggactgcagcaacgggtgcacagactgaccaaaggttaataatatgaatttatcactgtcaaagaactctccaaagtatcaatttctcactgtcatagaactctccaaagtcatggttatgagggtatccacaatgtgtcaagttgcttaaaaaaatgccaagtagcggcgggacttagaccgcaagcataataggctataaaagggcaattgatttgatattttatatagacaggttcaacagaactactagtaacccattctatatgccataattctgaatagcgtaatctgcaaattgcatagcgtttccagtgacattgttgcataaatacagcttttacaacatgtgacaaatccatatttaccaatagcattagtgttaacaatatacaacttaagataggtaaaaaatacttgtgtgaaatacacattactatcttgaatgatatcacattcaacaggatgaaaaaagttttaactccttgcaaacaaaggagtggagtatcttgtttttgcctaaattgttagtttcatttcctcccatctaaacagagcaacagttcataagcaaatactccactagtatgtctgagattaccatctctggataatccaagaattttcttatttagcaaacagcaaacactcagatctatggatgtgttaatgggaccatatagaaaaattctaaatgtccgtagaaagaaatagtaaagtgtcttaaagataacataccatgttgtgatgcaaacacgatggacagtgccggcaacaataagtgcagtaagttccgcgacaacaactgcaaagaaagagacagttaaagaaagtcgaaataaaaatcagggggaagcagcaagaatgagatcgtatgactatacatacctgcaccccatccagttttaactccattagcttcctgatagttgccaataaactgcaaaagtatatcaaattatcatatactaatattaatgttgagaggaaacagttaaaaaagtgcaaaactcactgatcttttaatacaaccataaaaggtgaaaatcaaatgtggataccacctgctcactatgtcttatgtgcttgtttttgctaagttttgttgccttcctaagggtctgcttgcactgttctcttgttacagagcagaaagctgggataagtaccccatttcaaggatactttctttgaccatcagataagactagtagtatggacattggggctgctagttctgctggatgctcttggggcttagcatgcttttggccaaaaccccctttagttctattatcttggctcaaaaggttaaaagttcgaagctccaggttccatacttaacatgccctttgcaagaattatgatagcatcatggaaatactagcagatagcttagcctacatagtaccaagtgagcttaaaattaaatgttctattctctttcagaagccatccttgacttcttgtgtagagagtgaacttaatattagatggtgtatgatatttcagaagctattcttctgtggatatctggaaaactgaacctgaataaactagttccaggtcctctaagccgaaatctcgcttatgcgcctagtcggatattacaattcagagaagcacaatgttactacccacttctgcacagagcaaaactatgttttcttctatggtgtttatcccctacagactgaatcactcaaatgtgacaaaagctacgagagacaacatcttggcaactccatttgctacggggtttgtctaaattaataataaaacgaaaattttaccactcatgtgattctatcacttcaaattagctaaaaagaaagagggacaaacaacggcatcacgagcaaaacttaaaaacttattaaggggtataagatcgtaagaggagggttgggagcggacgattcaacgcaccgtgagaaggaagaggaagaggagggagctgacgaatccgccggcgatggtcatgagctccgacgaggcgaacctcccccggtacatctcgagcagcgacagcgtcaccgcgaacagcagcagcgacagcgccatcgacctcccccccgtgctcgccatctgcaaccacacaccaccacacaccgccggatccaccatggtcaaaactcaagaaaccaaaatcaagaacaagaaacctcacgtcacgcacacaccgaccgagcacgaagccgcctcaccttggatcggtggaccctggggagatctgaggggagcgggaggggtcaagggcagtagggttttgcgcctcacgaaggtgatgaatttgccccgcgacgcgatgcgcccgcgagatctacccgccgaggtgaaggcgaggctgcagacgagaccaacgctgggtggaagatggtcaggtcagacggagtggaggagggcgtggcgtgggcccatgaagggcccactgtctgatcggtggggggagtgtgggcttgacgagtccatcggaaacgtccgagtggcccaggtcgaattgatgagggccatttgggaagttgggctggttcttgtaaaatgaaaaaaatgtttaatatatatttatattaagtggagtattgttataaattatctatgtaactatatagaaatattttttaaaataaaaaaataagtgaccttacaaacagttggagatttttctaggaacatatttaaataatctgttttaacaataccgtaaataagatgtaggtcgtacacttcatgattagaactagttaaatttaacattacaagaaaatgtttggtttttttaagtgagcgtaacttaactaatcaagttttttctagtcgaacccgctcttttagtgagacctatcaattgatagtcacatggtaacttcattaatttcaagatttactagcccattccttcagtttggtactccctccgtttcacggtgtaaatcattttagcatttcccatatttatattgatgttaataaatctagacatatatatctatctagattcattaatatcaatatgaatgtggtaaatgctaggatgacttacattgtagaacggaggaagtacttatcaatagcgagctaccagctcgtaacttcgttaatcttagctcaatatttcaaaaatattcatacggtaggttggtgtttttttttgcacctctcttagccttaggatctgtctggagtttaagattgtaagaaatagctggatgtagccggcttagaaaagctagatttctcagcatccgatttctaggttttgtttggagtagtttaagattctgaaaatctactggttggtagccagccttttagattcagttttagatttctagtttattttctagattctacgagtaaagattcttagaatatgggtgaaaatatagacggtttagggagtgggagattatgtgatgaaagcttcccaaacagctctctaattcattttccatattctataactaacttcttagaattaaaaaaaaagtgggattatttggaagagcttcagattttacgagataaggtgaagcttcgcaaacagagccttaccaccttacacggagtgcatcaagattcgttcacagggacgaagggcacaagcacaaacccctcgtccccgtctccaccgcgacagagagatcctcgcctcccgccgctaactctcggtctcgccatcgccaaaactcagattaggtcggtggccgcgccgctgctcaccggcggatggatcttgtgtcatctcgattcgcagccgacggcgtgttcgtcccggcccaggggaatagtttccagtcgtgcatcgtgcttggattttttttcttttttggggggagttgggagtttgatttagcggcggcctttcctgcattcgaattagagagatgcttgggccattggcgttggagtttccagcctgggtgatctgaatgaacccaatctgcagaatgttctctccctttccggttgccccgggggagggattgatggaatgggatagggtggggggctttattctgatgattttgaatgaactcaagccacagaatgttctacaggtctcaaattattctgttggtctatcgggtagtcttcgatgctgtatgtaattccagttaggctccggtttgagattatttttttcttgcagtaaattggtaggtttcatgaactcctgctcagctgcggacgcgagcgtctgcgatttgatccaagctggggagctcaatcttcggagaacatggatatgcattgttctgttattctcgacaagccgacatcatcgttcttgttcaggggattgactgatggatcctgaaaaccccgatgtttttcgcaggtagctacctcaagagaattaagaatcctctcgtatggagctgtacatatatccactgaaagataattgtgcttctaacatcttcattgtttgtatgttttagtggcttaacaactcattggtatctgtttgtatgtcgtgttaaccatgcagatttattttgtactacaagtttgagattcagagttcatacactatagactatgggtgagtttgagaggaggggaaaagagaagattgggaagatacgcaaaacgaggtgagctattagtacatgattaattgagtataaactattttaaacttcaaaaatagattaatatgattttttaaagcaactttcatatagaaaatttttacaaaaaacacaccgttagtagttcgggaagcgtgcgcacggaaaatgaaacaaactaactcacaaactcctcctgccgaacgctccctatatgattcttggagaaaaggctttggagttcggacaatggtgcataactgcatatttcttaccttccaggggaagttagaagtgacactaaaccaactaaacaatgtgaggttgctttcttcaatactttttcttcctcttgctaatttaatgttccattagcatcatctcatgatagaaaaagaccacaaacagaccagtgtacaattttttttaatttgtatgcctaagttactgtcttataatggattcaaggtccttttaccttttaagaactcccctagagtctagccagaatggaccttccttttaatccaatatacaaaataattattataataatattcctatttgtgctgagtaatgcgtatctatatttattttgccaattaaatacggtttaggattgaaacaacacatgaattctgcattattttctactcttattggcatgcaagttaggtaactgagtaaaccgaccctatagttgtaccatgtaactgtactcgttaatgaatgagatttgaactacactaaactaaaacctatctgcacatggatggtcatgcttttgttcttactgctcaaaattggtgcctgtgggagaagcaattacatagaaaatctttctttacttggttgacttaaataaatcaaccccaaaactaagcaaccaaggtgatgttagaaattggttacaaaagaatggtgacctaccatagatttgcttcctcaagtagccttcatatttggtcaatgcatctgatcaagaaatcaatgggagagattataggtgtgcatgagatgatgtgctgatattgggccagtttggtagagctccaactcctaaatttagctccaggagttgggtctggagtggagttatggagctgcctaaacccagctccacctctctagttcattttgtgagagagagctccacccagctccgctcccatttttgttggagctgaaactgtttggctgagctccagctccagaagaggtggagctggagctggagctgtgccaaacagacccattgtatagttgaatgagggagaagaacctaaaatatttttattgggtggaaattttcttctcagttcgtagtgtgaatatagggtaggatttgttcaaactaaccaaagaaaactttatatctgtggcttaccttcataaaggtgctaactatagtaagggcctgacaactgagttttgtaggattttcacatgatacaagtcattataggatttggaatgtgcattctaaatatagccaaagaatgagctttgtacccatttgtgtatatctatacaagagactacaaattacaagtggcttattgttgataaaatttgatccaccagagtaatgtttgaatgcttacgtttaatatggtaatttccagtcccttttccttatttttgttcagtatgttgcaatacctatgagtgaaaaaagagcatgtgttattctgatgaaatttcattgtttcttgctgacccaccacctaattttggaagtcacttttggaaatttcgagtttgcatctcaagctcatccaaacatgttattggtttagtatcacatagctaattctactattcaggattatacatggaaggtccataaatacgtggcctcttgaggctagttggaacaccagcttattataaagctactcacaaaatgttaatcctagacttccatgggttgtgagttctagtctccagttatagtaggcctgtgtttgttcagtgttggtaattattactacctccgtttcaggttataagactttctagcattgcccacatttatataaatgttaatgaatctaggcacacatatatgtctatattcattaacatatatatgaatgtggacaatgctagaaagtcttataatatgaaacggaggaagtatttgtttcattttatatttctttcatttcaaattattttgtaagcattagcacttttgttttgccttctagtgatcaactactaagtataattttcgcctgtcaaattaggttgaattttagtcacatattctaaagtaccacttttaaacttgcttgcactcaccctcatttgggttttcggactggttgtaattcacctactctcattatggatctctattactttttctagaatttttccatcaacagttcattagtttgccatgcatgacatagtgcctatttgcaatataacgagcaatgtgatcacatgttccaacatatgtcaaacaaatatactaaagatctatagttaaaaaaccaacatataactatccacagttttataagttgtatacacaaccatctaaatcaaccaaatacctaaaaacacatgtagatagtgcattttttaggagaatactgccaggtgacagccaatagtcgcttttaactagtaatatgtccgttcattgcaactgaccatacgatggtggggtgtgggtctaacctaaagcatgggatacaactggtattttttaccatttgttttttatggttttcttggggaggtagtgactcgtgctgtgcgtcatgagggggagggcagacggacgactccacctctaagtagtagagattaagaggcaacaaggattactaaaaccacaatccttacaaagttcgtaaccagctaagactatatctttaagagtctcattcattctgcgaatatgctgaagaatatttttcctaatgagaaaatcagaaaaactgtgactgtgtgactgcgtgagaatggaggaagatgttgccaatagtggagtggtaggtcaggattgaggaggtgaggaggaggtgccaattgatgagggtacaaccaaccaagaggtgggatacaagatattttttttgacatgacgggatacaagatatcaccggtgaactgataatgaaaatgaggattaagtgttgccatggtggcaaaaggaacaataaagatgagaaagaagggcattcactagagcaaaaatgtattttgatgtatcaataggcaaataaagaagggaagttgagaaaggtggtcaatggattggagggcaattttgcaagggcaaaaagggacgaaatcaactttcaagggcaaataaggaatttactcaattttgtatgcttagcccctttcgataaattccttattcacccctaaaagtttgcatatcctcttatttgccccttaatctcacaatggcatgtgggttatgggcccacatgtcanagagattacggggtaaatatgggattgaacttatgtgcctatggcaacaagggatagatgcggttttgttccataaaaggggttgaacccctatgcctagccgcaattcttggtcttttcacctctcaaccttctcaccaaagtaaacgctcaaggatgggcggccgcaaatctccatcaaagtcgacacaggtaatcctccctttccgccaactcctcaacgactgattttggtaattgttgttgtgatttggttggtacgcatgaggtttggtaggtagagatagtcggcaagtatgtactatactaggtaagacctcaattttccatttattcgggagtggtctacgttgacaagtatttaggattccccgtggaaaagcaattgaatactaatctagcggtaaaacgcatagatctagggttagggttagggatggcaattgggtgtgacgggcacgggtattggctacccatgcccacgcccgcgagtttgttgtccacaggcgtgcccgttactctatgaggggtgaagaactcagcccataactgtagcttgtggacgctgtgtgctcgcaggcatgcctatgtgtccgccagatagcttaacgatatggtttcaaaagttcagcggattggaaagagaacattgaaatagaacaaaaaaaaatcccacatgttagcatgaggatgctaatcgcttgatgtacaagctgaacaattactggcaagcacatgcaactagaggcctagttactggtaaacatgaacgaaaaccaatactccattttagatttctagatctgacaacatgatggtcctaatctgaaaaggcaaaaggggaatcgagagaatatgagagagacaatcatcatcgggaggattaaaggatgcgcggatggagtcctggtggttggtcacaccttgcttggttgtctggttgcctccatagtcagcgcatgctgcaccgtccgctgatgccatggatagctgctacctgccgacgcctgggaggaaggaaccaagggcagagctagcaggcagtgcgttgagggaccggctgggtgtcgtgcgctagggtggcttgagcaggcggcaaacaatggaatcttggaatagttgagcatggagacactgtccgcggcagcggcggttgtgggtaatttggttgaggggatttggaagaaccctagagagat

SEQ ID NO: 67711 - DNA, 14595 bp, Oryza sativa
ctctagatctgataaatggtgttatggaattggtagaatattgttgacttgctcttggcctgtttgttctttgatcatcatcaaaatgtcaggatcgctgaatgtgtgctctcatccttgtttagttgttttcagaaggccctcatccttactatcataatttttttacgtgtttatatcttatttcaataaatcattgcagtccagattagcagactcacgagcctgtttatactttattggtggtttgtgtatccttctggatactgtattcttgtaacttaccttctctttgtttagttcctctatttcacaaggaccttaaactatgtctgaaatcaaaacaaagtgttatgaatcatgctgttgaaggacacttttttcttgttgttattagtgctctttagagtagtgaaaagcagctttgaatactagctatgatttattatttaagtctatattataattaaaatttgatcctattattttgttttggcacaaatgcatattaaaatgtcacaattataggttaacttatgtcttgttactttttcagtcaagcagtagtggtgccagatcaaaccttccagtctcaacaggaaagccgttgacaccgaccttttctggtcaatctggatcagtttcaggttttcgtcatcctggttagtgacattacagttgtttattttgctagtccgtttgtgcatgttagaaagtgatgtttttctaaaactaactctcacgaaaaacttggaagggttgtatatgggaatctcaatcttagaaacatgtcaggttcactagcaccaaggggttcctcaatgactggtagttcatcccttggggttcaaccacctaggggtagtatttctggtgcttggtttcctccaaatagtcttcaagcatccatttatcaggttcttttttcctctcctaagctcgagtctgtttatgaagctcttctaatccagctcacattttctttcatcctttttgtaggtcgggtatcctgctctcagcaaccgaggaggtatgcatgttgggggaagtcctgtttttactggtaacatgagtgcaattgatggttcaatacaagcttcctcctcgtacttgactaaagatggtaaccacaattctgctcttggattggcagctgctccagtttgtgggaattttggcccgcgaataacttatgtggctagcgttgcgggtgggggcaacattgggagaaccataagctctgccggaatgtctatgcctactgttgcatcccctgtgaatttgtctggaagtggggctcttaatatccgaggatcaaaccaaatgggtggtactcatcaacaaggtatatactaaacatataaaccccttgtataaatgcacgcgcatatgttctcaatttgtctttctttctgatttgataatgaaatgatctaaaataaataatattaaaaatcacatactccctatttttttatatgacattggttggttcaattttgaactagccaacgccatataaaaaaaaggactgagtattaagcctatgaagtacactagtcatctggagcaaaaaagaataaggaagcacatatttgaccggtacctgatctggggaatggaagtgttaattgggtccattattaaagaagtacaccattctgttgaggcaatttgccatagttctgctagctgttatttattctgtactgacatctcatccatcttgttaatgtgcttattctattacatttatcaatcaaacgaagcaactaaaacgtgtgcagaacttactgtgtttagtaagaatgtgaacgttctcatttcttatatataaaagggcagttttgtttcaaattgtttatttaccaggattgccggctatgaatatgcttggaagctctagttcagcacctggaggaacactatctaagaaccaattgcaggcaggaagcagttcgtctggttctccaggaatgcgacatgatggtaactttggtgaaaattctctatttgacatcaatgattttcctcaattagttgggcgacctaattctgctggaaatattcaggggttatatggtaatgctgacatgcaaactaaatattctgaatgataatattagttaactaacttttctcctttataacaaatgaaggacctctaagacaacaagcatttggtattaatgctgttcagcaaaaccaggaatttagaatccataatgaggacttcccagctttaccaagattggaaggtactcttactctactttttgtttcattatttaattctatatgttattcagacagttccttgccaagtacctcatgctataggtttttattatgtcttggtactttgtttgaacattacctcatgctctgaatgtaaggtatggagttgcatcgcaaggatcatcttcctaagaatgcaaatattatgcaagcacaacattatcctgtgagtttttttctaaaaaaataaaaattgtaattccaacaacagttttatctccttttccttaaatttccgttacatgtgattctacagatgggcaaatcatctggctttaacacgggcagcagttgtccaccccgtaaacaacataagcagacagctaattcggtaagttacctgtattatgatttcttttacctcatgaccagatagtcaagattgaaaacaccaccattggtgaacacgactcttttttgttcatgtaccttttctttatggggaatagtaagtaagaatcctacaaaataattggtagcaggtgcctgctgagcttttcaaatatggactgaccatactgattgtgtttattaggttcaaaatactgggcctgaaaatgttggaccaaagccagtaaattctccaaggttgcctttaaatccgaggcctcgtgaacaagttatccagcaaaatcatgaaccacaggctcagaagtcagttaggctgcagtcatcttccggcccagagtctcacaaggttcagagtcccaagtcttctcagagaactgataccacaccagagtcttacaaggttcagagtcccaagccttctcagagaaccgataccgcaccagagtctcacaaggttcagagtcccaagtcttctcagagaactgataccgcaccggatccatatgatccatatggcttacatggactactgagggtaatgaagttgaaagaggagggaccggcatctcttgctttagggattgatttgacaacactagggttggatatgaactcttcagataatctttacaagacatttggctctccttggtcaagtgagccagttaaagaagagtattcttatgaaattccggattgctactcttctatgcagcctccacccctgcaagtaaggccctcaattttcgagttaccttcttttttctttttgtgagggaatgtttaggttagcattaatcttgttgtatctgacattacgatttatcttcctctgcaggcgttgcattttctgaggtttcacctcatgacactattctacatcttctacaggtacttagttcaatcaacagtgaattcctgtgttagtaggctatgcattatttgactgtcttttgtgcagtatgccacaggatgcagctcagttatatgccgcgaatgaaatgtaagcacaaaaccacagttctatattgttttctcatttgcctgtcattttcagtaaaacgatggcctggtatgccagatagctcagattgttgcttccatttcttcagatgcaaatacgggtgggtttaccacaaagagctgcgtcagtgggttaaaagagctcctaatacgacccctctcgtcaaaactacaacttatgaacaaggactctgctatctttttgatgccaacatttgggatgcaattcctaaggtaaacgtccgaaagaaattctgacagatattttcagctttttccgatagcagaagaaaatatatctgaaagttggttgcaggacaactttattctccgttatgacgatatcgagaagatacctgcccttcctccccttcttcctgccacccaaaatcctgccacccaaaatggtagtgtaagaataaacaaggtcagatttgggagtcccaatagacgttttttttgtgcacaatgtcaaaatagtgtcataattatgattaaaaaaagtgccataattcccttttctgatgtaagtttgcatttgcagccattgcagtaggttctccgtgttgaagattagagtttcatggcttggatcaattgttggtattattaaggtacagttaactctcacaaaatgattctgcaagaacttgtttagttctatagtaagttcagattaacttacttggtggcctaaactacattaatttcctctgaacagggtatgcatgctggttctggggatcggagctcctgcgatggccggcgtttgtggtagctgcgaaataccgcggttcataattcgttggctgcaatcagttaaacccatttttaagttttgaaacaaagttgaaccccgttttaattatgtttcggtcttgtgatgactgaatgttttgaatgtttaaacctgtttttacctgtaccgtaccagatatgtcgtttaaacttatcaggcaccgacattttggatcttgaatcagctcctgtcctgtttttttttttattattactttgataatttttggtcaggtaaaattttgccatgttgtgaacttactctctccgtccaaaaaaaaactcaatctgggcatgaatctagccatttccttctacatcctttttaggttgagtttttttggacgaagaaagtatgattcaagcaacagacaactggctagtggtaacgatctgacaaggacgacacatcgccgatgccgatggtggtggtcaggtaaaagttgccgtattgggtttggctcgcgtgctagtggtatgaatcgagtgctcgcgcatggacgccttcggctgcggcgagctcgatcggccaggcgctggtggttgtggatggcctgacgctctacgcgcgcctcggcgccggcgccggcgacgacctcctctccggcctcgccttcggcgcggccgacgaggctctgctgaggatcaagatgaacaccatcatgtcatgccggccgccgctggaccaaggtgatcaccttctcctgcaagctgcacgccgcggatgcctgtggcggagcgaacagtggacacacaagaggattcttctgcacggacaccatcttctcgttcgacggcaacacattctgggcggatctctcgcagggcttcatgtgctgcgacaccgccatcgtcttcaccggcgacggaggcggctcaccaccacccgtcgatctcaggtacgtcagcctccacccggacagtagcggatccaaaaaaaaaaaagcaggtggggctgaataaattagataaaatttaaacctccattttctatatatgtggagcaaatagttgtagaagagctcaggtggggctcccacattcctaacgccagtagtgagggctgagatcccttagcggggccctatgtcagatccgcgtctgccccgtagtacctacttctccacaccttcaaatccgagaagcttggatgtatggagatgcaccacacctaggcatcttggacaacttcatcaaactcgtttccgttaacaccgcccgcatcgctgttgccgctgccacaacgaaagaagaagaagacatgccatcgtcaccgtgccacgccgccaccgaagcagccaacgcgacggtggccatatggactctggacaaatcagctgatgagacttgagacacgctcgacatgaggagcttatgggcgtaggaggactacaagacgtcacggttgccccggatggtgctcacgtggcccttcgtgaggctgcgggaagatggtgttgttctctacttcttagggcctgtttactttgttgccaaaaaaaaccttacaaaattttggcaatgtcattttggcaatgccaaaattttattaactatgccaaaattttggcaggatttcttatatagttatcaaaatttggcagcaaactaaatgtagccattttttggcaactttaccgaaatttggtaaggttgaaaatggcactaaagtgaacagcctaagccgctcaggacataaaatgacccccaactatatcacgtttgcaggattgacatgcacagcaggagagttctgctgtcggggctactctctcaccgctcccatatcattcatcaatcggttgccttgcctgctaatgtcttccaacatcttaggatgatccaatgagaagccacccatgtggtttccgcggagaggtgtggctctcggtagctgtcactattcgccattgtatattgttttttataatggaagttttattatctcagtaaataatataaaattattccgagagcatctctggcgtatgcacccaaagagtgcacccagccaacaagaaagaaacaaaagataatatcatcatccaagacaaccgaaaaactttaggaactctctaaccgtagcctagaactccacccatgtgctagggtagaaaactccatggccactaactccaattattggcaagccgcagtgatggtacccaacaaattgaccttctggagaatagcccatgagtagagcctatatgtagtaaaaaaaatataacctataacagagaagatatgtttttcatttcaaaacccacatcatttttgcaaagccaaatagatcaaatagtggcagttgccccaaataagaccaaatgcctcaaattgtgtagttgtcttcttatgaaatgcccaaacatatgagttatactattaggtaaactaatattcgaagcagattggattaaagaccaaaccgcgcaagataatcaaagaataaatgattaatagtttcatctttacgacaaaaagaacaagttcctctcccattccttttaatcagattatcttttattaaaactactccctgatataagtaccataagaagatcttaatctttaatctttatggggctttaatcttccaaattctttaatttatattgggaacatcggtatgcaccaacacaagatatagagatttaaccgaaaatctgtcatcagtggttagattccatttaaactcatcttggttgtgagaaatataatattagcgatgtgtgagagaaggtgattacacgccactaacttagagccagtaaggtccctgcgctaagaaaagcttagcagactagtatggaaaatttctgaaatagttgcatgtttatgcctaacaacattataaagacatgggtattgttctattaaataggcattccctaactatttatcttctcaaaaccgtacttgagagccatctttgatgttgaaagagtcaaatatgtgaaaatcaggcttagccttcattagactagcccaaaagtgtgactctcttgttttccaatgagaaggctgtgactccaaatattttttccttagcatttattgccacacaccatctatagtgagtagcttatacaactacttactaaagagaatcttgttcttaatttcaagatcttgaattcccaacccccttgatctttacgatgatgtctcaccttgctagtcggtatttccttttgtgtccatcctcttgccaaaagaaccttgattgaaaataatcaattttattgatcactcctttatgtatttcaaaaaagaacatcatatatattgataggctgataatcactaaattgattagtgtcagtcgccctctaagtaataaaagtttgccttccaatttgccagccgtttctcaagccattcaatcacctactttcactccgagctacaaagtctcctatggtgtataggaatgcctgtatattgatcctgagctgtttgtgtttctttttgtacgatataaatgaagtaactaatgtacaaatattgcggtgtagtaactactagtaactagcaagtgtactgtagttattacaagtttaagtctacaactaatcatgagccgtggcttcttaggaattcgcaaccagaattgcaaagaatcggagtccctctcggttttaggcaaacggaagaagcgatcgatcgcctttggaaggccggatccgaattaatcccatattattcgcctttcgcttctgcttgctttccgatcgatcaccgaggcgccgatcgatgggtcgtcggcgacggcggcgcaaccgcgacgccgagttcgacatggcggagatcgaccggatggtgccggtgatgaagctggaccggacgaggcagccatggctgaccgtccccggccgctcaagctgcacctgcgactgctgcaatgtgacgacgaagaagaagccgtccaacaaggctctcatcccggcctggctattccgatccgacgacgacgacgatgatcaccacgaagaatcagcagaagaggaggaagaagataatcagctgcaaggcctgaataaacacttagctgaatatcggattggtcaatatgagattcgtaagtgcctccattgcaagcagcaccaaagtataaatttcttgttcataatatgcaagtcaaatattgggacaggattctaaaccctcgaaggatatctcctcgtgtaactttttcttttttttcaaattcaatgtgaatgtttgtattttttttaaaaaaaaaacttgacccaccaaagacaaaatagaccctgtacatcctgtgtagaataaaaccttctcacgcaggtcaagaaagcccttgaacccatgccagcccttacacaatggcattggagaacgaccaacaaccgaggcctctagctgtaaaaattgttagcaatgtacattatagtaacttttatcaccaccaaaaaaatataattcaaattcgatttacatattgagaattaaaaaaagataaatccagagcactttgatttgattcttttattcctagatgggtgatttaagttttaacttgattttatatagagtattttatatatacattattaatgttgtcgtttttttataaaaagatttaccaactatttatatgatgtttaaacaaacaagattatattccctcaaatttaaaacacttgccacatactccctccgtttccaacatataagcatttttaactttgaccattaatagtaaaataataaaaaaagatcaatcatgtaaaattgatgttactagatttattattaaacatactatcataatgtgcaactcttttaatttaaaataacttttatagatattgttagtcaaagtagcatctcggagactgtaccagagtccaaaaatacttatattttaggacaaatggagtatatgaacatttcttgtcttgcaggaggagccacgataaaacgatacccttacacagatggctacgagctcaccgagaagctgaacgccgagctgccggccggcgagcggcgctacaccccgaccttcgtcctcgagggctcctcccaccgcgacggcttcttcggcctctcgtggcactccgagtaccggatgcacgagacggcgccgacatcgctgccccgctccaggttcaccacccctcacccccgctgggactacgaagccgacaacatgctgcagctctgctcgctcagcctcgccgccggcgccggcagcggcggtgatgggcggcggctgctcgtctatgggatcgtcgccgcccgcgacgacatggaggggctgcccaactttgtgttcaaccggacacgggacaacgcccaggaagtgacactggtgagtgacaatgttaaattttgagtttgaacaggatctatcttggctgaatttgaacaaattttaggaaattcaaacacgttcgatttttttaaaaaaattgatttgtttggaataattcagagctctcctgcactggagctgtcatctccactgcgcggcatctccgcgttcgagcatgtgttgctcgagttcgacctgaagctgaagacccgccggcgacggcgccgacgctgacgccgacgacgtgctggtcgacgcgtgcaaagagttcgtcgacaggacgatcacctgcagcgccggcagattgctgaggtcacgcatcgagggcccaatctgctcgctggacatggactacatgttcatcaagagcggcgtcgagcccgccgtcgaggtgttcctgggcgactcctgcgcgagctgcttccagagcgtggctgccgtctaccgcgccatcgccggcgacggtgacggcggcggcgacgggattgtcatccacgaggagtccatcccgcttcctccgaagctgatgctggccgccgataccgctactgctcaggccgccgcggtggcgacggtggtcgccgtgccgtcggccggcgagctaacggtgacgctcagcttcgccacggcgaggcaccgcacccgcacgtcgcctccgctcagctatctattcgctaggtctatacccatatgagaaatgcagttgtacggggggtcgtttcatgcttaacttcatggctcggttcttaattgaccggggacggcactagccttttccggacaccacccaaatcctccgtccgccccagtcgaaaacagttgtttaattttatttctcctttcacaaatcatgtcatcaacatcatggcaatgtggcgctcatgtctccacatgccgcatctcaattaccttcccaaagataattgcccaagaatatagcatttgataaatatgagtatgcatgattctagaatagcatttctaagcaattgtcataattgactagggactcatacgtaaacatggttacgaaggcataaggggtaaacaataatcaaggcatggcataatcacaagtaggatgttcatcattgcatgcaattttatttgtaaacaaaataatttcgcaattgggatcaacatgttcaaagaatagtgatgacttgcattgctcgtagtcctgcgggtcttgatcctcgctcggatccgcaactccctcgggtctaaaagtacgtgcgaagaattgatttgaattcaattagaattcaaatgaaatccaaataaacttaaataaaagtcgaacgcgaatcgatctttctatatcgactacaaagtttgcaaaaccacttcattccaattttaagttcattcatcctaagtctttttttttgtgatttagaagtacattcctaataattcaacataattatttagctcttaaataaatctaaatttctaccacgaattgattttgtatagagattaccaaaatattctataattatataaaattttgtgattctacaactaaaagaaacctacaactaaccccaattatttaattttccaaacctccttaatctctccctaattttctatttatttttcctttttcttcttttcaattcttttttttcttttctttctttctttctttttctctccctcccggcttctcccttcctctctctctcggctcactgcctacccggggcggcggcggcgaccgaacaaggggaggggcggcggcggcgcaaggcgggcgacgcacggcgcggcactccacgcggtgcggcggcaccgagggcggtggtgcggcggcacgaagacggcggcgcggtggagaggaaagaggggaaaatgggggaagaggaggtggggtggtgcggggtgaaatggcgaccggggaggggatttatagggcgcggggagaggtggccggccctaatggcgacgcgacggcgcggcgcgtggggcttgaggcggctacggcgacgggcgcgcggcgcggcaggcggcagcagcgacgcgacgggtgggtggcgcggcgcggggctcggcgcggcttggcacggggctcggcgcgacggcaacaggcgacgcgacggcgacaggcgacgcgacggcgacgcggcgcggcagcggcgcggggcgcgaggcggcaagcgcgtggcgcgaggcgacgggagtagagtaaatagaattttagcccaaaatatatggcatggaatttaaagaattagatatgggctaaatgaggttttggatttcgggtggagggataaagtctattctcttagcacaggagcaattgttcataataatattattctcgtgctgagaaggaaatcaagccacggaaattaaatcggcggctagatttaaagaaataatttggatcgagaattttaaaggatgggtcgacaattaattccaatgaaattggaattgcttgggtttaggttcaaaggtatagttggaggatttcttggaccatgattcataaaagtaaaaaggatttttaaactaaatttaaagaaaggaaattttggtcgaaagaaggtttaagatacaaaatcaaatcaaagagaatacctcgatttaacaagatcaatttttagaataaaaccacgaaagattttaaataccaaagagggattttatacaggttagttttaggaggtccctctaattataatttcttaggtttaggaagttattaagaacataagaatcggcatgatgcatatttagaaaatagcaaattttcagtatgttacatgacgcgacggcgcgacgggacggcgcgcggcgcggcagcggcgatggcgacggcgcgcggcggcaggcggcgatgggacagcgcgcggcgatggcgacgcgacggcgtcggcggcgcggggctcggggccggctaggctaggattacatcaagcaccttgtaggcaatgaatagggctagatccttattaaccctaatttagtctattttctatttaaatctcgccctataaattctaacttttgcacaaatcaagtttactcaatatttgtgttgctctaaccaaaagattcgccctagattaacattacacatattttatttttatataaattacttgaatttaattaaagttaattcttattccatcgcacttaaatttaattgatactaatatggtcgcgataatatttttatttattaccaacctcacttaatctttattttaaattatattttaattatttattttgccagtttaattttagggtttattcctaattaattattctttattcgcgatcaacgaactccgaaatcaaaatccaatgaaataggtgaataaaatcggcataatgcaatttgtttaaaaagtttttgaaaatccgtatttttagagttttgattttattggtcgaattttcagggtgttacaatagtacagcccactactaaggccctctttgtttaggcttaggcttattggcctagacttttaagtcagcttattggcttatatgatttataagacagtggatttaatgtcctaagtttagtggtggagtcatacatctatctcataaaagccaaaaaagcttctccaacctatcttttggcttaatagtgttagagtggcttatggcttcaaaaaagccaaataaaaaaaagctacttgtttgttttgacttagacttttcgacttataagctggcttataagcctaaacaaagaggacctaactccaattcatttatagccaatctaatagccaatttatacaatagttgcttgctatactattaatatatggtcccacctgtcatacacacattgcgtcttagagttcgcgctgcagctggctacagatctgtagcccgctgctcttctctcatcttttatctcattaaaatgtttacaaccggctaataatccactattgtacctgctcttagtaggtgaatatcaggctaaccagatgtgtcagtaaacatcgaatggtttatatatatacaacagcattactgtcctacagtgccaaagatttgatctgaagggcactgctccaaaagcacctacaaattgccaacaactagccatggatatatgctttaccatgtacagtcacagcttgcgccattacacatccggggtgaagtgatccttgtggctgagaatctgtgcatcataagccgcaatggcatcaaacaccctcaaatggctgatcacctgagctccacaggcagcatactctctgccctcttccatctccttagggagatcatcaagcaatccttgggtgaaatcccttggagcgcccccgtcgtagacgaagtagcatggcttcacagcaactttctccaggttttcacgcagcaaatgcgagccgccgtttgtctccagtatctgccctccagcagctgcaatcaggctctgtatgtgttgtctgtcgtcagggtttatgtaggcactgaggcaaaagttcagtcccgagaacaacttctgtgcctgaaagcatcgcattatcatcatggagattgttgcggcagaaaatttgctctaaagaatgaaatgtcgtaagttgcaacacaaagcaggtggaatatatggagttatgcactagatatatacaccttgactttgaacagcgatatgtaaaaagtatttttatgcaatgttgtacccagttgtagataggcctgtaagaaaatattactgggaaatatttgcaaatcaaattcctaagcttatacaagtgacagcctacgatagttttcactac

SEQ ID NO: 67712 - DNA, 12053 bp, Oryza sativa
aaaacataaatcatgtttaccacaaaagctggaatggaagagttaacttcataaatgtagcaaatcatccactatgttgaattatccatgaagtaggattcagcattgtttgtccgtatacttgttcaccacaaaaaaagagtaatgtttgctacttctcacttatcctaccttctcggattcacttaaagctgaaccaagcaaaacccacagatccgaggggcaatctctttctgtgtaaaggtgatctgtttgcttttctttcctgtattcgtcagtggaaattccttctttgtccaagtattggctgcaatgattaaatacaacacaaatttatggaatgcaagactacaattgatcaaagaatcaggaaccttaaagacatctaacaagaaaggttaggaaagattgtgtacccctcaggaaaggaagaacatgaagtgttaagttgatctatttcccttttaggaacagcagaaattccttctttggctgaactttgtctggaacaacaaaaggcaaaagagaatgttgtaggtatttactccgtattagctaattcataaaatgattacaaagtaactcaaaaggcaggtgaataaaggtcatatacccttgagacaaagaacttgatgtgttccattgatctattataggatattcccattcgcaatcagcggaatcgctttgttcaattgacgattggctggaacacagaatcaaggagaaaaatacaaatgaaggatcaatgattaatcaaataccagagcctttgtataaccttccaagaaagcaataagattgaataacaatttcttattcatggaaaaacctctgagggaaggaagaagaattgccactctcatttcttggcgagcttatcttatcacatggtagtggcatcgttgcatgttcagggcacataacacaaccgttatcctgcaaaatgaaaattagcatctcggagcttagaacattagactattagagtggtgacgaatatcacaaacaaaaggatcgattacacaatattctcaagagcttacaacatcccagcggcaattcaaagtcatcattgcacatggaacatgatagctcctattgcactttgtataataacacccaagagctgctccaggaagcttgcatcttttgcacttcaatttcgcggcacgttttatttccaactccaagttcacaatggtatcaccttcgtaaaatacttgcggggcccttcgcaaaagaaaaaagtagggaaagacaaacaatttacccaagaaatagtcctttgagagtaactagctagtgccaactgttgcactggaagaagtaaatatagtttataatgtaaagctaaatatactaaaaataagaattgtctccaaatctagaaaattgaaaaattactacatgagatcaatcaaccatctacacatacacatgtgcaaacaaatcaactttttgcagaagaatatatcatgcaaacaacaaaattatgatgggggatggagggagggggatgtagaacgcaccatcacccctcaactacccactttaataccactccagccactggttatttttattaggtatggttagacttagcacgtctcaaacattgaataggctgtttaatggctaaaaaaaaatatcatgtgaatttactttgaaataggaatcaaaatggtaattcttgcatgccactaaaactatatatcatactgactaatatttggacataattaaacaaatggaatggttgtcttataaagcaaaccaataaggtattaaactaaaaaattatacaagggtccagatctcaacaaataaaaataaaaattgtccagcatccttgtatcttaaacctgcattggaagcgcatgatgataaatctaaattgtggtgaataagcatcaagagttgaaatatatttaggaacttaccactccaggcatttcttatgaacataaatgatatctgttgggcatggactgccattgtcactggacacaagctttcccttttgataatgcgccattggaccatgaaactgaaataggaaaagtgaggacctttagtgtcagaaatggttaagaagacctcaaaacataacctctggttaatagatcatggttcacctgaggaggtgttctaaatgaatggcagaaaacgcattcatcttcaaataagttgattggcgtttgcagtctcttcaatctagtagcacgtcccatgtcttttgacatgccatcgttgccatgttttccaggcatgttgttttctctatcagaatgttgtcgagtgttgcttaaattagaaagaggcaatgaaacttcatttgcatctaccgcagctttctcatttgaaccctctgcagccaatgctgtcttattctataatagaaaaaatgtatacagtcaaactgttgagtatatgtgtagatattatagaaaaacttgatttttcttttttgcatgaaccaccacataatgtgtaggtccttgtccttgagcatgcaaatctgcaggactgagggaaagaattttacaagagatctgggaaagacaactgaagtaccctaacaagacgtgatttactcagaaagatgctttgcctagtcaactaattgctgttcatatgacttcgttgaagaatctcgagattactgctgtccctttctccaaatacgctgtcagccattgtgctcatgatctacaaggcagcatgagagtagggtgaagctgagagcagcagctggacaatattagtcccatcattatttaaatagctcccccagattaattgattaatcaaatcataagtagcatatccctaactttttcaatagtcttgtttgtaaaaacgagatcaattcaagttggaattacaaaactcgtcgcattattaaaatccaaactctagaccatttgcaaagaaaattcattggcaaacacatccctgcctttagcactttactaggaaattcaatttgcgtttatatgtccgttgttacaatgcaaccctgattcaggggcaggacaggagtaatcatgcatctcttactgacaaaaaactagtaaccatctcgcaccattcacagtggagttatattccaatgatcactgcttaaagttgtcgaagcaatcaagcgaggaggggttcctgggaggcagaagagcgccaaattttggacttcgaaagggggcaaaacgtatagcactgctaattctgttgatcattgtagcaatagtacacaaatatatatgcagctaatgaaatgaatgcagcgtgttgaatagactcaaaataatttgtgggtaaaacttttatatctgttcttagcaatgaaatgttttgctgtgttcttttgtaagagtggcagatagggagaagggttccttcgtttttcgcgcgcgcatttcccgagctgctaaacagtgcgtgtttgaaaaatatttactatagaaaagttgctttaagaaattatattaatatatttttcaaatttaaaatagttaatatctaattaatcatgtactagttcaggcgttcagcttgttttacgtactgtatattccaagtcttctcctttctcctcagggaaaaccgttggaaataaactatggtgagaaccctaaaatcaacaccaaaattaggttacaaaatttaaattcggggaagcgtaggtacccgcagcactacactaccgtcgtcgtcgccgccgaccatctgccggccggccacaccggagatggtgggtgggagggggagacacgtgcgagccggagggtcagaaatagagggggaaaaggaggggaatcaaagcgctcacctggtcggcgatggcgctctccgcccctctccctccccctcccccttcctccaccgcccggttcgcgcgcgcgatccgccgagcgaagcgggctacggcctcttcgccgccgccgccgccgcctccgcctcgggcagcgtcggcgagcgagtgagcgagtgagaggagaggaggagaggagaggaggagggcgcgagagacgaggcggtttgagaggagggagacgagacgaagcggacgttttgcgtgtgagctgagtggagtagtgcaggtgcctctcgagtgtcgacgacgacgacgagtcgactcgttttggtctctggacgtgtttagccctagcctagccgagacgatgcagttaatgcagccgaagtgcggtcacttcacagtcagttcacttcgctttgctcgctgtctctctcttctcacatccaatgagatccgaatcctgggcattattgtagaggtttattgtttacgccttccgtcccatgaaaaatgagaaaataaacgtttagctatctttaaaactggatttcgctattatgtcatcctcaaaacgtaattcgatataatactaatctcgagcgcgcgctactcgtcgcattgccattttcgccttttcatgatttccgaaatgttttttttgctgttcacgtggtgatcagacgaaaatacccctccggcttgccttttcttcatctcgcaagtgaaaggggatcgagcatttctaaaaaaaaaaaaaaaggcctcacgccctcaccgccgccggctgcttcttgcgcctccctccgttggctaggaggggccacaccgccgcactggccgaagcacgaaaggctgagggggttgtgggctcctcttagcaaccgccgtcggtgacagcggcggaagtggcttcttcttcggtggtagtgacagcaaagcaattgttgggaggaccgaagcgacgcagtggtggaagggggagttgagggcagcgctagggatacggaagtggatgcacgcggcggtgagcgcgatcttgccagagccatagtcaatgatgaggttccgtgcgatgtcgtcgctactgacaaaaacatcgcccatgacctccacctccacacgagtagagctcgagctcgagctcgctaaagggtgcgccaagctcgcagtggtcatggcgctctagctcatccccgcgcatgtatcttcagcgagctccgcgtctctgctcgaagctgcttcgtccctgcgccactccctttgtcgaaacacaccgctcgcactgccaccaccgccatgccgaaggggagagagagagtgggggaagaaaggggatggggaagaatatcaacgccgtagggtgataaggggcagttccgtcttattacccagcggaggagccaaaatctttttggaaatgaataaaatggtgaaaatggcaaagtgacaacagatgcacgcttcgtattggcattttatcgaaccgtgtttttggggtggcattctagcgaaaccgtgttttgaacgtggccaaatgttcattttctccatgaaaattatggtccaactatgaatttgaacacgtgtgtctatatttatagttaagattgattttttttaatggagggagtactccctccgtccataaaaaactaacatattggatgtgacacatcctatctacaaatctggacatccagtactaaattggttttttatgagatagaggaagtatgtgagtataacagtggatcaatgtaatgaataccgtcgatttatggtatctacaataacatgaaaattgtagcacacttttatttagtgtagtaatgatgtgtttagttcacgtcaaaattggaagtttggttgaaattggaatgatgtgatagaaaagttagaagtttatatgtgtaggaaagttttgatgtgatggaaaagttagaagtttgaagaaaaaattaaatttagagctaaactcggcctgagatatataggccttatgcccttgatcggatggctgccaactcccataatttatagtaatcatgttgatcctctgccttacaacgtctctaatgcagagtagcatggtccatcgtaatacagttagtaatatgttaagtaatacttccttcatcccaaaataaagggttttagaatggatgtgacgcatcttactactgtaaatttgaatagacatttaaattcttaagacatccagatttgtactattgtgatgtgttccatccattcaagaacctgcatattttggaatggagggagtacttcctccatctgaagtctaaaacatgcttcttccatcccataaaaaccaatttttgattgtgtatcttgacctagatacatagtcagtagttgattttatgggatgaagagagtatttactattttttaagcaagaccaaagaaaaaaaattaacttatactaagatgcatactgttaatgccctaaaattaacttatatgatgcatgctgttaatgccctgaatatgggatacccaatacttaatacatcaaatacgaaatcaagtctcatacatatagcaaaaatcctggataaagaaagagaaatatctactattataaaaattaaaacttaaagatgtttttactggtattttggtacgtcatccgtatctgagtcaggttttaagttcgttcgtttttggaaatacagatgcgtgtttgagttagattttaagattgttttccttttggaagtataataggagtcgtataagaaatctttaaaaaaactcgcatgctagcatgagatgaaatacgaacctaattgtagctcatgatttcctgaaaaaaatatccaacgacttcccacagtgaattttatctaactaaaccgtaaacaataataaaattaaaatagcatttacccgttgcaacacatgaatattttttcaagtaaataaggaaagagaaataaataccactcggacactacaaagtctagcctgtttgaagggaacgtactttagctttcctgctacccgttcgcaaaaaatggtgaaactttaaaagtcaaattcgcttttaacgctactaacaggatttcaaaagcctatatttctgtagagaatataatacgatgggatttctagggccgtcaattcagaacgagcattcagatcatgatacatgaacaccaatgctctttaccgaacaaaacacaagaggattaaaatgccaagcagcatcaaactttgctcagaaacattaagccaagtcaaatctcgtaatagtaacacaaccaaagaaaaacatttttcccacatagcatttcaaacttcatgacattatctccagtggcgatgttaaaacattttggcagtagtgctaatttaacagaggttctacagggtagcttttgatgagatacgatttagacagccggcgagaaccaggcgaccctttcctggggatcaagaaatcttcagcgctttccaccaccaccaccaatcttcgggcccttggaacccctcggggcggcacccttcgactgcgacttctgggacttggttacctcagccttcttcgccttcttttcatccttggtcttcttgatgcgttccttgatctcactgcacaatgcataagctcagatgaatttagtcctttagcatcatcgaaatgtatatcggaggattatgcatacacaagatgcaataggggattatgcatgaatatgaacagagagttcactaggagcagacatccaataagaatgggtagcaaacatcatgttgcaatgatacagtgagctgtgcagaacaaaggcagcaaacgaaaacactgcttgagaagttaagaggcaccgcatgaggtaagggctaatgcagtgaaaatgaaggcaaaatgtaacccatatagagtggcaatgttctattccatgggtggatactttgttggaaccagtaaccagtctaaatggcaatcattcagggaaagagcataccgaagagcagcttctctagcagcatcacgaacttcaggcttttcagctctcttcttttggatgacttccaacgaagcaccaacaattgacctagagtatggcttcttggtggtgcggcgcctcttcttgacagcttcagcatggatatcctaaaaaacagaaaattgggaaagggtgtaaacagaatttatctgatcggaagcaatacatagcatgactaactgtacatatatacaaggaattgagcataagctgacaaagagaactacatggcacagacataaccaaagtacccaaacatacaatatttttatctgcacgcaaacactgcaaggcgcttatttgaagaatcaacatgatgtttgcacagtaaaaaaaaccgcaatcttgaatgtagacggtcacacttaatcatacaaacagacatttactggaatccaggtttgatagcttaagaaacaattaacttagcatttcaagcacaatacaacattacaaattttaagcattcggctcaacccaacaaatttaagaaagcaacggtcagtgaacaaaaaaaaaagggttaaaggtcatccagttagagtatgtgcatataggtgagaaaacgcccgcctaaatctagatacaataccttcttgtgctgcttcctgtacatggctgtccaggtaagctttgcaggcttcaggcggttgtggaagtagcgcttgcattttgagtttgcaaaaaggaagacctgtacaatataccaatacgtttacaacaaccttctaagcagagaaatatcctgacattaaagcaatcattcgatgaacagcctgacctgtgaatcagcacgaataaagcgaatgcccttccctggatatatcttctggccactaaaacggcaaagctctgtcctgtaggataaaaataaaagtaatagttgaaataccttccaaatatgaaatagtactcattggtaaatcattgctattaaccttttactaccattaaccaaaaaactacatagcctagagcatgcacaggataaaagggcactaaaacaatctacaatcatattgaaacaacaaaatatacacaggaacttacttcagcaccatcttctcagcttaaatcctcacagaattctgccaaatttccaacatcaaaagaaaaaggaatcaggactagaatccagaaaacaaaattgtgcagaggtaatcatggaacattaaaaacctacatcaagatatcgacaatacacagacagggtaatcatctcaaattttaactattaaaaatgtagggattctacaggcagtagaagcataatcaacttagcttagctcctgctgcaaggatactaccctggtccatcttgcacattaatcaactaggctactatgcaatcacaaaggccatagcacctgagtgcgactgtgcgacacacacaaggttcctcaaatgctcaaagcactcaagagaaccagaaacattgcagttcatacgcgcatcggattaccatccatgactaggaatccagaaacccagaaaggggtgaactgtcgggtgactactggcagaagaaacatgagacaaaccttccctgcaaagcgggttccctggttcatatagcacacacaagaataggctactacgccatcacaatagctatatcgcctcagtaccggtgctttccctcgcatctaacaaatctagaatctatcaaagaagcgcagctagtcatgataaatcagaccaaacagaataactacatactccacaaaactggaatccttcctccaaaggagtagcaaccgatgtatatacatcgcactacactacaggtaatccagaaccccagaaaggggtgaactgtcgggcgactactggcagaagaaacatgggacaaatctcccctgcaaagcgggttccctggttcatatagcacacaaaagaataggctgctacggccatcacaatggccatagcgcctcagtaccggtgctttcacacgcatctaggcaaataatccagaatctatcaaagaagcgcagctagccatggtaaatcaaatcaaacggaatcaccacggtgtcacatactcaagaaaaccggaatcctgcctccaaaggagtagcaacagatgtatatacaccgcactacaccgtgtcaagatcaactataagagagaagaagaagaaaccatccccatttacaagctcaaggatctccggcatttcttcttcttcttctcgaatctagcctaggaccgccgcaacgaccaacccgccctaattcttctagtcgctcgagggaaatgtaaagggcagcagaggcatagacgctgcaagaactatctgcggcggtggtagaggcgagacgaagagcatttcgacgcgataccttcggagcgcagccgtcggcagcggcgatgcggcggtggcggcggcggcggcggcgcgggagggagaggggggagcagcgtgtgctccgcgagggtttcttatgagacgggggagagctcacgagtgggccgggcttaagattggggaagttaggaacaggcctatatgggcccgatccatcggcatgtgggccgtcaggttgaatcctatgcgtatggtccgtgggcccgtggcccatcctaatctgctttgcttaggcttttttttttcattttcttctgcgagatgcttaaccatcttttttccccattttgtaatagctcttcgtttttattacatcatctgagagagcatcttcctactagggtctgtttatatttgagttgaagtgcgtatatttggtactaacttttttttcgtagtcaaattgttttcactttgaccaaatttattaaaaaaaagttagcaaggtcaataacgccaaattagttttattaaaactaacatttaatatatttttataatatatttattttgtgtcaaaatttttttttatatttttctataacttttctagaaacacattaacatttaatatattttgataatatatttgtttcgtgtactatattttttgagaaacacagaataaatgcatgcgctcaaaacgtgcacacacccactcctatgagcacctccagaagactggaccagcatatctctagatcgatgaagtcaccacgggcgtcaatagaagactagaccgatatattttgaggttgatgagacgaagtcactatgggtgtcgatagaagacttggtcggcatatcctgagattaacgaagtcaccacgagtgcctatctgtcgatgggtaagtcgcctatcactgaaaatataattagccgtaaatacaagtatatatgtcaattctatgatttgagctcagatgagctgtttccatcacaagtaatctagttgagctatactcatttcatttctatagattcgatcaaacttaaaattttaattaatatttaagtaggaaaaaaataaatagtagacgtgatttagtttactactccatctgtttagtctacgactttgccagcagacaagctgaggggcaaaacggccggcgagcatccacggtgctagtagtcttcaatatgaagcgtcgccgtcgacggccggccaccgccacacctgcgcactcgtcatgccgggattttcgccggtgcctatctagtaaaaaaaaatcttgcccacgtctaaaacaaattatttattgaattatttttacaaatttagttataaaactaaattaaatatttgataactaaagttaacaaaaaagctttcaatgcagtacaacacggtattttcatgaaaacatactttttttaaagactcgtgggaaagaatttagcctagatatagttgatggtcttaaattattttttttcagacaatatgatatttttgctctttgtcttaaattaacatttgagactgattctagaaatgtaatttgactaacatgaaatttaataatataatttattaatcaaaatattattacaccgtagcattagcacgggtaaattactagttctatgaagtactagaaagaacggacatagagcctgtttggggaagcttttagtagctgaagatttttctagaagcactagttatcaaatcctccctcaaacaatctagattttcattcagattctaaaaagctgtagctgtagaacctagggatggcaattttcccgttgggggcggggacccgccgggtacccacccctacggggacggggacggggcgaaatttcaacctgcgggg

SEQ ID NO: 67713 - DNA, 9895 bp, Oryza sativa
cccaatatatatatatacagatcagtacagagaagccaaccctaagacttgtttggtaacttgagggatggggattaggagtttacacgagggaatttatgatgagattaagatgggaatttgatttttaatcccaatgtcttgtttggtagatgtgatagaaactgatagggagtttagttggagattagctcattaataaaaacggatggctgagatttgcttagacaaagtaaaggagaaattccctcccaattacctgcccctacccaggtattgaaaaggagggagtttcttcctcaattccccatcccaatcccaccaaaattcccatgtctcccaaccaaacaaaatacttaatagcctcatccctctaatcccaattcctcttaaaaactccctccaaccaaacgggccgtaaaatcaatcccgtgagtttgtcgccgccgccaccaatctctattctcgttccagtagttttgacttttgacgctatcccacaaatcacgcaacacatcacacgccgcacgccgctttggcgcttcctcacctccacaaatcacgcctcgcgagttggtcccgcaccatcaagtagcggcggtcggcgctcttccacgctgcccgtatcgttgctctcacggacgccgtctccccatcctgccatccgccgacgccccatgtcgttctcctacctctccagctgccggcgcctgtgctgttctcctccttctccgaccgttcctctccctccggctgctgcaggttccccacatcattattcccttcctccacccggctgctgcaagtttcccagaccattctttccttccttcggctgctagcagtcgccgcttgtatctgggtgcggggacccggaaatggtgcggggccccggaggggccgggggcggggattgatttcgccccgttcctcactccggggccggggccgggtgaaccctcaaggatgcggaggcgggtccgttcctatccaacccgcacccgccccgtcccgccccgttgccaaccctagtagaacctataaaataaactataaactaaaagttggcttctccatattcttacccactgtttctcgtaattttaatctcctcgagacaaaggtcatagtttgaccgtcaatgttcagttcgctctcactgggacaactttcagtttttcagcgccgtattgttatactagcctagcacatgcatacaccacacattatcagcgttttttcaacaagacggcaatttaattgacaaggatacgcattgcatttgcaaacgaattgacaatgccactaactcgccgtaacgtatggccggcctccgtgagaatgaaatgcgagtgagactgatcaaatcatttcattttatcatgtaagtgcagtgtctagctaaattcacgatgagcacgcaacacttcagtagagaacaattaagaacagggtaggacgtgccatgccacacgaggagtttctatacgtacgttctctatcttaaataggaagaatatatacgcaaacatctccatgtagtgcgatttctcccactacatccactccactaattaaggtgtgatttctcccactacatccacccactaattataaggtggcatatatagccacatgttaaggttttagaattcaaatgtcgatgtttgaacaaggatgagatgcacgagacaatactgatttttacaaacacctgcgtgcatcacggaccgtttaaccgtaggcgaagatcgatttcgatcgcttgatctgtagtagtgttcattcatagagtatatttcttaaaccgaaccttagaattgatagattaattgagtcagctcagaccgatcagtgaagtgcacaactcttttaaatcacaataagaaaatcccttaaaagtaataaggtagagctatattacgtggcgaaatcaaaaacattaattaggttgagttctttagttgatcgaggttaggaactaacatctcacgcacgtaaaatgaagtaatttattaacttatcactaattaagtattagctgaacttttatgaaaaatgaattaatatattttttaaacaacttttgtatataatttttttaaatacgtattatttagcaatttaaaaaacatacgcatgaaaaacgagagaagtaagtgaaaaacgtgaacaaataaactcaaccagagtattaagaacacgctctttgctccgtggctcgctcttaaaatgggttgtcaatagacacgctcgctaaacgacgtgcgttttccatcgtgcgtgtactgttgctccacaaaatcgatgaggtcaaaagaacgaaacagcttccattcacacgtgcgacccgagctagagtagttttaaaagctaacacgtgcgatcaaaaaagtcgtggactggaggcgtggccgtccgatccggagtgaagctgacagcgaattttctttttctagtgagccatgccacttgtcgccgtacgttcagttggtccacggccactgtacaggctgtttagatttaaagtttagatccaaactttaatcatttttcattaaatcaatctatcatatacacataacttttcagtcacatcatctctaattttaaccaaaatttaaactttatactcagccaaacattaaatcgatctgaaagcaggagtagccgagtagtacggcaatagccgcaatatgcagacatgcatccactaaactcgaattcaaagacaagaaattttcttactgccacaaaaaacaatcatgatcaaagcacgtagtaataattaacctttctgggtaacgtaataatgctattagcagcagcactacccctctatctaaaaaatacaatcctaatcctagctacgaacttgaataactatctctcagtctaaaaaacaatcctagttacgaacttgaacatatatgtgcccaggttcgtagctataatttatttttctgggacggagtagtacgccagtaagagattagagtcaattttccttttaaaaaaagagattagggccaatttaaatagtaggaacaagaaaacgaattaataggaaaaacccattattctaacagaaatagaagtgtaaaacaaataatttaaaatacaggaaataccatgtgattgtaccgtaggaaaaaaatcatatgagaaagataaactcaaaggaaattttctaagagttttgagctcttgctaagttttctacaaaaatctctgtagaattatctattcaataggaatttcaaaggattggatatgattcaatcctttgattcaaagccattctttgaaatcttttctataggataaaagttatcttaaaatttctatgtttttcctccaaatcaaaagggtccagtgtataaaatacataactgtcaacaattaaaagcgttacgtcatattacaggtgaccaagagatcatacatataatagttggctatcgacacaatttccaatagattgatcatactttttttaatttaactttcacacgcagatgcttattatactacacataaccccacaatcatgtttttagagcaggtacaatagcagattataaactagctataaacacatattaaggagatgaaagaagagagataagcagcgagctataaatttatagccagctacagcatggactccaaaacgcaatatgtgtatgacatgtgagaccaaatattaataatatagtatatatttatagataactattatatgaattagctattaaattgactatatcagataattttgagtcagtagttagctatactattaaacttgcttttaaatgtgtttggaaccgacgccaaatcaatcacctgcgcacatatggctcatcactttttcttgcatgcatgcattaccgccagattaaactgtatattagagcaagtttaatagtattaatagtatagccgattatgggctccaaatcatatatagttaatttaatagtcaattcataccatagttatctttaagtatgtgctacataattaatgtctgatcccacctatcatacacacatgtatcttggagtccatgctgcagctggctacaaatctgtagcccgctgctcttatctcttctcttttatcttcttaaaatatgtttatagctggcttatagtctactattgtacatgctcttatagtttctctaattactccctttgttctaaaatataagatattttggtttgatgagacatatcttataaatagctctagatttgtagtactagaacgtatcctattcaattaattttttttatattttgagacgaaaggaatacctaactttacgcatgtcaaatcttgttgaatcatcacagcgatagtaaaagttctctttttctttagaggaatcttaaaagttttctagttcttacatcacttgagaacaaacaacgaaatcaaatcttgtcattatgcaaacgcttcagaatgtctaaactgctcgttgtttgcttgcttgtgccgcccaactcacactgcactagcttgcgatgacagcattggacatttgttaatttggatgatatctccattgacaaaatatctggcagtcgacgtagtcaaatttaatgcaggaatgagttgtaaattgtaatcacatggagattattgacatgactgctgttagtgcagagaacttgtgtgtgcgtgcgcgtgtggttttgacctgaactgtagtggtgactggccaaactgcactgcagcatcaatgtgctgtttagtgatcggtgtggagggtcaactgaataaatttcagactttagcagcagcagcacactgaattaatttgagaaaaaaaacaacatagtactagaaatctcatcagtagttcttctgtccatgaacagtggcagcaactatcagtcgaccactcgtgactaaccaggtcaagatcactagaccagctcgagatcatatgaagtttcaatggaatctccaacaacatacttcctttgtcctataaaaaatcaaattaagataataagagatattttctagtataatgaatttaaacaggcttttaaccagatttattgtaatagaaaacattacatctaatcctagattggtttttataggactctttcctccttcagtcccaaaataagtgcacttttacactgttcatgtccaacgtttaaccgtttatcttatttgaaatttttttatgagtattacttttattgttattagatgataaaacatgaataatactctaagcatgactatttgtttttaatttttcataattttttaaataagatagacggtcaaacgttagacacgaatacccacgactgcacttattttaacgttgtagatgacagtccgacagtgacatggttcatatgattccctcagcagactattagaagctttgattagcctttgccaatggctgctctcgcttggatttaagctcctggcactggccactatagcccactagccacatagtactatggagtatggacctgcttgaaagctgtagattccaagggcccgttcgaacgagcattttggctcagctaactggcggcacttataataaaataatctattaatgcaaattaatcggttcctataaacttaaaaatagaattatttgattttagaaaagccttttgtgtagaaaacttttacatgaaacacaacgtttagtaattctggaagtgtgttcacgaagaagaacgagtaagttgccattgtaaattgctctctagaacttagcatacaaagtataaagtgagtagtagctagctggtgagaatctaaaaaggttgaaggttttaatttctgatttttagtttatttcctaaagtgtatagcttttattctcgtaatatatacttctacatgaaaaagattgactacccggtaccgagcaacttgtcatgtgattgactttatgatcaatgtcctgatgtgcagtactatctccaagattggaagatgacgagccaaatgacgcagtttttgcatcgaagcgttgaaaccggttgtcaaattaaagtatttcttttcttcagattaaagtatatctgcaaattctttaagctgcattattttgacttgggagcaaccagccaagaccacggaaacaagagtgacatgggcaacaaagtcgataatgtacctagactgagttcttttcatcaaccccaaaccgtaattttttagcatgtttctcaaacgattaaatgatatgttttgtaaaaaaaaattgtatatagaagtaactaaattaatttttcaagtttgtaataactaatacctattaatcatgcgccaatggtttatcttacgttcgtgaaaaagtgcagccgaaaatctaccactagctacttagaaaagaacgcacccttatattaaagtataagtgaattgtttgtcttttttatgagctaagtttttatagtttatattgaactggatgatacatacaactcagtataacttctctttgccccaacacccaaaaaagtttcataatctgtggcactgtctgtgggcctcatcgtttggcttttttcgtaataagccaaaacggcttattagagaataaaaatgaatttgtaggtaaaacttttatatatgtgttctcggtgacgtaaaagccaatgctgaaaaagaaactacgttgaaaatatcacaaaatcaatgttaaaattaagtttgaaaatttaaattttgcctttttctttggctgaataggccatccgatggaagccattgttgtaaaacatggtactcctagcagatattcggttgaagcaatgccaacatgtcatcaagtacaatatcttatcctctttgtaaaaaaaattataatcctaacttcgaatctagatatatacgtatagaggtttgtagctagaatttgttttttttaaggcagatcttagtagcttccaaagccgtcatgcattggttaagccttaactaagcctaacgacatatgtcaatcacgatcataacttgactgagagaatgttgttgcttcaaggagtaactaacagtgcgtgaataaatcctgtaccactcgagaaaaccaatcattgattgctttaagtatatccattcgtgccagcgttaattaggacaagaaataggttgtattacaggttgtcgtcatgaagctgaggcaacaaagaatgaagaaaataagactaaacgaagtaaaatcacatgtacatccaggttatactatataagctgggctgggatttggttattacagaatgtctacacttggagtaggtgatcaatgagtattttacctagaaacatatgtgacggtctagttttaaaattgatggtccttaatactttttttactttctttcttttaaactggttcatgtgtgtcttggttgtgtacatcctagttataccgagatcgagaatactccaagcacaattgtattattttgatgtaatgtgactaagatcaaagaaagcttctatttctaacaaaatgtacatcctagctgtgtgtttctttgcctgcctgcaatggtgtttgaggctaaagagctatgcatgcacatttaacgttgaaaaatactttcatagatatgactcaaaaatactttatcaatcaagctgttgctccaattagcttgcttgtagtttcatattatctctgctatgtattggcaactcctagaatttataaattgtctacgaaacatgtttttttcgctgtggcctaccctcaaaggctcatgaaaatcgacgagtttaaaaggcgggcacgctaaaagacctgcctaaaaaaattgattttcgcgggcgacacacttaagtcactcacctaaggatttctagtgtaaaaagatgaaattccaaatcctaatatcctccaattcacaaattcatgatgcaattccaccataacaaattttaaaaagatttgacaaattcacaatgcaattccaccaaggacgtcatcatcgacatcccaacgtcggagtcgtcctcttcagcgtcttcttttgggagaagccaacgcaacacaccatcattggtgttggcgagggaggccaagggccggccacgacgaggtctgcattatttttggtcacaactatataggtcatgaggtggcggtgccatataggtatttattaaaggcatagaggagaggaagaggtgactaataaatgtggataagtaataccttgatataacagttgataattttatactaacacaatcaaatggcttaggactacccattatgtgtatctggttaaatgtgaacactactaaaaagacacatgcaggttttaaaaaaacagtattacccaaccgaggaggtggaggtgggcgacaaggcgatgctgctcctcttggaggcggaggcgagcgattccccctcccccttcccctctcggtgcaagacgacatcagtggcgtcgacagcggggtagggcagtgtcagcggctgttcccgtggcagcggacggggttgataatttgaaactaacatgatcaaatgggttaggattgttaataactgtagccaattaaaggtggagagaatgggtagagattaataacgaatgcagataagtaactccttgatctaacatttgataatttcatactaacataatcaaatggcttaggattgttcatgacatggcttcgtgcatgtgcttatattcgtcacaactatataggtcatgaggaggtgttactctacaggttttattgaaggtagagaggagaggaagggacgaataaggaatgcagataagtaactccttgatcacgattgattgttttatactgacatgataaattgacttagcataatcatgatgtatatttgttaaaggtggagaatagggatagagatgactaatgagtacgggtaagtaactcattaatcaaatggttgattgtttcagactaacataatcaaatggcttaggataagagatggctagtaaatacagacatgcaactcatttatccaatggttgataatttcatactagcataatcaaattagttttgattcactcatgatgtaaatctaattaaatgtggagagaagggctagaaattactaaaaataaatgaggataagctactcctttgtccagtggttgataattttatactatcaaatgacatagtatgactcatgatgtgtatctatataaaggcatagaagaggggtagggatacctaatgaatgaggataagttactccttgatccaatggttgatgtttttgcactaagataatcaaatggctcaggttaagagacgacaaataaatgcagatactctttgatccaacagtttattttgtactaacatgatcaaatgggtaaagattactcaacctaaacataggtggagaggaggggtagagatgactaatgaatgcaaataagtaactccttaatccaacgttgatatatttgtattaacataataaaatggtggcccagcataagagaagagttatcattacagataagtaactccttgatataatagctaattttatactaaacatgatcaaatggataaggattactcgtgatgtgtagctaaatataggtggagaggaggggtacagatcacaaatgaacgcggataagtaaatgattcatccaacgtttgataagtaccccccctccccaaggtagcgacagcaacactatggaaaacgctttatatcgcacgtccgacgaaacagaaatatcggacgcctcatctaccacactaaaaatgctgcaaatcacggctgatggatcggacgaaccctatcactgtaacatgtatgcctagctatttcttttcattctttcctcctctctttaaa

SEQ ID NO: 67714 - DNA, 3814 bp, Oryza sativa
  unsure (1)..(3814): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttaaagttggacatgaatattagtaatagtgttgatgtgacgttttggatgtaaaaagagacggataaaaatggaccgactatcaaacgcccgagcagatgagtttttttcgggtgctcttaagaaaggaagccaataggcaatgcttttggcacgttgtgtcccgcgtcgaggacgatgctgataaacctctttgttagaatgagatcttctgttctgcagtaccgtggctcatatgattgcgactacggctcacatcatttggccataattaagctaataatatatcgtatggcttattaaaaaaataatttatgagtaattttttatatagatggttttagtgatataaatgtcaaatttagcagcgatttaaaaaaaacttcgatgaaaattttcaaaatttaaattttagcgacaaatgatttatatagagcaaaaggtggaggccttctacggcagcagcagtactgtatatgagctaagtcccttttcgttcacgtttcaagcataatcatatgatttgactttgttgtttacttgagaaaagtgtaattatttaatttaactatcacttatactatagccttaccatagtgtccctatatgcatatttgacaggtggggctaagtagaaacaatgagagtattggaagtatatatgtgtgacaggtgatccaaatttctgagggagacaaagttacaattttattataatcaggagcggagctagtatatgttagggggtgcccaggaactcggtcaagaaaattttttagctatacctcatctattttcaccatgtatgcaccccctcaatacaaacttagacacccgtatcagcttaaacttgatctaaagtaaagtaaattaaacaagtggcactacgctctgtttcgctctagctccgcccctgattataatatcgtgtattattgttgcagctttgtaaatgacgagctagacttgtagaaaaataatagctttgacaaaactagttataattttctaaaatttaatcttcttgatgtgtaaaaggctatatattagccgataattattatagagcatttaaaaaaacaagttataacactagaatctcttcaccaatcaccatgcaacaaataaacactaatagcactaaattattatgggcacgcttctcaatcttctaaattttacgctttttactataactaggagggtagcccacgcatatgcacaggaaccttgtttaatttttactacaaatgattatgttgataatattttcgaaatattctttgactctatgttaaacatgtttttgtaaataattggtttgggcatattacttaaaacacaaaaattgtcacgatagtagagtttgttcgtatctatttgtactacgtctcattctttcctatgcaatatttaccataccttatttttggattttctaaattttaagtaatattttttcctgtatgctatagataatttttatgatatattaatgaaagatagtttctgttaaaaatatagctaatatgactattttatctaattaaatatagacttatattacttatacaccctcggtgacataaagagtcaaattttgtcccaaaccaatgagaatttatatgaaacctagacaaagtgatttttttaaaagaaaaaaaaactaccacgataatctccatagcaccatattattgcttatattttgttttcaacacctaccattcataatcacgtgagacacctttagtagagaatgctgttaatttactaaacttatttacagtaactaatctgtggagtatacttatagtcacatcactaggtgtatgacatacatctagggatgaaaactttttggattcctaacctatgttcggaaacacaaactgtcggtcgaaattttttcggaaacgaaaacaaatatgataaaggcagtttccgtcggaactcagaataggtttgcaaacaatttctcagaattttcgaagttacaaaggcccataccatagtccatataccataataatactccagtcaaattcaagttagcatcctaattgattgtgttttgtgatatactgttgaccgttgagacctgagacagtaattggacttgacaaagttcgaagctaagtttgaggggttttttcttcccataaattttcgttgccgtattcgcgccagttcgtatttagggatgaaaatggtttggaaagtttcccaattccggacatgttttcaggaatgaaaaatgtcggtcagaattttttcggaaactttcggaaacggaaacaaatataataaggctactatccatcggaaactttccggaaatgaattcagttaacatagtatttctcatatacaactaattagcttcagccttctctactctaaatggttagatttatactatgtattgaggtgcttaattaaatagagatattttgtagtcaagaactttagattttttttttgcgtaattgctatttttattagaccatactacttataattatagttatagatggatatagtttttttttctccaagaaagtaaagtgtaaaactagttgtgttattattaattgataaaatgtagaataatagctttatttttttagaaaaaaaatattgagctacatctcttagttgatttgagaagttcagttttaagtgctttctatattttgataaatatccgttattgtattcgctccattttcgtattcgataatatttgatttcgtttttgtatcatgggttcccgattccgaaaaaaatatagaaacggaaacgataaaggtggtttctgtccgtttccgaaccattttcatccctattcctattctctttgttttcagttccggttccaattctaaaataaaatgaaaatggaaacgatagaggtttttgtctgcttccgtagcgttgtacattcgtcaagtaatatttgacacccaaaaatacgatgtgaaattatttaaaatattatcataatattaattattatatgtcggcatcatgtgttgtgacgtatttagaaccatagacatcaatagtttatttaataataatttatttaattaaaggaatacaaggggattagaaattgaatatataattttgaaataatttaaaagatacagtatttcaagagtgttttggatattttatatttgttatatagatgtagtttaacggcgtgaatttgtagagtaatatattttatcttttgaggataatggataagtgaatttatgagaattcgcttggagaactatatgccgtttttttttaactttttcattttctgtctgcctcctgaacaggtttatttgtcagtggaccgaactgcttaaacatgtcgtgtgttgtatgcccagccattgacactgacagtgatcaatctgatgttgccaatctgccttgaagagcacgtgcatatgcacagatgg

SEQ ID NO: 67715 - DNA, 1586 bp, Oryza sativa
gtatacagatcagtcactaaggtctgcagaccagcaaggcaactggatcgattattgcacaagctcagggatgagcctcagcaagaatgagatttcacactgcgagaaatgtggcgttgcggcgtcttttgctgccccattgctcaaattatcggcgttcaggtcaggctccgggacggtgatgagctcagagacggcctcggtgatctcctgcactaggtcgacgatcacaccgttcacccccatcagatgttgcatgtacaccgcctccggtacgttgctgcacaaaagggatgggagattttgagcacttgaaattcagatataatgcaagaaagtgctcgaggtaaccgtaaactgtactgcttacttcagtgttccataagtcagtagggagaggttagcctctttgatctttggtacagcagcggggtgcctgaaaattcctcgtgcctccgacacgattccttgcatgccgctggcgaggcatagcttgatggcctcttccaatgagttcctcctaacgtcagcgtagatttctgtgcctccattagtcaaaaagtaaacctgattgaagaagatgcaagggatgaggagatcagtaactgttcatggtacgaaaagtactgttatggaacttgcaaatttgcaatgcatcagatactagtgtacttacagggtatgtgctttgcaattttcgcataacctgtgcagcgtcaggctggaagctagagaaaataataggccgatccttggcatactcaaaaacaacctgatcaggtagtacagataaaaggtgagatgttgttagattggccataggtatcaatctgcaaattttctgaatagccataacactatgctaacacataccttcaggatggcctggaggatacaagtgagctcttcctcctggtattcaagattgtcatcaaatttgagctcaatattgaagcccaatctaggattgaccttctcgaaagcttcttgaagtgtgcaaagagggtcatctgactgcacattccaattcactatccgaccatctttcagtttccgtagcaagggttttccaccctgaattcagaaccaaccaatatgtgatcagatcaattctagttatcctccaaagttaaaatcaattctagttatccccaaaagttcaaatgagaaaaatagtttctagcatacctttccctgctcattttgtgggccatatagcaggaagtcttccaactgaaggtctgtgacacgcttatctaaaattttaccctgaaaatggatgccattatggatacaggttagttttttctttaccatatatcacatgattcacgaaatggtccatgcctatatgacagtctcaatgatgttacttttttgtctgaatttttaaggtagctactgtaattcatacagtaaaagaaaagtaacttacatcttctttagtaaagatgaagttatcatggaagatgactgggcacccatccttggtaacctgcaaaattgatattcacggtttgttctcttctcaacatctttgcacaccgaattattgaagagacaaagagagaaggacaagaacaaaa

SEQ ID NO: 67716 - DNA, 23503 bp, Oryza sativa
  unsure (1)..(23503): unsure at all n locations
atgctctaaactagccatacaactcccgttgtcaaaacaactttattagacaaacactagcaacaattggtcaacaaccagaggtggccatttagcgctagatccacccgaggaccgagactgggtcaacacccaagtcaagctgttggcgctatggtgaagtgggaatcatacctattctcagcatctacccttgggtttattcctctagatttgccttctcttttccggtgtcctcgcaagacatcaggttccaaataatattgagaagatatgtgcacaccaagggcaaccatacgaacagtgtcattccaccacatggaaaacactttatatctttcaccgggctaggtgaaaaatatctcaaattattgaacctcgcaactccacgttgccagaaaattgaggtataatcgtttatctccaaatcagaaaagccgtgctctcaaccattgggaaagcaaaaaatgtcgaccgtagtccgaccatactctgattgagatgttaagccattaggggaaaggcacaatgaatcccaaacacattgtctaattccacacatttcagcgactcagaatcccattcttgagtgtgatcatagggatagagtgatctacattaatgcccaaagccatacaatagtcattgaaggcctttacgtgaaatcacccacactatcatccgaatcgtttcatgcggttctcagagaacgcaacacgcaaacggatgatatgcgcagtgaaatcggcaaaagcatggatctcgtacaacaagtatacgtgactccatcttgtagacacatcgatatcaccatttatgtatggaggagtgtatcagtaaagagtggtcttatccatagccatggatatttaatttcccagaatttccatgcattaggtgattttctattatttacttggtcttatttggcattatattcccaatatttataccacacagaaaaccatcacacataaatgcatgaaaataaacccatcataatgcttccaaggggggattctacactatgtgaacacaatttatagaaacatcataacctagagaaccatctctagattatttagttggaattgcattaattttaaaagcaaagcaatgcttaaaaaacaccattacatggttatttacgagtccggagacccacatgcaaagccgaactatatagggcctaagcaacaagacatagacacacaaacaaaattaatataatctcttattaattacaaggttcaaactataaaattccattaaacagtgaactatagcgtaaaaacccaacactccaggggcttaaacgcaagttaccaataaaccgaaattaatcaggccgaattaccgttcaggccacgatcttatttgggctagcaagcacagtgtagcccaaaatgcctaatgggccgaatttcccaaactctaggcccatgaggatttccaggtttattatttttattaatttgtttgggttgtcttgttactgttgggctttattcggtcgggcggaggcagaccggcccagccggttcgcctaagtgaccgagagagggaaggggagggggggaattagggtttcccctttcccattcattgtccgcaacgacgtccaccgcccggcgcaccggcccctcaggcacggcggcggcattggaggccattgactgtcgactttgaagggatttagggcggtgcacggcgaggaggtcatcgacgacccatccactacaccgattggcaggacggctatgatgacatcactcctgtgtggcaatttggtgcggcggcggctcggtggcacacgacggagctccgcgtcgacccgcgcatcctcatgacggcggcgaggcgaactcaacgacggcaactgtgaccccaacaacggcaaccaaattgcatccggccatatcgtctcggcggaggttaatccggtagcagacagcngacgacccatcatcctcccaccacggctcgacggcagcgtcgatgggaggtcaacggcgccggcgcctcgcttcggcattaactccggcggcaacggcgatatgggtttagggctttttctgagacggcggtttcccgcgacggcattgacgtaaggccgacggcgtacccaacagcgacggcgaacgatggccaacatgtctctaagtccgactacacaggctgagaatatgtcaccgtattcccggtgtggcgtcatcaaaagaaagagagaaacagagatgcaagggaggcgggcgagacggccgattcggcccagccgaattaggtacgtctccagtccagggtttcccatcaattttaatgatttctctcacacggttttctctagttttcatcaaataaaatagatgcatatagatcaaaagcaggaaattaatctaccgctagatcaagagcaggatcaaaaatctactgcaagcaaagcatccataatatgataaaaacgagaaaatataatcaatctataaaaacagcatatcttaatagacacatgcctggatatatgtatctatgaattagtaaattagtttagaaaccaatcttactaattacccaggttcgcatgctcacaaaaatctttcacgtgcatgccgcctcctgctgcgtcgcaggtcgcctcaggaacggcgcggcgtcgatcggtatatcgcacgcatctgtacgtgcatgtgtacgacaacgatgacgacaggtcgtctcgcaagatacgctagctgcttagcacgcacagcacctggtgctcgtctcgcaaggaggcgcgacgatgattcagacctcgtcgaccggcggcatacatgtatgcaagcaaaacaaccatcaaccattaattaattaatttgtaatcagaaatcaatctactgatgtaagtgcatgtgtcgatgcatgcatgcagcatgcgtattggttgatttgccatcaatcttgtgcatggacgccaggagccaggtccatccatgcttgcgtgtggccagcacatgccatcgcgtggaggtgcggcgtccagtgtagccgcagccgcgtggcggatcgcgtggggacgaaccgacgaagaacgggccggtgcactaggagatcgagcaccgacactccctacgggcgcgctcgatcgtgcgagggcggcgggccggcggccacatcggacgacaggagtagtgcacgctgctcgcggcgtctccacggtttcccggctacctgctcggtttcccattgcgatgtctccgcagtcgcgtgatctcgcaaaggaaaccaggacaaaacaatagatcaatctgttgacaaaacaaaatcaacagattggaacgacaaaccggtgaacggagagctgctgataacgtgttgtaaaccaacgcgcctattagcggatcaccggatccgttccatatccctcccacaatagtataggcgtgagatgatgtagaacacctgcgcccatccctttgccctcaagaatattgcagaagtagacaatgaacacagatatagggtggagctctctcttcattatagatcttatctggagtacaagccaaccattagccatagatgtcacaccctccctctgtatatataggggtcttaggaggagatagatcttatctctactccggttcggattggtccacaagaaaggatctttatctccccaggagataatattccgtaacaacgtgaacctttacctgattagatccgataatcacggtcctatactttctttttttctcacgtaacattgtttttcttttttactaaagatttgaaacctatcaacttgaattttaaaaactttcaactacaaatttaaatttttaagtcaatttgaaaacatttaagtcagattttgaaaatttcaagtgggattttgaaaatttttgacttgatttttgaaatttttaggtcaaaatttaaaaactttcaacttttcatctcaaatttgaaaaactttcaacctagatttgaaaactttcaactcaaatttaaaaactttcaactcaaaatttgaaaactttcaacttttcatctcaaattttaaaaacttttaacctaggtttgaaaactttcagttcaaatttaaaaactttcaactcaaaatttgaaaattttcaactcaaatttgaaaactttcatcacaaaatttgaaaactttcaacacaaaatttgaaaactttcaattatacatttgcaaagaggtgcgtgaaagattaaaagaaaaataggaaaggaatggcgaaaaaaaaagaaaaacgcgtccggaggcgctaaaataaaaaaaaaaagtgtgaacagaaagaaaaaaaaggccgcgggaggaggcccagctagcgccccccgcgcaaacacgccagctccattccaggcgaggcggtgagcgcgtccgcgggagctggcaatgtcagccccagacatgtttttttttttgcgtttttgttttattttatttatttttaatgactttcaacttaaactttgaactcaaatttcaaaaactttcaacttaaattttaaaactttcatttgcaaattcaaaacttgagctaatgctaatcttgacctaaaagttttgaaatcttgatttgaaatttttctattctaagtcaaaagttttaaaatttgagtcgaaagttttcaacttgagtcaagagttttcaaatacaagttaaaacgtttcaatctagattgaaagtttataaatttgagtaaaaaactttcaaatcttaagtcaacagttttcaaatgcgagttgaaaagttttcaaatcttagcatcaaagttttcaaaatataagccgaaagcttttgaaatttgagtcaaaagtatttgaaatttgggttgaaatttttagaatttagttaattttatttttacttttcagtttaaaattgtaaacattttaggagaatttggtccttttttttttaaaaaaaagagttgttctcacttctcgtgtgggctttcttatgtgtgatttgcctgtggctggagaggaataggccatttgggtcacatctatgcaagtgtacaaaagctaccacatactctttttttttttttgataggaaccgaaactttattactgaggtggtccagccaaatcgctggtcaccaaacgctcaaggccaggtggagtaccggcccagctacaggggtctagtaaattacaacccaattttgccaactcatgcgctaccttattacattccctgagacagtaatgaaccgagaaagaaatgaaactgctagaaatgacattcttgatctccaaaatcacaccccccatggcggaaagattgaaagagttctcctggagtgcagatttcagcagcatcgagtctgtttcaagctcaatcttcatcatccccctttcacttgccgctcctacagccgctgcgcaagcaagaacctcagaatggaaagcatccatcaggtgattagctccgccagctccggcctgaaccaccactccattatgatcccagataacatatccccatccaccttgtttggtgctgcagtggaaagccccatccgaattgatcttcaggacatcaggaatgggttttctccattttgccgttctcctctccttcatcttttttttttttgaaaccgtattctcctctccttcatcttcccctctttccgattcaactttaaatattcctctcgctaaccttcattggatactgagccagctcggctcggctcgttctggctcggtatgttaacgagctgactcggctcggctcattatctcaacgagctaaaagcctaaaagtgcagctcagacttggctcgttagaaagctcgagctagctcgtttagctcgcgagcaaatggggacggaaagcgatttcgtcgcggccggcggctagcagtgcgcgtgaacaacaaggagaggggaggggactcacaagcataggacggggaagaaaacagcattgctcacgagcttgtccacccgtttcaagcgttttggaagtggatccagacagccatcaccgacgctggcgccggcatcagcttcggtttcgacggcttttggcggtacattcggtccttcttcgccagcgtcgtggccacgctcgccggcgcagctcacgagctcgtcgggtcgacggcaacaatggaagcatgcggccggccaacaggacctatgcatatgcgggcgggcggccggcatcagcacaagcgtgcgcaggcaagcgtccggtcggccgatgggcgagggagcgccgcgggatgggaaggacgacgacgcatcgctagcgctctaccgcgtacgcaagggaagcgcggcggcgctttgcggcggcgttgcgtaatttgctatgtgcttgttttggagaaagtacaccgaaggtccctcaacttgtcaccgagttagaaaacgctccaaccgcaaaaccagatattcggggtctcttaactaatcaaaaccggcaaaatgggtctttcggtgattttgaccctggttttaacctacttggcggttgaataggcgtaggacccacgtgagctccacatgtcagcgtggccaagtgagcctctccctctttcccctccattctcttctcccccccctctctctctcttctctcctcttctcttcttttggctagccggccggcagttgaggagcaggccactgggcgaggcggcggcggcggcggccggtcgcgaatggcgtcggcgacgctgtgtcgccgccgtcggtgaagcggccccgcgcggccgggcgccgcggcgttgggcgcggaggcggaggcgaggccgtctcgcttcgtttaagtccctgtctcgggcggcgaggaaggtgaggacgaggttgacgtcgaccgccgcggggtcatcgccctccgtcttggcggtggcgcgcgcctctcggagtcgctcgccgctcggcaccggcttcatcgacaacccgctcagcaccggcttcagcgccgcgccgtccctcgccgccatccccaccaaccagtccgtcggccaggcgtcgtagtgcaggcggcgacggggaaagagaaggcaggcggcggccggcgcgcgagagggcggcggcggtggggaaagagaaggcaggcggcggggagggaggggacagctatcgttgcacaatgtttttctggtgctggatctgctggaagacgcatgcgagtcattacttgacagcatcgttgcagagaatgcaaagcgtttctgctcgatctgaatgaagctatctggaggcaatgtaagcatcatttttccatgtaaccatgttcagtatctatctactatgttaccccgatacggggatacggacacggatacgcgacacggcgacacggggatacgacattttccaaaaattgaggatacggggatacgctaatatatatatatatataaattaaaaatacagaaaagtagtaaattgaacagggcaaaaatagattgtgaataagtgctagaccacaaatagtgcatagaccacaaattaatagttcaacggtacatccaaactcgcaatgaccatagaagttcacatccagcccacagggcacgggcacacaactagtttataaataacaagttcacagccacaaatagaataattaggatagaccgataaacttgttcagtactctaagttcaattcaataataactagataggtagatcaatttaattgctgcttgtatcaatcatggtaactgaagtggctgaaggttcagcatcagcagacagatccaatgcaccaagatcttctagcaccctctcaaggtcaggctcatcaagtgaaagagcagcttcttgaagaaaatcagcaccaccctcgaacatctcaaagctgtctcctccaacatcccacattcttgatggaccagtacagtactcttcagatttcctggaaagaagacgcaaattctggtgcacaaacaccaaatcttcagcacgtccagggtttagcctacaataaagcaattgtagtcactgatcagttccatgcatttcaaacatacaagaaatttactaagtaagagaaggaacagaacttgtttctcattgaattatggatcaaaccataggtgctccaatttctttcagcacaagatgatgatgttggttgtccaagtaattttagcgccaatttttttaactcaggggcagagttaccataaattccccaccattgctttgcatccaaatgagctctatccttgattgagtcaaaggaattaaacccatttccaaacagcgagaaatctgcaaactgctgcttgatcttccttaattcatcaccagcaaaataccttctgaagcatttgtttctcatttctgaaatttctgcatccatgtgaggagcttcacgggttggaacctcagccaaccagctttcgcagtagtacctacattttataaaaacaattaataggctaacaacgactacaaattatggaaacaaacatttaaaagtagaagcagaacattacttggggttcagtgagtgtgccaagcaatgcaggggggtattactttttgcccatcgagagtacaagatctcttgcacatgaaagaaaaaggaggaatgctcatttagttctttcccttcatgacgataaactatttttttcaccttatctatcattgaatcccacatctcataaaccaaatggaggcaaggtttgtcggtgtcagctgcacgaatcatggaatagataggatcagtgaaatctaggatatactgcaccttatcccaccacacatcatttagaaccttctctttgacttgctgtgcttgaacttgattgtcttccctaataagaattccatttttcactcactaccatcaagattagagattctttgatagcacggaacctctttaacattacaatggtagaagcaaatcttgtatcaacaatggcaagaaattttagcttactgaactcattgaacatggagagcctcattgagtggttcatgatgaagttttttatgaaagaagaatctgctgctacctcagtgatccactgaaattcttcataagcatccccacttgaactcttggctgcacatatgttcttcaaggccaggttcaaggtatggacaacacacggcgtccaaaaaatgtggctgtacctctgttcaactatcaacccagcagccctgcaattagctgcattgtcagtgataacctgtaccacattctttggtccaacatcctcaatgactgcaatcatcttctcagcaatatattccttcctcttaatttctccttcagtgttgattgctcttaaaaacattggcccatcttctgtcactgctagaaaattcaagagtgggcgcctttgagcatcagaccacccatcggacacaatgctcacaccttttacaggccatgtcgacttaaggggatttaacaaccgctcaacatgtgtcttctcttgaacaagaagagtagttcgtagcttgttgtaacttggaggggaatagcccccaagcgcattgttgcaagcaaacataaaagccttcctgaaatatgggtttcttgcaacattgaaaggaatgcctacagaccaaaccaaatgtccaaatattagtcacatttgtaacacaaatatgagaatgtatgagttaataaaacgtactaaactctagtctaacctgctgtgtagaacattctcgcaatcaaagcatcaaggttggaacgagtatctgaattgaagctagactcaatagctgaaacagcccttctcttccccctactcgcgccctctgctggcagtgggatgtccttaggcaagttcctttcagcaactgctgcagctctagccatttcatcatgaagttgactaagaacatcgattgttacctttggacagggagctacaccattagatcccaccttcaagagatgtgctttaactcttgagtagctcccatgcataatattaccacaaagcctgcatctaaaccttacattccctccctggcctttacctgttttctccattaactcaacatacctccacaatggcttgttttcattgtcattgggaggaatcacacggcaagcattcaagaggttgcttgcccttgctggaccactagttcctcttgataaatcagtagcagaattaggagccggactaccactaggatggctagatgcactagcactagcacttgagcttccagttcgataatccatgggatctaacaaaaaaaaagatagtacttatactaagaaaagatgaagggcattgcattcttgcagatccactaaaactctaaacgaaataagaagagcattgcagtattgctctgctgcagtgcatagaatgctaaaagaggggatttattattcacctcaacaagggaacgaacaggaaaacagatcggcgacgacagtgttgtgccgacgtcacagtaggaggcggcgaggcgcagcccagtgcgcggcgccggcgcagctcggcggcggcgacggttgacgaggcagcccggcagcagcgacggcactggagcacgtgaggggcgttggtggtgacgctgttgggccagcatcggaggtggagagcagcgtggcggtgccggcgcagcccgtcggcggcaatggctgatggggcggcggcggcgctggagcgttggggaagagaggcgagagtgagagttgagaggcggcgcaggctgggtggatatgctccccacgcgcgcgcgggttttggtaccggcggaatattagggttaaacgtatcgggaccgtatcagaacgtatcggaaacgtattaggaattattttatttattttaaaatcaggataaataccgatacgtcctggacacgtatccgcccgtgtccgatacatgtccgtatccgatcgcgtgtcggacacagacacgcgcctgctttgccgtatcagtgcttcatagtctatctatgccatttgattgcgattcagaaaaccagaaaacactcacatcagcatgcatgtacccatgttcatacaatgtcaggctgaagtcatacttatcctatcttactataaagttattcccactaactaattaagcttaacatataaagataccacatcattatccactaacaagatgtcacataatcatctactaattaataagatgccacatcatcatccgctaacaatcatcacatttaaacattatacaaacttgctatatctttatagtttttataatttaagagagcttttcaaatacaaacatgttaaattatcatccaacataattcacataatgtttcaatatatatctttattatgttttatgatatcctattacttatatagttcatcctcacttagttagtgcttaaatgattaaactatggtccaaattatctttctcgttttttcctctaattaagtcatcatatcaattgtttttatcctttagatgattaatctacggtccaaactatctccctagttttcttcttccataaaatcataccaacttactttttacgtttgaatcaccattctacatactatttaaatttaaattatcataaaccatattaatttacttaatctgatattatatagctatcttacacgttattttttttattattatcatactaaattcccgcagcaatgcgcggggtttaacctatctagtatctttcgtgtacaccatgatttacactgtaataaaatcaccaactcgaattagagaagctgaactgttttgttagtaacacattgcacatgcaggaagaagccaagccacccctcgctgaggagcagcgcgacctccgcgtcagcgacgacggcgaggtagtagtcgccgcctcgccggtaggctcgggggacgacgaatccgacgcgtacgtggcctcggcggtgtcccagtggatgcccacggccgtgtcggcggcggtggcgagggacctgctcccgcgcttcttgtgcagcacatgttgggcgcacctcgacgacggcgagagcgcgtcgtcgaaggcgacggcgaggcaggtggctccggcagcgttccgcgtccacgtgacccggatgaggagctccttcccggagtgcagcgaggcaccgtacaccgccgtggtcgccgcctgtagcttgcgatccagcgcgccgccgcacccagagtcaccggcggcggcagcggcggcggcggcggcgatgcctaccgagctgtcgccgaagcacgacagctcctgcgtcgcctccggctttggtttttcttccggcgagattagctgctgtttgctattgctgctgcaataaaagagagagctgacgtggcacgctgacacgtggggtccacgtgggttccacgatgactcagccgtcacgtaggctaaaaccgaggtcaaaaccaccgagagacctaaagcggacggttttgttagttgagggatgcccagtatctggttttgcggtttgaggacgattttgtatctcgatgacaagttgagagaccttggatgtactttttccgcttgttttagcctagcctagggtttggcatattaagggctgtggtgggcctcgtggatgattaagctgctactataggccttgtttgatgggctatccaccggtgggcttcagcttgttttggctcacgtgcagctcgagctggctcgttatgtctaacgagctaaaatgctggctcggctcgttacgaaatttaaacgagccgaaccaagtttatcacgagccgagcgagctaacgagtcacgagcttcctgtccacccctaatgacataggccaaatcagctgggtctgtggcttttcctccttccctttctccgcctccatagtatttaatatggactgcattgcactcaataggattccataaggtctcttaagttctacgttgcaaggacctttcaaattaatttgaattatttttggattttggctatctgtcagtaatccctttttgatattgtcttatggagattggaattcagtatccacatgtacagtttcaattatgatggtatcagtttgctgtatgcctttcttttcagtgagatttcagttctgtctgtatatgtgaatctgatcttgtgctgcaagaaaataatgcttcgttttgctaatactgcagctgaaggctacacacatgacacatgtgcatatttttgtacgagaaaaatgggcacaattgatacctgataattgcatgcattgatctataaatagcctattagtactggagcaaaataaaaaatgcataacatagaaggctgaagctcttatatgctctcacaagtgtatggtggcaaagacacatgaattttggaagtgattttagaactcacagataatgttagatcaaagaacactttcatactatatatgagctcacatactgaacaattccacatgcacagcatgtcacatttaacaaaaaaacaataaggatctcgttactgcacaggttcaactaanacacagctctgtttagctcattggctgttaacaatcagctactgtccacttctctcatcatttacaccatgcgtactcttaactggtttagctcacgcccgtcagaaatcagcagcaggtcacttcttctccttatcaatttacaccattgtatgctcaagttgtaagtcagcataatacgtggcaatgaacatcgcttcaaaaaattcatcaagaagcccagaaaattgttcgttgaccatattcccgaaatctttttcagagaagagtagtttcctgccctctaccaccttcgacatgaaatgctgataagtatttcttaccaatctcagcaaggagagaacatcatctccgtagatgattggtacgcccgtgatgggatctttccagtaaaaggtctcaatgaaataaacgttgtgaagatccatcgggctccaaccagagaatatcttgagacgttcaagcacaaaattgtatcctgctgggtctgttgttggcaatactagcagtttattgtacaatgatgtaaagacatgcatcatttggtgctcttccatcaaacagtagtgatagcatatcagatactgataagcagttggatctctcataatcatacttagccatctgtgaatatcttcaggaactggtaaagattcaaagagttcttcaatagtcttcacatattgataaaagtcaacctctgcattggcctttgtataggggtctaaatcatcagcttgaaactcatccatttcaatggtcatctcgtcacttatcagaaaatttctcaatgagaatcgaccagcgagtgagtttggctgactgtgcaacttgtaaagggacctaacacttcttcgtaacacaagtcgagtgctcattcttgtgattcatatttccttgtccttccgcatccaggaggaatgatagtatctgttaacctcgttcttcttcttctagtatcaactaaagttgcaagagctgaggactgcagaattcagtaaattaggggtatgaccagattgattccaggacactatctactatcacgcccaaaccaggaaaactaagttgatgaaaatacactataagaaaaaaaaaatctaaaacagaaaactgagaatggaagatttcatatcaacaagaatatgccacaaagaaattaaaacttagtgaccgcattagtatcttactgaaaacacaagaacgatcataggcgaaaagaacaatatatgcagtagatgcacggatcataggcgaaaagaacaatatatgcagtagatgcacggtgatattattgaggagcaggcagataaaaactacaccctccatcccaaaatataacttttaaccttcaaaatttgtcccaaaataacaacttcacaagcattcctttcccaaccaatgacaaccctacatcattcaatttttccaccttcctccacttctcatccaaccccattaaattatacctactttcttaatgactgtatccaaccgtaaaaatccttatatgctgggacagaggtagtaataacttaactctaaagcttaacagcagcaagtaatcgcttcatttttgttggttgttcagtcacaaggcaggatagatacacaaaagtttcctaagttcagcaaaaaacagtaggacaattacagaggccgtcacgatccaatagtgtcaattgcatgcaaaacataactacaatccactattaacttatgatttagtacgcgcgtacaagaaaagatattctgctgaacagctagctgtacaagaacttgtgcgtgcatgtacacagtattatctgatgatctacaccctgaatttcataattcatatacttccatatttcaacattgttgaatgttaaagggaatcaaaccttatgatccttgcgaagcgatgattttgacatgcttgctctaggattttgattggagcagccaggtcgctttctttttctacctgaacgctgtttacaagagaactggttaaaatcatatatctaaccagacttggtagcaatgtcgagaatcaatataacaatcaaacatttcattcaacctaggaaacaaggttgaattgggaattaatgtattctaaaaacaagggaatacatggcactattaaacaagaaacttttgattcgacaattgtttcaactcttcttaaccacactatgacttcaggggcaattataggcagcaacccagcaaaaggctgaatcttttagaccaaacaagtatggtcagtagtttgcatctacgaggcctgacttaagagaaaccatgtccggtgatacaaccccaaatacacatccagacaaaagtttcctataaacagtccgataacactgaaagctgctcatatatctagcttcaggatttcttaccaaaatatcgcactagtcataatatcggcggaaatttcctcatattttcgcagtaaaaaaaaattgtgaatgtacacaaactgacaaacatgtggtccagattctgattttcaacattataaaagattacaaggagtcaagtctggtgatccgcatgaaggtgacaattgtgattacattcttttttatggatttcaattggacaacacgttcaccttcatcttatatccaaaagttactccacaacaaaacgtgttaaaattaattcatattagcagacttaaacccaattgcagggaagtaaaaataaagatcaagcattttactaggaaacaaggaaatatgggatgtatggagtttttcaacaactgattggcaagaacacaaaactggtgcttctgcaatttgtctactcttgccaattatgcttcgggccttcatagccaattccgggtgccaaccagccaaagtttgaatcttttcgaccaaacaatagtgcgtgataagtgattttgcatgtaagtggtcctttatttagtgaaactgagcccagcaaagcaatctctattccttagtacacatctggatgaaacattcaatgaaaatgaaagctcatacagtaggaatgaaatcaccaataaatcccccacatttttactgtcgattaaaatgcatcacattaaacagaaaatcagattaacacgagcaggagcaactaagtctcaacaattccaacagtcccagtgtcaaattccatagaagatagaaagaagacctacaagtagttaggaagtatttcgcaatgcagaaagccaaatttgcccccctaatttgcccagtcgattttgattctattctaagatgtcacaacatttcaaccaagatttcttcactcaagtacagcaaaaatcagccaagactttcacactggtaaatacaaataaagaatgccaagatcctagttccacattctaatacacaagctgattccctaaaaaaaaaacttttttttactgtaaagcaaacagaagaactccccatgttcctaacacaaaagatggcacaagagttaacttatgatttactgtgcacacaagaaatattgctctgaacagctagctgtacaaaagcttgtgaatatatatatatatcatgtgatctatcatcctgacatttcataattcatacacttccattttcaacattattgaaggttaaaagcaatcaaaccttttgatcctcatgaggcggtgattttgaggtgcttgctctagtattttgattggagcggtccagatgcttttgttttctatcgaaaatctgtttacgagagaaccggttaaagccacacatcttaccagacttggcagtaaccgcagagaattgatataaagatttaataattcagactagcaaacaagttagatagggaatacatggtattgtaaaaaaaggggaatatatgcgacttttaaacaacagactagaatgcccagaccagccaagaatgataagtaaacgtctccttacctttctcctgtcatacgcaagaatgctacttgggattgggagtaacttctcctcatgtggatttgaactattaatagaactaggagggagtgggtagatgatgtcatagtgagactctatgcgcagcaaggtcacgcaaggagcgccgcggacaatgtagtgcgtactttcgcaagttccatcatgaacgttctccacttggacggtcaccctgagagcttctgcacaagcttttactgcagcagaggttgcgtacacacgaggagcaattacgtgcttcgagcaccactgcatgcatccagagcaacaggtcagtcaggtgaaatgagtgtgaagaatatatagttgcattcagtttgtaacaggtcaggtctctaagggaagtgatgctgatactaacatcttccagattctgattttctccacaattagttgcacaccattcataattccatatgcgcgtgcacatccaggtagctgctactaatctgaggaaagcaaaaactgatacagaagaaagcatgtcagaatcaggaaagtggatcagatggaaggaatgaaggctcaaggtgttttctcactgtcatccgttgtatcataactgctgaagaactcaagaatcttccccctgtcatgagatgaaaaaaggcgcatgttcagtcagtgagatgggatagtacatttagaaacaacactcttccggaattgcagaaaaccaaacatttcaaaacctgattattgatattgggtgctcctgcatgcgcttccatccctttattttctctatcagcctctcaaatgcctgcaagaatcaatgatacaataaatcataacataccgctggcatctagcacccagagagtttaaccagcgtgttacaatggcgcttacagaatgatgatcatcaataaaacatgactagcataacttgtcggacaagcttccatagttaaacatcaagtatggagataatcattagaaagaacatttgatgagatagtagtaaggaagacatttgtgatttaggatcaagatggccaaaccatgaagcagcatgtgtgcagcatttcagtcttgaacataagacacctataatatttgttcttccccattatattttatcactattaatgtccaactgcaaaatttcttgcaaggttgaatattgttcaatcaggaagttaacttcacaaatttataattagaattaatgtcaacagggtaaaagactgcgatgtcatgccactattgtgaaacaatggtgtgtatctcctgcaaatgataaaacaaaggaagtaaaatgatggatacagattggtttgtacaatacaaatttagattagaggaatcatccattacaagcatgtttatgtcagaaaaaccaatataggggaaaaagcaaatagggaagacaagagattactttgtgtttctgggaaaattcagaggcccattgaagattttcagctttggtagccaatgctctaacagcagcaagaaggcggtcttcctcacgtgtgcctatactatcaacaacttgctcctgtcatacattgtcaaaactaagagagttataataacattgaacatacatcctatgctagggaatagggaggtggacacttaccaggtaggaaaatatgaaactcctatagaaacattcctcatctctatgtactggcctaaattctgaatagtgatggctgagatactttaaacgcaaaccaacttccggttgctggaaagaattatcaatgttcctgaaataatgatttgcagcttctcccatgggaattttctgcatcccacacacaaatacacaaataagggaactcaactaaaaatggtatatgcataagaaaacaacataactagaataaaatatattttatgttttatatgctccacttttctggtgtttatattctctgaaaaatgcttagaaataattagaattatcacttcgtttttattgattggttgttgtaaagtcataaaagacggaatatatgcacaagatttcctaaattcagtagcaggcctattccagaagccatcacaatccaatcctttaattgcttgcaaaacataaccagatttaacttatgatttagtatgcatacaaaagagatattctgttgtacatgaacaattgaatgtacagtgtcatgtgatctatcatcctgacatttgataaatggtgcacttccgttttcaacattatctaaggttaaaggaatcaaaccttgtgatacacatgagcaggcagttttgatgtgcttgccccgcaattatgaaacgggtagttcactggttctccttttctatctgaaagctgtttacaagagaacaggttagcatcatatattctcaccagacttggcagcaatctcagagaattagtacaaagaataaacactacagactaggaaacaagggaatatatggaacatttaaaaaacaggctagcaagattggaaaactagtgctttgacaattttgtcaactcttttccaatcatgctatgggtattctgagaaaattctaggcagcaacccagcaagacacggaatcttttagaccaaacattagagtatgctcagtgagtttgcatatacaaggcctatgatttggagaaatcatgtccagttatgaatcccaaatacacaccaagacaatttttttcatatatcactgtcctaagactgaaagcacatacatgcagctgcaagatttcttaccaaattatcacattagtaataatatggtgtgacagttcctcatattttcgccgtaaaggaacttgtgaatatacactagatcatgaggtctaggattctgaccctaattttatatgcccattttcaacatcatcacaggttaaaaggagtcgaatctggtgatcctcataaagtgaggataggtacttttttttgtggaattttgattggacaatgcgttcaccttgctttcatgttcaaaagctattccacaacaagatcgattacaggatagtaatatcaggatcaaacatttcacactaagaaacaaggaataggggatacatgaaacttttcaattacagactagaaatgtcacaaaactggtgcttccacaattttcctactattgctgattacacttcgagccttcatagccaattttgggtagcaaccagccaaaggttgaatattttagacccaacggtagagtacaccaagtgatttcgcatgtaagttggtcaattatgtagagaaattgaacacggtaatgcaatgccaattccaaatacacatccggatgaaccattcaatgacaatgaaagctcataaattcagctttaggatttctgagcaaaaaatcacactagacatgacatcacccaataagtcccccacaattttacagtgtgattaaaagtgcatcacgttaaacatcaaattacattagatcaagcaggggcaactaataagtgtcgacaatttcgatagaagatagcaagaagacctaatagtagtcagaaagagtttattcccaatactggcaatacagaaagctgaattgccccccaacatttgcccagttgattcttttttttttctttcttttttttttggtcataaggcctagttgatttcaactctgttataggatgccacatcatttgaacccagagttctccgccccaggtacagtaaaatcaagaaatcaaagattgccaagatcctagctccacattgcaacacaagaatacaagatggcacaagaaccgcatctaaggaacaggatagcacgttcgcaacggtgaaagatgatcccaagatttcacacgaacgacaaaaatgcccagccccagaccaatcaagaatgacaagtaaacttctccttaccttctcctcggcgtcgccatgatacgcacgaatgctactcctgagaagcttcactttgggggaatcagatgtcctctcctccttccttcgtgcctgcaagaacccaagaaatgctcaagaacaaatccaaaatactccaaggtacccaacacaaacgccatgacagcacaaatgcaagatgggaaccattacctgttcccgatcatcagagactgtaaaagatccttctccgatctttctctttcctttgcggtccaccaatgcagcggcggcgctcaaaccgtcgatgccgcggcctccgcctccgggctgctcacgggcccgcccctgggtgaagcgctcggtgggcgagcgaggaggcgagcgcggcggccgcgccggcccagagacaacggcgccgccctgggctgcggtggcgcgggagctggactcctgggagtgggactcgcgtcgcccgcgcccggatcgggattcggtgatattcccggtgatattacattgagtcactgacattccgagaatgtcacggagaatgtcaccgaatcctagtcccccgcgcccatggatcggtttcgtcttttggtgggttcgacgcggacgccatccacgcggacgggaaaaacttgtgggaagggcggaggggctgatttgctagatcccaattatgagagggggcggaccagaaatgtgtggaggttgtttcttttaattcttgaaaggcaagaggcttatctataaaggtgaaagtagttctgattcgtgagatggagtagctgataggggtagggacctggcatttttccagtttaccccttttaattctaaaaaaaagtttgccccttttaggggaatttaactatttatcactattaggtttaggggctgtttggacagtactaaaaattattttttaagtccctgtcacaaaattattttttaagtccctgtcacattatatgtttgaacactaattagaagtaataaatatagactattagcaaaactcattccatgattagcctggactaattcccgagacgaatttattgagcctaattaatccatgattagcctatatgatgctaagtaaatatgtgctaattatgaattaattaggcttaaaaaattatcacgtgaattagctcttatttatataattagttttgtaagtagtctatagttaatattctaaattaaagtccaaacatccgatgtgacatggacttgaagtttagtccctagatccaaacaccaccttagcaaataaccaaatagctctcttagatttggacttacaagagaggtgaattattaactatttgccacttttgatgacgtggcatgctaacatgggaaataaaattctcacccctttctatcttttgttatctccttcgtcctccatcgctgtatcgccatggccgacacgcacgctcatcttcctccttatgcccgcacagtcgattgcactaagctgtccacgtagctacctctagcatgcccaaggctcacgactgcttgcaaaaaggcaagaccacgccctacgccctatgccgcagttgcccccgtcaaacgcggctggcctcctaaggtacgctccatcactcttatcgagctagcctcctctaagagcaagaaggccaagtggacacttcccgaagctctccagtggcgatgacaagcttgttttcaccttgtctccctactttgaggccgagtgcaacaacagccagccaaactaaatcaccagattcaaaaggaacatgtttctttcctttgcttccagcaagtttacacctagtattcatgtgctctatgttctccttagtggtctcatgcagttttaacatcagttcatcacattgttttgcatcaaagttcaccctctctgaagttgggaggggcaaaagatcaataggagcacggggtagaaggccataaataatctcaaaatggcacttcttagtagtagaatgttgcgaacgattataagcaaactcaacatgagacaaacattcttcccacattttaatattctttttcaaaatagctctaagcattgtagataaaattctattcacaaccttagtttgtccatcagtttggggatgacaagtagtagaaaataaaagtttcgtccccaacttagcccacaaggttctccaaaaatgactaaggatttttgcatggtgtttggcactatggtgttcacttgcatgga

SEQ ID NO: 67717 - DNA, 7817 bp, Oryza sativa
actccatgcaagcgaacaatctcacgaaagaacaaatcagcaatgaaattttcttttcccttcttatgtttgatgacatatggaaaagattcaataaattcaacccatttagcatgcctacggttaagttttgcttgacttcgaatgtgtttcaaagactcatgatcaaagtgtataacaaattctttgggccataaataatgctgccatgtttccaaaattcgtactagagcaaacaattccttatcataaatagaataattcaaactaggcccactcaatttctcgctgaaatatgctacaggtttgccttcttgtaacaacacaccacccaatccaatctcactagcattacattcaagctcaaaagttttattgaaatcaggaagttggagtaatggtgcgtatgttaacttatctttcaaagtctcgaatgcattcctttgtgctgcagcccaagtgaatatcacattcctcttggtaagctcatgtagtggggctgcaatggtgctaaaatacttcacaaagtggcggtagaacccagcaagtcatagaaagcttctcacttgtgtgatcgttgttggaaccagccaactatgtatggcttcaaccttggcttgatccacttcaatttcctgcggagtcacaacatagccaagaaaagagacttgatctgtgcaaaatatgcacttctcaaggttaccaaataaaggtgcatcacgtagagcataaaaaacaacacgcaaattatcatgatgatcctctattgatctgctatatatgagaatgtcatcaaaatataccatcacaaatctgccaatgaaagcacgtaaaacttcattcattaatctcatgaaagtactgggcgcattagtgagaccaaagggcatgactaaccactcatataagccgaatttagttttaaaagttgttttccattcatctcctaacttcatgcgaatctggtggtaaccactacgcatatcaattttagaaaacacaagtgaaccacccagttcatcaagcatatcacctagcctagggataggatgacgatatctgattgtgatgttgttaattgctctacaatccacacacatgcgccatgagccatgaactaaaagcatggggacaacacaaggactaagagactcacgcgcataccccttgtcgagtaattcttgcacttgatgttgtatctcctttgtttcctttgggttggtcctgtatggcacacagtttggcaaagaggccccaggaatgaggtcaatctggtgctcaatccctcgaattggtggcagccccggtggaacctcctttgggaaaacatcggcgtattcctgcaaaaggttagtgaccggaggaggcaaagaaatagaagtatcctcgagtgaaaataaagtttctttgcaaaccgaagcattgcaaatagaagtgtcaggatcacttcgtccaaatctgactttgttgcaatgaaacaagatcccttcagcttaatctcatttttattattttgaacagagttggtgcatttcttcttatgcttctcaagttcattagccacaatatgatgctcactcctagtatgctcctgaagtttttgcttgctagctctagcaagttcatcctttaaaataactttaggagacataggatgtaacacaagcttttttccattatgcacaaagaagtactgattggaattgccaaagtataaagaatctttatcaaactgccatggcctacctaataacatagaacatgcttgcataggcacaacatcacagttgattgaatcatgataagaaccaatgacaaaatgtactcttaccaattgtgttacctttaccttgccgctgctattaaaccattgaatgtagtagggctgcgggtgtggttgtgtgctcaatgcaagtttctccaccatttcaacactagccaaattattgcagcttcctccatctatgatcacgcggcaagagcgtttgttgatcacacacttggtttgaaacaaggtgtggcgttgattttcttcagccctttccatttgtgcacttagcactcgctgcaccacgaggctctcatagtgctctgcagcttcggccccaatgtgttcttcatcttggtggggcgtgtcaccttcccctgcattgttagttgcaagcaaagcataggtttcttcatctaaatcaccagcggaggagtacccaccatcagctctcacgatcattacacgagtgcttgggcagtccttgcacatgtgaccaaagcccttgtagtgtaggcactgaatatcgcttgtccttcctgatgatgccactaatgatgaactcttggaaggtgtagcagcaacccctcttgctggttcactcaggcatggtgtagagtttgtcgtggaggaacgtagcttgttgcttgaggacgatggtgctgctgctcgagttgacggtgcaacagcgttggaaggtgtccaagagctagtacgacctgcagaaatgttagtcctgaagctagctcttcgtccctgcacttccctttcagctttacaagcaagatgaaacaaacggttaattgaattatattctttgtaggctagaatgttctaaatttctcgatttagcccacccatgaatctagccatatgttggtatttcttaacgacattactaggcaatggcgcagaaatactcctgttatattatggttacagagttcatccgcaagcgcatggatataccattgtagcatttcacctgagagtattccaaggatatcgtatttatttaatcccgtaggaagatcatagtagagagataataatcatagtctaagcaggggttaagataatcaaagggtagagtgacacacaagccaggaactactcattctcatactaaattacctaagctaagtggaaagaaaatagaaagagaatctattcctatacttctagtatacatagtatacatacattctagttatctgattaactagctaataccctctatccgatgtcctcctagtacttcaagaagccacccctgactgccgagttccttacgacagcccgtcatgaccatacaaccggggctaaatacagaggagtaccctcccctggaaattaacttaggactatatacacgcgtggaggaatacacgtactgagctgtcaccatcagcggtccacctctcatccgcagcatataaccccaaataatgatatcccgtaatctagacaccactcctaaactaccagatactactctaatatcatcgtcatgacatagagcaattgcataagcaaacactatacttgtacctatgcatctcccaaataagctagcagtacaatcagtataacatgaatataaagtaaagttggcattcatatactcggaaagtatttcaataccagaaatgtataaagaagagtattctaataaatgtacaaagcttacaaaagaggaaaggaaagctactagagccatacccgaaggcttccggactccgatttctactctattcctgctctactagcttaagaacactaaactaaacttgagagaatatgagagagctttgcttgaggtgtgtgagtgaagtgagaagaggagctccttttataggcatgtaatgacgattatgacggttggaaaggtcagtaataccctccaactgtcattggggaccaatcccagccatccatcaaaaccctacatccattggtgccacgggaggttcggccgaaccatgggctggaccgacctaacccaaactcggcaggtggcctcctctattgcttctctgcgaagacttgtgaatttttgcccaattcatcgtgtcaattctgagttcttggcccattcatacataagtctgattctcgacatcgttcgattgatttattgtctgatttgatgtcgattctcctccactttatggttattctctgcaaaaggttagtaaacctaatactagtggaatattattattctaacataaatatgcattgcaagtataactatttctcctctattttggtaatatttacggtcgaaactgatcgctaacgaccgtcaacaccataccagcatcatcattttccaccaaaccacaacgaagcattcctgtttgcaaagcttgataatactcttctacatatttgattccatgtctaagttgttgcaatttatgcagcaaatcacatgcatgatatgaaggaacaaatctagctcgcatgactcttttcattgcatcgcaggtttgtggagtgttatttggattggaacgaacaaattcactccaccaaatggatgcaaaatcagtgaacttactagtagcagccctaacacatttattctcaggaaaatcataacaagcaaatttctgatcaatggctaactcccaagtaagatatgcatcagggtcatattttccatcaaagcaaggaatggtaaacttgatcttgcctaaagaatcgtcattatcatgtacctcctgccgtggtggagcgcccattccatggcgctgttggcgctgttgtcgttgtggacgaccaagtacctcctcatcaagctcggtgtcagcagcgtagtccacttcttcccttgctgcgacgctgctattagcttcatggccaatgtggttgcgcctagccggtccatcatgaccatcttggctcattctcttcaacgtattcaagatacctgcaagagaagtgttcacagccacaaggggtgtctccaatgaggaaagcttggagttggtgtcaatttgagtagcctccaattgaccaaggcgatcattggcgaccctaacatcctcatcaaggccttcagcatgctccctcacttggtgctcaaaatgttgtatgatgcccctcgtacgtggtgaatgttgaggatgctcccctgatcctcctgtcatggttaatactccctccattctaaaatataaggcacaaccacccttaacccaaagaccaaaaataattattatcatcttgtagtttgaatcatcctaataaatataatgcatgcatccaataggattagataacatgagagtggaggatttaaaaaataataatttaatggagaagatgtcatagttaattgcatgcttgcatgcatgccttatattatggaacatctaaggaaagtggttgtgccttatattatggaatggagggagtaggaagcaacaattcacaagagatatgtcctatcaactattggagctaggtgttatccatctccatttctaccaaacttgtgcaaacgagttcttacatgttcttactttgctatgtaaaaggcgttggcaactagcaagaacaacaacaatggttagtagtaccagagccgacaacaagcacgatcctgtgatggtagtagataaaaaattgtggagctataggtgactgcaagtaatgtcaaggtacagctagaaccacattaatcaagcaagttgaataatcgctcaatgatggtattgtgttggtcctaggtaaaaccctgttagagagacgaacctactcacaagtgtagccactcaaaattgcaccaaaagaacacaaggaaaataacagcaacaacttcttctctatttttttcttttcttcttctccttgtttttcacttctgattttttttctttcctttttcttcttcctttttttaaactagttcaaagctgaaaatttttcccaatgaatttcgaaattactcaaaacagcaggaacaggaacaacttcttctcttttcattcagccaacatgtcaacacaatggagtaatgatgggctggttggagttacttggttcagccaacaagtcaaaagtgagggcacttaaatgctttctttggaagggctaattcactttacaaagttgcaaaagggttggctattggtggaggtagcaataaatgcatttgggggtggctgatgtagtgatgagggtgctgttggttgtggtggacgaaaatttggtgcggatgaaggtggattcgtggtgaatatggtgatgatggtggcagcgggatgaagatgaaagaggtgatggtggaagtgtttgtggtgacgaaattgtcaacagaacatgaaactctaaaggactaaactaccagaaccagtaactcaaccaatcgatgcaaccgaaaactcagcaagcaaaaactaagtagaacaacaaaggctcaacttgttttggtgattttggatctgacctattttgaggtttttttatgggctgtaggtaaaaacaaaggattgaaaaatctctcaccgagcaacttgagctctgataccacttgatgcagcaacgggggttctcgatctttcgatgagacgaggataaacttcgatttggaggaggacacgacgttggtggtccgactacaactaccacgggggtgctacgccttagcaaccggtgcaccgactccacgttgttgttgttcttgccgtgccaagaacaaccttgaacctacaagcaatcgaagaacaagcaagaacaagttgacaaggaaatagctcacggcgcttgtcaaatgatgaaattgaaacaaacgaaaatggggttctgaatacaagtattcgggtttactagctggtacacgcgagtacaaggacgtagctgaagctaaacttacatctaaacaaaactcaaaatacaaaatggtggctgctaggggtttatataggtggaggaatgactaggagaggaggtgggagcaaaccctagtttttgtggacccctaatgggctgtaaagatacaaggcccaagcccaagtttctgatgtgaaaactattttcgtcattctgagcagcttgggtcgaatctgatggtgagaccacacatagctgaaagtagacgacaagatctttccaacaagtactcatttgccccaattggccatcgaagtgaagagcattgacttcatcaaatcagcgctgctagtgttgtttgtgatctagatcttctcccatattcctaacaacaagtagatcataacaaccacttagtagcacccaattctgagaagaacttatatgagtagctaggaatgactttacctgataattacgttcacaagctcgagctctagtcattggtccttgctgtgcttaggcatggatgtatcgttggaagggatgtcctcatcagttctttttgacatcttcacaatctagcaatataacaagtagcaaactaggaatcacaaacaaaattttcaattcaatatctctgatttcttgaaaacttgaactattaataacaactagacttgacaattgaaattgattttaaatgacaaattagaaattttatatacctcacttcctcaaatcctcaattgctgagttcctgccttgccccttgctgctgccggcagctgccctttgcccccttgcccccttccctgcttgttgccgcgccgcgccgccgcgtcccctcgtcgacccacccccttgttgccgctcggggcccccaggccccagcggccagcggccggcgcgccgcgtgccctaactgctgcagtgtcgccggtcgccgcaacttcgcctggaaggctggaactggaagccgtcggccgtcgcacgcgcactcgcgcttgtatgccgccgccactccgtgagtctccgcctctcttcggtaggaggaaggagattagggttgggtgggattgttggggatattatgggacttctaagcctttagggccttctaaaaatctcagacaaagtctatctcagccccttcttaggattaggtattatgggggctctaatggtttgttagggggtagtgggg

SEQ ID NO: 67718 - DNA, 1566 bp, Oryza sativa
attagcgcacactaaccataccacttaacttccatctcatcaccaaacacaacaaaaatacggcaatcgatccgatcgactgatcgatcatctgtacatgtagatcgatcgaaagcaacgcatcgatagaacacgacacacactgaccgatcacctcgtcccctgtccgccgcctcgcctcctccgatgccgcctcgcctcgctcgagcagtgcgagctcccaccgccgccttgcttcgccgccgccgctgcaccccgccgcagctagccgcctcatccctcgctggcgctcgccgccccccgcctgccgctgtgtacatgagacggagagggagaggagagagagagaggaagagtgagagagagaagagagagaaaggggaaaagtgcaataagagtacgacagatggggccccactattttttaataaataaattgctgactggattgccacgcgtacgccacgtagaccaaaaccaccgctgattgggtcgaggagggtaattcatccagtttgcatagttgggggtgaagaatgtccggttttgtggttaggggggtaattcggactaccgcgatagttgggagggggggtaattcgtacttttctcttgctaggaacatccagctttctagacacagcacactacaggaacatcatccaaatagaacccttctggagttggaccaaactagatacaagcaaaacaacttagatagacgatggtagatgttgtggtttcagttgaaccaacttccctagcacagcttcatgccacccacccaagattgctctttcttcctctcttaacagcacactccacttctgagagaaagacagagctttgtaagccacctgcaagtgtgatttcaccaagatattgttaaaaacccaatcattcctagttagccaaatagcccaacagaagctagccatcatcagcaactaaaccctagattccttgtcacacctcactagcccaaaacaatcccacaaagatcctggtaaggaattcaagtttatagccaccttaagcacacaccaggaaaaaacagctaaagagcaacgaaagatagcatggttagtatttttagtttgtaaacagagtttacagaactcatttcctccttccaattccttttcaccaattgctcagcacaggggagtctccctctcccaactagatacaaaaaaatgttttatatttagaggaattctacctttccaaactgcccccatttaataccccaaaagttaaaattttgtacattgattttgtggtgaacacctctttttcagtatgaggccaacagacattgtctttatcagtccccatctgagcttccccaattaactctacaagttccccaacctctaaatttcttctaaactcaagctccattctccttgtaccaccatatccttgacagtagcattttgatcatgaataatttcaaagagatcaggaaatctaactttcaaaggtacattataacaccaaacatcattccaaaaactcacatctcttccattgtgcacttcctttgtgactagcctggaaagc

SEQ ID NO: 67719 - DNA, 10663 bp, Oryza sativa
  unsure (1)..(10663): unsure at all n locations
cctatacttgataatgatcccatctcattaaagaagcaatgaagagtgaacattcatctgaatggctaaaagctatgaaagatgaaatgaaatccatgagtacaaataaggtctgggacttagtagaaattcccgaaggagccaaaacagttggctgcaaatgggtctataagactaaacgtgaccccaagggaaatatcgaaaggttcaaatcaaggcttgtagcaaaaggatttacgcaaagagaagggattgattataatgaaacattttctccagtgtctactaaggattcattcagaattattatggcactagttgctcattatgatttggaattacaccaaatggatgttaagacggcattcctaaacggtgatctgtatgaagatgtatacatggcacaaccataaggttttgttatgaaaggaaaagaacatatgggatgtcatctaaagaaatcgatttatggactaaagcaagcatcaaggcagtggtatctaaagtttgaccaaatcataagacaatttggttttaaagaaaataaaaaggatgactgtatatacactaagtttaaggagagtaagttcatcttcctaatattatatgttgatgacatactcttagccagtaatgacaaaaatatgctactggaaacaaagaaatttctggcctctaagtttgaaatgaaagatctcggtgaagccacttatgtgttgggtatagagatttaccgagacagatcaaatggtgttttagggttatctcagaaagcatatatagaaaaggtactgaagaaatataatatgcataattgttcagcctcgcctgctcctataatgaagggggataagtatggaaaattccaatgtcctaagaatgagtatgaagctgcgctgatgaagtcaataccatatgcttcagctgtcggaagcataatgtatgcacaagtgtgcactcgccctgatttagcttttgttaccgggatgcttggcagatatcaatctaatccaggtctagaacactgcaaattagataagaagaccgtgcgttatcttcagcactaaagacctcatgctcacatatagagagtatgaaaaccttgcagttgttggttattcggactctgatcttgcagggtgtgtcgatgataagaaatccacgtcaggttatatattcacccttgcaaggggagctgtatcgtggaaaagctccaaacaaagagttactacatcgtcgacaatgcaggctgagtatgtggcatgttatgaagctactggacaggcaatatggctgaaaaactttatcccgggataacaaaccactcaaattatactgtgataacaaaccactcaaattatactgtgataacaaaccactcaaattatagtggttgacagtatatcaaaaccactcaaattatactgtgataacaaaccaacagtatactattcgagtacaacaaatcaagtgcttctgccaagtacattgatatcaagtaccatgttgtgaaagaaatgatccaggatcagacaataagcgttgagtatatgaacactaagttaatgttagcggatccacttacaaaaggcctaccacccgctgtatttaaagaacatgttgccggcatgggtttggtagaaaaaccttcgatcctggaataagaaggaacctatatggcactgactccccataaaactaaggcggactcattttgtaattaaataggaaccatagtcacttggttcagtggtgcttaattggctactgtaatctagtgtcttgatgtactgttttgttgaaaagtgagtccataagtttgtataagcctaatgtaataagttcaaagagctcgtaagattaaagaagtttattttaaaatataatggtatgctatagtcactggattctttgatgctttatattggtcactgtaatccttttgtcttggtatactattttattgagagatggacttataagtttagcctcacgatcaagggggagaatgttagtgtgaacacaaaatatgatcttgcggctaaacctaaagtcggcaaagagatattttgtttagggcgatcgctacagtgatcgatctctcatgaacatccctgatcgggggataaccgccataccctagtgtcggtttcccctgtgtgcagtggctataaatagagatcaatacctaagtgttaaaccttaagagatttctctcgctacccgatcaagcaacccactgaaacacagggaagaaccaagacacgattctctctgtgcttccaaactagaagagaagaaagaagaacaaagacagagagatgggaactccaggagatcaaggtatgatccaatcccatttcaatttgtagttccactttgtgccaaaccgacccaaagcaatccaacaattatataatgtattatgtgttttatttatttatatattattagatactaaatatcaaatacatattattttgacaccgtgtcattgtcctttatctcccactttttagacttcgttcgatcaagctcattgtgtgagcttccagggcacgcaaaatggtgtaagtcattagcacaggattaattgagtattaaattaaaaatgataataaatttattttatttgtaaaaaacttttatataaaaaaatttgcaatacatgcaccacgtaatataccatttagtagttcgggaaacatgctcgacataaataagggagtagccaatccgataaacgccttagaacatagccttaaatgtattatttaggtcctaaaaaattaataaataatacacaatatatttgtatacttggtcaaccatagcctaaaatatcaaacttatgtcctcactgatccccatatatgtaagttctatatataagccactatccactaattgctaaataatattatttacgaggtattcatgcacaatgcacctaaaaattagctgatatctaattagcacgtgtgtcatccagcaccgaaaataaatggtgatactaagtgcacaaccatcaacaaactatagagtaagtagacgatgcaaacaatatttgactacaagtagattacaactatgagtaataccattcctacacttctataaacgctcctaagatatcacatgatactctaataagttagaaagaatctatgaaagttatataaaaaagtaaacatctatccataaatttacacttaaatcgatgatccattactttcaaccattaaattaaattagatatattaaagtaatccctctgtcttaaaaaccatataatatgtctctacatacgtacacaactcctatataattacgtacacaagagatataaaaagaaaaaaaaaaggaagagtgtgtgtatgtgattcgtcctatctggtagttttctctttctttccagctctaagattttcccaaattgaggatatataaacatagcaaccgctcctagcgaggtggtaaaacaagccatgccgcggcgctgcctcacgccacccattgcttcactcccatctcgtcatttttctttaaagtatttttttactaataatgtaaaagtcaatcatatgagctcatataaatatgtgcagatgcacactatgaatacatatacatgcaccatatccctatattagaaaaatattcattcagaaaaaggaaaaacaaacgtatgtacaagagactaatattcgctagaaaaaaaaacaacatataactacattatatctatttttatgtcatcctcatccaaataattttaacaaattagctcaaattccaacgcatattaacccccgtgtacatgcataggtgaattagatgtataatataagaaaaaaaatcaaaacttatattaacttgtaagttagcataggataactgcgtgagcaaatattttttacgtggtcctcatcactggagctattagatagtcgaatgatcaaccctgcttttttaaaaaaaatatctatactactgaaatttagtactattgattaaatgcttaaacaaattatgtctaccctatacaataaatcaactctaagacacataaagactttcttatcacctccatcttgtttcacttcttccataaaagatgccaagtatgaatctcaactggctacattatagtaattatataggagtatacattattcggttaaggtgatccgagtaagatgctaccgttgataataatgcttaactggcctgctacttaccgataaaattatgttaccattgagaagcacgattatatcaatgcgggacccatgaatcaaggcattagagctaaatccttagcggctatagtcggattcatccgatcgtcagaggagcattcatattcatatataagtttaattgttttatcctattaattggtagaagcggtatttttaaatatttatatatagatttggacctgtgagacatggcacttggtatgatgtggatattaactttttatggtattaatgatgtattgggtattttttatgtaactgcaattccatcgattaaaaagacactcatacttcaaaacaatggtaataagttatggcgaatggtgaatttatatataattgggataaaatgatttttggttggatatgatagccattctgatcatttactacatcaaaattaatggtctattcaaggtaaaaaaaaattaatggtctatttcttatagtgaatagtgaatatggcgagatatgatttcttttagtattctttttataggcaataaataaattgtccgcgtatccgcgcgggcttcctttctagttagtctaataaagctcaaaatgtgctgctcatattctagatagtgtaccaattttaatttttaaacaaaattggtgtttttttaaagtacgttttaaactaaaaacaaagatataaccgcaagtaccgtgtgggagcgtcacaaaaattcaacgtagaaattcgcttgtaaaagcatgggtgcacgaacactgacaattatcacataaactatattttgagaaacatagtactaacgttacgctcaaaacacgcgcacactcatccctataaacacacactcacatcctacccattatccatttgagtatcttcagaagactggaccgacaaattttgtgtttgacaaaatcaccacggacgctttattgttaatgggtacatcacgtactacttaaaaattaattaaccataaataaaagcactcgtgttaactataggacttgaatttgataggatagttccaccataataaacttatagttgagctatagtcacttcgcaacttatatttgttaatcacgagtggcatgcctagataattattaatttgaatctgaatttttaagttaagggaatcaacaaaataagaaacctgctgctgactattaataccgaatccaggaattactaaatcatgagaaaatataactgagaatctttgtatttaggctatgtttagatttaggggtgaaaatttttgccgtgtcacatcggatatacggacacatatttgaaatattatacgtagtctaataacaaaacaaattacagattaatttcgcccgtaaactgcgagacgaatttattaagtctaattaattcgtcattagcaaatgtttagtgtaacaccacattgtcaaatcatatagcaattaggtttaaaagattcatctcgtaatttacacgcaatctgtataattagtttcttttttatatttaatacttaatatatatatgtccaaacatttactagaagatctaaacagtctcatacttaggttccgcttgcgaataccaatgagattatgtacgtgccgacgtcgatcaagccccagaactatactaaagcccagttggtgaaaagaagatatgagatcaagacgctgaggagaaattgacttgcactgaccttagacacgggcacacggcgatcgagattaactcgaattttccacgggcgcgtacaagcggataaggacagggtgtgcgcagcgacaagcaaggccggttaagagcaggtataataaagtacgataagccggcgacacaagcatccacgtcataaaaatcataggtggaagagagagaaaaccagagagagaagacagcgggtgctaatgcaatcgccgagctctagcacaggaaatgatgcaagtcctgagaaccagccctcagtcctagcttttgcccaataacttaacaattgctccatcaaagattgagtgaaaggaaacaagtctcattaaaaaaaatcaactgcttagggatgtgtgggtaggtaacttaacagctagttattatacgtatcatctattagtaacatctattacttacgtgtataaatttttaacccatcaacggacgatactattaaacttaaacttgctctaaagaagtagtagagggaggccgggacagatatcacaaagaataaagagatcagggacagattccacgagaaggtttgccgatatgccgtggccgcaagcgtccaagcgcaagcctacagctgcttacgcgatgccgctcgtgttaccgcctgcgacagaaaccgccatgcacgcgcggcggccgagagagatagagagagagaaaaaaaaaagagaaaaagaagaaggcggcaaccaccagccgcccagccagcgacgctcgctgccgctgcttcgtccgcctgcgtgctgggctgctgccgctgccggtcttcctcctttaatttgttccatgcccttgtcgcgtggctgtgctttgcatgcgttcgttgcggctaggtcagagtcagggtcaaagtaggagtagtgcgctggtggggtggtaggagtaacctgtgactcgtctgcgagaaaggctgctcctcgggataggtgcgttgagtgtgcgcgcgcgcgcgatgcatgggcatggcaatggcaattttgacagcggtacgtgtggctgcgtcccatgcggcggccgtaagcgtgcggtcgtccatgtgcgagtnngttggcgcattttggcaaaaatgccacggccggccggtcggcgccgcgcttgtgtccgcttgcgttggccggccggcgccacccgcccagctgttgtgctgcacatgcgtacgaacgcgcgtgcatatcgtggagctctctttctacgcctctctacctacaactacaacagggctagtacagctactgttccatggtggtgcagatgcaaaagaaatcaaatgcaaatatgcaacgcacacgtcggctcggcggtgaggtccaggtggcgagagagagagagagagagagagagatcgatccgggagttgatggcgcgtgctgcgccccgcgggaaaggcaaggtgggggcagacagcgccgtcgtgtcccgcgagccacgaccagccctgtcgccccgccaaagccgtcgtcacgtcgatcgatccatcggtattacttctacgcgcctgcgctgcaggccaggccagcggaaagtcagcgacgtactactacccctacgtgccgacgtcaccccggcccggtgaggcgatccacgacgtggcgtcagtactgatcaagttcatgcatgcgtgcgtcaccccggtgagagcacagcattcctagtgcatgcatgcgcgcgctcttcttgtccatcaagttcgatcgcctcgcgcaggaccatgccctcctcacctagcttccagcctgctttattcttatggacgatcgcccacggactactacataccgaccctgcagctcatgatacagagtaccctgttcgtgataactccagttaaagtatgcatttgtgtaaataaggatcttagagcagctccaataatctacctaaatcaaatcaagatttagtttttcaaagctctccaactgatttaacaagttaaacttattgctcactccaaccgtctctctattaaccctatcaaaaataacaagacccatatattaacctctagttccttttttccttccctttttactacccaacaagctagagaaccggaggtggggacagcgacgctaggaggggtcggagtttaggacggtggcgctaggtggggccggaggcggggacgatagtgcaaatcgatagtgagagttctcctatacggattgtagcatgaggagccgctcgatgccgtggatatgatgtcatcgggccacatggctgccaggtgcccacctacatcgaagtcagagacctagtccccttgccctagagagcttgatgtgctcagcagagaggatgggtgggaggacggcaaggggaagagcttgttggctaaggtgtggaggtgggcaaggaagacgtagaaagaagctatgtgcagcgacttgcgaagacggcgtacggcaaggaagatgacttcccatccgcgccgccataggagcacgtgttgatgccgtccctatccatggccacgggtgtcgctgaggtcctgcttgtcgcaggcgtgcccacagccggtgtcaggcaagtcgcagggatgtgcctcgagctgctgtccatgcctatgaagatcgacgaggcggggttcngacgtaaagnaggtggttgatagccggcactgaagaacgtaaagtgatgacactttggtgatgnaggcgaagtcggtcattgacagacgctggagcacaagaaagataagaggggcgtagccacgtgggaaggaaaaatagtacgtgtggcccactgttggcaagtgattttggttggccaaatttggtcagtgaggagagacatttggtcggtcggatggcttagcaatccacttggcgagattattcgagcacaatttttcgttagaattgtctaattttagcttaaacagtgattcggagagaggttgttggaaattctctcggatcagatccagttaattgtacgtgtgacatagggactggtaagcaagaaacatgcaaacaaaatcatgcgctgcctatcactactgttggacgtaattgtcggcagtattaattcagttcagttcagttcaattgaagaagagtaaagagttgaatcgcagcgcagcagtacagtagggccagccgcgcgcccagccggccggtagcccggtaggcaggagggggccctatacgtgcaggggcactcgtacaaacggccgcatgcatgcataaatgtgagccctttttggagccgatcgatcatatcgtacgtgccgaaagccgattcgccggagcccttgcgcccttttcccccaacacccataaatatggcagtcataccgttgctgttcctgtttcttgctccatcatgatccatcgatcgatcgatgctggagtactgcaagggtgtggctggagtctgtctgtctcgatcctgctagcagtactacgaattaaacccagccataagatatacaattgaaattctttatatttcaaaatggaggttgtagcttactgatattttaacgagttcagttttagttggatgcaaaatttgtactcctgtatgcactatatatttggattgatcatccaaggtgtctcaagattcgtcttattaaattgacaacaaagttactatggtccggctcatttctcccacaagagctggattaagataaagattttcatggcacgttttttaaactgctaaactgcacgtttcgtgcgaaaactttatatataaaagttgctctaaaatatcatattaatttatttttcaagtttgtaataattaaaactcaatcaatcatactccctttattccaaattgatcatcgtactccctccattccaaaatataggacacaactactttttaaagatgtttcataatataaggcgtgcatgtatgtatggcaattaattagcatctcttctctcctaaattattattatttaaatcatacactcacaagatgcttaattctagggtgcatgtattgtgttagttggattgattcaaacaaagagataataataattgtttcttgttctttgagtcaagtgtggttacgccttatattttggaatgaagggagtataatttatttgaaaatattcctaaatgatcatcatatttatgttcattcattaagtctattcgttatttgtgcattggggtaaatgagcattgatgcaggcatccatacacacaagtgttttgatttgctattggctagaaaatagtggggattgtgcatgcatcaagtttattgctaaagtaaatgtagcatgagagagttattatattttcttggtcttggtgcactcatataatatgaagatcaattaggaataaagggagtacgttaataccacctcgttttgcataaaaaaataatcttcatcttcatcttcaggagaaaagaacaccacctatgtctcacgataattttaatttgcttttgttcgtcaatcataattcatactccatatattaatataatattcttgtacaatactccctccattccaaattgatctacatataattttttttaggttattcctaaatgatctacatatttgtgttcatttattaagtctattcgttattttatttgtgcattagagtaaatggacattgatgcatgcatccatgcacacaagtattgataacccacatgcaatatcttgatttgctatttgctagacaatagtggggatggtgcata

SEQ ID NO: 67720 - DNA, 12316 bp, Oryza sativa
tcctatcctaggttgctacattataggacgaaaggagggtcatgtctaaattcgtagtcctagtatgggacctagattgttacattatgggacaaagggagtagcaaataatagtccttttggcctctatataaacagtcattgataatatgcctgcgactaacaatcgaattgggatccagtgcagtcacgatagggactgcaagttaacaattgcacacaacttcaaccatccatttttatgatcaacggttcatatctaaagctacagtacccatgtgaacagtattcaacgctacagtattactgctacagtactgtgaacagtaccgtgtgtgacctgagccacccgatttgtatatactgctactgcttaagctgcagtcacacaaatccctaacaatcatacaaactgcctatgatttaggcacctagcatgacctcttctgtatcatttgcaagtgtcctttagcactctggtctaggagatcataaataacacaaagatcataataagagaaacattttattaagctcaccgcatgcatgaggcaacggggacgatcgatgagctggcaaaaaaaaaatggcccatgtgggggccagatcgaccaacatgatagccaaggtacgtaatgataggttttataggcggcagatgttgcgatttgcatgggaataattttgatccacatccagaccgatagatctttccaaatcaacacttttaggccctccatatgtcatcatgttaattaaccacggtccttttgttatgtcagtaacagtaattgtacatgtaactacatctttggactttagcttttacatgcatgcatgcctataccttttccttgtacatgctacatttttatgcagcggtggtggtactactgcaaagtgagagtatcttcaaagtacaatttgtttggtcggataggagatcaggagagaccgtcagtacaagcaaaaggacgttacgcaagcagacacaggagacgtaaaacagtgcagagttgttacctcgaacggagagatgaagagaaaacaaaaacagaacgggggaagaaggcccagctagctagtgaagacattaagaaatgaattaagcaaagaaaaaaaaactatagtaattaaacgtggtcataaaagggcagtagtagtttagtgtatttgattgattcttgcactgtttgttgagccttgatagtcgcataatcaaaagtagcaggaatgtcgtaggagctacatacatgcttctgttctgctctgcactcattctgaactagattcgagaatgtttcattctttcagtttcagatggcgatgagaatatgctgactgtttctatgttgagtttaagtattcgaactgtaactaattaatttaccatacatactgacggatggtcaaagactcagatagttttgacgaaataagcagaattaattaaggggagatgaaataaataaaacactggtagtagtaatttcagtagctagcaatagcatgcagcatcaaagcaagcaaatccagcgcacgcgccaacaaacaaccacatgcgcgcgcgcgcgcgcgaagcatgcacgagacggacagaggcagtcgtcgtgaagaaaaaagcacacacacaccaacctcgatctctcttcttctagctctagctcactcactctcaaacacacactcactcacacactgattaattagctagcaccgtgtaaatgggctgtatctcgatcgatggatatcctattagcagcagctaaatcaatcaactacttgctagtcatcatcatcatcttcatcttcttcattagcagcagcagcagcagcagcaggtaaagctttttgcgtgctaggtatactaggggggctaagccagagcacgccaatggcgggcgggcgaggcctagagccagagcgcgccggcctccttgaggagggggacgagggagccgttgatgtgcgcggccatgacgcggtccatggcgccgacgagcttgccgccgatgaagacgacggggacgacgggcggcgacgcggcggcggggccgccgtacccgacgaggcgcgccagggcgcgctccagctcgcggccgcgcgggtcgaggtccagctcgtgcaccgtcgggtgcacccccatgccgcagaagaggcgcttcacggcgtggcacatgcagcagctgctcacgctgaacaccaccaccgcgctctccgacgccagccgctccacccgcgccaccgcgctctccaccatcggtgccggcgccgccgccggcatgtaccacgcctgctcggccgccgctccgtactgcattctcgccgacgacctggccggtgatctgatgcacaaatggagatgtgtgtgcttccttcgcctgaaaacgattagcttagctagagaagcacagagagctgagctagctagctgtgtgcttgtgtgttgctaagctagaatcaactgaggtgagcttgaacacttggagaagggagtgaagggtgctgggtatgtatatatagagaggagggtgaggggtacaatggtaaatttaggggggcagggaaggaaggctaggccacttccaagccaatgaggtccttttggggttccaacccaatattactcggttttacttatgtttttttggggggtagcactagctcaccactttgtttatttttcacctgtctagtttagtttattgtcaatctgttggtgatgtgaattctttgacttgcttgtatgccgctggtagcttgactcatgcattactcgttgtacatgcatgttttttcacctagctagtggtagctcctccattcatatatttgagccttgtccattgtgctccctttcctggttaattcagcccaaatgaacattgaacaatcccaaatcaagcacaatacgtattgatcatttgatcagagacatattctgcaattaacagaagcatctggtcaacttctatggcaaacaagtcattcactactaaagtttagtataggtgaatgttagtaagtactttccctttacctggaattagtcatatatattatatactaaaagttcattaaacttcctacaaacgcttctaaaccgccatgtgtcaccctataaacgctcctaagccaccacgtggcgctttaataaattagagaaaaaatatgaaaaaagaaaaatatctgaccgtcaattttcatttaaaacggtggacccgatactattaacctttagatcaaaacttaaaccccccccccccctcaccctttccttggctgtcaccacatgtgtacgtacgtacgtacaaattcctcccccatcaatctcttcttttctttcctaattaattaaggcagttaaaaatacacaccataatttgttaccgtggagtcaaaagatctgtttttccatagagttttagccgggagcgaacacacaatcactgttatataaaggagtggtctcgatgctaccgtaaatagaaaatgtgttttcatgggtctcatattttacaggaaaaaatatatatttgaaatatgaggatggcatgagctgtcaattatatgggattcttaatttgcaacgagcataattgtgacccattacatataatctgatgagtaatttcaatgtagtctagagtttatggattttaatgtagtctatgaagagtataattttaattttatatataatatttgtaacacaatatataatctatgatgataacatcagttatcttattaaaaataactttctaaaatagatataatctaacggtctaaaataatgggtccactaatttaaatgaaaatcgacagagaactttttaaatagatataatctagcagtctaaaataacaagtccaccaatttaaatgaaaatcaacgatgggattgtagaatgccacgtgacggcctaggagagtttgtaggaaatttaaatgtcctacaaacgctcctaagccacgacatggcattttaaattagagaaatttctaaaaattctaagaaataaaaacaaaacatctagccattgattttcattaaattaggtggacccattatttaccaccgttagatttatctaaagaaaaaaaaactccctaaccccaatcaagggtccacctaggcctatacgtacagtacgtacgtacgttttctttttacaggtaacaagtgcgtacgttcgtaatgtacttccaccccttcttccctcaatttttttcatattgcacatatttcttctattcatactttattagttacaaaagcaaaaaattggtgttaaacaattcagcaactataacatctaattagaactattttttgatccacttatatctttaaatttatttatgactaaatttacagctaaagccaaatgttcactataattcaactttgagaaaaaaaaagtcaatttggattttattttcagacggtcacgtgccattcaagcaattataaaaaatatgaaataataatgatattatagactcaatcatcgtgcataacttcataataattaaataatatctacaatcataaaggtaaaaataaacataccaaaatatattagttagaaagcaagagttatgctaaagaaataagcaactataacatctacatcatggatccctaaatcagataaataatatttctgcttatgtattttgattactatacatttaaagacccatatttggggttatattttctggctttgtgtgccattcaaacaactacactactggagaatgtctctattctcccggttcggaataattcaattagatatgtaatgacaaaagtaaaataaatctaataactctgagtattgttccaaaaaattactcctcccattttgatattataataaatccaaaataacattagtaaatctgtagtgttcatattttcagtatctcctatatacgaaaagatgagtaaaaatgatatatcttaatcaatcaataaaacttttattctatttttagttaataaagtaatggtaactaaaacactacaaatgtaaaaaatataattatatgtgggtgtactttgtccccttctactttgtgttcttttcctttctcactcaactcctccttataatttctaactaattgacaacataatacaaaaagatcaataattacaaagcaatataattatgattcttatgttatatattttttaagagaacacagcaggggaggcccccgatgttaatataattttattaaaatagaaaagaacatagttacaacagattaatccactttttcttatgttatatctgatttttagtttatttgaattgttattttatttataattaaataaaaaattcaagacgcatattattcatatttcactgtataaaactaaaaatacaccatttgagcatacacacctatctttgcatgataaccaaatagaaaaaaaatacagaatattataaataaaaaatgacaataggtttatatgacctcaaatcattgtgcattctctgtatgtgtcacgtgttatgtcttaattaaaaataaaacctcagaaactgtaaataaagacatctgaccattagtttccacttaataggtggatccatttttttaccagtagatataattttagagaaaatcttaagccgccatgcgctacgtcttaaaatttagaaaaaaaaggatattagaaattttgacaaaaaaatcatcggttttcacttaaatcatttaggaaaagaacacccctccacttcgccctcccgtcacatatgcacagcacaacactacccgtcccctctcctctcagctctaactcaccactctctcctctacccatcaattttttattgcaagaaataatcaataatattaaaacatgtatatttttaagctacacatttgatttttaatctgactattgctctatccataacccctatattttgaactggaataaaataaaatttacaatttaaaatatcaatagggactaaattgaactatttggagaaaatcaaataagtttgaacttttcactaaaattgaaccaaccattacatgttccatttttctaacaattattaaatgcttaaatattagtggtcttgcatctatccaataccatattattacgagtttgtctgcatattaagccacactaagatattaatatatagttggttatatttgttactattatatttaaatttttggactcatgtcgactatattttcctatagatcacacatattaaaaggaagcgaggttctaagatatgtttttgttaatttatatgtaagtatgtaaaacatgcatattgaaccaactaaaaagatgactaacttgatggtacaaataaagcatgtttactaacaataatagttctttaggatttattaaaaaaggccactaaacaatcaattaaacaagacaaaacattttactttatgtttattttgttaggcacgtttttcaaacaaattaaataggtatttttgaaacattgcaggtgtttatacagatcatacataattgtttataccgatggattaaatattatatattttaaaagctaacaaatagcatggaaaaattatctaagtaatgttgatgaagaaaaattacggagaaatagtacttttgaaacatggcatgtgtcatccggttgatattccgcgtatataagcttttcaaatgcaatctaaatacatgcccgcgcaatacaagtttttcaatcatggcaatataagtttttcgaagtagtacttttgaaaaacttgcaggtgtcatcggttgatattccacctatgtaagtttttcaaacacagtctaaaatacatagcgctaccttcctagttaagatgaaaagttgcatgcaattgtacatgcactgtttggtttctgaaaatgtatgtgttgtgctgcacggagacaggcaatgcaaccggacggattaaacgcaaggctttttctttcatggcaatgcagcagcaaacactgcgagtgtattacatcaccaagatgtttctttgtcccccctggcttttgtgcgtgctagcgtagtaccaccacttttccggggcacagcctgtctttatcaatgcaaaggagtggccggcgcccctgcgttgttgttctagtactgctgagaagagaattggctacgagatttgatttgatggtgacagagagaaattaaaagccatcctccaaaagaccggcttttgcttcagcatactactcccaggctgtgtttagtttagcgtaaagtttggcttttggttaaaattagagatgatgtgactgaaaagttgtatgtatgacatgttgatgcgatggaaaaggactaaactttaaatccaaactttgaatctatacacggctatgtgtgtttccagaatcattcctagtcaacaattcaaaaaagcttatgcgtgcatggatggaagcaaaagatcgatcacctcattctgtcatacatatccgttatggaattggttcctattcatactgatctactacttttcgaatcttataaagattcagattaaatactagcacgtaaaaaattattacgtatgattaattgagttttaattattataaacctggaaacgatatatttaatattgaccaaacaagtgcactaacgaccatgccattgcctaaaatatctcctatttataaccagagggagtaccaaattaaaccccgggtgaaattctgagcaaaattaagagctttcaaaggagaagatcgatttaacgaagaatttccctgcctttggaggaaagaaaaaatcaaacaactttgaaaccccagcagaacaacaactactactacggcctttggaagattcaacggccgggcatgcccatgcaatgcaaatgcaagagatatgcaattgcaactttgacagcgagagtgggggtaatagcggctgtcctcgtccttcctgtcgggacgagacgactgtaccgtgcatgcatacaggagtagtaggacctacaaagccagagcaagagcaactcacatgcgttacatatatatggccaaaacgagctttttggtcgacccccagccaaagcaaaatcaaacgaagccagccacgcactgttctctgttcgcgtttgctgtgctatagctgtgatcacccatagtgccccacactagctttggctttgctttcttccccacctaacatgcaaggagatatcatgcgtgtctctgtttgttttcctcgtcacactagggtttgcacagtgggcgttgtctccggccgggccattgcatggtgctctgctagcttgttgttggctttatgtggcagctatagcacacattcatgggacatagttattgtcttctgtggtgttgaaatgttgagaccggccgggttagaccataatatctgatggaataatagtagttgtggagatctatatatattgcgaaaacgctaagtaccgcgtatctgatcgtgcgctgaaaaatcggtcgccacacgcgccatgaggtcgagccgcgtggatcggacggctatccatcggactgtgacgttgccgttggatgttatccaacacaaatgctcccatctctcatttcttcaaaagatttttttcttgtaaaccatttatctaatctacgttctgattacaccattaaatttgttacaattaaatctttacaacaagaccacacatgattatatttcgacaaaaaaatattttagcttttttattgatatttttttagaatgctgcatatggttcttttgatgtttcaaccagtagttttacgatgtttcagctagtgtactcgtgatgtttcactaagtacgaatcaaatattgcagtggattttgatattatggaacgtcgttgtaacaaatcacccatatattttggaaaccctctattaagggaattcgtttctttttttctaccaaaaatgttttacctagtgtacccatgatgtttcactatgtattgatctaatgttacagtgaactgaaacattcttttgcaacgaatcacccatatattttggaaaccctctattaagagaattcgtttcattttttgttctaccaaaaatattttacttagtgtactcacgatgtttcaatatgtatagatctaatgttgcagtgaactgaaacattctttcgctatttgctgaaacattgtttttatgtaaggtgaaacaacgctcgatttaaacgattgaaacattttcgacctacttagtgaaacaattccgatatatttggtggaacatcgtgcaacatttaaaaataatttaataataagctaaacaaatttcatcggaatatatccatgtgtggtcttgttttgaagatttaattgcaacgaatttaatggtgcaatcgaatcatgatttggataaataatttaagagaaagttagtttaaagtggttttgcacgcatgcgtggtgctgacatcagacgtcagcacccgaattttacatgtttggatcgggttcccgatgggtagtcccctcctatatattgggcacccccatctcctataccccctgcccctaaaacagaatgtaatgggcaactagattactagagttatctccctcttggggttgctctcaaaaggaaaacaatatttaagttttaaacaaagtcataaaacctagctgcttccttagttgtttggtgttacagaatataagctacaatactagcttgtgcatagaatggagaaattttgaaatgctgttcaagttaaaaatggaatttccttttatttttgtgtgttttgtgtattcctcttcatgatgtttggagtctaagtagtactcgtgtatcttttggctagctgtatatcctttgtgaatataaagaccagattaatgaaaaattcattatctaaaaaatctatggcctgttatatttatataatgtgcaaatataacacattatatggtttgtcaaacgtgtgttgcacccactattttggtattataaatctaaaattgaaattatatgttacttcaaaactaatcattatatgatccttattttagattatatctggtagctagattaataaagaatacatatcaattacatctagctaattaataatttcaaaactaaataatgaagtgagaatccagtactacaggtacaactttatatttatcaattttaaaagtttaaatcactaaattttgaaagaagaaaaacataaaactagagagtccataatattaacaaagacgtgtgaatggtcaaccgactctctcttttgttgttttcttttgctacattaattaatcggtggcgtcaactctagatgggttacgtgctcaatctgatttggttttgagttagggagatcgtgtcagacgtcctgaatcgctgatttctccataaatgtagagccgtcagccgtgacctccacactatacatgccaaaaaacaattttagcttatgttggagtgggacgcgaattctggctcgggcacctgatgggaggaggtaaaaatcggatgctgatgtcagaatgatgtcagaacccgatttacgtgcaaaattaatttaaacttatttttctcttaaattacttatccaaattatgatccgattacaccattaaattcgttgcaattaaatcttcaaaacaagaccacacatggatatattctgacggaaaaaattagcgtattattgaattatttgtaaatgttgcacgatattccaccaggtatatcgtaattgtttcactaagtagatcgaaaatgtttcactcgcttaaatcgggtgttatttcaccttatataaaaacaatgtttcagcaaatagcgaaggaatgttttagttcactgcatcatttgattcatatatagtgaaacattataagtgcattaggtgaaacatttttggtggaaaaaaaatgaaacaaattcccttaatagggggtttccaaaatatgtggatgattcgttgtaaaagaatattttaattcattgcaatattagatctatacatagtgaaacattgtaagtataaggtgaaacatcttttgtggaaaaggggagggacaagtgggtgggtccagtgggggtgcgcacgtggggggagggggagcgaccgattttcccacctcccctggtcgaccgatcctatttattctccattggagtggcgtaatatttggcggggttacgcttcctatccaatttggttccaatgactaccgagctaactctccatgcaacacatcgtaaaagaatttatgattttgcctcctcctccgtactgtcatcccgctcgtcggtgtgcactggtaattatcattagagcatatcttcggaacttattaaaaataatactattttaatagaaaattgcaaaaatagagatcgaccgactaaaatcacaaatttaataccctatcgaacaatcattattcgataagataaatattgaacaactgttgtttgacagaggttacatgctaaaaagtaaaaatataaaagctcatcgtgcagtgcacatgctgccattgcagttgggtcgaaggacctatcgaacagctatagttcgatagacgtctcttttcatattttttttattttatttaaatatactaacaaacctgtcgaagaatagttgttcgataggctatctattattgtatgttcagtactaatcgtgccgtagttgtttgatatgtagttcgacagggtattaaacttgtgatttcagtcgagtgacttctatttttacaattttctattaaaatagtattatttatagggcaaaaccgttctttttagaagcgttatattgctacgtttgactgctcaagttcgtccactatggttcgtccctcctctaagttcggacgctgcacacgtcatcatcgacacttggtatcatacatcgtcaatgcacatctgctgagcccacaaacctccaccatcatataactagtgctttcccgtaaagtgatattttcttatgtttttggcaaaaatagggtggtgtattcttattataaagatgaggaaaatcgagccgaggatcaaattaatcaatcggagggaaatattcatcttgccagtggagattctctacagtaccactgatgtagtagtagacattgacgtgcgagtctatatccacatgtcaaccaaggctgcggcatcagtagtactgcaaagggcatgcatcctccacttacatgtttgagcatatatatttttatggcggtgcacttcatcgatcccaatgcaaaaataaaaataaaattg

SEQ ID NO: 67721 - DNA, 753 bp, Oryza sativa
ctgcagccccaattcgacctgtggaatttgtacataaagcatcactatcttgcgctgcctgatatgtagatgctggggggggtaattcatctacttcagaccattctgagatgaaaaaaaaatatggtattatatgggatatgaattgatcaaccgctaggacaagggctaggctacattccaactgtctatttggactctgcagatgtaaattctcactgacgcgtgaacatactggttagcttacatgttaactgacatgtttcggtcaacatgggcaggggctgagaagactagggtgaacagcaatgcaatactaatggaaccttatgcgcccaaggatgccaatgggaatgtaatatgagaacaaactttctccttcccagaactctcgaccgccaccatgaatttaatgccaaagtgcttcctgtacgaacgaggctttgggcgcgatcataagggccgactagatagcactggccacttaacttatttgacaaatgggtatatgcttcattcttgccttcacctgcggagagctgaacaaccggataattgcactgttgcaaaatcttcactgaacactattgattggctaagatacacgtacggaactgtttacatgactgacaaatgaccatgcttaacacctgtttatctcatcatggttgttcatgcataataatactatgcttataccactcgtcgaaatacattgtaatcttggcctggaccgccttctttctgtttaaa

SEQ ID NO: 67722 - DNA, 767 bp, Oryza sativa
tggattgggttgaggggggtaattcgtccggtttgcatagttaggggtgaagaatgtccggttttgtgattcaggggggtaattcggatgaccacgatagtttgggggggataattcgtactttttcctcacagcaataatgtagtatgttcgtgtttttcttttcgttttgtgtaagactctgttcctgtagtcctttcggctttctcccaaaagccggatcaatgcaagttgatatgttctaaaaaatatagggcatgcagaggaagatacgatgttgagctccaagcgatcgttgtgggatcaacacagcagcaacatcgccacgtccagtaaaaggtcgcggtggagggacgatgataaacacctctacatggtgcttgattgggacatgggatacgtcatccacaagctggacatcgacgagttcaccgattccggcgccggcactggcgtagccatgttccaccacctttcttagccagtcgccgtccacatagaggtgccggtggaccgctccttcctggccatggtcgcggtcggcagcaagatcgtcatcgccacgcatgccttccatgaggattctcccgtcttcatgtacgacacagggacgtcgtttatggccactggccctcgcccaacaacgacgctgatgctgggcatcatggtgcccgtcgacggccggcggctgtatgcgctggaccctcgcagcacgtcgaagcactacctccagacagtggcggagacagcgtgggggcggatggggg

SEQ ID NO: 67723 - DNA, 2929 bp, Oryza sativa
catttgaggaggaatcaacattataggtggcatcgcacacagagatttgataaagttgttcccatccaacggcgagaccaacctctttattatcatgcataattatacatctattgtttccaaaagtacaatagtaaccaccattatctaaacgtgaaactgaaactaagttccttttcatagagggtacataaagaacatcatgcagctgaagtttgaagccagtatgaagtgtgagagtgaagtctccaatggcctcaacttcagtttcaactccattagcaactctaattcttctttcccctcttcttagggtcctcctcatagcgaatccctgcaaggaatttgcaacatgaattgtcgctcctgagtcaatccaccaagaattggtggcataatcaatattcagggattcatcaacaaaagaaataacatcagtacctttcttactgagccatctcataaatccaatacagtccttttggcggtgtccactctttccacaaaagtagcacccatccttttcttttcccttttcttctgtatagggatttcctccagatttattttgctgggattgattcgaagattgccctttttctttaaattgaataggcttaggcttcaaatactccttcttaaatttcttataccttttcttctcggagtgtttaaataaatttgcatggtcaactctttctgccttaagcctttcctcttcttgtacacacatggctattaattcatcaatgccccacttgatcttcattgcattataattgatcgtaaatggagaaaactcctgaggcagagatgacataatgaaatggacaagaaaacctttagagatttccatttccattgatttaagcttagaagccatgtgatatttcttcataatatgttccctcagatttccagtaaaatcatatctttcattgaccaatcttttaataagagtggtggcataaaccttagaagagcctttaaactgctcctcaactttagcaagatattctctggctgtctgagtatctggaactgctcctcttattgcgtcaataatggagctcttaataatcataaggcatttacggtttgaaatatcccattttgcctttacttcatcatatctcctttttagggtctcataattttcattttccggtataggctcaaccggaggatcattatggagggcataatcaatatccaactgagctagagtaatttccagcttctccttccatgaagcataattacttccattaagttgttcaatattgcctattattccggcaatttgtgaggcgtaagatgctgcataagagagaatcagcagctaaataaataccttcttttattgattaaatccaaaacggctttggccagagaaggaaatgaacaataaaattttgtgaataagtatttattaatcagctttggccagaataataaatacaaaccacactttatcagtttgtttaaaactccttttattaattcaatcaaaacagctttggccagatttgaattgaattaataaaatttttgtaatcaaataaaagtcaatcagctttggccagaatgacaattatttgtcacacttaattgtaatatttatttgtagcggaaataaactcataatgcataaaacaataataactttaagtaataaatataatataatgatcataaaacaaataaataaatgaaagtgaattttatcacataacaaagtcacttattattcttattatcattaattaaaacataataaaatatctttaatgtttgaacacaatgatcataatcataattctttaaaaggaaaaaagttaattgtaatattatcttagcccaatctttaattaggcccattactatacagcccgttactatgcagccacacatttttttaatggaaatcttgagctgggcctttctccccgagccaggccgcattcggcctggcccatcacagccgcgccgcctcccgcctgggctccaggcccatcaacctgggcctgggccggcgtttgctgcctctctgtgcggcctcatcagcccgcgtcgggagcgacccgatccgagccgtccatcttcatcggacggccgggatcgctcccatgcggaacaaaaccggcgcggcggccgcccccgcgaaaaccctagcccccattctctcctcccctctttctctcacgcccgcggcgacggtgagcgagacgacgacgacggcgaagcggcgcacgacggggtggagatggccccgccgagccttgctcgccggggttgcgtgccgccatatccggcgcgcatccccgtcgagcgttgctcgacggtgccctaagtagccggtcgctcgcgcaaggaagacccacggcggcgacggcgagacgagcggcgacggctacctcagcgaggcggcgacggtgacctcagcaaggagcacgcgaggaggaggagccgggccggcacggcgggtcgcgaggccgctcggggaccaagtcctcgggtgcgtgctcgcctcttattgcgtcggggcgacacgaaggtcgccgccggccatcatgcccttaggtaagcccgccgctctccttttccccatgattttagggttagggttccatgatttggggaatttttggggtcttactgcagctagggtttcggttcttagggatttgtttgagatttgcatgaatttttgctttccccttcttctaatttcttcaacccgaaaccctagaaggcctattccatttcttatacttcgggattgcatgatttgggctcaattcaacattaacagagggatttgggcatgaacacgaagaacaatttgaacataaacacttattgagttccaatttgaggccaacccggtgctctgataccatggtggattgctttggatcggtttggc

SEQ ID NO: 67724 - DNA, 2544 bp, Oryza sativa
tagggtatggcggttatcccccgatcagggatgttcatgagagatcgatcactgtagcgatcgccctaaacaaaatatctctttgccgactttaggtttagccgcaagatcatattttgtgttcacactaacaataataattaattcggtttttatcttgtgtgcacgaaaaagagaaaaaagaaaagaggaacgtgggcccagtgcatgaagtacgtacgttcatgcacgtatgtgggccttttaaggatagattaaattggttgttttttttataatctagtggttaaaaataatgggttcaccagattaaatgaaaaccgacagttagattttctttaatttctctaaatttattagagtgccacgtggcggtataggagtatttgtagagtgccacgtggcggcatgagaatgtttgatttttaggatttgtttagtatggatgtgagatataccaccacgataatacctagagcatcatgttattgtttatattttgacaaatatgtatagtcaaatagttctaaaaatacaaaaatactttgagaatcttaatcacaaacaaattataatttaattagatcaacttgaaaaacacaactaaattgtgttgtttttattttttaagtatgtagatctaaagtagtgttgtatatttgtgaagtgatatttcacttcctaaaatgtgatgtgatttttttaaaaaaaactatcatacataggtcggcctcatgtgttggtgttgtggtgtattgaggaccataatataacttttataatttaattaaagaaatacaacatgatcaccaattggatatataagttaaaaaatattttagaaggtggtttaaagaacatttattgggtattttatatttttaattatagatcatagtttaactatatttattatatatatgtatatatatatatatatatgtatgtatgtatatgtatatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatatgtatatatatatatatgtatatatacatatatgtatatatatatgtatatatacatatatgtatatatatatgtatatatacatatatacatatacatatatgtatatatgcatatatacatacatacatatatatacatatatatatatatatgaactaatatatttcatatttatattgtagaaaataaccgtccatttttatagatctatattttttggctgtcttttctatctacgttcttattgtttttccattccgtgaacagtagaagtttaaatggacgtgctaatcgtacgtcgtacatacgggagaatggtagtagcgcttgtatctaaacaggtggaatggtgtgtttagttttcgctaaattggaagttttattgaaattagaacgatttgacggaaaagttggaagtttgtgtgtaggaaagttttgatgcgatggaaaagttgaaagtttgaagaaaaagttggaaactaaaccaggccgaagttattatttttaatgatagatctaatttagtggtgtaaaataatgggtccaccaatttaaatgaaaatcaatggtgagatttgatagtgtcatgtgactgtctaggagtgtttataaaagtaccacatgacggtataagagcgtttatacgaagtttaatgtacttttagtatataataaaatataatagatagataataaaataacgaaaaggagaaaccgctggttcagatgcggctgtcacctacatccagcgtgcatgataatttctttttattaagatgctcatacagtactactggtttcgatttgcaaacaattctctgtgcagatagattgaaccgttatcagccagtggcatagatgcctgaatcacctttctactgctatctgttggccttttccgtgttcttgtcctagcctgttgggaaggtagtgtgtacaagggtgtatttaatttaggcccatttaaagtattgtttcctttttcctgatttctactataatttaaattatttatgtcaagttcagcccatgctagctctatgcaggaataagtctatttaacctccctcatatcttgcccttgatcaaatcatatcctcaattataaaacgggtataacgcctccctcaacttcaaaaaaggtgcaaatcattttcttcggtggtttaggaaaaggtttatgctgggtcagcaaaaaaaactttaaaaaatattagtgggatccatatcccccccttcctcgaactctctccatcctcttttatgtccttcctctctctctccacttctgtctcctccgatgttcttcttcatccccatcctcatctgtctccgccccgtcggctcctgcttctcctcttccttcgcactccttattggcctcgtcttcctcctttacccctccgcgcctgtcgcgtgcatggccgagcttcaccccgacctctt

SEQ ID NO: 67725 - DNA, 2576 bp, Oryza sativa
ccggtttttgaagttgagggagacgttatacccggttttgtggttgagggagggataccattcgattgagggcaagagacgagtgaggtaaaatagacttattcgttctatgcatgatccacatgggcccaaacaatatccattgtgcctcatagaaagagtattaggcccattcgccgaagcccattggcagcttaagcaaagcactgtatatccaaacatttgtttcttcttgagtccggtaaggctgtgttcggtgctttcccatccctctccctcgtttttccgtgcgcatgctttttaaactactaaacggtgctttctttgtaaaaaaattctacacgaaagttgcttaaaaaacttaaattaatttatttttgaaaaaaaatagctactccctccgtcccaacatagaagagatttcgggtgaatgggatgtattctagtactatactccctatccagattcatagtactagaatacgtcatatcgaaccaaaatcccttatatttagggataaaaggagtaatacttaattaatcatgcgctaatgaactgctcggttttctgtgcggaggagatggttcccaacccaagttacaaacacagcctagtggtgtttggattcagggacttaactttagtccctatatttagacactaatttagagtattaaacatagactacttataaaactaattatataaatgagagctaattcgcgagacaaaatttttaagcctaattaatccataattagagaatatttactgtagcatcacataggctaatcatagattaattaggctcaatagattcgtctcacgaattagtccaagattatggatgggttttattaatagtctacgtttaatatttataattagtgtctaaacatccgatgtgataaggatttaaaagttttagtcccatctaaacaggtcgtctaatactgagctggattgattggagtttttgcagtttttcacatgcatgcatagtcttaagtatcttacgactgcagatactgaatgtttgaaagaagttctgtcagacctgaagtatctaacaatctcaaatgccactaatttatgaaccgtactgaagaaatagaaaacgaaaaaaaaaaggacatttggttagcgagaggtcattgtcgatgtggagatcaggggtacacgtacgtcatgacgaacgggccaaatcaaacgagcggactacctacgttgtatgcatggatgattgatggagtcaatttgtttttatttcttccgagacagagacagagatagatggagagatatggtgtcaattcgttgtttccaagtcgtcctcacaaatagaaatttccaccacaagcttgaccacagaggctagttatattggtcaattactaactctcattttagggcgtaatatgttttgaaactaaagtttgagtacaatcaatatgttcttaacagctataaaagtagcatttctatccttttttaaaataaaaaaaatcaattatgaaatttgaaatcctgacacattttttttaatatgctatacatttgcaattcgactactgttggtcaaaactcaaaagcatggtccctctaccccaagtctccaactaacctcccctgcacctgcacttggtagaaaaatcagaaaaatggccggttgctagagctgctagctaacctaaaccaaaaccagcctttatctcaactgtttttgtctccttctcttcccacttttgctgcgagctggttgtgcgttttcctttttgaaagaccaagttgtgcgtttcacctgttccgttccagctcaagtacaccgtgtagatggtggctgcatgtggcaaatggcatgattatttggaagcatccgtcgagatgtaggctcgctcatagtgtggcctgttcgtgggccaaatccggcttggcttggttcttccagtactttagcctcgagacattactatagtcggcagtccccaaaaacacatgaaaaacaacacagtaatttttcctgatttctttaaaagcatatatttctgattgattcttttaaagtattttttattaggtaaataattttagaaagatgcaggggcccttcaatttccaggcgtcagcattagtcatgttgggcgggacagggtatggattgaggtttagaagggtatcaaatctgccaaatttacctagataaataattctccggatggatatgtttcatttatcatgtaagaaatggaaggattgaatggtggaacttgacaaaatcagatggatcaaggtttcattacagaaacacaaaaatcagattcagaatcgaggtcgacagtcaaaccgtgtgtgtcgacactcgacatccaataagaaggaagaccgattaacggaaatacactgcagattttgttaattacataacaaatgtataatcctggttttgttctctccaaggaaccaattctgatcctgggttagaacatggttttagattcttgtatgaacataagcaactctttgaccttgatcaagctatagcatgtgacctaatcaatcaagatacctatttgac

SEQ ID NO: 67726 - DNA, 14200 bp, Oryza sativa
actaataaacacactagccatatatatgctaaacattatacatgtgatttcacttatattcatattttaaagtactttcatgtaatattaatttcatatctgttaggaatataacatgaaatatattaatgcttaaagtatgtcattgaagcccgtgtaaaaaaaaatataggccttataatttaggacggatggagtatacagttgtaactcttaagcagatcgtcatcactaacaaaccaacagaatgacaagaatgcgcatagaaacacatgtttcaaacatggcattagagtaaaagtttataaattatgcaactctaagttttccatcaccctaagtatatcactagcatacatcatatttcatcttcactccagcctcagctcaaaagcttttgatcctaggggcattcttgtcttttttttaagaatttctctcattcagcaaattaccagtttttagagtgtcttttagccgtgacatgtttttacagtgtcttttagctgtaacacgtttttacaatatctaccagcaaattacactttttttaagagttctatagcaaattttgccacacaattattagtggaaagtagtagcgtactgtatttttcaaagggatatgaccagtagagcatatgaaattgtaactcatggtagttaatccctcattaaaatctatcagtacctatattaatagaacacttttcaagagatccgacgttaactaaagcatgcaaaattatatttcatggaagttaatgtcttaggagattctacgttaagtagaaagatctgaccgccaatcaagtattatatcatcaagatcatatatacattaattgatttaatctaccataaagaatggtgtgaatgttaaaagaggtgcctcttttgtagcgataactaaattaagtgggttccatctagacatcaattcatacccttgatttcttatataaatagtataaaataggggaactggagtctagaggtgctcctttgcaacttttctttcacccttgcaatgctcacggttggtagatcaacaaatgtgcaaagcgagggatctaatcgtccacttttgcgaaagactcttaacccttttttccttacctttaggtctacatggtaacatgtgtttgtcaggcatcccggatcagatggatgggtcaaaattacgcctccctgaggaactgatgcccacaacttttgacctttgcagtattttcgctagaaagaaatgactgcagaatccaaatggattcgtagatttggagcaatttgcttaatttcccttgttccgaggggcatcgatccagcgatttgtcatttgtccatggttttaaccaaacattttcgttggaacaaaagagcattatcctagtgttaactatagcaagtgaactgtgcaacaacaacgtgatctctatgagacattatttgactgttaattaagtgtgtgttgacttgatagtattcaatgccatatgaacaaccttttactgttaggagtacttagtagtactcctgtgcatcaacatggacaaattgtctctggagaactttcttttttacaacatgggcaatccataaccttgttgagtttaatttatcctaagattaattaaggccttgtctggtttgactagttagattttacatcatctaagtaacacataattcttgatacatccatctatcacttcttgattaaattgaagatatgagagttcttttttttgtcctaaggaaataagtagttatataagtttctattaatgtaagatatctgtataataagtatggatatatgttaaaaaataactctgaaaaataactatgtcttttcaatatctcctaagaccataaaaatattcagcatatatacaaagtccttaatggataaggggcatagtactcttttaagaaaatgcgcatgctaatctggtaatattagttactcctacttgggagttgaattcttaaaagaaaactaggtaaaataaacgcaagtgacatgaattagaagcaatttcaccgatcaccacccggttattacctcgatgtttacgtttagtataattaatcaactgcggtgataatcaattcataaactccgaacaggccacatgagtcaagtaattgctgagaatattcctctctcttttgctagataatttcctttcccaatcatgttgcccctgtatgaaggagccaaacacatgcaacaaagagggagagtgtggctttcttattcacctcctttttctgacctttttagttgttcctggtcgtcgtcttctctctttctaaaacatcctcttttctcatgtttctctccataagaaaaagccattccttctcttgtggcataaccaaggattaaaatctccggatatgccctttagctgctaggctttccatcagctacgaccagctatagctggctatagcggcagctaagcccattagctgttttgcaaaaactaacataaattttgcaattctcatacagttcaaagagtcaaagacacttgatattatattcaatagttccataccacattcaatatccgagaatcatataaaaatcttgcacatctcttgttaggaaaactagagaagaatggggagagatttgtgcagcccagcagtccccgccgtcttcagcacaaccgtcacgttcgcagcttggggaagaatggagaagtatggggagggagggattggtgcagctgccgcccaacacagtcgccgcttggtgccgggattgcacagccccgcctccgggcgtcgccgctgcggcctccacgtggagctgcagtcgttgttgctgcaggtcagagtcgccgtcgccgctgcaggttgcaggcttgcagccgccaccgttgcctccgggcgcagccgccacaaagctgccgtgcctttttttcgaggggggagggtgagagacagagtgattgagagagagagagatagagttagggttgaactgctgctatatggacctatatgggctgttgtttagctttaggccttcagcccaccaagttagttgccgctatctaagggcccatttagcggctatagccagttaagagcagctaatagcgccatagaatgtgtagcggcaaattggacatatcttagcggttgcttctcctagcagctaatagccggagatttaaatccatgggcataataacatcttggcctctttgttgtatcctatgtgaagttttattactttgtcctggaagaataaaaatggctggcgacgactatgatttgttttggaggagactggtgttgtattgtagtcaaatatttacagaacaccagatatttggcaccactgatcccctccataccaggggtaacaaataggccaaccaaatctcatattgtaacaaaaacattagacggcgttagagaaaatggcatgataaaaaaaactgtgcacatcacttgcaacagttcatgttacattgtagaacatttagttgcaagtagaaaaggtatacatgagaggctagataggggagaagtcctatttataatcctaaattcttgcagaaagaaactcagcatcaatctagaattacaaaaccaaacatttacaaccctaaactctctatccggctcactttgtccccttagagcaaattcatgttacagccctcttatccagttcaaaaccttataatataactgtagtaatttatagtgtgtttttctactctttctttacagaagatatggtgccataaatagagttaaacacaaaagttattgtttggttgatttaaacacaaaagttatttgtggaattaccaaaccaccggagaacaacggacgttcgcccaaattattaagaaatatggataacgaaggatacaatagcaacaccaaggcgatatgaacaaggtttacaacatctatgattatcacgatatctgggtgggttttatcgttgaggtgtggtaaaggtaacagactgctataatgaccaagttcaaaagaatttaaataaaaaataatttttttgtagaatttatccatttttcttattttcgcttgtaactaggcttattgcagagaggggaaacctctctctgatctataaggttaaacctagctgtggtgcggttaatatatagtggacgcctcgtaaagatagcataaaacctgctccaaaatgcttaaatgcaggggtatgtaagcataattgtctttaagccttgtgttagttattccatttgagggcgggattggaggggatcgaggagggttaattctacaccttaatagatgtggaactattcccgccaaaaccccctctatttctttgtgggtggaattaaccaaaacaaggtcttaatgtttggtgtggattgattaacttatatatatcttcctgctttaagaactactccctccatcacaaaatataatgtgtaactatcattaacatgaagatcaagaaagaattattatcacctcatttaaaccactcgaataaatacaatacttgcacccaataaaattaaagatattgagagtgtagtatttaaaaataaataaataaaagaggacaagggtgttatttaactttatatatataatgcatggatgcctttgtattatgaaatattggaaaaaatagttatactttatattttgggatagagggcatatttgcgctagtagtagtttgtcttgtaatccctcaatatattttccagatcccaacagtgctatatccctgagccatgtgttctcacttgtacggtcaaatagctaaatatatttaattcagtggttaaaaatgaaggattatattccctgtcacagagagtcggccggtatggataagcgtgtctcatacttctatgatatttcggcaggtatatatggagtaagatttttaaaatcactgcaggatagatgttgaaaaaaaaacccattaatatcaaaggcaataaccaataagcgtatctgcacctacgtacatacgtgtgtacaggctggagatactgaatgtacagcgcgcacagagtgtgcacatgttgtcgacgggaggatactgatggctacacgctaatacaactctgagtgattaattagtctggatagcttagctataatgagcctctctagctcgaacactcttgaagcaggagtacattatgtatatatgtatgtatgtgtatgattaatggctagcaaaatactccactacgtgcaagttgctcacctgacctagctactagctaattggctggctaatgcgtgtacgtacatgctaatattgctaataccagccatggaacatgttgcgttgaattaatgggtttatttggtggtagctagtcagcctcgcacaaagtagtggaccagccgtcgctcgcgtacgagaagagcaggcgagacagtgcgtacgcagctgctactactaaacacggatgcaattaaggcttgatttgtggcctcgtctccgtgctaattaatcgcgcgccagcccgtgtgcagcccactgttgttggcagacgtcctcactgggtgcgcatcatctgccgttctctatttctacggcaccgtgccgttgatcaatcccaaccgttactttgaatggatgatcaggatgtgcgaacccactggctgaaggatcgatgcttaatttcctcttttcttctttagttcttctgacctgtcccgattgaataaaaggaaagagcgacatcaccgttaaatgtttccatcattgagtaaacagaaacaaaatggtcaggtgacacacgtaaaagtgaaaaaatattggtttcaaaaaaatgaaaaaaaaagatttttctgttagcttgtcgcctcatgccacaaagctaaaattttgataggtaaatttgtcatcaatcgatgccaaggtggaagttacagaacaataaattcaatgtaaaataggagtgttcttcacttctcgtgggttattttgatcttatccgtccatttcaaaccaacggttgggattggccaacggcacgctgccgttgaaacagctaacggcagacgatgtgcacccgtcctcattggtcaccagccgctatagacttgccgtagtagctctacagcagcataaagagatggattattttctttctccagaacaaatataataataataatatctttataactgatgccatttttgaagaaaaatgcataaggatattccagctaactccacaaggtggtggattaaacgatctggtttcgaaaccttgtcgttactaattatttgatattatatcattccctattattcgtgttcttttttcatttctgaaatttactttttctaatttatataagtgtgatattgaaattggcattcaatagttaaattcataaatataaaatttcccgaccatttccgtacaaataatagaaaaataataccgattctgaccatttccgaccataattcgataataaattttagaattgatttagaactttttttttcatccctctgtatattttctagccttaatttgttggatcatttccgattattttatttattttccttccatataagccttatctcaaccaaccaataaggaacatctttttccgaagatcttccacccccgaacacgtaaaaaaaaacaatcggatctcaaattaccatacaaatgtacaaaatgagataaacatgcagtcattaactaccataaaaggtgttcaaggagataacaacccattgattacaacgaaacccccacgcaggcgtaggtaaggaaagaccaggacggacggccaagccagcaaataccaccaccacatcgtgtgaaagccgccgcagcaacgagcgagggggatgaaacccaaagacggggcgaagacgggagacggaacccgcaaagacgcgtattagttgggcggctgccgcgactccaccacctctcctcgctttgcttgcttgcttcctcctcgctctccctccctctcttcgcttccttcccctccaaaaacccaataaaaaacgcctttcctccccccccccccacctcctcctcctcgatcccctcgccgcgaagatccgatcccgagcacgagcagcacaccgatcggtgggtggcctcctccggcagcctgaggggtggcgggaatggcggcggcggcggcgatggccctctgacgcgacgcgcgcctttctctggcttttggctgtggtgggtgcttgtgggtggagagagagagggagagggagagagagatgggctgcttctcgtgcttcgactcgcccgcggaggagcagctgaaccccaaggtgggagggccgtacggcggcggctcctcctcctccgccgccgcggccgcgtacggcggcggcggcggttccagcgctggtcggcatggggagaggggcggtggttacccggacctgcaccaccaccaccagcagcagcagctgcccatggcagcgccgcgcgtcgagaagctctccgcaggtgcgtccgttactccctccgttcgcgttgggttgagttggggtggatctccgggcggcggcggcggttggtggggatcggatccgcgtcggggggacacggattcggtccttccttttccacgcctcctttgatctgattttagtattccttctcgtgtttcgtgatctctgcctaccgaattaccgcaatttgtcctgcaaaatttgtccagaaagcataactatcttgcgctgtttgatatgtagatgctgttggggttagttcatctacttcagatcattctgaaatgaaaaaaaaatatggtattatatgggagatgaattgatagaccgataggacaaggcctatgctacattcagactgtttatttggactctgtagttgtaaattctcgctgtcgcgtgaacatactggttagcttagtttttttttctcatgttttggtcaacatgggcaggggctgagaagacgagggtgaagagcaatgcaatactaagggaaccttctgcgcccaaggatgccaatgggaatgtaatatcagcacagactttcaccttccgagaactcgcgaccgccaccaggaatttcaggccagagtgcttcctgggcgaaggaggctttgggcgcgtttataagggccgcctcgagagcactggccaggtaacttattttggcaaatgggtatatgcttcattcttgcattcgcctgtggagagctgaacaaccggaaaattgcactgttgtaaaatctttactgttcacttttgtttgtctaagatctacgttctgaactgtttacaggaatgagaaatgaccatgttgagcaactgtttatttcatcttgtttgtttatgcattataatactatgctgctccctctggtcgtaatacatgtcattttggcctgggccgccttttttctttttaaatatatttgtcaaacccattaaattataggactatgcaagtacgttgaaatgcaaatcttctcatatgattttctttatccagtttaattattcagaaatattactatacccagaagttttgaaactttgacatgatgcttgtccaaaatacaagtatttctgaccggaggaagtagtaataactagtaagtgcaattttaggcaacaaggatctagtgttgtatgttcagtgtgttgtattgaaaaattaagagcaatatgattgaagcaccaaaacttcttctaaattaaaattagtttaaaagaagtatgatgattgaagtccctttttcgtcattgcaggttgtggctataaagcagcttaatagagatgggcttcaaggaaacagagaatttctagtggaagttctaatgctcagtttgttacatcatcaaaatcttgttaatctgattggctattgtgctgacggagatcaacgtcttcttgtttatgaatacatgcactttggatcattggaagatcatttgcatggtacgaattctatgtttattccctgtagagatactgttttgcatatgaccacaacctgtaaattttctgttaatggtttctatgtctgtacctgcaatactgtcctctgtcacatgtttccttaggtacagattgtccatcagcgattctatccatgcttttctatctgtgctctttatgtggcagaattagtgtccatgattattgtttttcaatatcggcaaatgtttatgtggtggtagactagtatttcattacttagccctaaaaatgtcaccatttgcattaacctgctccctgttgaagtgttgacattttgtctcttccaagggtctaaaataggcttgtaagagtggcaaatagttaatttttccctaaaatggtgcatgacagcataatgtgagtactatgtttgtcatgttttacagttcgctcgcattctcatctgtgtgtactgtaattttcagctgcaatttttagatgtgtttggctatttgttgtaagttaaataaaagtcataaaacctatggagttacttataaagttatgtggagttgttggtctgcatataccaaaaaattacttataaagttatgtggtctactgaaaatggttcgtgatgtaaaaaccaatgaaatatttttagtcaatgatctatggaaggtgtaaatatattttttatgtcttgttacttctcaaggttctcttatgttcagaaattgtaccctttaactgtattgtgtgagtctaatatgtgattttgaattaagtgtcgatataaatatgtatgaataatgaccgtactaaacttcaataaattgtttatgtggtatagatctacctcctgataaggaagcattggattggaacacaaggatgaaaattgcggctggtgctgctaagggactagagtaccttcatgacaaagcaaatccaccagttatttatagagacttcaagtcatcaaacattctcttagatgagagtttccatccaaagctgtctgactttggtcttgcaaagttgggtcctgttggtgacaaatctcatgtctctactcgtgtgatgggaacatatggatattgtgctcctgagtatgctatgacaggacagttgacagttaagtctgatgtatatagctttggagttgtgttgcttgagttgattactggtcgtcgggcgatcgacagcactaggccacatggggagcaaaatcttgtctcatgggtaagctatgttctgattatttaggagcacatgctatctatatatgctaataacctgaaatgatttatctgtctagtatctcctaagtaattgtttggatcctgacatgtcgcataccatcaatatgtttggtagtagatctaactaatatctgctgcattttatcagaattaaaacatcttgaaaaatagctcataaagataagatatttcctggttactttctggaactgaaaatacaaaagcaaatagagtaaattattatgtcttgatgtccaccttccaaggaacggatgacatattagatgttgtaagctacatctatgatttcctgtcctccatgcttatactggtcaacatactttgatgggctagagcagatcatgtattgtgaggctaaatgtttttttttttttgggggggtgagaagaggctaatgacttgacccatgtactcacaatatttcatattaactgccaggcacgacctcttttcaacgacagaagaaagctcccaaaaatggctgacccaagactggagggacgataccccatgcgtggactttaccaagcacttgcagtggcatctatgtgcattcagtcggaggctgcgtcgcgtccacttattgcagatgttgtgactgctctttcctacctggcatctcaatcatatgaccctaatgcggctcatgcttcaagaaagccaggtggcgatcagcgaagcaaggttggcgagaacggcagggtagtctccaggaacgacgaagccagcagctctggccacaagtcaccaaacaaggacagggaggattccccgaaagagcccccaggtatcctgaacaaggatttcgacagggagcggatggtggcggaggcaaagatgtggggcgacagggaacggatggtggctgaggcaaagatgtggggtgatagggagcggatggtagccgaggcaaagatgtggggcgagaattggcgggataagagacgtgcgatcgagaacgggcaggggagtctggattccccaactgaaaatggctaggagcagggcagcgaggggttgatccatccacccatgtatgtctgtttatttccaacactatttgctttcctgtggcagggagaggggagggagggacggtgggttagatgtacatttctagagaaaaagagagaagaaacgggagctttgaactggatagtgaattcatgttgttgtacttgtaaattctcagaaatttttgtgagaatgaaaggacacttttgagttccctttgaatcatcctcgttatatcttcttatcatgttatgcgctcgtagcaattaataatgtttatatcggactcgttcctattagttgacttgatcctggtcatggacatgggatcattcttcgtcagcgatcagttaatgccggtgctgtgccgactggttacacgatcgagatgctgaagatgctctgaaagcaactctgtctattggtcgatccatcagcgggagagaagaggcaagacgtcaaaaaaatatcaagcagacgttttggtgtcacgcaccgagcacacggcaagcgtgcctggaaactgaccgatcggtggagcgggggaaccgcttgcgcgcacgacgcatgcatctcccggagaacattacaccaccgtcgccgcgcccgtgtcccctgccggccagggagaccccaaatataggctcaactcgctccctgtcacttgccatgtaggaaggcatagataggaagctgtagttacacgcgtacgccctgaatctcaccaggagaaagcaaagcgtgtgtggctggcttttcctgcggttgtgtttggctcaaatcgatctcgatgatcttgtttttgccctagccgtgctggtgtacccggctgcttaggacatcatcacgacgcaacacgcaaagcctaaacggacggagactttagacgagaaggcgacgctaccgtaggcatgaaccaccacggtccaaaagggtatgggtgcatacacaaaaatagacatacgcccacagtgaagggccgccatccaacatgcacttcagactcattagtaggcccaaaccagcacattttccttactactttgctgacctcaggccgaattctccagtgtcggttcaacccaatgataaacggaataagttcacttcaggtaccttaatttgtcatcgagtctgaaaatcatctctaaaccacaagaccggatatgacgcgtctctcaactttcaaaattagtgcaaataaggtccaagttggtttggacgacaatttcgattgacatggtgcttatacgtggctagtttgacttagttctcatcctatgtgacgatgaggtggcattggaagcaaaatagtcccaccctcctcttcatctccacagacagcggcgcctccttctccgctctcctcttatcgctatgggtccaaacactactagaaaattaatttttaggaggccaaaaaagattttagtaggcgggcgctccgtccatcagtatgcaaagacctgattttcacagacggacgtccagtccacctgggaagctgtatcttcgcaggtagaccgcataactaatccgcctagaaagatatatctcccaagcaggctgcagcacaatatgccatctgggaaaatgtgttacgcccgcttgagaaaatatgtagtatatttgaaattaattaattaatacataaatatatctaacaactagtatatacatgtaatacagatataatacacatatattgcattcattagtaaaaagtgttggtcatattagtaaaaagtgttggtcatatatacatgttaattacacaagcacgtcatttcgaaatatattgttaattacacaagcacgtggctccaatccaaaagagacttgtagtctcgctcatcgctaggctatcttcggggtcgaagaaaagtccatcttgataacagcactcgcagtggatgaaacacaggataatgtgggccccacacgattgtaggaggatgtgacgggccactagttaaactttcctatcattagccatcttcggtttcgaaggcttcgggtcataactgcccacgaccctaatgtttatctggtctccgataattgcgctgttgtggtggagagggcgaagctgccaaagcatccaaagggtttccaaggcataacctctccccgtgaaacttcaacctatactccatctcatttgaaatgctgatgcccaactcctctccttcaattaatcgccgccgccattcttctttcattcttgtccgtgatgccataggccaactgtcgtgtggtgccactcgaaaggtgagctcttccaccctcgcgcctacgcgacgatccagagctagagaagggagaacttctgataccagcctcccattggtggaggccaaacatcacggtgagacgggggtcgctgaagcccaaggaaaacgagtcgtcggaggtagtgtactgcattgactacgcagtggtcaggttagtactctcttcttatagttcttcacgcatgatagtgttggccattttcgcccatgtgtgcgagatgttcgtcgatggagttgttctgcaggtcgttcttcatcccacaacacctaatgaaatattggggctctaacaacccgaagcaagtggtgtggacttcatccccatagtgctgaagaagtgggagtaagccattagcatatgaataattgtgtattaattaatacaaactttaaaaattggttcatttgatttttaaagaaaacttttacataaataagaattttttaaaaaaaattcgtaccatttgatggtctgaaaatatgttaacaaaaaaaacgagtaaattgtttggagttgaagaaaacaactatgccatagtctatgatgcagcgggtgttggagggactctagttgtgtgatctcacccctaacgacatacaggaacggattaaagatcgaggttgagaggcttgctttgacacg

SEQ ID NO: 67727 - DNA, 1326 bp, Oryza sativa
gtctgtgcatgcaaggcgcgcccacgaggagcggagagcgcgtgttgtacgtgcagccaaggcccaaaagcgaggaggggatcgcggtcgctacctcctgcttccgcggggacacccttgtccgcttctgcacgcctgcatatgccgctgccgccttatttgatcgacctccacacacttgtcccgctacccttcgcgtgcgtgcacccaccgccccgcttcgcgccaacgctttcgattcctctctctctctctctctctctctctcgctcgccattttgctatacagctcgttgatgtgaatgtaaacggtgtcgcacggtaagctgagagactggaaaatcatgttgcagtaaaatccaaattttattattgaactgcatgaatcgaatgaagctaagcaagagcatcgacgcgacaggccggtcgattgcacacccacacccttcactcccccctcagtagctaggttcacaaaacacgcatgcactcggtcggtcgggccagcttaattagcttgcttgctcggtcggtctctgcatgcaagctggacgaaccaggcgagtcacgcgccaatacagtccctactagatctggccggagtactactgtacgtactacgccaagaggtgtctcacctagtagctagtacgtacgcgatgaacatgtgttcgtgtttatgtttgtgtaccaccagctagctggctatacctcacatgagagaattactactagttctctaagcttaatcagactacacttccacaacaatgccatgtcaggcttgatgatctgctccgttctgaccatagcgtgatcgccgtcaccggccatctcgtccgtacggttcgtctcctcgtcatccaccttcacctccaccacctccgagggcatcacgtcgtcgatggggtgcacctccgcgccgcagctgatcctgccctccggcgctgccgcgacggcgcccttggcgacggcctgcacctccttgacatgctccggcagcttgatctccagcccggccgccaccacggcggacgacgacgacgccaccagtggcttcttgctccggtacgccatgtacagcgccatctgcgccacgccgaacacgaagcccagcacgttgggcagcgccacgaacacgtccttcttgagcagcccgtacaagaaccagatcaccgcgctaagcaccaggaagaaggatagcgagaatggcatgaactccacgctcttggtccggatcaccagcctctgcaaaacacaacaatcatcagaaccttgtcatcagctgctggttgatcgatcgagcgattagttagcaagacatca

SEQ ID NO: 67728 - DNA, 2036 bp, Oryza sativa
tttttctttccaccttcagctgactattgtgagaattcattagtagaaatcttcagagttatgttgccttcaggtgtatgctgaattctagaatggtatagatgatggtgacccttcatgtgtatcattgacatgtgtgatgcttttttttttgtacatactgaactagtattattattttaaaaacctaacaaaacaatgttatgcatgtgcttgatagaaattgaagcaagttgaggtgcttacagtggcgaaaggaataccattagtgagattaagttacctgcaaaaaagatcaaaggcagacacgggttatcagtgatgtcagccaatacaaaagagagagagagagagagagagagagaggcaaacagagaaaagaaatgcatggtgcatggtaaaaactaaaaagagaaaaaaataaggtgtgtacgtttctaactaacatgcgtgatggctccctttctctgtttagagtaactacctgattagagcctaaaagttttgtttagcagttccatttattcaggacagaaacactagttcttttttttttgttcaaacactagctttgaaagatattgaggaagacacactggagtactaattaaggtgacagaagcaacaaaggagattattgatctagttaactaagaaaacttgattccaatgggtgttttgctgcggttttcagggacattgcttgtgcggttgtgggaattaagatcgatacatgctgccataatgtgtctccaacaatatgggagaacatgcatgcacggattaatcaaatcaaaggaacagagtaagctaatataacagctagaaagaccaccgtatgcatgagatgaatgcagcattcatgagcatgttgatgcctgtatgtacctaagatgccaaaggtgaaggcccaagtgctgcgttccatggacatgaaggccatatcgatctccctagaactcttcctccaacaaaaaaatctgaacaaaaaaacttgatactagtatagatggtagctagctagctagctgagcctcccttctcctcttgctcaatggagagatgcaaaacacactgagcagtcagtggagaaaggaggaggagctatgtaattaagctaagatgtggcttgggttcatggagagccttgaaggcaggctcctatatatagggagagagaggtgagaggaggaggagagatgctggagaaaggaagaggtgtggcaacagccagcagaagcatgtgggccccccacgggtcgatcattgcacactgacctgacctgtcgcgcgatgcgcttgtggcgggtacgtgtagcatacgtaccctgctggacgggaaaacctcaccagacaccagccatggcaatatgttgtgcatgtacagtatgtagtaacgtactcctaatgtatcgaggggcaataggtttttttcaggtatgtgcgtacacactatgcccgaagagagtaagccgtgtttaatggcggcaacgccctgtgacatgtcaaacaccaaacctggagaggcttccgtgttaagccccccacagtatccctggccgtttccacctctactttcgagaggctctgtgtgcagtgcgattcgcggtgggtgatgcacccagctgtttgacatgcagagctctcccccgatgtcaccgggtgcctacttgtcctgccttttttttgttgctgcaacggccgggctctcgcaccacgatagatttctgcgaaagatacggcagcacggagagggacgcgtcgcgtgcgctgcaacctgcattgtgtgctcgtcacggttgacacagctgacagcccaacattttttgtacgtagcgcgcccgcgctgtcattcgagactcaccgcgaccgtccgtccttccgaaaaatctttccaccagctcgcgcgcgcggctcgtcccggccggccgacgcggtcacgtgacgcgtacgtagctactatagcttactagatcggtgtggcttgcttggttgattgctttcgttgcgcggcgcgggcaccgtgtgtgtgcgta

SEQ ID NO: 67729 - DNA, 1823 bp, Oryza sativa
  unsure (1)..(1823): unsure at all n locations
ttcctacctagcttcaaatgctcatcaatctcgatcggtggatcaatcttggcttgctttgcgtaactcgttttgcgtgttgtgcataagtggcaagattgaacgttaacgaggaaaagcctcggcctttttttctcgaaatgaactgcgatcttgcgagccaggctagcatcgcgcgacggttcgacgcttttgaggtaaaaccgcggcgcaagtcaaccaaatcattggtagagggctccacaaatgagaccacgtcgacgtcgatcgatcgatcggactgacgagcaagcaagcaaagcagagcagcaatctctgcatccggccccgtttccgcggacggtttccaaactgaactcctccatctctctgcatgcgcccgtcgttgcgagccagctcgatctgcgtggattgccttcctcgtcatcgcgcacgcagaccattaacgttgcaggtgtctggttggcagctctctcaacgcgaccgatcgagcccgcccggtcgaattcgggttctcgcctgcctgcctgcctgcctgcctgcgtgcgtggatgtgtgtcgtggcgtggcgcgcgggcggaccgtttcccaatcatggagaaaccaattatggacttatggttcggaggcggacgcgcgcgcgcggtgacgtgacgtgaaggcgcgcgcgggcgcgagcggggggagtggatcgctcgtcgctcgcgcgcgctggggcgcgtggatggctggaatgcgggatctcgcccgcgagacggcgtgcgtgaagtgtgagacgcagattagctttggcttgcaagaccggtatcattgcgccacagctgaatgattgtggcgctaattaatgacaccctcctcgtcatcagccgcgccgtagtagtactactactctactacagtgtaagcaaggaacgcatgatttgcaagcgattgggttttggctatgattagcgtcctcgaacttagggcacccacaataattatctataggctctacaagagatatatatcagcatattttcctacttggaagaaattaaatgaagagagagagcaaagctatctactaaccttgagatactctatagagaaaaacgaggcaattgattagagagctatagatacccatgtagacataccattaaagtagtttactattaatctagtctattgctaagatgtacatcttttatagatagcaccttactttatcattgtgggtactcttactagagttatgtagaagccacgtacatcaatcgtcgtttgtactgtatagtataactagcatggtggcccgtgcagattacgcggctagcatcgttatattttctcttatataatagtatatatgttttcttattttattatttaaatatattaaaatgacaacataattttaaattttacaataactttacaaaactactaatgtgtaatatttatattttattttatatacgtgttagttattaattatttttaatatcaaattttagttatttgtaaattatatatattcctatatggactctagactcgtcttttaatattttttttctttaattccgaattttctgtaaattgtatttctatatagactctatgctcttctttcaatattatttattattatttctaaatttttattatttctaattgtatttctatgtggactctaaactcatatttcaatattctttaatttttaatttcgaatttcagttacttctaaattgtattctatattgactntaaactcttcttcccatgtttttcttaatttcgaattttagttatttgtaaaatggttttttatacgg

SEQ ID NO: 67730 - DNA, 7022 bp, Oryza sativa
aattctgaatttcagttatttcttaattgtatttctatatggactctatactctacttctaatattccttatttttaattccgaattttagttatttcctaattgtatttctatatggaatttcagttatttcctaattgtatttctatatggactctatactctacttctaatattccttatttttaattccgaatttcagttatttcctaattgtatttctatatggctctatactctacttctaatattccttatttttaattccgaatttcagttatttcctaattgtatttctatatggactctgtactctacttctagtattccttatttttaattctgaatttcagttatttcttaattgtatttctatatggactctatactctacttctaatattccttatttttaattccgaattttagttatttcctaattgtatttctatatggaatttcagttatttcctaattgtatttctatatggactctagtctcctcttctaatattccttattttttaattccgaatttgaactatttctaaattgtatttctatatggactctagtctcctattctaatattccttattttttaattccgaatttcagctatttctaaattgtatttctatatggactctgctttttctttttctccgattaatgtgagaatttctaggccataaaagtgaacgtggaggctcctttttctatttatttaataatataatagattataagtatattctcccgtcttaattactgctaccatcactgactcgttcgagggggaaatatctccgcagtcttctcgatcgggttcgattgcaaaggtattttacattatgattacacgctttatgacggttttaaggcacgttttgcattgcggaggcatgagtattttgcgaaacggtccaggtcgtcccacatgacagcgtatctctctctaattgaaagcagcgatccagagaaaggaaagacacagaccggtacagtcattacaatactctacttccctccgtttcagaatacaagacgttttgactttgatcaaaattaagctgttttaagtttaactaaatttatagataaatatatagtactatatataatactaaattagtttagtcgaatcaataattaaatatattttcataataaatttatcttgggttgaaaatgttattaatttattctttaatttttaatttcgaatttcagttacttctaaattgtattcctatattgactttaaactcttcttcccatgtttttcttaatttcgaattttagttatttgtaaattgtttttttatacggactctaatctctacttttaattttattatgtttattccaaattttagttagttttaaattcctatatggactctatacttcacttctaatattccttatttttaattccgaatttctattatttcctaattgtatttctatatggactatatactctacttctaatattccttatttttaattccgaatttcagttatttcctaattgtatttctatatggctctatactctacttctaatattccttatttttaattccgaatttcagttatttcctaattgtatttctatatggactctgtactctacttctagtattccttatttttaattctgaatttcagttatttcttaattgtatttctatatggactctatactctacttctaatattccttatttttaattccgaattttagttatttcctaattgtatttctatatggaatttcagttatttcctaattgtatttctatatggactctagtctcctcttctaatattccttattttttaattccgaatttgaactatttctaaattgtatttctatatggactctagtctcctattctaatattccttattttttaattccgaatttcagctatttctaaattgtatttctatatggactctgctttttctttttctccgattaatgtgagaatttctaggccataaaagtgaacgtggaggctcctttttctatttatttaataatataatagattataagtatattctcccgtcttaattactgctaccatcactgactcgttcgagggggaaatatctccgcagtcttctcgatcgggttcgattgcaaaggtattttacattatgattacacgctttatgacggttttaaggcacgttttgcattgcggaggcatgagtattttgcgaaacggtccaggtcgtcccacatgacagcgtatctctctctaattgaaagcagcgatccagagaaaggaaagacacagaccggtacagtcattacaatactctacttccctccgtttcagaatacaagacgttttgactttgatcaaaattaagctgttttaagtttaactaaatttatagataaatatatagtactatatataatactaaattagtttagtcgaatcaataattaaatatattttcataataaatttatcttgggttgaaaatgttattaattttttctacaaacttaatcaaacttaaaacagtcaaaacgtcttataacatgaaacgaagggagtagtggtttttttaacttacacaatacaacacagacactcacaatacacgcacactcacccctataaacacacacgcaaacatacccctataagcatgttcgaagattcaaccggagatcatgtcgatcgagtgcatgggctgctcgtctacttgctactgctactagctacctgaccgtgtgccatcacgtcagagctagccatcaaaccatgactccatgagtcacgagaaggacgtatatgcgcgccgggctccatgtctcaactctcaagggaacgaacggcttcaagccctctctctctctccgtccggccgtcgcgggtgccgttgcaaaaggagaagcggccagcgaggggagacacgactctacgtggacgcggccggtcgctctctctctccccccttcgcccatccggcctcccaccggtcgatcgatccatccatccatcggccggggcgagacgtaccactgtacacttggatcgcgcggtctgactttgctgcaaaaaaagcgcaaaagctgcacgtcgccttgctgctgcccgcaccgcctcgctgcatccaacacacacctgtctctctctctagctctcgctctcgctctcccatgtgaacctctgcacgacgcgagtcagatttctgtttcattgtcttgtctgcttcgcatctctcatgtgaaaagcagcggccacaaaatttcatcccaaaatgttgttttcgtcatgcgtcagcgagatattcctttttttcctgaaccgtatatactgcgataatatttttagtgttataatcggacaatatatatcacttaaaaaccttatatttagaacagaactaaaaacctagcacatgctaaacgacctagaataataagtattctgagatggaggtagtaagtaggagctaaaataattttaaaaatatgttaatatgattcttttataaaactttcgtgtagaactttttataaaaaaaaaacatagtttagcggttcaagatgtatgtacgtgaaaacgagggaaaaaagttagaaaaaaaggtataaaagaactcattctaagtacaactatataggtattttgttgagacagatgatgggataagatgatagatgggaaagtagatgtttttcgtgatgacttgggcatggtttttaaagaaatctaagtgccccttctattaatgttggatgcttgtataaattgattagtgttgtaattattgatttcttattgttgtttgtaagtgacgtggagttcagcgaaaaccacaatgatatgaactggtgcctggtggtatatcagtatatgcatgtaattcagctcaaggctgagtttgatacagtggttaggtttggctatttagtggaaagtatataattaattacatactaataattaactactacaaactttaaaaaatgaatttatttgctttttaaagaaacccttgcattgaaagtttttcatgaaacacatagcttattagtagtgtagaattagttgggcgttcaacccaacttcactttagaacacacctttggtttatggtgtttgtgtttcagtcttttcaagtagcccaatttagagcgatctctttttcctttttttagcctctcttccttctacattggttttacatgggagtcgtcaggtgtgtgagttccgtactagtggtatgataattgtattagtagtatcatgggttaacaatttgttggttttgtttcggaaataggccagctcaactgtggcagtggtcaccggtttagtttcatgacgatgacagcatgttcggtggttgcgatgccactagggttttgtatctatagaagatatgcatgcgtgtgcctcgccaggcgaagtgcatgttagctagtactaaagcatggagaagacgtcacagaagactagtattaaggcccatggtagctctaactcatatactcccccgttaaaaagtaattatcaattattccctttgagttgcaaacttttgatcaacaatattctttttaactaatataattatttagcatagcatcccagcttgttttagctgcaacttataagccatatcgaattactccctccgtttcacaatgtaagtctttctagcattatccacatacatatagatattataatgaatctagatatatacatatgtctagattcattaacatctaaataaatatggacaatgttacgaagtcttatgagttttagaactaacttcgtgttttttttctgttggttttgctagcatcacatgaatcaatgcctttatttttttttcagtattgacttttgaaccactcggtcccatttgactcaggtcattattagcagggtaattagaaaattgattaatttattataatatgttgccaagttgaaaaggtggattttaaaaagtattcaagaatttttttttaaaaaaagaaaggttaaaacgtaccatatttggtagtttgagaagtatgccgatgataatcgagtacctagctagttgcactttagaacaaggcataccagtagaaatatagaatcttaacataatttttttttgttcttttgattcccatggcttaagccatggttgtgaaaatgtctctaaacaggtgcaaagttgtagttagctagatttgtgatcaaaagtaatttagtactccatccattttatattataagttactttatatttatcctaagtcaagcatcttcaactctaaccaagtttataaaaaatatagcaatatttttaacataaaataaatatactataaaaacatatggatttgatgataatttgttgtcatacatgttgctattttttctctaaaactactagtatgaaataggtggagtacttcttacattggaacttatggaacactttgttgtgcttaaataatactaactatcaaagttcatctattcttggtcaaaacctatgtaaaaatggaattaatttgtaagctggataaaagtattttagtctaaaatgtgactaagatgcctcatacttcctccgtttcacaatgtaagttattatagcatttctcacattcatattgatgttaatgaatctagatagatatatatatgtctagattttttaatatcaatatgaatatgggaaatgttagaatgacttacattgtgaaacggagggagtactaataattttagtcatgctcagctccaataccaatctaaaaacttgaagctgaagtgacagggttggtcctaagttaattgattatcatgtgatgactaatatgataggtgcatgtgtcattgatttggcttttagtactgtccataaaggaagtatctggtggagtaattatgctatttactggtacctcacaactaataagaaagtcggtagcacaaattaacagtagataaagcgtggcatgcatgcatacacggtgcatgcaccacttaagctaattaaggtgaaaacctttaggcatcttgagtgctattcatattgacatattgcgtgtcatttgtagcatatgtgtgcacgaggtttaatttagggatatgccagcaagcgtgttcatcagatgttacacttaacagcgaagtatgagtaacaacaacggtttggttttgggaaacttctgacgaaaggcagctagctggcccccgatgagatgatacacatgatgatttattatgatgacaatatttcatatatattctgttgacatagatatttcacagcacgattttttgctagcttttcgacatggtaagtcagtgttggtcgtgcattagttagttagtactcgctgtagatgtagtaacgagctagagtatcgatcacttgtaccgtgggtaccaatttggtcgcggcaccattaattgagaaaagattcgagtgactggccttctactgggttctctaccaacatatatggataccacaaaatcaaaaggttttggatgaacagtccacgtcgaccccttccaagatgggtgacagtacacaagatgtggttgatcgatcttaatagtactgtacaaccagctagctaaacccagatcactgtacactactaaagtgtgtgctctaaatatatacagcatctcaatcacactcacacattcacgcaccattaatactgttcgacgagcacgtactttccatattgatgaagcaacaaatcggttgccacacgcagctctccggttcgtgttcctaaaagaagagctgttcgatctgttggaactttttgtcttgcccgtactgatatttactccctttttcagcttaaagaaaaggtagtgctactaatctcttttttttttaaagtacagattatctttcacgtatgaactcatttcagacgaagcagagcaatgttatgtcaaacccttagtcacagtgaaggagccaacagcatcatcgtt

SEQ ID NO: 67731 - DNA, 1647 bp, Oryza sativa
atagtgtataccactcaaggcaagagggcagtcggcagtatatagagtactagttggcatgttaggaaagcaaacaacgttcgtatccaattgatgtttgatttatgttttgtctcctattttagtcactaccgtcgcgttgtctttttttttaatctcctaaattttaatcatacgtttgtcactggtcgtcgttgagtccagatgacttataaagtttcattgcaatattgatcagcttttatttatgtcgaaggcaaccagtagtagtgggaggaggaagtaggggagccactgcttaatcgataacaatatactttttccgtaaaaaaaaactcaatctaagaaaggtcacaacaaatttgaataattattatatagatttgtcgtatcaagaacggtcacaagttttgagttttttttagagggagtatggcagatttcgaagatacagacctggtctatcaaccatactcgaatgcatgcgtggtcggtcaatcatatcatcatattaagctgccagatatgcacacgatgattgatcagtagctagctctgcctacgcaagtgacatgtactacgtatttgcgattgttgattggtttcatcgaatgggcatgcagatgatcgatagctcgatactagctagcaccgaggaggaaataaccaatttggtcttaagctagaacgaacggatatatatccacgttgcatttatatttttcatctttttcatgagaaggccagagaagaggaactaattaacggatggacacatggcggtggccggcgacagacaagtgtccaacttgtccactgtaactgctggatgccggctatctagctacagtgctcatggggtgctggtaaccaccagtttgatcgatcttgagcttcagatagacaggatagtacagtggacctgcagtactgaaatctcccccatgagacgatgggtcctcccgatttgttggaggcaagcgtacgtggagcttcgcagggaatcgacggtggagctccctcccctcgtctggatcggtccctccaaggctagcagttgcacatggccggtaatgtcacggggctaggacagagtactgtgtgccctctgtgagccgagatccacacggtcccaaccctcccacaatttgatggttcaccagctaaaagaagttgggctgaatgtggcatgggaaatcttttgtgaaggcggcctctcctcgtcttcttgttgccttttgaatcgtagcaaaacttgaaaatttaaaactattttttagagagtcgattttgagtggttttgtttctttcatcgcagcattggtttttaaatcgatgaaaagatataggtataaaagttttgacattgcctactagtccatttctcaacggatagttattcataagtcaaacgagcaaagctgctagttttgttaaatcaaacgcatagaaaaccatacaatttatatcttccgctcctttcaccctcagaaattttagtgtttttagacaagttggtttatgtgcaatcatccaagatatacaagagctaggtgagcttaagattctgagaagtaactgtttgataaccatcttctaagaatctggaaacgttgggtgtccaacttctgacttctagtttatttt

SEQ ID NO: 67732 - DNA, 1526 bp, Oryza sativa
tatgtttttcttattatggtttatttcacaatatttggctttgaaacgctaagaacacatataaaaattatatttataaattattttttattgctaataagtcgtacatataatcataagtataagcaaaataatggggctgtatagtttcttttttaggtttagccattagggtatctataatgggaccataatgtcttcacgtggagtcccaaatcctgaattttgtcaagtaatattgggagcgacaaaaatgctaaaacaggcagaagccgaatgtttcggtgggctatcagttatcagttcactttctgggagtggtccaaatgattttgaaggcccatccataactcaagatcctcatttgtgctgagttatggagttgagcaactatccatctactatcacatattcacatgttggatagtgggtcatataacctggcagagaactggcaagaggtcaagaaggagatgggaaggaattgttaatgggctttatttgatttttgcatttatgcatggattgggccagccttcttggagttgatgactcggagtgatccgtacaaaaatatctccatgggccgaataacaaaatcctttttaaataggaataagttcactttggtcccttaactagttactgaatctaaggaataagatcactttgactccctcaactgaccaccgaatctaaatcgtatccctcaactgcaataccagaaatctcgacccccgaacttgcaaaaccggtgcaatttgactccctcagcggttttggggtggtttcgctgatgtggcgccacgtggcacctatgtggcgatattgaccgagtcttcggtcaacgtggcgttggcgtggcagtagaattaaaaaatatgcgtgggacccattagtcattcacacaaaaagaaatatgggcccactgacatgtggggcccacatgtcagtccttcctacttcctcctccctctctctctttctctcaatctctccctttcttcccattcggccggcgggcgggagggtagcgagagcgagcggccggcccagctctgcctcggtggggaggcggtggcgcaccgccggggtccaccgacgatggcaacggcgcacggacgagtggagcagcggcggccatcgtggcgcagcagaaccggagcagcgacagccatcgtggcgcagcagaaccggagcggcggcggccatcggagcttcttgggcgccgccagcgacgagctgacggcggtcgagtagtggagtgacgcggcgcacacgagcaggacaacgccccggccttctccagccccgccgccccggtcttctccagcggcctcctcatcaccccccgcgccagtcgctttgtcacgacgacgaccccgcgagccgtcagagactgtgccggtaaccgcgaggacgaggatgacgagcggcagcgcgggtcgccgccaccgttccccttgtcctcccactgccgcgagccactacggccgagccgccgtcgtcctagccgctgaccgccg

SEQ ID NO: 67733 - DNA, 3421 bp, Oryza sativa
cgggggttgagatttctggtattgcaattgagagatacaatttagattcggtggtcagttgagggagtcaaagtgatcttattcctgaatctaattcttatccttgaactgcaataccaaatatctcaacccagctcctattaaaaccggtctaatttgactcccacggtaattttggagggcagtttcgctgacgtggcgtccgcatggcagtgttgacgtggtctgtggtgttaacgtggcgcttaggtggcattagagttaaaaacatataagtgagacccatttgttattcacacacaaaattacagggcccacgtgtcatcctctatctctttcttcttcctccctctccctctctctctccctcttctctctttctttctctttctctccccttcctcttcccctttggtcagtgacagccagacgggaggcgagggtggcagcgggtgggagggtgggtgagggctggagcggcaaaggcgagcccacagtggcgaaggcaaaggaagcggtgtgaagaagaaaagaagaccaaggagaaggggagagagagccatcctcatcaccgccgtcgacgccactgccctagagctccctggccaagctccatctcgtcgttgcgatcgaccaccataggtcgctgccccgcactccctcgctgtccccgcaaagaagataaggagcccggggagaaggggagagaaagagagccgtccccgtcgttgcggggcgccgccgcctagagctcccttgccgagctccatcccgctgctgccaccgtcgaccgctagtcaccgccccgcactcccttattgtccctcgagctccggagcggcgatggtgggacaactacggggatcggcgacggcaagggtgcggcgttgggggacagcgtgtgaaggcccacgcccgcgccatggttgaggaatgagaggcgtgcgccatctcccgtgcccatgcctgcgccatcgccgttgcgcctcgcgcgccttctcgcccgccgctgccgctccgatcctcgctgaccgaaggggaagaggaattttctttgtgaatgaaaaatgggtcccacacatattttttaaattctaacgccacactaggtcaataccacaacgttagcaaaaccgtccttcaaaactatcaagggagtcaatttacaccggttttaatagttaggggtcgagatatcgggtattgtggttcaggcatacaaatcagtctaggcctctagttaagggagtcaaattgaacttgttcctttgaactataccctgacatgaaatgcttgatcttctattttgagaaaatccgctatgtacctttgagaatttgttcaatcccttgtgtgccgctaaattttgccttatcccttatatacccctgagtttttattttcgtctcctctatgcctattctgttagttgaccattaaatgttttttaaattgactatattatccctctcttatatttatgtgctagtttagtaataaaaacacaattcttatataaaaaagatctatttgtaaaaaaaaacaaaggaaatatgattatttgacacttttttaaaaaatctaaaagttttaaataatttttaatttatctttttgaaattcatacattgttttcatcaaaatttgaacccaataaataaatagtttcggttaaaaaaaacataatttctagctaatgctcttatatggattttgtcaaaaaaaaaattgttcaccaatttaatttttctttttcgaatttaccataactaattattccccattttattttatcatgaattacagtttttcacattatgaattatgaagtagatatagcatgtaagtatgagaaatggacgatatggttattttagaaaaatctaacagttaactcacaatcaactaacagaatatggatgtaggatatcaaaatgaaaattcaagggcatatagatggtgagccaaaattcagagatacacgaatttcctctataattttagttgaacttagaggttcaactgttcaatcctaatgtagcaaaggagaagcgaccatttgttttcctcatgctctcagaaaaggtttcggaataaacagggtgctcaatacgttcaggatggcgacttccgttttctccagagctgattcctttggcgattgcaatggcgattgatcttcatggcgactccctcccccctggtggctgggatttttcccccggcaattagctaagggatcagtgctggcaaattcatggtactccggttcacttttcttcgtacttcagtccttctccttttcgtttggttgttgacgtttcgcgatcgaccttttgcttgaatgagaactccctggctttagctcttcgggcttgtttaggtggatctcctactgatttctatgttagtcatataagggatcgatgcttctctttctttgtgtatttataagcttagatcttttatctgccgccatttcatcttcgttttttcttgtggcgcaatggaagtcctaattggtcttatgagttcatgcgctgggaaaaagagcaatcagatgaatggactattgtcaagagaaagaaaggcaaatctccttcaaatcattcagtgatcccagtctcatctgtttttaatcgttttcgagtgcttaatagttcttcatctcgtcctgctggagttctgcttaataatgtttcttctaaggagccagaaaaggttgctcgacggattgccgacggtgatcatcgttctgatagtcatgattcgtcttccatggcccctaagtctttgtccaatgacttagtctctcatcagaagaccgataagcctgatccgacttccaagcataattattttaaaaaaaatattctatccacccctttttgggccatgagaaaaagcccatggatcagcccaagggagttaagccacaaccagtttcgtggaagccgcaaccaattcgcggaaaatttgggtgcaaaatctcctataaactctgtaatccccactgtgtcgcatcctctctcttcacccgactccacagtaaacccccctctttctccggcgacgaactcgagttcaccaatggcgaaccttcaacctcatcctctctggttcatcccgccggggcagcacttgcatccggctggtccaaatcaccgtcgaagggttgacacagtaaacttcattcctactccaatgcggcatgaggattttgtgctagctattgttcatcctgctttacctgaagacctttgggatgaacatagggctgagattagtgggttttttgaacaagtcagccatgttcgagttgctgcttcttttccacacccaaatgttgttgccctgtttcagattgattctccggatcaaagagatgcacttgttcttgggcttccctattaactatga

SEQ ID NO: 67734 - DNA, 3071 bp, Oryza sativa
gataatcagggaggtaatcaggtcgatgaacatcttatgcctcttgtcccacagttgttgattgatttgcaagcaagctctgcaagctctctatctacttacccttctgctagctctgcaagtattgcggattcggcagtcagcatatctactgatgaacaggctttaacctctccagacaagagtattgtggttcataaggattctgttcatgctgacttatataattatctttgtgagaggtttccccataccatgtttgataaacactttactcaagattcttccttttgggctgctctcagtattggaccatatatgcctggtgaatcatcttcttctaggcagcatctgggctatagtcagggaatggaatcggaattgccagtacttatgcttactcatttggttatagtcccacctgtggtccatgtgcttcctgctccagttaagagtccaaaaatacggattgacactccaatcacaactgttgggttaagaaggagttctagattgtctgctttaaatgatgggcacaaagatgaatttctcactcagccagatccaaatcagggcattgggaaacctagaggtaaatcagttaagaaattgaagcaagtggccaaggaggtaggtcttctgttctctggttgtgatctgcaagactcggattttgaggaagggtctaccactgaagatgcttctggtgcgcctgctgactgctcgtgcctcttttgcaaaaaaatggcagttgatctgtgtggtgcttctgctcaagaggtgtcccaaattgaccttttgaagacgcgggctccaaatgaatctgatgggaacaattaagtccttccagttgcagtctcttttaggagtcaagaataaaagtgtgattctttcctgttggtttagagtttatgtgtctgctaagtctcatgtccttcatgttccttttggctgtaataattcccccctctggttgtgcaggtttgctacttgctgttccttttgtcgttccttctacagtcaattaagactgctttcctctgcattgttatctttccagcagtataactttgttatattgtgtgtttccctgcctacctctagttaattatgagtaatcatagagctgaaggaaagtggaggacggttaggcaaaatattgaggagagtggttgttcagttttctgtctgcaggaaactaaaagagatttttttgacactgcttatataaagaaattagccccaaaacggttcgattctttttgtttctctccctcagttggagcttctggtggcattttagtttgctggattggtgctttgttctctgctaatgtcatcagcatctctagatctgcagtcataattcaattttgttccaagcataatggtgaatgttggactctagtagtagtctatggcccctgccatgaaccagatagatcggcctttgtgcaatggcttcatgatttagatattcctgataatgagaattggatccttatgggagattttaatttctatagatcagttgacaatagaaatagagatggtgctaatatgaatgatataatgattttttaatgaggttatcagtaatttgggaattcttgagattcctcttaaagggaaggcctatacctggagtaatatgcaagattctcccctgcttgagcaatgagactggttttttaccatagtttcttggacttcctcatatccaaatactttagtcaaatctctctcaagagtcgtttcagatcatataccttgtgtggttcaaattgtaacttctatccccaaaacaaatctgtttgggtttgaaaatttttgggtggagcatgaaggtttttttttatttggtctcttcaatttggtgtggtaatgggaactgccaggattcagctaaaaatatctctctcaagttcaaaagcttaaggaagggcttaaaaaagtggagcaagggtttgcccaggcttaatttggttattaaaaactgctctttggtcacttctttcattgacagaatagacgaactcagggatcttactttggctgagtggaatctgagaaatattatcaaagggaaagcagttctatatatgagatacatacatttatattgcaaaagagatgtactgttagatgggtcaggtttggtggtgagaacaccaaattttttcatgcagctgctacagaatgatacaaaagaaatctaattactcatcttaaatctaatgatggtatctctctctctgggcatgctgagaaggctgctgtcattttctagacttttcagcaaaggatgggggtaacttctaagcccaaaatgcattttcagcttagtcagcttttatcaccttgtgaatcacttatcaatctgtttgataatatttctatctctgaaattgatggagttgttaataaaatgcctatagatagggcccctggacctgatgggtttaatggcctctttatgaaaaaaatgttgccctttgatcaagcaagatttctatatgttgtgtgctcagttttgtgaaggtactctctgcttggaaagtctgaataggagtttcataactcttgcccctaaaaagccaaaccctgagaaggttaatgattacagacccattgctttgcaaagtatagctctcaagctaataaaaaaggttctagcagacaggttgcaatcagttattattagtctaattcaccaaaatcaatatggtttcatcaaagctaggattatccaagattgccttgcttggtcttttgagtatttgcatcagtgtcagaaatccaagagagaaattattttgttaaagcttgactttgaaaaggcttttgacactatagagcattctgtgattttggatgtcatgaggcataaggggtttgattcaaaatggctaggctggattgagaaaatctttacttctgcttcttcttcagttctcttaaatggtgttcctagaaagtctttttactgcaagagaggggttaggcaaggagatcccttgtctcctcttctttttgttttaggggctgatctcttacagtctattattaat

SEQ ID NO: 67735 - DNA, 2979 bp, Oryza sativa
tataataggcatcctgttccttgggtaaatctaatttggactacatattaccctgataaagttccacatgccttgtctttaaggggttctttttggtggaaagatgtcttgcagttcattgatattttcagaggcttatctaagtgtacagttggtgatggcaagacttgtttattttggactgacttttggaatgataatataatatcagtgtcttatcctagagctttctcctttgtaagaaactagaaagactcaatgctgcagacttctttaaaggatctatctcagatgttattccttcctttgtcagatctggcctatcaggagtatcttcaaattcaaatggcagaccctttggatcggctctctgatgagtatcataaatggtcctatatatggggcaatgacaggttctcttctcagaaaatttatgctacaaatttcatggatgtgcagtcccctgtatatctaaaatggatctggaagagtagctgcactatgaaggttaaggtttttggttggctccttctcattgatagattgaacactcgtgatatgcttgacagaaagttttatgctcctcaaggaagtgatttaacctgtgttctatgctcatttggagaaagagaaacccttgagcaccttttcttctcctgtcccttttgtactgatcgctgggagcaatttggtatagtctgaaatctctcctactcttttgagaatatgctaacacatgccaagaactcctatcaatcttcgcacttcctggaaaaggttctttatgcggcctggaatatttggaagtaacgaaataggttcatttttgagaatgttgtgccttctgttccttcctggatgtcgttcttaaagaatgatatgtcccttcttgtttttccgtctaagattagatgatagataagttttttttgttcctggctagacaatttgtaacttttgtaattctattttttaataaaatgttttaactgtgggggcttcccctacagtgttttcctaaaaaaaaaagaaaaggtctcggtgcttgacaacagattattatacttttattaacatattattatacgttattccccgcaaaaaaaacatattaacgtttttcactaaaaaaaaacttgcaactgttatttagcaatttcaaaaaaaaaatcttattaggaccagacctagttgaaaaattgtaaagaaacacttttatttcaacaaaaaacggattgaacttttacatccagaatacttttggtgcgactacgtggttatacctagacaccaggtacgtgcgaccacggcggcgaggtgaaatccgcagctcccccgccttgtcgtagctgagcccaaacacggtcacgtggagcacgcatccatcctccgcgcacagggcgtccgccatgtcgaggccacggcgaagcgcgcactcgacgaggcagaacacgccgtcgcccatgtacgcgagcgtggcgcccgagggatgccctacgtgcctcttggggtcctcgcgaagcagcgtctcctcggtgatcttggaaccgagcgcggcggccgatgccgcggcgccgcgagacgcgacgtcgcaggagcagaggcggccgtcgtcgtcgagcccgacccacgcgtccagatcgtcgacgtagtgtccctggccctggaacggcagcagccagtcgccgagcggcgtccacgctgccgcggccggacggcggcgggcgatgtcgagggcgtaggtgccctgcctccggcgttcgtcgtccccggcgcgccggttgtgcgccgacacgaagacggtgcggccgtccgggtgcacggcgtaggcggtgacgaacatggggtcgcggccggcgccggcgaacggcggcggcgacggcgaggggacgctctcccatgaccaccgctcggcccgcccggaaaacctgaacgagtcgcgcgcggggtagtcgtcgtcgcggggcgccggcgacatcacctggaggtagtgcttcgacgcgctgcgagggtccagcgcgtacagccgctggccgtggacgggcaccatgatgcccggcatcagcggcgccgtcgggcgaggggcggcggccagcgacgacgtccccgtgtcgtacatgaagacgggagcatcctcaaggagagcatgcgtggcgatgacgatcttgctgccgaccgcggccacggccgggaaggagaggtccaccggcgcctctatgcggacggcggcgtgctcagggaggtggtggaacatggcggcgccggtgccggaatcggtgaactcgtcgacgtccagcttgtggatgacgtatcccatgtcccaatcaagcaccacgtagatgtgtttatcgtcgtccctccgacgtgaccttttactggacatggcggtgttgctgctgtgctgatcctgcaacgcccgctttgagctcaacatcgtatcttcctctgcctgcttcgcgcgcgcgagtaaacgaataatcggtggatttcggaataggatttataggcttcctcgccgacggattcgccgtgactaattccaattccgtttcggaagtccgagtggattgcaacattcccacacggcccgtttggttgggattccgagactggcccgcttcggagtcgctcccacccccggaaccggatcgtctgactttgcatagtaacgtcatgagcgtgcagttctacaatatccaccgtccattccatcctacggtcctgcttgctctatcctcgcactggtgcacaggcacccaagacggcaagacccaacgttaggcccacaaaatcagtggcactgtaaagtgggatttttggattagtcatgagaggctgttaattttggattagcactctcagttttggcaccgttgacagttggaggtcctactcttgctaaaaatcagttctatgcatattgcatatattgctcctatgtatatctataacttaatataaatattcgtatttttccgg

SEQ ID NO: 67736 - DNA, 755 bp, Oryza sativa
tcgtgagatgcacatgtgcttacagaccccgtctgtttgatctcatcgggttcgtcatttcaatcttatcaggtcataaatgggtcatcatccctccaagggattatacaatatggtgtgttcagacttactaattattttgtatctgagaggaaagaattcatcaatgaggtctccccctcagagaaattcccgtcaatgtgattttctcccaacgggagatggtactcttaccggaatacccattggtacgagatttgcatgatggaacttcactaccgagtctattcaagacctcacggatttcctaaatccgttagctgcatatttaatttcatgccattttgccaatacctttatttagcggaacattcaacttacgtgggagaggtctcatctaggacctacttgaaccatcgcgcatcaccacctcattatattaataatgacccataaaaatccgaacaacgttcgcgattttcaattggctattcggttcaacctcaattacatttccatttgacccgatttgagcatcgtatgctcatgccatggactttttccggatccgggttctctcagagagaatcattagcaagaggcgacatagtgtcgacacatttattcccacttacacatttaaccagatctttgtcatttcccaaaacgatcgatccatggttgttccgtattcctagcaccatcatatgcgcgcatcgctaggaatgtcgtctccacgacgaccatcattatga

SEQ ID NO: 67737 - DNA, 2680 bp, Oryza sativa
taggtgaaaatttttgacgtgtcacatcagatatatgaacatatatttgaagtattaaatatagactaataataaaataaattatagattccgtctgtaaactgcgagataaatttattaagtctaattaatccatcattagcaaatgtttactgtagcaccacattgtcaaatcatggagcaattaggcttaaaaaatccgtctcgcaatttacacacaatctatgtaattatgtcttttttatattgaatactctatgcatgtgtctaaacattcaatgtcacatagtgaaaagtttttacgtgaaaactaacagagcccgagtcgacgttgtgcgttcgcgtacgtgcaatcgttcaaagccgccatcgtggcaatacaacttgacaagtggtgtcgtccagatggtttggaacagctggtgggtagtactagcttttaccacggcttcgcccgcccaatctgcagcgaactcctgcagcatccgcccgcgcaacgcgtgcgtgcgtctgtgccgttgcttgcgcgcgctcgtcgatcgccgctcgctgcctagctagccgttggtcgagtgtgtcaagtgatatcattcgtatcagccacatcatgcggatgcatcgatcgttctggtggttccgcttttcgtcgtcacttcgtatgcgattctgtttgtccaataaagaagaaatcgtgattctgttccacgacgggttaaaggataagacgattggtttattcctgctatacgtgatggacacgacagattcatcacgagagcacaaaggagcaccttcttttctcggttttatttaggctgaaccctgagaatatgtgcagaggagattgcaagtttcagtttatatatatatatatatatatatatatatatatatatataaaggggaagggttaattaagggagaaggaattaaagcttgcaagttgctactagagtagatattttcttctttcgtgtgtagctgaattcggtatttcagtgccgttttaatttgtttattgtccatgtggtagcaggagtgatcctcctttagtttagtgattatgtccaattgtccattgttggtagttgcatccgattctttatataaaaaaactgcattatactgaggggtcaatgctgctgtcagatcaacacgcgcgagaacgcaatatctcttggaaatagaatcacgagttcatttcatataaaagacgtgaattaatagcagcttattcctcaaaacagccatagcacgtacaaacagcactatttattttgaaaaaaaaaaaggagaaaaaggactagctggctgagaatggcttgggctaacactcgactaagtacagccgggttaattaatttgattaattaacgaggaaaattctttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcagaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggccttagaagacaagaactgctgatgacatggttgatttggttcgacacactaattgatcaacacttgcaactccccttcatttcatgactaatcctgtatatccagcatagcaacaacaaccttcctttttttctgaaaccacgtacggcaggacggagagagagacagagatcgactgataaagattacagaaaaggcagtttacagtaataattttacacgtcaacttaacaataaatcatcgtcaagtagtccaataatgggagacgcgtcacgcataaattcaggcaactaggccacaaatctcctgttactagtacttgtttaatccattattgcgcacacggccggttggttaactcgcatgactaagtggaatcacatgcatcagcgcattgtccattgcccctgatcgatatactgatctgaatatctgatgcccttgcttgtttggttggatctgatagtagtagaagatgaaatgcaggtgattgcaaattaggacgacggctcatgctgaggtgctcgtcttatcctgcatttgtttagcgacttggtcgatctcttaactttgactctctttttttttttagaactcttaactctgactcaccaccagcacagcagattgatccaacaagggggtgtttcgccaagacgccaagctagcaaggtataggtagcttcctgggctcctgtcctgtggtgtgccagtgccaggtcgatgcgcgctcgtgtctgtcgcctcctggcgtcgcattgactttggataaatggattatggatggatgccatcgcaaaaagcaaggacactagtaaaaggatggccttttctttagggagaggagagaaggtaagaga

SEQ ID NO: 67738 - DNA, 5239 bp, Oryza sativa
ccatttgctcaatctgttgatagatctagaagacacaggggaggatcacgtgacgtggcggatgtacgaggaagaatattctctggtggttggacaggcaggagtgctggttttgccaagagctttgatgctgatggagtgatgagatggatataccgatagagtggttgctgcgtcggttccacgtcacttcaattcgtctgcatcacggcctcaaatacctgccaccgagcgaccttctctactcgccagtagttctttttgtttcttcctctcatgttttcctcaagcactcacaagttacaacctgcgtatggaagtgtttagttcccttcaaacatccaaaaatttcatcatatcaaatatttagacatatgcatgaagtattaaatgtggatgaaaaaaaaccaattacacagtttgcatataaattgcgaaacgaatcttttgagcctaattacgccatgatttgataatgtggtgctacaggccgtgtttagttctttggctaattttttttaagtatacggatacacatttgaagtattaaacatagactaataacaaaacaaattacagattccgcctgtaaactgcgagacgaatttattaagcctaattaatccatcattagaatatgtttattgtagcatcacattgtcaaatcatagcgcaactatgctcaaaagattcgtctcacaatttacatgcaaattgtgtaattgtttttttcgttcacatttaatgctttatgcatgtgtccaaacatttgatgtgatattttttgacaaatttttttaggatctaaatacacatacagtaaacatttactaatgacggattaattaggcgtaataaatttgtctcgcagtttacatgcaaaatctataatttattttattattagtatatgtttaatactttaaatatgtgtccgcatacttaaaataaaatttagcatatgaaactaaacaaggcccatatcaaaaaaaaagttacaacctgccattgtttgtacatgcgcgagcgcgacggtttagatagagagcgagcgtgaaataattgtgtaatatactacctccgttctagaataattacatttttaccattcaaattttattaaaaaaaatactccatccgtcctataatataagggattttaggtcaatatgtcacaatcccttatattatgggatggagggagtatttctaccaaagtgggatccaattttcctttaatcaagtttaataatagtaattagctgagtttattgtctcaatattacttttagtcaagtgtacgtacgaaatgtgtgtatgcagtgtcgttagtaaatagggttactgtgtttgttgctaatctgtctctattatcagcggatactcctctctattctttcctttcatcgtaaaaataaaaaaaacacaaagttaataaaaaaaataatactctcattcatgtgcatagagtttataccgtaaactttacacgcataaactttatacgcataaactttatctatagaaatattttatatataaaatatttgaatccggatttgaatttaaatcgtgtatgtaagcttttgacttataaacattcgctctacaaactttaggtggataaactttatatgtgtaaactttaggtgtataaacttactaaaagaggaaaatataaaatatttgaattcaaatttgaattgaatcgggtatataaactttggcaaaatttgctacaggacacgcaaaaaacatgtaattagctgggagacaccatgaaaacgtgacatagctgatggacactacaaaaattatgtaattggctgtagaacactggtcgcattattttgttatttctgggtcaaaagaggtgagatattttcctaaatgaccagattacccccttctctttccttcgttttcacgtgcgtagtggggcgagggttcacggtcaaaatccctgaattcctcacttattagcgaaggctggctgcagctttgcttcgtcgtcctcctccaacagctcgccccagtaggcagcaggtcgccatcctcccgacgctagcgagcggcggcggcggcggccgcggaaccggcggcagcggtgtggctggagtagccggcgacggcgctccgtggcgcgacgacgacacaaaccgcgcgggcctcgcgaggctggagtggccaccggtgggctccccggctcttcggcgtgacgacgacgacgacgacgcgggcctcgcatggctggagtggccgccagtgactccgtgcctcttcggcgcgccgacgacaacgacgacacaagcctcccatccttgcggcttgcgtgtgactgtctcattctcctgtctctactttggattggatggactcaatgcttatcttctgatctagatcacatttctttaatttcgttgtttgaattcaaaatttgtttgaaaatttgttcgaaatttctgaaagatttccgaaatttcggaatttcgctgacccccgaaaatcttccccttctcgatagattgaaccctgcccaccacgcgccttcccagcaaaggagaaaacgaaggaaagagaagggcaatccgggcatttaggaaaatatcccacctcttttgacctagaaataataaaataatacaactagtgttctacagccaattatacattttttgtagcgtccatcagccgtgtcatgttttcgcggtgtctcccagctaattacacgttttttgtgtgtcctatggcaaattttgccataaacttttgacttataaacattcgcttcacaaactttaggtggataaactttagatgtgtaaactttaggtgtataaacttactaaaagaggaaaaaacgatcgctggcaacgatcgatcgcccgttagccttttcgatttagaaatgtaattattttggaacggaggtaagtaattttttttatgttgacccttatgtaaaagggaaatttaactatttgacactattaggtttgtcaattatccaaatacctcttttagatttagatttgctctctttttttttttttgcctctctaagatggtggcttcttatctttttaccacttctgcccatctgggatgccaacgtggcaatgtagtgtaaaaagcgacgtgggatgcacttgtcagtctcacaagtctcccttcctctctgcctccggcagtattaaaaatcgacgcggcaaccctctctttcccagcggcggcggcggtgcgacggctcgcggcagaggtaaaggaggagccaagtgacgccgcggtcaaggacgagcatttacacgctggatcggacgtgcgaagccgtgctcgcatcgtttgcgccaacggtggtcaaagtcctcgacgagtgcctctacagctacgagttggtgggtggcgccgccgtcgagacagagcagcgcaacgcggcctccctcgccagcacaccatgggaggaggagccaagcgccgccgcaaatccgacctccgcctcgccatgctccatggcaaccacggactccagtcggccgacgcggcgttcctccctccccagccaccctaagatgacgtgggcggctccgctgctgctgacaactctatcgctggaggcgctgagctcgccacgctcttccttggagaatccgctggtcggtactgacctacgccatctccgtctcccgtacttggctccctttcctactcctccgccgctgcagccaggaaagagagggctgccgcgtcaattttaattggcaaacctaatagtagcgaatagttaaatttccctatgtaaaaacttccatactagttaagtatcacataatactttcccattgtactaagacatagtatcatacttatatatcaaattatcaacaaagaattataagcaatattcaggttttatttggaactatactttcacaactttcacactctcgacttttgtgcgtatgcttctcaaactactcaacggtacttaattaatactgcgttaatatgttttctatgtggaaggtgaggttctcatccccttgattcgaaaatagtctaaggtacaattatgatggtgccccaataatatcacagtgctcacccgcatctcagacaactcagatgtgcaagcaaaacagttttaaaaaaagatgtgcaagcaaaagaaatatgaaaattatcctcaaaagagggggcaataacacatatgaaagaagcccgatactctcccatcaacgggctcactcataacgctatcatacggcctatccgtctcgctgacatgcagcccaaaccagcctacaagacctaatataccacgtgcgcgcgggagcctctcgcggagagggcttgcggcggcacggcccgtccagcgttcatgttcatggaagcacatcccgtccttattctgcgactgattaggattccgaaatccgagtcatctcaaattaatcaggctgccgggaaccctacaaaatcaaacgcccgaaattcgccgattattattcgtttattcgcggcacggcccgtccagcgttcatgttcatgtaagcacatcacatcttaattccgcgactgattaggattctgaaatccgagtcatctcaaggttaaccaggctgccgtgaaccctccaaaatcaaatgctcgaaatccaccaattattattcatttattcgcacgcaaatagggcaggtaggatgttagtaagtctgaacaagtgggataaatattgtgggtcaggaactggacacaaaaaaaaagtattttgggaactaaacaggttataagacagggactgagggtgagggacatagaagtgccggtgcaattgaaagctgaattgagaaaatctgaagtcaatttgaacacaggtatgtctaactcttttgccattttcaattcagttaatagagatgttttagttgatattgtcaatataagtaatattgtgttggagagaaatgagtgtgagattgagacaaatttgacagtcgtttgtgttagagaagaagcaaagctatgttgtttgctgcggaacagagtaagtgcaatgagcatctgagtttgttgagattagtgatgatgttgaagggatggttaaagaggaaggaggcaaggagaggattctgcagggaaggtggagtgatccaataaaaatcaaagactaaagaatacataggatctgagcagaaaaagaaggggaggaaaaaaaaagtaaatcatgagatttttttag

SEQ ID NO: 67739 - DNA, 5762 bp, Oryza sativa
gttagggtttcgtctattcgttgccttcctcgccggattagcgcgtccagggagggtgagcggggtgtgcttggtcgcgtcgcgtcgtgccgtgccgtgccgcgcgtgggatgatgggcaccgccgtggagctcggccggaggcacggcggcgaccaccgcttctacgacgcatccagggtccggcgagggtaccaccaccacgggctccccaaggcgaggtgggcccccgccgtccaccaggagaaggcggccgaggagccgtccccgtcgccggcgagggcgccggtcccgccccccggcgtcgcgggcaaccttgagcggttcgtggccgccgtgacgccgttcgtgcctgctcagttcccctccaaggttcgccctgccctttgacttcctcgcgtggtagggttagatcgtagtaattacttgcggcagtgcgaccatttctgaatcggcggtggatttgggatgcagatgcagagagccgcgagggggtggcggggctgcggcgtggatgccgagcgggaggaggccccgcacttcttcctcagagacgtgtgggaggcgtacagggagtggagtgcgtacggtgccggtgtgccgcttgtcctcgatggctgcgacggggtcgtgcagtattacgtgccgtacttgtccgccatccagctctatggagaccccgcagtcctgagactggcttctggccctagggaattgtgatttcttctaatcatgctcaggcacgctattgatctgatttggaagtataatcctgaaacccacttgacttttattataattaatatatggtgtgcattgttacatttacaaaagagcaacgatcatttctaatatgtgtttttgtagaacaatgtttcatacatttctagttgccagtaatacctgactgtttgctgtcacacatgtcgttaggaagcacttatcgggttaatgatcccatggtagtgaatgtttacctcatgaagctattagttgtccatttgcataaaatggatggcccagagaattttagcatgaaattccacacttgttttattctggcgtcttgtgtttaccaaaacaatcaggaggttttaatccggtgcagtgtgttctatgacattccaactttacaatttgtagtgattgtatagactcgaaggtagtgaagttcaatcagatgtgacttaatcgtgagatgttgtcgttatgattctggatttggaatgatatataataatattatttctcattgtcaaaactagcttgtgatgttgtgacagatcaatgtttgcaactttaacttgtgcatgggaacgaccttaaccatttcgttaaagtttcatacgtccatacattccatccttttatgttcgtttcctttttgttcattaaacctttaacgtgacattaatattgtgtttgtagagaaatttccccaaaacacaatttagcctctccattgatcttgtctttgaacagtatttgttatgttcatttagattagcagttcactaaaatgattgtgtttgaattccataatgccatgaaaaataatgagcttcggttacttcttaatgtgcgttatagctctagttgctcatgattttttacatattcccacatgcatcatgcaggcaagcttttgcttccctttactaatttattaactatcattatgtttctaacgaattctagtatgaggtgttatagaaaccacttagtctgttcagtaagatataactttaagatataacttggtccacttgatttgtgcaatatctaattttgtggttatgtttggatgaaaattttgaagcagacatataatggatgacagtgatggggagtatcatgattccagcagtgatgcaagtagtgattatgaacttggaagagtaaaacatctaactcaggaaggcttctcaagtgatgatggtgaatcaggagatttgcatggccgcttgctctttcaataccttgagtttgattctccattttgtcgtgaaccattgactgataaggcaagagttaactaagacggttctataatattctattgcatataaatattctgaccttatttgttctttcagatttccagtctttcagcaagatttccaggactgaggacccttagaagctgtgatttatcaccgcgaagttggatatctgttgcttggtgagttctttttccattggcatggtagcagactagcagttatagagtatggtagtaactagttactgagttgcctacaacatcatgcaggtatccaatttaccgtatccctactggcccaacattaaaagatttggatgcatgctttctcaccttccatcggctatcaactgggccagaagaaggtatgatcgttctgatttccaaaacaaacagatatgcttccacctgtctgctgttctttcattcggttatcttctgtagtctgatttagcacacgtctagggggcacaaatgtttttgaaatacaataaagttgtacaacaacttaagtatgtgttatgtcttctgtgtacctgctctgtgttggctcgagaatatgagctcaaaaggcctttccgatagtattttttatttgtttagtttgaaatgatcaaatgcatgcaattgacaatctctttttcctggtgctgatgtttagaaggatttaacaactgccagttgcatccaaaatctatttagaaaagattggcatagttagggagcacatgttctataattctgagatatcatttcagtgatagttctgtttttactgcttggcgcattactcctgcatgcggattctgccacatttaaagataaaaaatactttcataaaactgaagaaattaatgaatgacagttggtcgttggcacttattttattttgttagtttgattcttttttatctaattctgtggctgcacgctgcttgtttaaacactatggaatcacttattgcttgcttgtgttgtgatctcaagtttttatgctctcttggccagataacggtggtgctgtaaaatactggggtcctggtagcaaaccgactataccactatctgtttttggtatggcttcttacaagttcagcaattcaatatggtcttcgactgatggagatcggcagctggcaagcttcttgcagcaagctgcttctgactggctgcgggatagtcgtaccagccatccagactaccagttttttgcttcccgtggtgcatacaacaggtagtggcacggagtctacgccttggcagaatttgcagcagaatgtctggaaggtttcagctgtaaatacaccgaagggggaggtgaatggctgatagctttcacacatgcatgcggagagacggtgtgagctcccatagtaggatgcaagcagtgttctgctttgtaaatggcggtaataggggagggtttgatcggctgtgtttttatgcttaatagtcggtgatcctcctgagggaagttgagatgaaaagtgaaaaaaaaagcaaaaaaggactgaagaaaaaggcagtaaaaagattagctgtgcttgtttgttgagctatgcatgcatgtcgggttgttggacttgttgaggctacttatgtaatcctacgaatacgggggatgagttttgatgatattccccttaatgtctgtaaacacttgtgaagagcctgtctgacactacagactgttgtgtttgaagggaacttgtagttagcaaattagagtcatccgcatcgtttgttctatagaatataatgttgatactaatcatgtctagacttgcaatgcacaaattaagagctgctgatgcgtgtaaacagtctgatgttcattagtcaaattaccttaaaaatgccggtgtccaaacttctcttacaagtgcatcagctctgttagtaaatactcccgttctttaatataaggattttaatattttgttctttaatataaggattttgatactttgtttgcactgtttgatcatttgtcaaattaaaaaaaaagaaatcattatttattttatttatgatttacttattatctaaagtactttaagcataattttttgttttttatatttgcataaatttttttaataagacgagtagtcaagtaaaatatcaaattcttccccttattctttaaaaaaactaatagaaagcttaggaaagtttaagcaaagaagtagacagttttcttttaagtaaattgcattggtcatacataaacttggtatatacgtgtaatttaatatacaaatttataaaatagtcgtttcagtacacttacttgtttagttcttgcgaatgagaatcaaaataacctggcaatattaatttatgttaattttatgaagctgatgttgattaggaatgtgacgtgcatacgtgtataaaacatgtaatatttataaatctggtctctagtgaatttcatatatttttaacccttatatcattgctcggttttttttaaccttttttaactatcactatatcctattctatttttttttatgaaaatgtgtatatctaatatcaaccttatcaaatttatgtttacatagtatcctagtcaacccctaagtcaataagattagccatgtagtgtccttttcgcttttcttcacacgcaccggataagttcatacatcaaaacgagcattttacaagttcgtgcactagattacacccacttaataagttcatgtaccgatgatgcaatttactttttttaataaggggcgtttttaataagcaagtttttaataagaaaggaagtattttaaaagatgtatattcatgacaacaatgtataaatgaaacgaaggtagagttatgtagcacatggagtactttgatgcttggttggatggagcctttaaagtttgaagtgtttgctaggtggatatagggttgcaagcgggccgacccgtgagttcacttatagatcaaactagttgataccccgcgcgttactgcgggcatagaagtataattatcaatgtgcaacattagtgcaaacaatctaattaagtttgcttataatttgctgagaatctcttaatgatagttctgttcccagcaatgtatgatagtatatgaaatcttcatctgctggccaaaacttcaaaatagagaaacaatagtatacagtaaagatctgattggttgtgaacgtttagaatgaaagaaacaaaagactgaaaaattatatatttattaggcatcattactataattcataaaattgtatgcttccagatcatggattgctgcataccttagcaaaaataaaccttcacctaatgtggatggttcaaaatctaaaagatgacccaattatatatatgagcattgagggaagcatcaagcatacataggagttgggcacttgacatccggatcactcatagtatttgttaagagattaccaacaaaataattccatttaatcaattgaaaagcgaatgggatcatggcacctgaaagcttaactttctatatgccctcagtctgtctgaaatatcatagctcaaattgtataccaccttaccaactgcatatatgacatgaaacaaaagcagttacaaattagatggaatagcataaaacaaatatgtgcagattgatctggctctagctttagaaatacaattacatattacatatatttgagctatccaattttaagagtttttcagctcatctgcaacagaaaaagatctaaagtataaaacccgtcacagatttttttt

SEQ ID NO: 67740 - DNA, 11781 bp, Oryza sativa
  unsure (1)..(11781): unsure at all n locations
ctcacagggcaacacaagtcttttcggcgcactttgtgcttactcatgtgcactcgggaagaatttcccgatcggtcacccatccctaaattgctctaggccaagcacgcttaacctcggagttctttagagatcagcttccggaaaagaagttgcaacctgttgatatgagtattctattaatcctattaagccctaggccgggatgttacattaatcaaaaatagaaatatttaatatgggatattttcaaaaagcttatatgaaatggagaaaaacagccagacctaaaatcttagccaaaggacaatatattttggatcccagatggccttcacctgaaatcctgttaattagaactctggagtaaatgatgcatgcagagaattagagactgaaggttgcaaagtcaaggtcttagtgtagcatctattaacttgtcacgaatgcttagaattttaggagcggatgattcgatggctgcttaccacctcaatttactggcagtgcagctttaaagcccatgaaagtggactgggataggagataattaacagaaacatgagacatatcagagatgatgtaaaaatctctatgtagaggaacacaacaactgctttgtttggtgcctacacattgcaatgtatatcaacatcaaccaatcagatatgggaacaaagtatcatcgaagaaggtcagctacatgggtatcatcaaagaacttaataacttcctggacctggttggcgctatatatcgttgacgcgggcgataagatgagggtgagagagacatcgagcagtgccgcctcccaatctcccatccatgcgctaaactgatgaggctagctaggacagctagctgctgatagaaacgtatgttgccagcagctagatcaacgatgatatcgcagagattagtggtggaataaaaacatgcattaggtgaaaggagcataaaaaggaattaaacatggtattaaaatttaaacatagcccctcggcttccctttgatggcgacggtttcattgacggacaatacgattattattgaatcggtttcatacaaaaaaaatcatagaagaagagatcatgcctggtcgatggggggagacggtggatgctattcatggtgagctgaagagtgaagaggatgcacgacgctccacctcgccgcgcgctgtccttaccaccacctgcgtgtgaccgcgccgcactacgccgccgccgccgccgctccgactcaggaagtcaggaggatgagacccaccgaaccctaaatccttcattgggctgcgatagactaacatgggtctcctgggctgcggtagattgacatgggcctcctgtggtggaagaaatatataggcctcacgtgttgtgttcaatccgacggttcagatgagatctaatataccgatccaacggttgtgaattaatgatgacgtggaacattgaggtgtgagttttaggagattaattgcacttagtggaggataactttataggaagaagggataaatgataatttatgggttttcacgtcgtgcttcggtttaccgcatctagatatacaagtgggtcgatccataaacccatttagagcaagtttaataggatagccaactacgagctccaattcatctatagccaatttaatagtcgattcgtataatagttgtttactatactattaatacctggtcctatctgtcatacacacgttacgtcttggagtccgtgctacagctggctacagatctgtaacccgctgctcttctctctcctattttatctatttaaaatatgtttatagctggcttagggcatcaccaatgtatatggcaaagtgatccatatagataggacccatataaatagtttttacctatggcaatctccacaatgtatatggatataatgtatcactaggagaagagagatgagtagagatagataatataatttattccatatgggtagtccatatgcatatggataccttttgttattttttctatatatggactagttgcacaatggttataggtggctgaatggaggacctcatcggtttgctgttgctgaggctgatcttcagcacaagcccatcagttagcttattggggctgaataaacaccagctattagtagtggatccgatcttactggacacctttttacggctgattatgctgaactgaaaaagccaactttggctgatcaaccaaagctgtagggttaccgatgaggaccggaatattctattgcttatggactacttttacactacattgtggatgcccttatagcctgctattgtacctgctattctctctcctattttatctctttaaaatatgtttatagctggtttatagcctgctattgtacctgctcttatagatcaaattaataggtaacccgctggtcaaatccgcgggttacgtactaattttggttataagtgggttcgcggacaagcccacttacacctctaggtggatagctgtggtaccttaatacatgggtggtgtataggatgcgggattttttttcttctaagctttccttcatagcaaggtttaaattaagggcccctttgaatcgcaggattgagaaaacgtaggaataggaaaaacgtaggattttgataggaatgtaagtgtaaaacagaggattgcaaaacacaggaaaaacataggaatggccgtttgattgaaccacaggaaaaacacaggaattggatgagagagatagactcgaaggaaagttagcaagaggttgaagctcttgctaaatttcctccaaaatctctataggattgtccattccataggaatttcaaaggattggataggattcaatcatttgtttcaaagggcttcataggaaattttcctataggattgaaatcctctaaaattcctatgtttttcctccaaatcaaaggggccctaaaatctggaatgacccgacatttgaaatcctctaaaattcctatgtttttcctccaaatcaaaggggccctaaaatctggaatgacccgacgttttccttactcaaaactggcagcgctaaaaccagcctcgagtcgacggctgaagattggttagaaagtggggtccatctgcagagtatattttcttttgagatatctgcagagtatctgtggatgtatacaaacaggctctttatgccgactgaggcgctgtttggaactaaggaatagaataggaaatgaatggatgtgcaattgcgaaacagaggaaccatgaaaattataggtttgtggtgtttggaacacagtaacagcaaacaataagggcccctttgaatcgcagggttgaaaacaatagaggaatgtgaaaaacacacgattctgacataaattaaagtgttaaacaaaggattgcanaacacataaaaacatatgaatgatcgtttgattggacagcagggaaaacacaggaatnggatgagagagataggctcaagaaaattttccaagaggtgaacctcttgctaagtttctttcaaaatccacatgcaatgtgtcattccataagaatttcataggattccgaaagtttcgatcatttaaatcagagggccaaataaaaacatccctataggttttgaatcctataaaattcctacataaatcatttgattcaaagggccctaaaacttttctcttcctcaatgctctctgggccaatagattgcattcaaaggaaaacttcctttagcttggagcagatgttttattttctccaaaaaaaatagtactccatttcaaaggataggggaaaatgtcataggaattggtttgctccaatcctccattccaaacggcatgtgaagtgctcaaaacaaaggattcacaattcctgtacttttccttggttttcctccaatccaaacaggccctgaaagggaaaccatagccctgtggactttgtggagtgttatgaactgtgatgattctctactagtctgactggacacgcataaagcaggaaaaggataatgtggtaccaattttggacgttgaagaaaatccatcataaccgataaacaattcacacgcatgccatcagagtatgtagatctcaattttcaaaacgaacactcaacatcaacaactttgtgcagttcaacagatgtaatgcagcattgttcaatgtacaacaggaacaagggaatgtttgtgatagaaaagtcttagcatattcctcaaggaacactagacctcttaatgtagtaataaatcaaatagcacactgataccagtaagcgtaccaaagttacccagaagatatgacattaaccgtatttaggatcggtataacctgcaagggaaaaccacagtataacattggaaataagaggactgtaaagaatggtaggcaagggcatgtgtgtctaaatataagaagggcctaaaaaatcagatggaaaagcaaaacagaattggatgttcagtttgttctgacaacacataaccaacgtaaatgatgatgaaaaattttccatcttcaaaaaaactacatatcagatcattctagcagcccttaattaatcattgcctgaccctattacatgtaaaactacaaaatgatatgcctcaaatctaaagcttcttatgtgtattaacaaaaaacattgccaggaaacttttcaaatccagtagttattgttaactatatgaattgttaaccagaaaatctataatggaacttataatacaggtgagtaagctatggacaaaactgaacattattgcgcgcccacaaaaatggtacatgtggcataacaaagacatatatagggaattacctctaaaagtatcatatcaatgttttgacatattgatcaaggtgcttattgaaaagctcgcacctgcttaagaaaggtttgaaaagttagtcagttaaggtaaacaaagaaaaaattgattgaaagccactataagaaaagtttgtcaacctgacatagttttttatgtatattattaccatactattaaagttttatttagtcacaagaaaactaaaaggatacttaaaagttatggaagaaattgagtgtttggattgtagccgatatcttgggatagcaaaattttggaaaggttggctcaagcataaacgaaacaaaagtttacaagctaccaataccaaattaggattatttaacgaaaatgttcactattgtgcaaataaatcaatagaatggtatcctgataggaatgactgccacaagtaatctactccctccgtttcacaatgtaagtcattctaacattntccacatttatattgattntaatgaatctagacatatatatctatttagattcattaactntaatatgaatgtggaaaatgctagaatgacttatattgtaaaacggaggaagtacctcatatctacatctgcatgaaattcctaatataatgggtagaaggacaaagtaatgcctaccttgcatgaattttctcttgaaagaaagaatctacattaatgcattttgttttctgatgagataatcctgatagctatatctaatgctgttatgaaccgaagggtgaagcaaattttcattcgcagggaaagcttacttgattggtgtgccaggagcgtacaaaggattttttacaacatattccacatataggttgtagatatgcttcagcgtgtcacgttgatcaccagtccttggatgtgtaattagaataagctacacataatggtagtgtcagtgaatgatatgttttggaacaaatggtattaaacaacattctgttccagcaaagataaaatcatgccatattaagaatggaaaactggaaggcaggagatgaaacaaattgactaaccttgataccagaagggctctctaggaagttcaatttgtatgtgtttgtcttgaagctgtaaaatgagcaaccctggcccggcagtagtggcaccccaagattccccttttctgctctgcatagtgatgtgcagagtgatcatgagaacactgataacattttaagctcaatttagattcacctaattcatcaaaatggtaacaatctcgtgggcatgaaaaggagagcagttagaaaatctaggaaagggcgacgaaagtgtagaacagtgtgctgggaatgaagataaaacacaccaaaagttgtaatgacgatataagaattttctattgttcaattttaaaaacttacacatttcctcctctgcttttagtgattaacatgttgagtacctggggtgttagtattgagattctatatttatatgaagaggtgacagatcagaggtcagacccttctttatttttccatcttaaactcctgctttggagaagaggtagagttcaactcctggtattgtggcgattattgatccaaataccagttgtaaaattgaagtgatgaactattcccaatcttaaatcgatttcggcggaccatccttgcgcaagggatcccttgcttaattttctactgcaaagcctgaaatctctgccaaattggccgcggataactgtgaattactcccactgacccaatttagtgagtgaaacaacaatttatagttcattcatttgactcatttttcaagcaacaagaaacaggtggtttgcactgaagggcacacttgtaggtagtaacaataagtaaagtaatccattccaaaccactagcggttcgatccaagaactctgttgaggtggggggagagagagaggcgtagtacgtggtgggatcgatcttggcggtgaaggagcggagggagaagaggaggccgaacatgagcttctggtcctgggtggggtcgagcgtgcggagcggccggtgccactcgcggtacagcaggcagacgccgccgcggttgaagacgtagagcacctgcgcgttggcgcccgtcccggtgcccggcggcgccgccggggccggggtcgcgtccggcaccaccgacgtcagcgacgacccgccgccgaaggagaacatcgcgcgcgcgtggatggcgcccgaggaggaggtcgagcccgccggctgtggatctccgcccgcacaagaggagatctctcacgggaggtgaggacgacggcgaagaggagtttgtcatcgtagatagaaggcggcccatgtacacagacagcagaagccaatgatgggttttgggcattaagccccatgggccggtaaagcaaaccgatttctcaagtttttatttgtttctctgctggagtattatagatgtggaattcttaaatttatttatttatactagataaaatgtccgtgcgttgcaacggatgaatgctattttaatcttattattgttatacggtttagctaggatgaaattcactgtaggaattcgcttggatattttttttagaaaatcatgagctgcaattaggagtccgactttcatctcaaattagcatgcaagttttttaaaaggaatttattttacgacttcttttatatttccaaaagcaaacaaacttaaaatccgattcatacacgaacttgtaattccaaaagcgaacaaactttaaaactgactcaaatacggatggcgtaccaaaatactggcaaaaacatattcaatttttataatagttgagaatttatcagttttgaaaattttatttttcttaaaattacagaaatatacccaagggacttaaatgtcaattttgccatatagcttgttaacgttgtgattttacaatttaaaaatatatcatatcaagtccaatgaaatcaaactttacattaaaattatagagcttgaggagatttacaacttcaaagttaataaccttttagtttaagatcgtttaggactccaaatatttgttacaaaaatctaaaacttgtttctaacaaaatctcatatctacgtttcaaacgacagtgtatgtagacaaactttcatataagctttgtagtttatcacctttttatttaaatttaattagagtggcaaacaagcgttaatagtctttaatacaaataaaagaatacagttaggccccttctcgtcctcaagaagggtgattttcaaaaaacaccctcatggagcgtctagatctgtagattttttaaactaaaaattattttcataaatattttaataaaaaaatttcttctaaatattcctcctccccaacaatcacattttccccacataaaatacaacattaacatattcagtgaaaaccatcaaataaataaaaacccgtaaaaatcaaacctaaaaattttgtaaattcatgacaaagaattagagactaaattttgtttggggagtactgaaaacaatgacaaatttcttgagttatttttttcctcctctctcgactgtagcgtattagctagtttagctaatgtgggtgcaactggcatccgaatgcggggcgctgattagtgaccagtcgcgccccacgcgcggtgcgtggtcactttttcctctcttagtctctcttctctacagcacatgtatatacgtatgtatatactatatatatatacacacatataaattttgtatatacatatacaaaatttatatggtatatatgtagtatatatacatataattttttatatgtacacacttttaatgtaaaaaatatatacacatgtatataaagtttataaagtttatgtgtgtacgtataaaaaacctaaaaaaaaaatatgtgtatataaactttatatatgtgtatacaaactttgtatacatgtatacaaaaattggtatatgtacatataaaacctcacaaaatgcacgcatatacaaactttgtatatgtgtataaaaaaattgtaatatatatgtataaaacccaaaaaaaatacacgtatataaagtttgcatatgagtatacaaactttgtatacgtgtatataaaatttgcatttgtgcgtatacaaagctagcatacgtacgtattaaaacccgaaaaaatacggaaagaaaaaaacaggaaaaaaaacgaaaacagaaggtacgaaataaaaacagaaaaacaagaaaaaaacaaaaaaaaaaggaaaaagggagccaacgcgccgtccgccgccctctctccacgtacgacacggcgtacgacacgggtccagtgcacgactcgcgggcgactggtcgcgaactagcaatttcgcatccgaatgaacctcgttgacacttgatagacgcctttttagagaagacaaatctttttagaaaaagctgcatctgtctgaattttagaccatcttctgaactgcttggtagttcgatggtgtcttgaaagagctttcttctgcgatggcgttgtacggagcatcagttagtgaaccgcctcttattctcacgaaagagatgaagcatggaaaagcttcctctcaaacatcaattcaggttccaaaagaagctcaggtgattaggtgagctcaggacctcaggttctaggaagctgagcaatctgaattcaagtttcctcaaagcccgaaacatcttatcatcagggtgaggatttagaaagcatctacatatatctcataatggaatttcgcaagtagatgggggaaattcaccaaccatcacagataagaaatcagaattgtagaacaaaattctcagaacatatagctactcaaaattccatgctcactggcatggtcaatattgttgtggaagccattacaagggtttacaggatgtttcttcattaactatttaccactcaatataacgcaaggtgacttccacttggtaaacacaacagcccaaccagttatgaccaaaaatccttaacccaacctgatagttcccaactaaaaataacttcttcagcttcttcactcgggatttatcttttgcttctttgagtggtccttgtttttcttggcttcacgacgctccctcttcaaccccttgacatcgtttgataaactcatctttgcgatctttaatagtcaaaaaccacgaatcagcttagcatgtcaaaaggcaatttcaacctttacaattgcagcaaaaaacaaaacaaacacttacttgctggtctggaatgtagaccttgcccagcttgccatgcactggatccttcgtgacatttttcatctgtaaaaatgttgataattgtgagaaccatagtgaattagtggtttaaggattttttggcaagaatacaaggacatgggctatagttgtttaatatcacaacagtttacacggcaccaaaggtcaaaagacaattatcaattgggtttaccttcttagcatgatcagcagtcttcattgcttctttcttcaagctttcaactggataccggtgtcgcctaactactagatccatagaaggtccaacttcaaccagctcaattctaggaatagatgtgccagaccgttttagacggagagcacagtgcatcatgtagacagtagtaggggagattgctgtgcacacaaatacccgatctacaccagcaatggttcagattctctaccacgctgtatcaacaacaacacagctgcatgctgaagctcaacagataatctggtcccaacatgcccacataaatacatcttaacgcgcgcctgtgctttgcaaagatcaagcggcactgacttcagatgatacagctgttcacactctcaaagtgctgcacagggaaggcacagaaaggctctgacccaggatcatgtgccagtttcttgtcatacacataggatacaatggagatgtagatatcaactcctacttcaacaggatcatatatgcggggagcataagtcctccccaaaacaagattgttgggcctcttctttgagtgagaaccatactggaacaaaagagaattgaaggattacagtcaaaacgatgaagaaacataatctctgaaaacacatcatcttactaccacattaaaagaaaaacggacaaactaaaagcatctgaataggcaaggagtaagtaggtttcagataggtttcatataagcggtgagaagttcatcatagtagctcattgtatacggttctacttctcctccacactatcaaatcaaaccactaggaatattaaatgatcctatcttgtgcaaaggaaactatttcttctctacaccaacaacctacaattataatcagaacaagtgagctttaccactataaggctgcaatccgtcttgagggagaagaactcgagagaagtttcgccgccgctctcgaacggcctgatgttgtcattcttcttggagtacttgacggcattgtcacgcttcaggtggaacaaatccgcgagcacggagttcagaacggcgctggtcttggttccatggaggataagcgtcttcttgccggtctcaacctggcggcgcggcgcaaatcatcagagagagagaaaaaaagaacaaactcaagaaccgcaagctcacggggggagcggagataaacgcgcttacgagcttcggcgcgtgcttgaggagctccctcttggcgcgctggctcctgggcaccctgatggccgccaccatcttcttctccccgcccggttccgatcggtcgacgccgccgccgcgtggggaaggggaagacggcgggtgtgggggaagaggtggggagcgagcggtaaaccctagaaaacctcgcgagctgggagagttggaggcgacgcgggtctttgtgtcgcggaaggggaggaggaatgggatggagggatcgtcgggatggtggagaatcggacggcttaggttcgttgcg

SEQ ID NO: 67741 - DNA, 2582 bp, Oryza sativa
ggcccatctcctccagcacgacatcggacagaacaaagttactcggtcagaatctactctcctgtcctccatccgtcccaaaataagagcgagtacaatagtagaacatgttcgggggaggagagctagatgagtgaggagaggagggagagtgagggcgggcaacaattttatcgccggctccagcatcgacttcgagagaaaagtgatacttcctccgtcccataaaaaaccaacctaatattggatgtgacacattctaatactacgaatctggacatacctctgtgtagattcgttgtactataatatgtcacatccgatcctaggtttgtttttttagtactgagggagtaagtgtggagtgcatgtgtgacagtgtgagtctgagaggaagcttaaattctttttaatatgacgtgatgttcagtggcggatccagaaagaaatagcagtggggtctgaacaaactagatagagttacaatgtcccatcccatctatatataataaaaaaatttagcgggatcttcgtgggggctctcatagtcttcacgccagtagtgggggctcgagaccccgccgcccccatgctagatccgcccctggtgatgttgatgggtccagcattgtagcttatttattgtattcacaaggtgcaaagaaagctatagctgagttggatgaaattggagccaactgcctatgctactataaccttgctctaaaccaacatcgtactaagatgtgacatatccttgtataataaatctgaatatacagagtgacacattttagtaggatgttaatttattttgagacgaagggagtaaatgtggcgtctctacagatttatagtattatggtgtatcatatccactagtacctctttaccaagtttattattatttttatttactagtaatattgttagtactaatgctaaataaagactaaaataatgcattaagataatatttgtttggcaattaagtatcgaatgtgtcagttttaagattcgtgaaaaaagaacgatatagttaagctattctataaggacatgttgtttgtgtaaacaggtctaaaacagatttgaaaaggtgtcacaccatatttttcataacactacatatttaaaatatcgtatcagaaaattacatatttaacatcagttttatcacaaaactacaactttgataacctcaatagtgccaaggatacgagctctaaaatttgtagttcttcggtaacctcatcactaaatttgtagttttgagatacgatcaatgccttaaatctatagttttataataaatttaacactaaatctgtagttttgtgatacaaatatttaaatatgtagtttgtgataatttagtcaagtatatatatagttttgtgaaatttactctagtttttaaggtttattggatcataatcattgcaaattttcccaattgaaaatctaccattactatttattcgtgaaatcgggcaatgtaaacatatttgtattcaattttaaaaaattataaatagatgctaattgacattaagtgaaagttagactagaagtaattgttcttaactacaataaggaaaatgatggtacctcacgacataaataaataaattactgaaaagtgaaacaaagaatacattttagtcagtaccattttgtaacaagtacaaggccttgttccacacaccactttcccgattttatcaaatttggcaaaaatccttaatgatgttgccttaccatatttttgttattagaatatgaagaagtatattccatacacagaagttcagaaaatccaaataattaacctacaaagaacatcaacaaatactattatattcactttttaaacataatacctccatcccaatataagtgcagttgtggtttttcatatccaacgtttgaccgtacgtattatttgaaaaaaaatatgattagtatttttattgttattagatgataaaacatgtgtgactaatttttttaaaaaaatttcataaaattttagaataaaacggacggtcaaactttggatacagaaacacacaactgcacttatattgggatgaaggtagttgttagaacagaagaatgtgatggaataaaactaaccataagatagaagatgaaaccaccaaaacctttcgatatgtcaagcttggttatgtgattcatcaaccattcaaataaaaacttgctccaatccaacttatcaatagaatccaactcttctggagcattacgacattttgtgctatgtaccaatgatgagtttgggtagacaaagcaattaagatagacaaacatggatcaaatttggatgtgttcaacagacatgccatctttgttaataagcttgtctataaagaacttcacaaaggacactaaagatttgccaaaactaaagaatctttttcttcagatcatcaaaacttgatttgatagaattgcctctaactggtaaactgtgaacaacatctatagattcttttgattcggtggtgtttgaatctcctaaagatgaagatgaagataaagataaagtgtttcacgta

SEQ ID NO: 67742 - DNA, 757 bp, Oryza sativa
ggtacttttgcaattgttaagagtagaaaataaattatcttatctttatgcttttgatttcttccgagtaatacttagcaccttgcgttactcggtccatccaacgagcctccgggtgctaggaatcggcccaaaggcaactatccattggcaaaccaaacggaaagcataggaagatggaactccataactcgataggcacttttgtactcagattatgtcgcgagcaaatcaagataaatattatgaaaattgttgaaaaaatatgacataacgtctatagcccccgactaacaactcaacggagaaccagttgatggagtgaggcagaggaaaaggaaaatatcatatcagaaatataataaaagatgacttagctttgtaatattctccttggtgatggcataagtagccgatgtggggagaaggtcatccatcaatggcaataaaaacacccgccgtggaggcagcctaggcggtcggcggtgaagtcgtagacgcccaacaacggtggcataataggccagccgtacaggcggaaacaccagtcggcggtggcgaaggccaccggtcggtgaagatgtggacgcctatgaacggtggtgtgaccaaccaaccgtataggcgaggacaccagtcggcggcgacggaggcaggccggcggtgaagtcgtagacgcccaacagcggcggcataataggccagccgtgcaagcgaaaacaccagttggcggcggtgaatgccagccggtcggtga

SEQ ID NO: 67743 - DNA, 718 bp, Oryza sativa
agactgatagaagaagagatatatgctaataagaaagataacacacgactgttaacctaggctacaagttataacacatttcttgcaagttataacacagtgattgcttttcaaagtgccctccaaaggaatgtttgaaatcatattctagtttgacttattttctatgaaagaaaagtttgccggtgcaagatagacatcaagaaaatgtggacatgtaagaatttagagacattgtttgagagctagcctgacaccctctgtctagaagaacagagaggcatctacatagtcaatatgctgctgtgccagttcaaacaggcacaagctcactacaaaaaaacggtaggtgtgatatgtctaaaaaacatcactatgtagtctgcttcacccttacatagttatgttagactctacaattagagggcaaaaatacgatgactatttcttttgtctctacaatatccacaatgaagtatcaattgtgaaagaaggaaaaggcattcagaggagaaaagatgtgctcaccgcttctttttcttgggtgtatctgttggtcacttcttgaaaccgcgctaaagcctgcacaccatttaactcgatcaaagctctctccaaattgaaaagaaaactaaatacatatttcatgtgttatgtagaaaaagatgtagtggctgacttttctgtactcagtttcaaattggcgcaaatcatttct

SEQ ID NO: 67744 - DNA, 6980 bp, Oryza sativa
  unsure (1)..(6980): unsure at all n locations
nnnnnnnnnnnnnnnnnnnnnnnnnnnnnnnntacaaaactttttgcctcaatactttctttaaacaaataaaaatatatgagacttaaggtttcatgaaatttatttatatatatggaaaacaatagcaactttatagaactctctccatcccaataaagcgtgcacacattttaagatttaactccctaaatatttaaccaacaataatttactggtaacatgcacatgcttacgctacggcttaacagttattttgacaattaaatatataatgagattggtataagattcacacaaaacggaacaaattattgggtgacttcggaattagacaattcattaaccttcataccaacactttaaccgaaattgagaatgcaaaagcactagtcaaagtgcaatgcagcatataaaaacagatagaagggattaaatctatcatctctttgcctctctttcaatggaaagacaaaatatttaacattttcatgaagcagcaaggaacagtcaaattttccaacaccaagaaattagttgaatttacttgctttgtctgtcgaatctatataattgatcgagaatagacaagtctcacagtctgctataaaaaaggacgtctttgcaaaagttgtttagtaagtacttaagcaggaactacttggccaacaaattatagattttcttaccaagtcaggagaatttcacactcatcaatttatctggaaacaaaatcctatgtgtgccataaccaatactaaagaaaatacatataatatagcactggtattggtgaagccgcaatcatcaagctgagcactatgatgacctacgtttcggtggtggcgacgcagaggagatcggcgaggtgggcgactgccagcgggcattgagcgtgtgaaaaaaaggtgggagagggtgcgaaagacgggagtcacaggaggtagatggtgggagggatctaggaaggctagggcaagcgtcgatctgggcgacctcggtggcagacagtacagggacgcggtgattagtgggtgagggttgtagaggaaggcatgcgaaggaaaatgggccgtgattgatttgctggcgtgtgtgattttcagctggtgaccctgcgtgcatgcgctgttgtcagatctgatgtattggatgattttcggacgttagatttgatgaataaggtccgtaggatatcaatgatgaactatagggtagattataaattaagttttatttgataaaaaaataatattattgatcgatatttgtatttacttttatataattatgatattattgctataaatatcataatatttaaaaataccattaattttaaagtggaagagtatttcataccgcggccgtccacgccacttgatgacacgctgtcgccagcggaagttcccaaaagtgacgaaatttcggcatagcgaaatttcgcagctcgacttggaaaacccaaaacggcaaaaagcacggagaaacaatccatcgacgtggtaatcaatcaaatcgaaagaaaaaaaatataaaagaaaagaaaagcgcacgcccctcaaagcagcagcggcctccccttccttggagcagagaggactagaggagcaccgaatccaaggtcgaggggaagaaaaaaagagaaaattccacgaataaaaattcaaaaaaaggaggaggaaaaaactgaatccccttgcggctcgtgctccttctccccgacctcgaggcaaggcaaacccatccttccccctggcctcccttctccgcttcgccggctcacgccttccctctctcgcgaggcggccggcgagatctgcctgcgccgcgctcccgctcgcgccgtggtcaggtgagccccatctcccggcccgatctcgtgcgggtttcctgccaattcgggggggcagggcgaggtgaccttgtcgtgtggttgttgttgttgttgttgttgttgttagggtttcgtcgcgtgatggcgtcgtcggggaagatggaggggccgtcggcgccggcgatgcggcgggacccgtacgaggtgctctccgtgccaagggactcctccgaccaggagatcaagtccgcctaccgcaagctcgcgctcaagttcgtgctccccctaacctgtccgccctgctcttgctgctgctttcgatcgcgctattcagattgcagaatgtgaacgtgctgctagtttagttgaatgcgttctctgcggcttcattgctcatggtcacaattgtttggatcagctgcagcaatttaccacatcagctgtggtgttcctcagaatcacttgaacttttctcatccagatgcatttaacagcgctgaactttatgcccatgtgtaattgactaatgatgtgccaattgtgtttattgaatggaccactgaacgcataacaaccgcatttttccaatgcaacatgaagaatgatgctcttactttattgtgctgagtagatatgtaacattatttctgaagaaacgatatgtcgcaaacatcattctagatgaaactgaatcaagtgtatttattgttttggattaaatttgggaggaagcattgaatgagagcaaaagtttctttgttgtacttgcattcttttctatagatacattttttgttagatgctattaccacaaacataagagcttactgtcttttccttatttttgtactgtttctgggttaccatagaacattttgtttcttgattggtgcaatactaacaatggaacagaaaagagaacattagagtgacttgtactctaatagtagattatttacgtgggattagaaactgtttggtcataaagggttggattagcatgctctatatgagcaaattccatggcaatgagtttttccttcttttggatatctatactttactaccttttgatgaccacatgattcttctttgggttattagtcctctctattaatgtgtcatctcaaatactgtcaccccattacaccctgttgattactgaattaggtctgtcatgtatttacatgtgtgatgtactgatgtgcttggctgctctatctattcattcctgcatctgcagtcttgatgattttctgtactcatagttcctgatataattgataggtatcaccctgacaagaatgctagtaacccagaagcatcagaactcttcaaagaggttgcatattcatatagtatcttgtcagatcctgagaaacggaggcaatatgatactgctggttttgaggtgctattctcataatctcatgctgactaccagactattttcgaacagttttttttgtgtgtattttgcttttactccaatggttctgcattcttctccttttctgatcaatcaataaggagaagtttggctgggataaatgaccagcaaggtgatttttggtggtgctgcaccgacatgtatcatactgttgctgtgtatttattagaccatgtgataactgatgagatttttggatgcttatttatctccaatcctttcttctgttgcaatgaagattagctaaggcagcttggtatataacgtcgtagactcatagagagagatttaatccctggaatctgtcaaagaagaaatggagattactcatctagcttgatatttattgtcatagatagacaatccctggaaaccacttaagaggtaatggagaacctgtatcctctaaacaatgacaaactattagaagcatttccaccatgtataactattttaattccaaaaccatttgactaagtacctttgtcatggataatatgcttaagatgataattgtaccaagtagccaagggccacagcttatcctttacaaatttgaactcagtggcattttttttgggcacttcaattattttgggcgtgtaggttaagatgtgtttgccaagtttcacatagttggcagaaataatgtaactttgttggtttgtaatctaaccatctgttgtaatatgctttcttaggcattggagaatgaaggaatggatatggaaattgacttatctaatcttggaactgtgaacacaatgtttgctgcacttttcaggtgactgtagcatctgtatgaattgttttctagaaagaatcgaggatcactaattgcctgctaactttcttacatattataccatttagcaagctcggtgttccaatcaagaccacagtatctcctaatgttcttgaagaagctatgagtggaacagttacagtgagacctctcccagttggatcatcagcaacgggaaaggttctgccaataccagttttatggtcttgtttataatgggacggctaccatatatatttttctatttataggttgacaagcaaagtgctcatttttatggtgtaacaataagtgaagaacaagctcagtcaggcattgtagtcagagtcacctcagccgcacaaagtaaatttaaggtatgaggttgattcttccttcaattgctctggaattgaagcttttatgttctgcatctctttgaatttcaggatattatttaattctctcatttgccaaatatttctctatagctgcttttctttgaacaagaaattaatggaggttatggactagctctcaggtactttcgagccttcgcctttatataattgcatgattgatgtgttctgtagtttttctcattatttgtcaatggaatgccatgcggccatggattagtattactttctctgttcataaatacctggcgttttacactcggcatattaaacaacgtgacattttgcattttggtggataatgagggtctctgttgcacccttagcctccatgaataaatcaagcatcttggccaccttaatgaaaagaaaatgcacccttatctttccataaatgaatcaagcatcttgccctaaaaaaggcaagcatcttagccacccatataaaaaccgtttatctatatgagtttttatatgggtggctaagatccttttattttttacagcaagatgtaaatgcctcccttgcaactacaaatacctccctcgaatgaaggagattcacagcgattgtaaatgatttctccatggctgtaatcgtaacatagataaaatgacaccacataattgtaaatgaagtagtccgcagccataaatactatcagaattgtaatatagctccatggcactttttaggggtaaattttgattacactttgagctaaaaggttctaccattacaatcccattagtatttcattataatcaagcaaattctatttacatccatgttcatgagaccttacagtcaatggtacttgtttacgaccacaagaaaaataatgcgtgtacatgtagatccattacattctgtgttatcaacccaaaccaacaacaaaaagaaagaaggccctagtggtgacgcaacggcagtaactgccttgtgttctctaatgggaggttgaggtgataggagaggaggctgcaaggaccagcatgcaaggactctctgtcagggaaggaaggcagtgaaaccaacagtgtgacaaggtttggtggtggtggcttgagcttgtcgagcacagtaggctgccttcatcaccattctggtggataagtgggatgccattgatggatctggttgaaggagttttggatgcggtggcatcgagtgctggaggacaggggtgctgtcgatatatccggctagaggagacaaggccgcctgtagagcgctggaggtttccgctattgtcagatctattccaactcctgaggttgccactgctgggctgggggagcaatggtgtgtcattgtctcattgatggatccatctggtggaggagaggaggtgccatgttgagcgttggaggccactgccatcgtcaccattggtgttgaagtgggagtggttgggatgctgtcagctggagtaggattgagaggcggttgttgaggagggaggaagaggagtgggtagttagggttttggaccgtttgtactctgtttatacctgcttatggtcgaagcagtttattacagccaagattgacccatttactattgtgggctaccacttatgagtaatgcgagtggtaggggtgggagctctccaagagtccatggcgtagactagaagtatataaaaatttatcatttatgtaaaatgtgatatttctggacttctccaattttaattttgataccaattgtgcagtaagtgaccaatgcatgctgtacataactgtctgccaaatggataagagccaatgtttttctagctgtctccaagtttgcatctgtgtctctagttctgccattgacttctttattgcctctaatcacaaaagagtgtcgttttaggatgcacacagtcaacacaaattaattttgaccgtaattattatttggaacgtaagtttttaggcataaggacattatgtagccaagtttgtgacaacaagaacattaatattgtacttgtctaagttcttattttggttcatgcaataaactaagtgatcaaacttatgtcttttgagtgtgaaaagtaaaaaacaactcaccttttgtggctggagggagtagtatgaatggtcaacaatgattttttttttgttaaccagctatgaacatgatcttaatattttacattaatctgcagtttttttcttttttcattttgggtatgttaatgtgctgcatataaaaaaaattagaagcctagcttaataatgcatttggtaaacctgggcaccattacattgtaagttatttctatggcgccatgcttaatcgttgttgaatggcggatagatttgctaaacgtggcttgccacacccagcagcttgccgtctttgtgatcaagacgatgagattatccaacacctgctggtttcttgcatggtcgcccggcaaatatggattgaagtgctcgggtctacatgctatgatacccaaccagattcggttaggttttcgagttag

SEQ ID NO: 67745 - DNA, 7824 bp, Oryza sativa
ataaactacgatgaaaaaaatcccaaaatcaactccaaatttaaggttgaaaattcaaatttggatgataagcataagcataagcgaaaagatgaggccataagtgcttggctccatgctgtgttcaaattctaagtgagttgcatatttgcagctagtacttgattgccaacactgatgtttggttatatgaatattggtacccactcaaactgaaattgcgtataattaagtctgcacagtggatttacatggttggtgcagccatgttcagtgaatgcagcagaaatactgttattaagaattgacttgttaaattattttgtcagttgacatgcagtttcttctgagctttcgtcaattaaatagtgtcctagctgttaatagtttgaagtatactccctccgtcccaaaataagcgcagccatgatttttttgtgtctaactttgatcgtccgtcttatttaattttttttatgattagtatttttcttgttattagattataataaaatatgcatagtacttcacgtgtgacttctggtttttagttttttcaaaagaatttcaaataagacagacgattaaagttgaatacggaaactcatggctgcgcttattttgggacgaagggagtacatagtagtgtagcttacagaaccgtgcgctgtaaaaatttgaaaccaaatggcatcaatttatccttcacaaaaattcatcaaatagttatatctaccaatatgataaagtttgtatcatattcttttctcaggctgaaccctgatgattcttcattacttttgctaataatattggattattgctaaagagttgtaaggtctgcaggttgatgatatgctgagagaaagggatgacatccactcctccttcacgaccgaacgaactatggtgaactctgttggagctggtagcagcagtagtagataccccactgagagtcccgagaatggtaacatagatggtaaagataaatcaagtaaaaagaagtggttcaatttgaatcttaataggtctgacaagaaagcttgagtaatctttcatcaaggatcttccgctgttgtacatttcagaagccctattgtatttgtgcgttgtgagctataacggttaccaattcttgggagttttgtagcattagaagttttggacacagaaagtcatgtattatccttctttaaattccatgttcctgtcttacttttcttccactatctcgtcttcctcttgctcttttacctctgttgccggtcgagaaattgctaaggtaattcgcactggtgttggaagtgggaactcgagtaggttctttattgcaattgttgattatttgtttgttttcggtgctaattatcccatttcagcagttacattgtcagaacgagctccttggcattacccattacttatggacgtattgtagtagccactactttgggccttttaaggtcaaaactttcattaatcagaagaaatattaccgacttgatcgcaggtagcaagaaaatcctggtattttttttgttcatgctaacgatggcagttgcgacccttttttatttatgaggtcatctgctaaattgccatcacgttgatcaaaggacgacatgagctatttcttttgggattagcattccgacaaaaatttggggatgaaatcaccagattttggactcgacacatcatcgtgctgggcatgacctgtaactatgtagccttggtgcttgtaaagtctcgtactttgtttgtcctaaaatatagtatttttgagattagtacggatattaagaaaatatgtggaaatgattgaaagaagattatgattagttgaaaaaaaaagtagttaaagaagaatggttataattggttgtgaggagaaggtaggtggagaaatagcttcattttagaacaagacatcatgctagaaatagctatattttaaaggaaaaattggttatatagcatggagtgtcgccctcttggtgctaccccgcccgtcccccgccccccttcctagcatccaaagtttaccatgttcccatttttagcacttccgttatttttttcgtccgtcttgatcgttattgatccagccacacacatgatatgacatttctacccctcattgacatgcattatacttgtacttgtgaggggtagaaacgtcatatcgtgtgtgtggctggatcaagacggacggaaaatgatcgagaattgacggaagtattaaaaataggaacatggtgaactttgggtgctattaaagtgaaccggtaactttcggtgctataaaaccaaaaacgtgaactttcgatgctatataaccaattttgcctttaaagatcgaggtaatataaagctaagggtctgttcgttcatgcatttaggaatgagtattgagttgcttgcaaaacgataaatctcattagcgtatgatcaattgagtattaagtattataaattttaaaaattattttaaaaatatttgtatagaaattttttagaaattgtacattctggcgatttaagaaacgaattgacggtaaaggagagagttgcataaggaaaatttcatcagtagtgaaaggaaagaaaaaagaaaaagaaagaagaggccagcactgacatgtcggtcccctggtcttcttcagacccaaacccacgcctcccccccatctccgatccgccgcgccggcaaatcccccacaagcccaactcacgccgatccacctccgatggcctccgccccgccggcggcgccggcgccggcgccatcgctggtagacacgctattccagcgctccctcgacgacctcgtcaagtccctccgcgccgacccgtcggccgccggcgagtccgccgccgtcgcgcgcgcgctctccgagatccaccgggagatccgcgcccccgacaccgccaccaaggccgtggcgctccagaagctgacctacctctcgtcgctccacttcgcccccgtcgcctcccacccgctcgccttcccggccatcgagctcatcgcctcgccgcagctaccccacaggcgcctcgcctaccttgccgcctcgctctccctccacccggcctcgctctccctcctcccgctcgccacccatcagctccacaaggacctctccccctccacctccagcgccgcaaccaccacgtcacggccctcgcgctccagctgctcgcctcccccgccgccgccgccgcgcccgacctccccgtccacctcgcgcacgacctcgtgccccacctctcccgcgggagcccccgggcgatcgcggccgccgcgcgtgtcatagccgcctcgccgtccgcggccgtgccggtccttttcaagccactggccgcgtgcctcgcgtcgcctgacccgcgggcgtcggctgctgccgcagctgcattctgtgagctgtcggcgccgccagccgatgctgctcctttcctgccgctggcgcccgacctctacaatctgctcaccacgtcccgctccaactgggcgctcatcaaggtgctcaaggtgtttgcacggctggctcctctggaatcacgcctcgccgcacggattgtcgacccggtgtgccagcttctcgcgcgttctgctgctatgtccctgacgtttgagtgcatccggactgttctaactgccctgccggcacatgatgctgccgtgcgccttgccattgggaaggccaaggagttccttgctgctgaggatgatcccaacctgcggtaccttggcctccttgcgcttggtatgcttggaccggcatatgcatcgacgttgcatgaatgccgtggtgtgattgcccaatcactgggtgatgctgactcaaacatctgccgggaggcgttgcacctcatgatggggttgatcgatgacagcaatgtcacggacattgctggcatgctggtcagtcatgcttcgaagtcagacccagagtttgcaaatgacattcttggcgctgttctttcagcatgtgggcgcaatgtgtatgagctggtatcggactttgattggtatgtctcactcctcacagatatgggtaggaaccttcattgtgcacagggggatgagattggtcggcagcttgttgatgtgggactgagggtgcaggatgcacggccagagcttgttcattcatctcgaactcttctcattgatcctgctttgcttgggaaccacctcctttgtcctgttctttctgctgctgcatgggtctcaggtgagtatgtgaacttcacgaaggatcctgttgagcttgttgaggcacttctgcagccaaggatcagcctcctgccgatgtccgtgagagctgtctacatccaggcagtacttaaagtgatcactttctgttgcaatttgtatgttgagaggttgagtgattcaagcaaggaagtgtctgtagcattgaatgggttatctatggatcaaactgttagtgggggaagtgacgctccaattgggtctagcaatggacaaattacagtccctaggatgatggaaaaggaccctttttcacttaaatcggttgttcacatgattaacttgattgaaacaacagttggcccacttgttgagtgcaatgaggttgaggtcctggaaagggcaagaaacttgattggttttgtttattcgctaagagagattcaagaattgaaggaaagcaagtttgatgatgataagcatagcagggtgaaggagcttgttaagaatatgcaaacagtattatctcacgaaatagggcctgtttctttaaatgcacaagagaaagtatcccttccagatgatcttgtcctgaatgaaaatcttgccgagcttgttgacatcatcagtgaagatgacactactctgtcatcttcaattgttttctaccctcgtagctgtggttcagtcgaaaccagagatgaacctgcattatcacttggttcatcttctcttctttctgagcaccgtaaaaggcacggactgtactatcttccaacaggaaaagcggaggatgggccagttgattatcctcatgccaatgatcctctgctgcctgctagcagcgaaagtgctctggatgataaattgaagactatccagcctgttaccggtgggaaaaaaccgaaggccgtcaagtccagaccaaaagtagtgaagttggatggtgaggatttcctaagttctatggtggctagtgcaagtgttccaaaagaagattctttatctggtgctgtacgtggtgtactgttgggtagagatctcaagccatcatcttcacaaaaggcttcagataaggcttacgaaggaattataaacaaaatggactctggtgaatctagttctcagtggaaaaataatgtagatgctgatttcgtaggccatcccacttcaagttctagaccaagtattcaacagagccatgataaagagagtacaaaccctcttgaaagtgatgggaaggaagcgagaaaacacagaagatctaggagtgggcatcgtcaaggaaaacataagcatagagaaaggcattgcactcaacctgatgtacctcaagctcctataatccaggattttcttctatagttgctgaggactcccttgtttttgatacatttctattgccaagtacatgttaccttttgttcattcacattcagcggtttttagttttcactttcatttcatggaagttatttagttggtttatctgtggcagctggtctaactgccactgttgtatcctgtatatctttcttgagcatagcacttgatgttcttcatagctccatggcaatatatttgttcatagtgtacaaaaccagacttaatgtttttatcttttactacctccgtcccaaaaagagtgctgtccaggtagtgagaaatgcactatttttgggatggtggtagtattaatgtagacttcttttacatccctccttatacctctaagaaattgatgtaaccttgcaaactaattatccctaatactgtaagaccatgggtactttcgctatgcatatccccataggcttacatagttactggaatgtaccagttatacacattcataaatcgttttcatgttcttgcttcacataacataaatccagttatatatgtacaatctagattgaacaatgcaaacatgtcctatagatgctaaataagatgaactgaatttagaagggaaaactcttttcaagatgtactacagtacataccgagggaaaagatccttcagaagtatgctagaccgtgatgatttgaaaagtgatgctagtcgctaggccagacaccatttggtgagagggtgacctagaacagccaggcagccagccaaggatgtcaggcacagtacaagaattggacggatcgcacgtaataaacttggaaaagcgaaaactagtggctttatcagcttggttcaggctctaagggctttcacagtgcggtgatttgtcatctggcctgagcttgccacgtctacgactagatgggatccagtgtcacgttcgcagttgggcccaccaaactgaagcctggtcacccgttcgaatgtttatacttttgtaatttttcatcagatctagtctctactctcgagactatccagactaaataaaatgtttgtagagactatccagactacttaaaatgttttctgtagtgcataaattatggaattgattttattagattctctttgtttctttattcttgatttgatgctactgtaatcttttgtattattcactcttcttttttttaaacatacatgtacttacctttcacaacttgttctgttttgcctaacatgaagtaaatatattattgctccggcggttagaccgataaactggcggttggacgggtgaaccagtggtccgatttgttctttttctttaccacgtgttagggaactagagtaagaaaaaataaactcgcaggatatacacacgagggcaactcttcaatctggacaggatttgtagtaaaacaagattcattttcgtactgcattcgtttattttgagatatatagagtagtcatgtaacaacataatgttacataatgtatgatattgtgcttaggagccccatttatatatacattgagggttaaatgtcattatgctacgcaatgtcagtcttctcaacctaaaaacctatagaaactctttcctttgaaaaccataccttcaagatggaggtacattatttagttattactccctccaggtatgaaaacgtactgttatagtgttatggacatgtttcaagtcaactttacacataaatatatttttaattaccagaaaaagtgcccgtgcgttgcaacatgaagaaaagatgagaaaattgaggagaggttaagaaatatttacattacttaattaagtaaatacaaatttccggaatacttgtatttttttaagctggtaggtgtttaaattaattgaaaagtaagtaagtgtgggaaataaaaatgatatggctggatttaatttttattaaattctccatagttaattacactctcttaaattttcttgaaattttcagagcttaattgttaattttaataatacaaacatcatttcaatatttatttaaataaaaatcctcattacactctgggccattttcagcccatagcctccctcagcccacaaccgagccggcctgctttcatcccttccctccgcctcggcccgcaagcacgcgtccggcccagcaagcaatcgaaagtacaattagcctccccatggttctctcactgttgtgtgggcctatcgctacattgtcgtccccta

SEQ ID NO: 67746 - DNA, 2818 bp, Oryza sativa
tttgagcgaagggagtacctatgttcttttttagataacattaggatattgtcatgactatctttcatgaacatatttgattattaattttttaatcatacttcataaaaattattaaaaacataagagtaaaatacacgaatggttcttaaacttgtgcttaaaatatatttttgtccataaccttgtcatgtgtgtcatatatatatacaaacaaaaagaccgaatgtgtatgatgatcggatctgtttggcggaatttttttaatttttaattttatttattaaaatattttaaaaataatttttggttttaaagttttaaaaatctacacccataacgccttctcaaagggcgttttttatgatatggcacacgcccgttggtgttgtaatggtcgggtgaacatctacgagggtggcaagagttttgcctgtaaatggtcagctccggttgttttgcaagcgccccctttagccctttgggagggcggccaggggttgcctgtaaaatggccgaccgctctccatgtgaccgttagaatgcatcacgtcataaataacgccctttggaagggcattttaaaaaacgacatcctaaaggatgttagggggcgtagatttgtaaaactttgaaacaaaaaattatttttgtaaagatttaataaatctatctactctaatgttataaaaattaaaggtatttttttttgctaaagtttggtacgtcatccatagtccgattcccgtgctcgtccacgcgacttccctgtctgattcacgtctgacattgatgtgatcgcgatagctaattcgcgcgcgcgcgttgacggcgcccgttttaggcccataagggctaaggcccacgcataacctagcgtgcatgcgtgaggcggatggcgtccatgtccgtatgttttttccccggaaaagctaacgtccacgcatttttttcgtttctttttgccatttttttcgtgatctttttattttagaagttgaatctttcatctgtaattttagttgaaggttttgaatttgagttgaaagtttttaagatttaagttgaattttgagatgaaaatttttaaatttgaataaaatgttttgtattttcagatgaaagttttaaatctgagttgatagttttcaatctttagttaaaagtttttaaatccgagttgaaagttttcaaatcttgacttgaatttttttcaaatctaggtttgaaagtttgagttaaagttctatttatgtattatttttttaaaaataataatactaacaattatcattaaaactaattaatgtcattaatgctaatcagcgttattagcacttagcagaggctgagatgggggagtgcgttacgtgattacccactcatgtgtgagatgaaatgacccaccgaacaaaagatggggtgaccgaatgagatggtaaaatatatgctatccatcattaattctttctgcctgcagtgccctaattacaacctggtggcatatatggttaatgagaaatgataaaattttcaaacagacacccccaaataccagccgtgcagtagcgtgcattctagatgacatacgagatagggaatttgctttcaaaccgccttaagcgttaatgttctttttcttctcttgttaaagtgtatccatattgcattgtctcctgtgtatatgtaaggcacctattctccttttaatataaccggcaactctcttgccgtcttctattaaaaaaatcattaattctttcattagccctttggttttattaatatttgaaaaagtcattcatctttcattcaaatgatttcttccatacctgcccaagagttatttttgcagaagcttattctttgtgctgtagttgtatatatatatatgaaatatatatatgaaacgcatttcatccctcgtacaaacatcccgatgaggtatacccctacaccatagttctctatatcgttgtgttccgtcattaatgttgataatattaattaattttaactgttttgctctcacttcaacttcctcaatcccagtgattcagattcagagaatctatcaattgctctacaaactagataactttagctcttcaacccaaaaaatatttcttttcgtagtactgttttcatgtataacattccagaagcatacactgatacacaagctcgatttggagcagttgttttgtttgaggttcgtgtatctatatcttatatagtttttcatcgatacatctatatgtacataagtattttggatttttttccgtctcctcccacgtgatcccacgcaggcagcgcgcctccgatccgcccgggaagaacctacgcgcataacgcgccttcgccccgcccggaccgaaccgtacgccactgcgatcatagatttgcctccacatatgtttcctattgcaaaaatctcactccctcattattttcgccgtaatttccttttctattcagttttaattcatcgaatttaatattttccccgtaattttcttttctattcaactttaattcgtcgaatttaatctctatttcagatggcctaccggtaagcttatccaaccttttatcttgagttttgcgaattctctccgatttgaaaaaaacggaaatagaaatcaagtggataaaaaaccatcaactaattttgggatatcgagagaatctttcgaaggttgaaaacgatagcggcggctatacgagttaggcgcaggcgtgcagcccacaatttgagccagggcttgctttaaaggaaggaatgaatgtccacaatttgagccgcaggctgaag

SEQ ID NO: 67747 - DNA, 9411 bp, Oryza sativa
acaatgtttttgataattgtttttttttcttttgcaatcaaaatttcgatccaaacattggtttgctaaccgtctataataatcgttaactcattgttttctgattctttgggtaacccatacatatttataacattacttcagagtgaacataactagtggataagatttaaacaacgagatatattcacggaatatatcaacttagaaactttttttttctttcgtgatctcaaaagaacagtgagcgtattccttgcacggtaataacttcgattttgtggtaaattaagacctcgattgatctggaggacttctgctctgctcctaatcatacactattttcgtcggcacgcgtaaataatgtacatgcacgagcattttttttttctgatgttagtttaattgcccttatggttttcacctttgtgtactttactctgtcatactgatccgttggcacaattggtggtttctaacagaaattccaaggatgctgaaatatattagttacaacgtaatggtaaacgctgaagacaatctaggaatattgaaagagattgcaatgtaatgataaaagcagaagactaatttgtcctacaagcagaagactaattccaaacaacaaactaactcatcctggcataatccacatttcaatatcgaattatccaaaagggccgccaatccgtcatcttcactgtcgatcaaataaatttaactagtcaatcaattaaataaggaaactagcttaactgggaagctagttaagccctgattgttgttgcatacctgcagaaccttattgtatcaggagataagataattgaccctaactcactccgcaggatcgccaaattaactgccttccctttcctgctcagctggccgggcgctgtaaaatccttcagcaggaaagaactactacaactaaataaacttgaagtctgccgttacctgcctaagctggtcaagtcttgaactcttgattgtatagttgcttatctgcaaactgatatgatttaatcgggagaaaaattaattgatcttactgccaaaattatcttctttccctttaatgttcagctggctaggaggcggctgacattcttcagtaggaacaacaaagacagtactactaatcttcagtaggaatctacgcaggattagtacaaattttgggtcccgctatttaccctgaagtttaaggtagatactcaactatgtgattctcacatacacaactgcaaatggtacacatggcttgctattatctggcttttgctattgtcggatgaaaaactagcaatattccacaatagacctaagaaaaacatgatccagatgaatacttcattgttccccctcgccaggccaatcacaaaagaagcaaaaacaaggatttatcaagtatcaaaagggaaatgctagcaaacagaacctcttcaaaattattaatatggtcacatggatcgaaatgtgtgaatgcgatggtctgtacaaaaaaattatgtggttcctaataaaatagatatcaaatcaactttgccacctactactactaacttgccatctcatgttaagctggtagtttgtactattgcacaaagagctgttatgccaggcgtgccaagacaaagattttgtcaactgaatttcatgccaaagaaagaaagagcaatttatgacccagtatcaaaacaacaataatcacaagtgacatcagaatggcaaaccaaatgtcatgtagaaacatataatgccggaactaagtttttgccatagcatagggaacagactacataacgatgatgttactttcccaacatacagcttcttccataagcatcatattaacttagaatgtcagcaggattttgcatacttgcccaatctattcactatcaaaccaccaaaaggacataattaccatcacaaaaggacactactaattaacctatagagtatagagctaactgatacttaactatggaaccgaagatgacgaggagagactagtggatcatattaccatcagctaggatcgcagctccttcgagcttgtaaattagtccctttctaatcttggccatcttaactgccatctttttcttcctcttcatatcaatccacctcaggttctccaactttttctcaattgcgacaacttggtcgccgtccaacctagggaacaattccatgatagcaggttgtccctccatgagcaccttaatttcctttgcgagcaatggaaactgtttgcacatatcatcgaatgacctctgctcatcactagctaaggacttctcctcgtccctggccaaagacttctcatccctggcgaaagacttctgctcatccctggcaagggagctctgctcatctctggccaaagacttctcctcgtccctggcgaaagacttctgctcatccctggcaagggagctctgctcgtctctggcaaggcacctctgtttgtcgtccccggcatgagcaacagagcgcccccagatctcacaggagagctcatgaagctgaaggtcatgatccttggtaatagcaaggcccgacaagacaacatcgttgtaccgacgcttgagactgcgcaccttatccctcacatcactgtggttgaaggtgcggccctccaggcgctgcacgagttcatggaacaaggggtggcccggctcctgcggcacatttccaccactgcggatttgatcaacaagagcctctaggatcatgatctcgtcattgccattccacttgcgcccgaacccgggcttctgcgcatccacaatcttggccctcttgggatcaggtgggcaaatgctgcctgacaatgcggcaaccctcttgctcttccgctgcggcaacggacccttgccgtcttcctcatccccttgccatggcgccacctcctcctcagcctctgccatcaaatcaccatcttcctcctcttgagcagcagcatgttgcttcgccgatggcttcttccttgcctgcgctgatgccttcttctttgccttccctgcgttgggtggcacctcttgctcagactcggccaagcggccgtccacctcccccacatcttgctgggggcgcgtaggctcagcgggatcgtccggagcagcgaccttgccggagtcgccagctcgcagggccttcttcttcttcttgcggttcttcttcgacttgggaggggactcggggagatcgtcctcctgcgccgcatcatctccttgcggagttggcacctcgttcgacggcgacccggcggcgaggttctctctggagccgtggtcgctcgacggcggcgccgtcaccctcttcttgggcttcatcggcgacttggcggggccgtccggcgccgcggcattgccagagccgaagccggagccgctccgcggcagcgcggagtcccccttgggcggggcggcgacctcgtccttgccgggatcgccgccctcctcccccgattcggcagcgcgcgtcggcggtcgagggggctgggccgcagcaggaggcggcgacctccgccgcattgtcgatctgcggagagtcgcctccggagggggaagagctggaagggagaggcaacgagggcgatcgggcgacgcgcacccgcttgggcgccatgggtggatggatggatgctgctgcttggggatgagatcgaagtggaaggatcgatcaggatttgtggggttttgcagggtttctttcaggggggactcgtatagccagcgaacgcctcctcgggtccatggctcgccgagtggtggtggtggagaaacgaagcgccgagaaactcaacagggacggaggagggagtacgatgcagcagggcgggtttggccgtatttaccgaaatactccctccgtatataaaaaaaaacaaagacaaactcctgatttccgtgtctaacgtttgaccgtccgtcttatttaaaaaaaatatataaaaacaattaaaaagacaagtcacgcataaaatattaatcatgttttatcatctaacaacaatgaaaatacgaattataaaaaaatttcttataagacggacagttaaagttggacacgaaaacctagggtttgtctttttttttgagacggagggagtaagtttggttacctgcacgatgcctgactcgtattacgggtgtaggcaatgttagagatatactcctatttccttgtttgtgttaatctccaattgatgaatctttcatattctatcgttgtttctataaatcggttgaggataaatgaaatgttattttttgagggagcatatatatggaatgttatagcggtatatataaaaaaaagaattatcgtgtccaattctcttattctaacatggtattagttgttttcgcttccgtcaccaaaccctaaaactctacctctctctcccatgctcactgttggtgccgccatgatgcccacaccttctgagcctttgtctccacgatccttcgcccttgccgacaccgtgctcaatgcccaccacccgcatggtgcttcgggcgatcccaccctcatcgcctccgtggtgaccaccacgtctaccaccgctcgcaaggccatcactgccctcctcgccaagcacgccacaattgatgcgtcctcctcctccaagtcgtcatcgttcgcggcagacgccactccgtcggagctcgccacttcgttggcccaggcgcttgcaccactggcgagccacctctacctcccagcatcgacatctcacatggtgcgttcaacgcccccgacgccaccagcaccggcacgccccacgccggtcctaccgcgtccgccgatgcccatggtgctactgccgacttcctcagcgtcctcaacgtcgccttccacagcgcgtctagcatgccccacgccgcccccacgggcgccagccgcggcgtcaccggcctacctcccgcccaaccgcgtctctacacgctcaagccatcgccatcctgaacatcaaggcattggtccccgtcaccctcgacatccatgccagcaactataatcgttagtgcggtctcctcttcgccacgctcggcaggtactccctcgccgacatcttccgccctgaccgaccagattggatgcgcatagactgtgtcatccttacatggctctacaacgatcttcggcgatctcctcgagtccgttatgtaagtcaccacaatggctcgcctcatttggtgcggcctcgagcagcaattccttggcaattgcgagcactgtgccatcaacctccaagtggagttccacaacttccaccaaggcgacctcttcgtcacggactactgccacaagctcaagaccatggccgacaaccacggtgatgtgggcgaatgttgacagttgttaagtgcaaactttaaccgtcaacttatgtataaaagatatcaaatatattatcaaaacttaatggtgggagtttactactaaccgtttccaccagttttggtaaatatatgtatgcaggttaattaaggagaaaatacaccataggggcccacttgactgttgaaaccgacttaagatgggaccaaactgtctttaaccaccataggagcccattgtcaacctcccaaccaagagagaggctaggaggtggggcccgcagttcggccgaacaggggattcggttgaaccgccatagtggtgccccatcctggccttccacgtgtaggtcccagatgccttcccaatgacagttattcccggttttcggcctggatgactgccacaagccacaaccgcaatatggaggctctataaggaggaggcttcacatacttcaacacttacaactttggtgggaaatcaaactctaaccattggatagaaaacctgttaccattccaatagtgtcaatttggagctctgtttatttttcttcttagcaaatttattgcttaatacaagcatcataattgcttaagctcatatatagctcctctactcatggctttggctttgaactttgtgcttaaggttatttaaggcttagaaagaaaaaaataaatttacaaatgtcagtgatactatacacaattgaacaagttaaggagaatctagcatagctctatgatgacaactaccaagaaggggacatatctggtgaaaacccgtgaaaatcaaacctaaaagttttgcaaattcatgtaaaaattactagagacaggtataggtatgaaatacattctcaccaatttcaaattcaaactcaactttattatggagcaaaaaaagataaattttgagcgaatagtaacaagactttattcacctgaaatttgtcatttatgtttctctcgtatgaagttatgtttggacttaagatttggtatgaatgtatttcaagcctatctcatgtaatttttttttgtaaatttacaaattttttagatatggtttcaagggttttcacttatttgatgattttcaatggatatttcccctaccatgaatttctatatattattctaattacacaactaattaagaggttcacttcttaatcactaccttgtgttcgtgggagtcgtaccagaaattgagcccatttggttggcttgatagtttccaatagttgtttctactagtttctaagcctagctatgtcttgcatgcatatacaatatacatattgtcttgtggacaaagaaagctagctaggaggcaggaaaaggaaggaaacaagctacacacatgagctaccttttgtacatgtaccaaacagatctcccagggttttggttaaactcaaggttatgtgctcaagaaaagaaaaaaagaaacagcattcatagctagttcaaacttggcgcgaactgatgacatggggttggctggacagcaccgatgtctagaagaggatatttgtttaatttgtttgtgcataatttttgttagttacagaccggtaggtgtatatatatatatgtatgtgtggatggatggatggatgcaagcaagccattttgacagaattgttgtggaaaaaacattcaccggtggagatctgattctggaacatcagaaaggcattatgcccagtgtttagagtttagacctggtaattcgtttgagctgatttttatattttttcccctatacaaacattagtattgtaccgtgctttgctttgcaatctcaaaactcaaatatataggtatatgcaactattctgagttaaaaaataactataatctactctaaattaggtcaaaaggtattagtttgtgactagattatagtgactgcaaacacacgcatggcctaggggctgttcaaattaatgttatttttaaccataccatttttaaaaatatttacgtttagtttgttatcaaatctggtaaacacataagaaatcctactaaaattttagtaagatggaattttgacaatgccaaaatttgataaggtttattttagctacaatataagcagacccctaaaatttatgatgccatggtggtgcatatttctggacgtaatacaagaatgcgtggaaatcaaagttgatgaaaaaccattgttgtggaagacgaaatatgctttcagacgaaaagggtatcgttcactgataatcagaatacaagattaataagaactatgtggaaatttgatgttggcaaatatgacgttggcaagtacgtaatttggacatttaaatggctacaactatataatttgaatatattaatgttatcttttaattgaatggttataattaacatcaacttaaaatatagtttctaacggtcattcatacagcaaacaatggcatgtttggttatattcaataagtaaaacataacagaatataagaaatactaaacaaagtcccaaaaacaactttggatagtcatcaaatacacatgccacgaacaattaaacggaagatggtgaattaatcgctaaaataattttttaatgttcatgaaaaataaatgtcgaccgtatcacgataacaaactgtttcattaagtgtttgaatctcctaaatataaagataaaaataaagattaaatgtttcacgcaaaacaaaatagtaataacatgtgattaattgagatttaattattacaaacttgaaaaaggattaatatgatattttagaacaactttcatatagaaagtttttgcatgaaacgtaccgtttagcagtttgaaaagcgtgccacgagtatccaaaagtttattaacttttattggagaaaagaaccggacacatccgtttaatcggtcggtacgactgttttccgcaacctgccaaaaatctgtgctattcttcctaagattcgcatggactcacacaactagctactcaattaattttaacagctgcagctagaggcgacaactgagggccctggcaggattcggtagaagactgccaaagagaaatcagtgactcaagaaatgagagattgaagcagaggtaagccaggccagttagtgtgaagtgagataaactaatccaatcatccctttaagataaaaaagaacacgcgatttctcattgttcggggattattgttgggaaatgattatcagcggtttttaacctctctttctcacagcatgaacaaaacaacttaatagagcggaaaacccatacacatatctacattcctttcaaagactaattatgatggtgaatctaccatcacccgccacagatatagtatcatcgtccttcatccactttcacgctgaccaatcaattgccacacctagcgcgctcttccactcaggtccgatgccctgatccgtgcagcttggaagacccaccgtgatggtggggactggggatgtgccattgctggctactccatcaccatgggaaaatccacccatcaccctgggcagatttgccatcgaggctgcgccagagagcttgttgatgtgctaccctgatctacaccacgctgccacaatgtgcacctatgctgccttgatccacgccacttggaggtcgaccggcctacggtgccctgattcacactacctagagctctgttggcccctatcacgctgaactagggaggaggggagctcgagaccaccgccgtgaatgtctctgagtgcgagcgcccaccccacacgactagctagagtagcttctcttgctcgttcttggtgcagcgtgatgggaaaaggagaagtgaccgagatagagagagaaaagaggaggggtgggattttatatcagtttctgatttcgagagtgtataaagtaaaatgttggacttatatatatctgaattgcaaaaaaaatctaataatttaaatacgaaatgtaaaaggttgacaagggttgtaacacaaaaattcattggagagtggcttgcattgtagacctagtatcttcacagtagtttc

SEQ ID NO: 67748 - DNA, 1497 bp, Oryza sativa
agggcggcggaggacaacgagtgggcgggagggggaggaggaggggagggcggtgccgcggtggagaggagtcgaaacttctctctcgcgcgtggataaggccggaggagaagatgcgcggataaggaagagaagcagggacctacgcgcggataagtccggagatgaggccggctcggctcgcccagttcggctcggtttggtatgggtgccggttttttaattaaccggcacctataatatattattggtgtcggttttttaattaaccggcacctattatatattattggtgtcggttctttttaaaaaccggtacctatagtattggtgccggtttttcctaatgaaccggcacctataatccttaaaggtgtcggtcgtatattttttcaacgtgcggatgtgggaaaagtctcataggtgccggttataaatgaaccggcacctataaggccggtccctataagggtttttgtagtagtgggatgagaatctaaagttgaatctctcaacttctggttttagttcactttctagattctataactaaaattcttagaatccatatgaaaatatgtacttggggacttgcacattctagaagaatgggaaactattctaaactctcgcgaagggatgtccactcgttgtttgcatgtcactcaaatggttatgaaaaaaaaaattgagaagatgtattaacatgtgatatatcactccacaatatgtacctttcaaattcaacttctacatctcgcaaaaaaaaacaaattgaactacagctagtaaacttatatccgcggtcaaatttgtttttttttgttgtgatatgtagaagttttaacttgcatgtttatggagtgctatatcacatgttacatcatctcaatattcttttaatttttttcataatcatttgaatgatatgcaaacaacgtgggacatccccttgagagtttaaaatgtactctcggaagaatatttcttaagtcaaatctattaatatgattatttagttaagaacgagataaaatgtcgtaaatatattatgattaattttgatgagtaatacaaatttagaaatgtctattttgagaaacacacatgggtcttccggctagctccacaaggtggtgggctagacgacctgggttcgaagcctcaccccttctaattatttaatactttaggttcacaaggtagtattagattcttcccctaatattcacgtcttttcgaaatgtctactttagaatactctgtcagggttaataacacttatcgttttggtgaaaactatatcaaactttataaactttggttattaataacatttaaaatatttatgagaccatatgtatagattagttttaagaagtaattcaataaaatcatatatttattaatatatatatatatatatatatatatatatatatatatatatatatatatatatatatatatatatatatatatatatatatatatata

SEQ ID NO: 67749 - DNA, 2594 bp, Oryza sativa
cggcatgactcggccggtggccgggagtagtaactttatttggtgcaccgcggccgacttaacatgtaactattctcgtgtgtatccccttcattttcttcccatttttttagggcaaaccctgttattttcgttgtttgcacatctcgcaaaaatgcaagagctcgagatatatacagtacatgcttgatcaatcatcaagctaatatacctatgtatactcacacagttgcccccactgcatttggtgtaattatcgctaatttataattctctcttatcaagtcacaccatcttatgccttattcgatttagagcagattgaagaggattgaggggaaatatttccacaccaaaatatgtgtggaataaatcccctccaatccctcccacatggggactaaccgaacaaagccttaattatttgttagtcattcgatgatcaatgtaagacgtggattatttacctctcttcaccatcgtcaatattagtaggggtgaaaacaggtcgagtttggttggatcttacccttcctgtatcctaacccgtattttataattgaaattgggtcaatcacggatagtgctgaatatagatataaactcggataatatcggtcacaaatataggacgaatatatgccaaaacagatacgtacactataagttaaaaaacaactagttaacgtatatggtcaaaattgtttttttttcgttgtgagatgtagaagttaaatttaaacttgcatgtttgcggagtaatatatcatatgttaatatattttctcaaatttttttcataaccatttaagtgatatacagacaatgaggggatatcccctcgaaggataaaaatctactcccactattgttgtctgtatttgctcacaagctaaacgtgctagctcgagttaacaaacaatctaacaagaatagattaacccaagcaaacacaaattactagagggatggagaagaagtactgcagagggacagtgacactacagcgtcacaccgatcaacacacgacggcgagaaacaagcgactgaggtcaagctgaaatactggcgacgtttcatcggaagtggattttctaactcgagtgacaatccttatttgtacatgtcgttaaaaaaattattaagatagatcaatatatgatatattttttcacaaacatgtgagttaaaattcttctgatacaatttgaaacaaaaataataaatttgaccgtgaattacacgtttttatagtcaaatttgttatttttgtttctacttatataagttgaatttgaatttgcatgtttgtgaagtgacatatcacatattgatctatcctactaaattttttcaaattttttatgattttttaagtgacatgcaaaataaggggatatttccttaaaggatgaattgggtttcccgttatctgtaaatccaattttctttcctacgtagttccgaggacaataatagagccatcgatattactccctccgtttcaatgtaagtcattctaccattttctacatttatatggatgataatgaatctagatatatatctatctaaattcattaagatcgatatgaatgtgaaaaatactagaatgacttatattatgaaataggggaagtattagagagtcatacacaaattatgtggcggcaatctgtgtatgactatgactacagcttaatcctatatacatatacaagtcatccccactaagtgcaattaaaactaatttcctgttttgagagtaagccacgtcaccttgattcattccagccatcggattgctcataaacgtttggatagcaatcaatcaatcaactggagatagcaatcaaaataaacatttagcaatgactaattaaagaggcccacctagccatctcttaattttgaaacatacagttggaataccaacagcaacgcatgtagtaccccagcagttataagctctttaatcttccattgaagttattttatctcctgtaaccggtgaatcagatgaacagttatgcctttatatactctctcattcactaggactttgttcctgatcgatcatctgcgcttgacagtctttccatgcatccagttgatttatttgcccactcctctgctcatgctgatgcttcaacagatcaacatgcacaatccgctttggtcatctctctcttgcttgcttgctcatggatttatttttctttttcttactaatatcacttcttgtttagttgtagaatctgaagagaagaaaagaagtagcagtttcaaatatttcttattttctgttctttgtgaaggttgcagatcttatagagagaattgaagggttggtgcattactatattcacataccggttgaaataaataagaacattttttttgtttcagttggttaaaataaataagaatacttttttgtttcagtaggttattgacatcttcgactgaacttttgaaagtttctacttcattaaaactatagtttggaataagcaattacatagcatctttgtgtaatcaccatgacgtatattgtctaccatttttctttcttgcaacatagcatagaacaa

SEQ ID NO: 67750 - DNA, 13261 bp, Oryza sativa
agttagagttcgtttagtgctcatatatgcgtggtggacgaaaccgagatctcgagtcagtctcagtcgtcgtggtcataatcaatcatgcgtattcaggagaaaataaaaaagaaaaaaaaggaccagctgatggactgccgctaccctctctttagtcccggttgataacaccaaccgggactaaagatctttagtcctggattggtagtcccggttttatctcggtttgaaaaccaggactacagagggttatgaaccgggactaaaaagcacttctccaccagttataagtgccgtgctacttacgtgtcagggtctcagggacgactaatatggcgacgtcgatggagctggcgcccggcgacgcgcggttcgcgaagctggcaaaagagctcgacgacaaggcgccgcccaaggccgcggccgcgccaccggcagcatcagaagaccaagcagcagcgagctccgggaagcccaagtacaagcacgacttctacaacggcgcgagcgaggtggtggtgacggtgttcgccaagagcgtggcggcggagcacgtgtccgtggacttcggcgagcagatgctgagcgtctccgtcgaggtccccggcgaggcgccgtaccacctccagccacggctgtcgggcgcaaggtcgtcccggccaagtgccgctacagcatcctcccatcgaagatcgaggtgcgtctcgccaaggcggatgagcaagtgacatggacgtcgctggagtacacgagcaaggccaacaacaagctcgcggcgacggcgacgacaacgacgaggaagaaggtagactgggacaagctggaagccgaggtgaagaaggaggaggaggaggaggaggtggacacggcgacgccggtggtgaacaggttcttccagcagatgtacggcaacggcgacgaggacatgcggcgagccatcatgaagtcctacgtggagtcctacgtgctgtccacggactggaaggacgtcggctctaagaagattgaggccagcgcgccggaaggcatggagctgccaagtgggagtattgatagtgttattattatatatatagtcgggctaattaggaatggatattgtccgtgagttgcaatgagattttattttaaaaatatttttaatccagtattagcattattttctatatacatcatatatactgtttcttacttatatgtggatgttctaaactctgcggggtaatttttaccttttcatataaagtagggagttgatagtgggggtggttgacatatagaccctctgaccctacatgtcttttcttttctaaaaagtagggagttagtggtgtcttttcttttctaaaaagtagggagttagtggtggaaatggtgacagattcacttttcttttctaaaaagtagggagttggtggtagaagtggtgacagattcacctatcactaattcaccaccatcattactctcttttataggtattataggtatataattcttgttatttgtaaccttatataatttttgttatttgtaaccttttctgtcagtatccttaaaaatgtggtactgtcttattaaggtatcattatacacatagtagtacatgttctttgttgggcgtgttactaatgtgctacaagtttaataaactcagttggaacttttattatgtgtaagttagcgattacggtggcagagtcgtgccagctactcgtggtagatggcaaagctcctgcctgcatgcctgaatggaccagaccaaatcatttaacatattgttaagtataattcaaggcgataatacatattgataagtgaaaatattgagtttgttctggtccattgcaaaacttaggttaaaaagtgaccctaagtgaaatttattttaaaattattgagcggataaattggatattttagaaaatatacttagctgatagcttaaaataagtgttctaagtaatgtaatgtagtgggaaaaaagggaaactatttatgatccctcgatgagatatctcctcgtttacttaaaatccatccaacagttatgaaaaattcttaaaagaaaaattgacaacactcatacaacatatacaactccacaagatcttaggtccaaactcaactcacatattgagatataaaaaagacaaattcagcatatgaatagcaacgtactgtttacatatgaatctatctttttgtttttcaatgtgtagggcgagtttgaacttaatttttggtggaccagtagataatacgatactcttcaatgtcatttttagaatttttcacaaccatttgtatcgaatatggaaggaaaaggtacatgaggggacatccccacaggagattagaatccactcctgggaaaatggatttttgagacaacattttctttaaaaaaaacataaagcacatagtttcgataattcgatgaataatctaaaaataacaagggctaaaaaattgctctcccccctccccaagataatatttttttttcgaggggacaaacagggagctcctgcaatttcactatagaagaagagagttgattcagtttgtaaggaaaaccggacctaaaaatcttacaacggcacggtttattaaaggaaaaccggcaaaaacctcgacattgacaaactgaacctaagtacaaccgtccaacaagaggaaagctcctaaaacgaagccttcaagaaggttacgccgacagaacagcgacatcatccgatcctaatgaatctaggttttcacccggagaaatctcttgaagtggagttgaatgagggctccagtagcaacgccttcaagaaggtgaacggcgcccaagggcgtcgccgttgctagcaccgagagcggagcaaggctttcgccttggagcacccatcaaccatagcatctacgacgggagccaccaaatgttacctgcacaccgagggtacctgcaatattcccatccccacccgaggacgcgccggatctgggcaagagagccagatccggccgttctcctcaccaccaatgccagccgacgccaaaggagtgccggagaacgccagtggcagccgcgggatgcctgcgtgcgctgcccaccgccggccgccacgccgccgccggatctgtggcctccaccaccgccgctccatcgccatcgccattcccgccggccatcacccacaactccacccagcgcaactcacctcgaccgcctccatcacccgtccccaccgccaccgtccttgcggccgcgcggctttgccggcggtgtggagattgtgggtacccaatacccacacggcatggttatccgactagttataggggataacttatatctatagaatatgtaacagatcatgacttgggtattatgtttccttgtatattacggaacggcctaaagtcctggtttgataatattgtaaagtagatttaggaaaccgataccgtattggttaaggtttctatcttgtaattctgccccccaccctatataaggtgggcatgaggccctctagggggcatgagcacatatgatcgtcagatctatactacacccggcagattcaaatccccaaacaggagtagggtattacctctcatcgagagggcctgaacctgtctaaatcctttgtctccgcatccatccacttttaggtctcgtgtgctaccccgttttattattgccaaattcatgtttcgacatttggcgcattaggtaggggtgcgtcgagtttcccgtcgaaaagtgtgatggaatcaacttgatgagtagctcgcttcgtcttcgctttgggagctttttgcttcctcgctgccgacgactacaacaaactctcgctctttgacttggattcaaaccagtcgggagagattcaatctagctaaggaggagatgcaacttccgtatcatcttcatcaacagcatcacgcctcgccaccgatcgatctccctccgatcataggaggccacatccacatctcccgccagcatcatccacaatgacagcaggccaagctgcagacggtggtcggccttgtcgccatcctctacggcacggacgcctgaccttgccgatctccccgatgcccatgcgcacgtgacccgcgcatgacgcccaagcgcgagcgtcgcctctgtgccatgcatggcttatggctgggagatccaatccttacactatagaccatggcaacatggccgaccaatgaggtgaagacacatcatcgccaggctataggaccatacaacaccttgcaacaggatcttggctaggagtgctttgcacgccttaattttttcatctacacatatacatatgctttaatctatgattgcttataagattgatttctccttttttgcatgtacactcggggaacggcgccgcacgcccgggggcttcatcctttgcgtggctgacgcggcccgactacccccgtggcacatgcgtccaaggcatcacgtcgcatgcccgggggcttcaccaaccggcttgctttcaccgccaccgactggtgttttcgcctatatggttggcggacttcgccgccgctgttgggcgtctacgacttcaccgccggtctgcctccgtcgccgccgactggtgtcctcgcctatatggttggttggtcacaccaccgttcatgggcgccatatcttcaccgaccagctggcctttagcgccgccaactggtgttttcgcttgcacggctggcctattatgccgacactgttgggcgtctacgacttcaccgccagcctgcctctgtcgccgccgactggtgtcctcgcctatacggttggttggtcacaccaccgttcatgggcgtccacatcttcaccgaccgactggccttcaccgccgccaactggtgttttcgcttgcacggctggtctattatgccgctgctgttgggcgtctacgatttcaccgcggcctgcctccgtcgccgccgactggtgtcctcgcctatacggttggttggtcacaccaccgttcatgggcgtccacatcttcaccgaccggctggccttcaccgccgccaactggtgttttcgcttgcacggctggcctattatgccgccgctgttgggcgtctacgacttcaccgccgaccgcgtagactgcctccaagacggtcgttggttgccatattcaatcatgcaaaaggtaactgtctgttgtaaacatcttaaggttttgctagttatctagctcgcgtctgctcgtataacatatatgatatgatattttccttttcctctgcctcactccatcaactggttctccgttgagttgttagtcgggggctatagacgttatgtcatattttttcaacaattttcataatatttatcttgatttgctcgcgacataatctgagtacaaaagtgcctatcgagttatggagttccatcttcctatgctttccgtttggtttgccaatggatagttgcctttgggccgattcctagcacccggaggctcgttggatggaccgagtaacgcaaggtgctaagtattactcggaagaaatcaaaagcataaagataagataatttattttctactcttaacaattgcaaaagtacccgagtagtaaattccaattcgtgaaacttcgttccattaatgacaaactcatgtcactcatatgcatgtttgggaagtgcctaggccgactcccgatgcttgggggctatgactagtcggacagagtgtttaaacgtaaggagtcatccgctcggggaaatcaaaatgcaaaagaagaaatacatatttataaatattttaaaatacttgaattttcctcgagtattatatttacatcagatactactcatcctatatatttgttctgcaggatccagatccagatatgcataaaagggattcatggctttaagcttatctcttacgctccaggaatggatcagtcagaacatcaccaccggcttgccgtcgtcgccgccgactggtgtcttcgcctatatagttggttgatcacaccatcgttgttatgtgtctacatcttcaccgccggcttgccttcgtcgccgccaactggtgtcttcgcctatacggttggttggtcacaccaccattgttaggcgtctacatcttcaccgccggcttgccttcgccgccactgactcgtgtcatcgcctgcacggctggcctattatgccgccgttgttgggtgtctacatcttcaccgccggcttgccttcgtcgccaccgactggtgtcttcgcctatacggttggttggtcacaccaccgttgttaggcgtctacatctttactgccggtttgccttcgccgccgccgactggtgtcaccgcctgcacggctggcctattatgccgctgttgttgggtgtctatgtcttcaccaaccggccgccttgtccgccgccgactagtgtctccgtctgcacggctggcctattatgccgccgttgtcggacgtctacatcttcaccgaccggccgcttcatatgacgccaattgatgctatcgtcttcacggctggccacgttgccgccaccacaaataggcgtcatcaccttcaactcaagttgtctatgtctgcagccgactggtttcttcacttccttgaatgcatgattctgccactagttattggccttattgtcttcaccgccggtcgtctcgtctgctgttgactgctgtgcaactttgtcaccatggtggagctacttcatatttattattttcgacatcggcaaactctatagcctatactttgcatgatttgccacttcaccaaccacgatgtctacaagagcgagcatctcggcatgtgtcacgaaatattatgccgtgttattttactacaacaagtggtgttccaatctccaatatttctactcggacatcttcaacacgtatcttcactcaagcaatgactattcgacgacaagaagctacagttctcgactctatgttcagttgtttctcaactaaccaaagagtcgggagctacacaaatacaagactctcaaaattcgacaagccttatgtcaagatgaagcaatcaatcaatcaacgaatcaattcggggagttattatcttcgtcttcgcttcagagccgacatttaatttcagcgactccaattattacatcggcaattttggcttcttcatgccgccacaatctactccaaatttcttaagtttgagatttaatttacatgtctgggagtttggagtcatcaaccaatcaactcagatcagatccaatgagttgaacaacagtttctactttcattcaagtgaagcatctacattagctataacactaagttttgcagtcatcttcgtaaatcaagaagctttgcatcagtcttctttatgcacacactcgaatcaaggaaactactcgagttttgatatcttctcaacaatttgatggattattgtcactgacatcatcaccagcacctctacttcatcggccctgacatctctaccgttgctaatggatgactacgttttcacctccggctgcttctgtcattgccgactagttatttcgccttcatggttgacctactatgcaaatgctgatgagtgtcttcgtcattatcattggttgctacactgctattgactggatcaccgacatcgtcatcttcatcatgtcggttgcgtttgtcgtcgtcgactatttttcttcatcttcatgattggtggatttcgtcatcgcctttgatctgcctcgtctgtcactgactgattatttcgctgccatggctacacaactttatcgctaggcgccttcatcttcattgatggctgacctgactgctgccgactggtttcttcgcctccacggctatgcaacttcatcacttttgattggtatcactatcttcactaccaccaatatttttgccacctctgctgggcaatattatctctatattggtcgtcttgtctctatgccaactgcgtcagctaccatcaatgaacaattgtgactacgtgcttagggcttactagctcaaacacaagtatcataccttcaatttggacttgctccgaatacatgcaacatgaattcatgatcatgggtctattttctatgctcaaagactggactatttattattccccataagggttatcaaccgaatacttgcgccagtcgggattcaattattatatctattttggagtatcccataagggataatcactcagatcagaaactattgatatgagctacacttggtctatatcacccggaagatgtattactcgggagcatgttatatgcgtcatcctttaaagggtgtcgaaggcatattttttggcctaggcctaatatgtctgcagcccatattttcaggtgtggcctgtcacgttcttttagggacttaggcatttttgttaggccaaagtgcgcgtgatcaaagtgtcctaataccttaaaatcattttataccgcagttactcaactttttaggagttagtacaatgcatcttaaaaggtgtcaaacagtaaagctttatatagctgcctcgctgacttttttatatagtcaaggcactgtttgggtttatcaagcaattgattggatacaatatcgttgctttttgccacgtaagtgtgcatttttattgactaatattatggcttaggctgattatacattgtggtcattttccaggcggttggtaaatcatttatgagtttatttactcagattttacaccacatatgccatatatttccaggtatggtgaaaccatgtgttttttagggacttaagcacatctgttaaagcagtgtgcgcatggcgtatgcccaatactttggaaatttctttattcgcagcattcaagcttctttatagctgttttgctatgtgaatttttaatgatgtaggcaactttaggttgtactcatcatagtttacaaagcagtcggtatatcacttggatcatgttattcggggattcacatcgcatatgctatatattgatatcaagtcatttggtttattacaattatcaaaaccactcagttagttagattatttattccttgactatatgcttggtttgttcaactaatcacatggtcggaggctacacctattaggtgcatatactcgatgcacctaaatttacattcaattatttttcagccctccacagtcttcatatttggtaaaagtactcgggagaccatggcaaagatgattgaagcacttggctttggagtaatctggttcgagagaagattatcttttcgtctgttaaggtcttaggggctactgtggagattatgggtacccatacccacacgtaggattgcaagtgggacgggttgcgggccgtcccgccccgccccacaaccatgccatgtgggccacacggcatggttatccgactagttatagggaataagttatatctatggaatatgtaacagatcatgacttgggtattacgtttccttgtatattacggaacggcctaaagtcctggtttgataatattgtaaagtagatttaggaaaccgataccgtatttggttaaggtttctatcttataatcctgccccccaccctatataaggtgggcaggaggccctctagggggtatgagcacatatgatcatcagatctatactacacccggcggatttaaatccccaaacaggagtagggtattatctcccatcgagagggcctgaacctgtctaaatactttgtctccgcatccatccacttttaggtctcgtgtgctaccccgttttattattgccgaattcatgtttcgacaggcggaagccgtgtggccgctcaagtgacggcgaggcagagagggaaggtgggggagagggtcggctaggtcgtcgcctcccgagccgcgggagagcgacgcgagagatatctatgacccaagataatattgaccttgcgcatctgcaacagcaaaggaggggtgctgtccagcaacgacgctgatcaacttgcacaagacgatagatgactagcgaagaggcgattgacagttaattccgccgcatcaacaacaattcattagttgattggctactcgaaactcttgtgctagacagcgccaccagtggcgtaacaatatctcgcatggtttcgcctttcacaagacctttttttttgcttggccttcacaagttaatcaggttaggatcactggcatatccttcggcaatggattatcgtgtaaaaaagaagagcaggagaaaaaaagaagagaacgcaagaataggatattccattagcaataaaggcaccgataagttacaaataaagaataatcggactatcatactcaactcgcgagaggcaagctgcagttagttcatgcacctacaagagaaaaatggagacatactctattcactcgcttcacattttcctttccccaatactacttacaacacggcggctagttcctcacataataaattaaaatgcaacctaaaattatccgaatcgcctaaaatcgagagagagaaaaattgtaacacaaagagcgctcacaattgaaaaagaaggtgagtttgcgggagctacaatggtggctgattgcaagtgatatcatagaaccttgacgccacttggtcgtttaccttccatggcatccttcttgtcgcggcaatcggaacaaaggaaagggccttcccatggcttagaggagctggaagagaagattgaaccagcatggactgatataccttcacttggttcaaggtccacctggcagatggcacatgtaaacaagcttgatgatgttctccgaccacttgagtcattgcctaacctgcgtagtaaaaagcatatgaaatcagaaaatatattctaaagtgcacgtcttatggacagaaagcataagatctctgcaaagaaagatagtgaacgaatattagaaataaaaattgcaaacaacccgagctgaagagaaatttgtacatcacattacaaaaaacatatggttgcattattcttatgtgtagcacagtatagtaccaagctaacagtcaaaatagtcagcaagaagggtggtaaatcagcagttacatggacttttgccaacatatagactaagcataagctgatctatatatataaagcagcaagcaaacaagctcaaaagagcttgttcaagttattcatgcagattagggaaatcaaccaagacgaacagctgattcaatcaaaacgaacaagttaaaatgctaaagcattataatctttatgtgcatgacattactaaccactcccaaaacattggatttgtctcacacaaggcttgtacaaaccaacttgtggtcctttcaattaaaggatgaatgaagagggtattcctctaagctgtacaaaataaattgtgatctaagtgctcaaacagaataatgtacacccccccaccacccccacaaaaaaaatgtagcttatctatttccaattctccatgttcctcatctcattcccacgttgaaaggaagactctaagcattttggcaacttggtggaccagccaacagggttcctccaatcctcccttatatacgagaatacgaaggggacaaaggaatggttgattgtgtacacatacaaagaattgttttaatagtggactgagagcaccatgttagcaagacaactcagtataagttcagcttggtggctatctcaatggtgaaaactagtttacccttgtatacctatttgagaatagaacaagctgaccgctttatcagggggtgggccctgcattattcaagggtattcagatgtatacccaagatttttagcaaaaaactaacatatatctatgtatttggtatatgtgttaaaaaatagaaaaaagacctcaatcagcccatagaacaaacaagccacgttactaggccgtgtccctcctcccctatcttttggcccattcgctagcctaggcccaacttttcccccactcccaaacagccaaacaggccggccaggcccacccaccaccaaggcacccacataaaccaaaccctagctagggcagggacagtgggtggcggtggcgtgggcatggcatgggtggctggtggctgagcagcggcaatcgggtgacggcggcgcgccaccacgcgggctgcggtggccgggcggtgctgcaggggcggccgagggcgctgggcggaaacaaggcaggggcaacgggtggcggtggctggcggtgtggcacaggctgctagtggctgattggcgacgaccggcaatggcagcacgcctcacgcgtgctacggctgcacgatgttagtggcaaggaggtatgcacagtggccgagcggcataggtgcaggcgccgagcagtgacagggcaaggggtcgggctggacggtgtgctaggcggcaagccagtgaggccacaagggtgattgggttgggtgagctcggctgacaactattgctactcatctgctctgccttctaaaatctcaagcagaagttagtgaatttttctgaatagttgatttgctctactcatctgagttattcacaatttcacacttaggatttagccatttagggaagtaggaacttgtgcttgtggaatggctttagatgcttactgtatatataccaggatttagacttgtgcaatggcttaatttctaagaatagaagtacagttggctattaaattctaggtccaaaaatgaagagggacaaggggctattagcacttctatatgttgaacaatttcaagtaatgatcaattctatgaaaatgtgaatttagcctcaattttgtgttatatatatgttagatatcgtacaaacactagtgtttgatgttatagaagccaattattaggcatttgggtgtttaaaagaacttacattacccttcatattttgaacgcccaacctctaaatcctgggcacgcccctgcgctttatcattgtcttttggcatgaacaagtatgcgatcgactggctaggaaatgactggataattttatcatgatgtttttctaactagagatatagggggacaaatagtgttttcacgataaggattgccatctgtcttgcccacatggcacataaggtgggcccaagggtcatattgacccaaaaggtaaagttaaatgactggtttggacaaaatcaaatttcaaggaccaaagcgaccctggaatggaacttgatggaccaaattggcctatt

SEQ ID NO: 67751 - DNA, 3017 bp, Oryza sativa
taagcatgaagcatgcaatgtccacctataagatcagctcaagttgtttgtatttgctcattattacttgatcgttactaaccaaggtagtaatagttactgtctaactctcccagagctaatattaaataataagaacaatactaatgccagggctcaatgagctcatcccatctgacaagtgtgtcaccacatcggaacatattgctcaagtattgtgcttgcaggaagtaagttgcgccaatcttgggccaacataatatagtaccatcagagaactgagtaagcaataaatgtgcactccaaaattaggagtacaatggaccagaaaatcataggtgagcagactaggattattgtgttctgttatcatctgaattgaaccaaaaaaaagtaagatctgggagggaatgagatggataagaaattgaaacaaaaacgcagccaatgagccaagacgaagcacaattttaaacaatgtgttcaaaccaaggtctaactattatctgaaaaagaaagggtctaactggcactgtgtcagtggccaatatgtatcaaatattaattggatcttgtttccagtgctttcacacgggggctgtgatcactaatttattccttttgactatgataaccactgatgtgaacttttgcatagtttgaacacacttattgcttagtcaaactgaactaatggtgacagtgtgacactaaaccaattgggtgtgacttgcaagaaaacaaaatcgatctggtatggtttcaaccagagttgtcactgtcaggatagggatcgtaggcatagtttaaagaactgaaccagatgttagcctgtgaataactcactttagtggttccccaataggaacacaggtttaccagttcaaccgactgttcaaagaattaataaaacaagtcattgtcggtatggcatagaaaacaggccttacagtacatgtttccctcctaaggcaataccatcgtgcgctagttggttaaatgggttgtagaacatagactagtcgggttccacagagagaccttattggcttcaacttcatccaactctccagtaataatgtcagttcagcacaaaaccagcccttcacagtggtcactagctcagggagactccctatgctgaaacagtcttggctcaaaaccggaccagactgtgctagttcctgatcactgctgatagacaatagaggacaagatgatagtgaacctgaactaactagctacaaatgtcagttaacacctccattacttgctatctccacccccttgccatcactgcttgctagattcatcactggcaaagttgctgatcaccatcatcacggcttgctagcttgagagaagagaacatgagaaaagaggatggcggacaacgactcatactccattcacattcatggcaccagcggcctgtgtagttgcaatatatccataaaccctccgtgtttgtttgtgtttttaaatccaaaaaaaagcctttatgggctgttaggctacaggagtggtcaatgctgctcagatggattattaggctcaaggagaacagcttcttttttttttcctatatgtgggttgtactatgataaatagctttgtacttcattgaccttcaacaagaataccacggccaagtttatggactcaatcaacctgtgttaatggtcttggtcaagcaagagactgggtcatggcgatccaatctgactgggtatataatccacagggtgtcatggcgtcatgctatacttaaaacaggactactggactaacatagtggttagttagctcaagaaaataaactactgatgtatatacacataaacactgatgtatggttgactatgaatccagctgcttacacccaagaacagggagctagcagtgaaacacttagaaagttcataaacactcttagaggagagctacaactgacctctctgatagcattgctgaaccttcttcgaataactcttccaccatacccgctgctgacagctgcttagtcagtttattaggatggtcttttgtcttttttctaaagattaaagacttcaacttgtttatcttttttggtggagatggatgacgtattgtttgatcaggtgggatcatgtcaacaacgatgcaggtcgtatcatcttttagccctcttgtcctgagcgcctcctaaaaaattagggaaacaactcatttataaggaaacatgtctgatgatgcaacattagtaatttggtacccattcgaggcacaataactagttttacagcaggattgctaagaatttagagaacactagatagtttcttaccttaacaacttgcttagcagcaagctcagcaggcaaacctctgcaacactttgcagctgcctctgatgacaaggcatcccaaatgccatctgatgcaataataagcctccctccagcattcgacaactacggaaaataacaataaattaataaagaaggcagttagctatcttccaccaataacataggacatcgagcaggaacatgtgttcttgtctctttgttgttgggctgtcaaaaatatattattgccaaacagaaacctaggaggaattccaggcgtctatttgcaaagtgtcaaagttttaccttcacttgcttgacatagggaacaggaactataaattctccaacatcgatatctccaatggatcttgatagacataaacctcctggccagcatctcagtggaccaatctgataaaagggtgatacagcttgttagcattgttttgtaatccttccaaaactaagcacatgtatccaatggagctatcttacatagcatagcaagctatgtttgcaaccatatcgttgtaagttgtaacagaaaggcagtgaaacacacctctgccccaccaacaacactaagccttccaacttcacctccactcgcagtgacacgttccctcctacaatcattttatatagaaggttggttaaagcttacaagttacttttctattca

SEQ ID NO: 67752 - DNA, 2918 bp, Oryza sativa
accctgcgacaagcgcacgtgggagcgcatgcaaccactcctccctggagagtcctcttggcattgcgctaaggacatgattgagcagattgtccctggtgtatattgcggcggcattaccattatggccatcaagaacctacagacagagaaacacccaattagtgaattgtgaaaacagtccaatcccggcactcacaactcaaagcatctccatacaatggttacatgcgtagttgcaatttccaaggtctcactagcatgcctaaagccatacaaagaactagcataccaagatctgaaactatataacatatacatagcacagcatagcaatttagcaaccacacaccccataaacgggagcgaaatccaagcttcgcatgccacggctgatggtaataccccactagctggctatttagctactcaggagcacaaacccaaggaccggaaggggaaaattcgaagcaggcaccccgaaatgccaaatcgagccgcactgccatacacacactcacgaacacgaacacgaacacgacggtggagcacacaaactcacggcgaagacggcgaaggtgtggggaggcgaggacgccaaggaggaggaggacgacgacgaggtggagggccgggcgcagtcggtcctgaggaggaagaagtcttcccccttcttcgactgcgccgcgcacccgtaccgcagcagcggcctccgccaccgccgccccccctcggcgccgccgccgccgccgccgtcctcctcgtcgcgcgcgcagatcctgctccgctgcccatcggccgctccgcgcgggcctcctccttgatgagcgcggcgagcggcacgagcccgctcccccccgcggcgcccgcatgctggcgccgttggtggtggtggtggtgcgccgccgccgcctccgatgacggcgacggcgacgacattaccccgcttcccccgatcggatcaaggcggaggggagggcgcagggcagggggcggggcggggccgaaggggcggacaggcacgcggaaaggtgggggaggaggaagatggcgaggcgaggggcgagacgagacgagacgcggttttgtctcgtttttattacgcccttcttttttttttttctattagcggagtccagcccagttgctgctctccccctttttttttttttttttggttttaatttcatcgccatccacctggacctttggtacctcatgctcgcctcactcacgacgtgttcaccgggatggtgtcacgcctcgggtgtggtaaactcgattgtcacctagctactcttcatggaccatggcttaggccccgtctagttctctaaaaaaaattttcaaaaaacatcatatcgaatctttggacacatgcataaagcattaaatatagataaataaaaaaactaattacataattagagaggaaattacaagacgaatcttttgagtctaattagtctataattagccataagtgctacattaacctacatgtgctaatgatagattaattaggctcaaaagattcgtctcacggcttccaggcgagttatgaaattatttttttcattcgtatccgaaaaacccttccgacattcggtcaaacatatgatgtgacacctaaaaattttcttttcgcgaactaaacaggccattatcgtgccaatgctagagaatattttcttttatcttctctcaaaaaaatattttttttatttataaacctttctaaaattatttccaaataagattttagaaaaaaaaatacttttattggcaagtggcttcaaatagcttggcaacccgtaagaacagaagaagccacagaattagagagtgtatgatttgtgtaccatatataataaggttaattggatctatgttattataactcttgtcaaattgaaaatcactattattcacaattcggttgtgtgtcattagtattttataacatttgaactatgctactatatatgtcttggacacagtttgattgggtttttcataacgtgttttcgtatgcaccaaaatactttcaacccttagaggttgacaagtggcacccataagtcagacttatcttcttccccaactcttcctctagcttagcaaggccggcggtggtagggcgacatctacagcagtggtggaggggtcgtcggcggtggcagtggtaaagggtcggcgttggggctcgttgggatgacgagacgaggagccaccgctgccactggggttgctgctactactgctcctcattgccctgatctggtccacttgccccgatctagctgtcacgccatcaggaagctagcggtgggggtgtcatgagaggaacatccgtcagctccctcgagcttcgtgacagttaggtgatcaaggggtcatcgctagggcttgctaagcgaccacaagaagaggagcgaccgtgattgccaaggctgactagggctactgctgctgcagctcgacactcgagctcaagtgcaccgccgatggggctactgctgttgttccttgctgccacgatctcgcctccacaatgtcggaaagccagccacggcccacgggggcattgtcaatctagcggtttcacgtaagctgaccaattttcgtgaaattccatcggtttttgaaccctggttttcactggcaagccccaacgccgatgtcacgccccgattttctttcggggattaaaaatcatttaataatgcatttctagattttacattaaatgttaaagcaatttatcaagtaaagttaatgtgggaaataaaatttcctttagaaatcatgacggtgaatatttttttaatattctccatgccctaaaatactctctggaattttccatgaatttttagagctcaacaagtaattttaataatacaaacatcattaca

SEQ ID NO: 67753 - DNA, 1309 bp, Oryza sativa
cttacatctctcagattttgcttagcttataaaaaaatttgtattatggctatctaacctaacaatcttttcctcaagagatgtgaaactgacagatgctggcggtcagccccaacttatctttgcctcccaaccaatgtgatcggcgcaagaaaaaaaaaacagtacctacaattctattgatcacatagctatacaccgtatttggtttgtatggccatatggccatcttaatcttcgattcctagtatgtttccccaactatgtaagatcacatcaactccaaaccatgcttgctgctagggcaaaaggtgcatctacataaaaacacttatttttgctgtaccggtatccatagaagcaaacaatcgttttttcagaagaccacagcaacaaacgagcaattagctggttgaataatatagtcaacggtaacactgggaatacataacaaagggatatacaaaacattgtatccgatcccgatggctaggccttgtttcttgtaaaactctaggcgcatctgacaatatatggtcattggtcagctataacagccggtcagtattcttcagaaaggtttaaatcgaaacaaatgagacaattagcaggtcagcatataaggaggcaacaattggctcctatcaacaatttagaacacatgaaacaagggaaatattttaacctcgcaccaaaacataaatttctgcgtatgccgatctctttcaccaaaatctgtgcttaacagccgccttctcttcaataatgggcaaatggcaatgcaaccatgatcaccaaccattacacccaagctatgtcgaagatagtctcagccagcattacaagctcagtggagatatgctggtttttaagcttttgcttagtgaggcagcaactggtgcatgagtcgattaatcatctcataactggtgaacgtaatgacagcattcggggttgtccttagcaaattcgtagcacaacctctgtagaagccgggaattccctccttctgatacacttgcttgatacagtcgattacaccggtgtagtgcacagcaccatgacgagcacgaccttgttcttgcaatttagatcgtacaacctgccaatataagccaattactataactgaaaataaaacgtaaggggtttttcaagttcctagctactggtgctccaaaaagaagtcaagtaaattccactagaaagtgatcttttcttcattaggttagttcatcttctctttcactaaatagtgtctgaaggaggttatttattcatctacgcctctctgcctctctgcttattt

SEQ ID NO: 67754 - DNA, 3677 bp, Oryza sativa
cgccgtaaagcataccaaatgcttgtgtaaggtaccacacctgtcctcatcccttgtgtctacaagatgtaaatagagtacataaataattttaaacatcatccaacgtgacacatatatacatgtaacaattgctataaataagatcctatgcccaaaattatgcaaaaatgattaaagaaacaagcagggtcacgtcaggctgtaattatcaggtcaaaatatactatgccaaatagtttttcaatcattggttataaacattcatgcaattcacaaagatttcaatagtttagtgggcagcattctcagatttattttaattatgttgaatcattgataacagcgttcatgtaatgacaaagtaactagaattcaccctattctcagagtaatgatttctagacagaaaacatgcttcaaacaggtggttatttttactaattttgaatggactcatattaactaaatgattagccaaccctgtctctcacttgtgagttagttgtctaggaatgaggtttgactcttcaatctaagggaagtttctgatcaagacaacatcaaaaataaaaagctcaatgacatgtaggacccacgtgagtcaatgacatgtgggtcaggatggcatatctcaaattttgtaaaattataatggcacagttacaattttcccaaaaaaagggaattatatggcccattgccacacttccacaatcacatgaaatatgagtttcaatggctattattaggttttgttgtcacagttgtcatatactaaacatccttcacatgtccaacaagtcatatccataacgatgggacagttgcaagggatcaatttgttcgctagagactgcgtgccacaatttgacaagaaaagtgcagttggtgtacctactaaccaagcatgacatcttctataacaaagcaagagaagactggcagcttgttcatgagaactaaggggtataattgaataccccaagaaggcttttatgcatgcttgtctaaaaaaagttctagtctagtttattgaatggtgcaaacacagcaaaacatctcctacgatggcttggcgtagctgccaggctggcctgtaacctccttgtttcttagaaccatattgcttgtgataacacacaaatgcaatctctttgctattaaaatgtgcacctattagttattaataacatatgttccaaatcctcacacttgaaaattaaggaggggatgggggaaggaaaaccaaatcccttcatgatgttagttaatcccagtttctccctctctagccaagttgttagttactgactgactgactgactgactagcgctgatttctggaaccatggttacatctactgcactagtgttgatgcattgaagtctcagaatcgagaactacccaagatagaattgcatgcccaatatgtggcccaagaaaaatgttaacaaaatgtgttgaatacagtcgttctcaaattccatcgggaacatcatcattttgaagttctccatgcatggaagaattagttaataaatgtcttacacaggaaatgctgcagctcaacagctcatatatagtcatatcatattaacccaaacaaatgtatggcatttcacgcatttcaggtctctaggatggtaagaaatacagattctggcacatgatcaaaaccctggaacattgtaaatttgtaagcatttctctgatgattggcgcagccaccttcacaatgttgttgacaccccatggaacacctaagttctgttctcataaaaatcttaagttctaactagcaacatcaagcatcctcatatctgcccctaggattcacaagtaaggcctaatacatatatccatcatgtaccaagcaagtagcaaatacaacgtataagcagtatatactactgtgagccaagttgtatcaccatcttctacaaacttgccggatatttattagtctctcatctcaagaagaaccatagccgcacccccacccccaaaagtaaggtaataaaattgcaaagtcacaaatctatagaaagttgttttgaaaataaataccatatagggaaaaataaacagatataagttactacgatatagcttacttgtagcatagtcttcacaacccacaatgtattagttgcaacagctgttgcaatcccggcacatgaagcagctagaatatttgcttggacagacaattcgccagtgttatcacctgcataatgaacataaatgattaggaattggtaccggagtttgtactatgattctctacattaacaaaattatgacaaggcatgcagacaacagttgatgcatcaaatatatgttattaatataagtaatcatccctgaattaaaagcataactatgaccataaatcaaaactagaagacatctgcagctgtaggactataaggactagttaagagaaacgggaggtggctactgacagaaagaagtaactttatttaacaactgacagaaagaggcagttttatttggacatatgtatatatactagtgccaactaaaggacaataatgttaacacgtaagaaccacaggcgcagaaagacagtgcaaaatacggagtatgtaataggacaaaaaaagacgaagtaattgagttttgtaattgtcagcaaccactagcaaaagcagtcagtgcaattaaaccaataaattaccataacaagcacgtactggtagatatagcattgttatctttgtccatgaaaaaattatgttcccacctctgtagggtagagccttagttattaataagcctatggtattgagtagaatttaggattatgtgtgcgcgcatgtgcgcacaagacaggtatagagatgaggcttaactcctcatttgcttatgtgcataaagtcatcggactctcaatcgaagtttctcatttccatgattttacaactataattgcacgaaacaataaatgacccccaagcacactctgcaccctgttaagtttccagcaaaattataaaatataggatcatgatctagtttgcccatagttttgtctcctatcctataacagtccttagttgtaaatatattaactgttacatatatgctcttcatgaagtaacaaactagaaaaacccattttacaccttatatacatgtctaaataacaatttaacctcagtttgtactacatcttcgaaaaaggaaataaagagtagactgaaataatgcaataactacaaataaagcagagatatagaccgcaaatgctgcaataactacagagtacttgacttccacaatggcttgagttgtgaaagcatgcatttttcataaaaatgaacttataatacaggatggagagcatatatgagttatcggatcatattaatgcaccaaaatatacacctgatagatctaatagaatccacagttccacatgactcaattagtctttcctagtttgattcaacttaattctcttggtttctttagtgtaattgcatggacatctgcacttagtactttccttgatttgtttggggatgtgaattgtgaaatctacagatagaaggcaaccacatttgagagaaaatgatccatatctggtcaggatcaccagacactttaggtagttaggtatatataagagggcaacatatcctatgca

SEQ ID NO: 67755 - DNA, 11740 bp, Oryza sativa
  unsure (1)..(11740): unsure at all n locations
taacaagtctttagctgaagcgctttaaatgatttcctgatacagggaaagttggacacattatgcaaacagtagatcctcgggaaaattccttatagttcactaagctgttgtgttaaacatgatttaatgctaattcttttgtgagcatttcaaggaatacaaatatctaatatagtggcatgtcagaattgtccatagcattccctgaaatgctcaagaccttgagatgcttgagttaactgaaaacaaaaacaaagatggaaacacaatagaatctaatccaacacatgattcccttaaataaggatttgatgcttctgcccacctttcttcaatattttacacataagcacaaaaactgacaaatctagaccaacattggtaaagcacagttgtgtttaaccttgagaatgaagaagacccttcaagtgattataaactgaaaacgtaacctgcagagtgcaacagacaaaacattatataaggtgtgattcaaaaaatatatatcaaaggcagagataacaaaaatgaagagaatcagacagatattttgtgtgttttctctgttaatacatttcacgtgttacatgtttcaaacataaatcacggaatcagcaaaaacaatcaattaactagcatctaaacaaaagatcagccaccactaatagaaacaaaaacgccaacagcacacagcccacgagccatggcttcagtgcacagaattgtttctttcactacagtgtacgcagtcagaatagctgagcatgcatatttatgagattatgagtcaacagaatcaaacacaccaaacaagcatcaatcataaagcaatatttagcctgcagttttgaagcacaattagatgttcatagggagtatggactatggattagaccacatatatattgaaaacctcctgtatcacattctgaacgtggcatatattaaattctatttgatgacatacttattgaagaggatgggaatcactgatttttatcataaaaaggagagcatcaaatttgccagatcttcctccacaagtcacatgatactactccctccgtcgtataatataagggattttagagggatgtgacactgcccggattcatattactaggatgtgtcacatccctccaaaataccttatattttgggacggagggagtatattactattaagcgccaagagaaaacaaccgactcatgtttccccttaaacaattgagtgccaacagttcaaccctgacagtatctcccacacaacctactaaaacaaattcacttctgcagccaaaatctcaacaaactcctcaaaatcaatataaatgtccatacatatagctagatctgtaatattgaaattggtttttattgaatcgcaatcacaagtggatctagatagtaagcgaaatgcattaaagtgttcaaacagcaaacacgcttcgtggagatgtacatctgttattaggcattgcacggaacatgtattcaatttagtgaaatcacataaaacatcagcattaggcgttttcaaaactcattgtttatagacatgtagcaagctatcatctaaaagtggattaaagaaattaaaacaatcctgtaatgttactaactgtatttgtacattaatgattactcacatcctaagttggaaataatgctactgtttactgactgactgtataatgttaatgattacttacagcccatgttggaaacaatgctactatcgttggtgaaaggccacgatacaacccaggcaggccttcattttttaatatgtgctgaaaacctgaaattattaccctacctaatacggaagagaaacagaagtcagaaaaaaagataaatggagcagatatatgatgaatagatgaattatcaagagataaaataagactgtttgagaaggattaaaaattagtaatacatgctcaagagaacaatactttctgagtatccaaaattaatttataattgtactagattgatcatcaacatacagagataagcactatattgttcagcatgttaaactaagatgtctatagaagtgtgaaaggttttatggtattaatagttgtgccattggagtgacacatatgcacaggacatatagttccccttcaaacagagaaatgtgcatgtttgtaatgcaaacttgatgaggataacaggttttttttttcatttcagattcagataaaaacattagaatatacaaatgaacatgcaagtcttttcaaacttagcgaatcatatgatttatatgaatgctaatatgcctttgtcaaaatattcaatatatggaaatattttataatattttactcaagacatccttccattttgcaatatttgtccacagcccactttacacagaccaagaaagcacagtctaagaaaacataatgaaaatgactgtggatatccctaatatactcataatacagacaatttatcttttcaaaaatatttaagtaggtgggaaatgcatttaagtaggggcaaaatttgcaagaagtacatcttgatctctgcaatggacaagtattttgaaacagatactccagagataatgggacagatactgtgaaatggaggaaatagtgcaatgtcaaaacaatcttatatgaaatgttgcattggttgactataagagattctgcagcagcagctacattacgcactgcatgtgcagcattgcagggaaaaagacttagctcacaatttcatgtgcctaatttataactattcaagcatacaaaagcatggattattagattatctattttggcactcctacccttccattcctcaattttgacagtagtacttcagttacaagcatgcattgagctcctaatcccctttatcaaccccaacacgtcagaccagccccccaccccattaagcgccaacttttgcaatcaaaccattgtccagcataactggtataatgcaaacatataggctttcatcatgttctttagtatcgcaacgcgacaaattgatcttacagcgagaccaaaacaggctaactcacaaatttcatggggcaacaagcccagagaaagcgtatggacagagtgcaaagtaggcaaacggtacgtataaaccatgcatcagaagagaagagagctagttaccaggtggcgccgtgctagagaggttggaagggaggccgtacacctgcagccgcgtcttgatcacgtccagcgggcacagcaccgttgcggagatcacacctgcgcccaacacagccaccaaacgaagagcaatcagaaggatcaaaaccccacgccaccatcccgagaccgaagccaaaaaaaacccaccaaccctggctagaaccatacgcaggggagagcagaattaccagccgaaccgcccgcgatggcgttgcaggccgcctcccggaccatcactcgcgcgccgttacctcccctgccctccgacatcgcggcgcccgagaagccgcggggggaggcagcccaggagctaggaagctgcagcagacaagagagggacgagaccgtctccctcggtcagggcgaagtcgaccaccggaaatggcggcggcggcggcggcggcggaggacgcgctccgtcccccgcggtgggaggccccggccggatccgggcgggcggccgggcgggatgccacgcgccgggcgacggggggagcgccgcccgctccctcaacgcggcttgggacactcgcttgggaaacggaaactggggccgcagggaggcggcggcggcagcggcggaggcggaggggaggggcgacgcggccggcggtgtgggaggggaacggtcgagggggggacgggggagggaggcgtcggcggcggggggagttggaacttgggaagagggggaaggcgtgatgattgatcgggtggtgggggggagggggggacntnacnggtgcntncgtcnatgttgctgctctcttggagtctcgatctgctgctgctgtctcagccagcggggggctgagcggcggagctacacgcgtccgtcccctagagcgctcgcttagccctgagctaccacgccgtctcgcgcacagggctcggtgtgcgaactgccccggtccatcgtgactaaaggctgtgttcgggccgacatgcaaaacaaaacaccaattattatatgattaattaagtatttattatttttttaaaaaaaataaattaatattattttttatgcaactttcgtatagaaatatagctcggctcattggaaaaaagcagagctacaattttagggcctcgttggtaatcaacatgctcggacagaccttttccaaatcagccaaagcaattccattggttggcttattttgtttggatggatttgatgaaggatctcctgcttatacttggttgaaaatactcagatgggctttggcagtttggctgaaaatcttcagcccaagggtctcaccggatggcttgtttggttgaggcttgggctaagacttttcagccaaacaagtgggacccgcaagggagttggatcatcagcagtggctaattatgtgaactctctagtgaccatacacaaaaaataaaaatcccaaaaccaccggccacagaaaatccttcaccagccatataagcaaaataacccaaacaatggtttttctttggctaaattgaacttggcagatttggctgatcagccaaagcttcatgccatccgatgaggcctgaaatagctatccgatgagaatcttagtttgagcatatagcccttgagacgttcattggttgccatattcaatcatgcaaaaggtaactgtctgttgtaaacatcttaaggttttgctagttatctagctcgcacttgctcgtatatcagatacagcgtgtcgtatatttagttgcttgaacattgacctgagccagaatgagcagttacaaaactgccttcgtagctaggttgagcagaaaagcttgaatcgagctcaactcatcccgcatgagcccatgtaggtgtggggttacgcaggggcgtgtggatacaaaaggctaggaggggtttgtgcctccgcttcatttgctcatttccatcgacccaatccgttgttgtctccatcactgcacctgtaaagcctctcgccctcactttgagtagctgcagcgagcagccataatcctatgacagccaaatattccctttgtccatgaatataaggtattatgcctaaaagagcacaaattaagaaagagtaagtagtacatctgtgtacatcattgacacaataaacaaatttgtagtacactagtattagtatgttttctgtaactttttccctttttgacatagggcatgtttagatcctgtcaaaattttacaccctgtcacatcgaatatttggaaacatgcatggagtattaaatataaataaaaaaataactaattacacggattgtgtgtaaattgcgacacaaatcttttaagcctaattgcgccatgatttgacaatgtggtattacattaaacatttgctaatgacggattaattaggcttaataaattcgtctcgcggtttacaggaggattctgtaatttgttttgttattagactacatttaatacttcaaatgtgtccatatatctgatgtgacacgtcaaaattttacacccatgaatctaaacaaagccatagacggggcgaagtagtatgagtactagatgttctttgtatttctttagttctatgtacatcatattggtatgtttttttttgaaaacgattcatggatggtggatggctgacaggcagtgcctgcttgctttgggaggagacaaatccactatatttatggacacaccaagggaacaaaatcccttatatttatggacagagggagtatggcactagcgtctagtgagctcggggccactagattttgcaagtcgcaaggtcttactaactgggaggaaaaactcgaggaggatgtcaaatctagacgccatcgtctgtcctcctcttcttgccatcgatgtcgccactgtcatttatctcctcttccttgctgcccttcttctttcccgaccactagactgtcggatccgatggccatgagctcaaggctgctaattttgaccatgaactagcgatgatggcaagtggagacgtagaaaagaggcggagggagaccttataaaacatgaggtaaattaactaaatccatttattaaaaaaaaccttgtgtttacatgtttttcctcacagcataaatcaaacaacatctcataccattgtgatctaaaagatacaaccaagagtcttgtcaacgtttgatgtcgcgattccggtatttgcatagtatggggatcattggtactatcatatatgcgagattgtagtaaaaaagatggggacaaggatttttatacaggttcgggcccctgaattgtcaggtaataaccttactcctattggccgaagctggtcgttgctcttattcaccataatcataccagtacaatatttggggtagcctatctaactgttgtcgacttggcggtctgaagtgctgattcgtagtcgacaacagggtagccttcctcctcgaatttgcatccggcgagatcaaagatagcgttatgtctctcctgacggtatccgtaggcaccgtaggggactagccatgcttatctctgaagtcgatattcggcgtcttgtcttgacgaatattggcttgtatattgatcttgtgtcttgatctattgtttcgtgtcccctctcctcctagggggccttgtatttatacccatagatgtccccttgtccaagtagaactagggaaaccaatatggatacaattcaagtagtccttgtcgttttcatgtagaactctattcatcattccttatgcggaactccttctatattcaaagttgttttcgtataagacatggtatgtggcgggtcctgccgagatttagtcaactactattaggtatgtggtatccataaccctgacaagtctattttttcctcaactccaaaatttaactttcttattttcctttagcacatttttcaaactgttaaataatgcatttttttaaaaaaaaaatctatataaaagtaacttaaaaaagcaaataaatttattttcaagttattgaaagagcatctatgcccctagtgggttttggtttattgatgacaaacgattaagggactaatgcacttatggagtgtataagcaagtgattagtccgatgaagaaactaggaaatggacttatcgatggatgagaattaaagagaagatattgaagatgcgggcatgaagtgactacctatggcaagacggtgaagcgcaagtgacgctcagttgcgatggaccatgcggtggtgaagggcaagcaaggggcttggcgccgacgaaccgaaaccggtggtgaagggcaagtgaagactgtgtcgtgatgaaccgtgcgaggccatttgaagccatggattatccacattaatcatttgagaaatggaagatgaactgtcaaagatcaagaagatgagatcttcctgatgatcaaatgactttgacgttggtaaccctccaagtgaagaatcaatatggtgtgaaggtactcctattggtataactttactttttaaatttgagtttaggatgccgtactattaagagggataccacatgcatataattggttgaatactagtgctcaaaatgcttcatgtttgtgtgagttgaaaaacctaagccaaaatttttaatcccgagtggtttcacttgtcacaacacttacaccgggtttctttgcaagtttttcaacatctcttgaaggttttggaccatgttttatgttgggtttgatagcccatgaaactagctttccatagagtccaagatcttcgaaatcggagttcggagtaaaaagttatttcatttttacttgagcaacatcagactatccgatttgaaatcagactatccgatgtatcggactatccgatttttcacagaacttcactctctgtctttgtttaaaaaattcttttgagtgagtttttctaagtgtcggagtatccgatgttggatcagatagtccgatgatacagagactacgaaatttcatggaacttgagtctctgtttgagaacgaagttttctgcttcaaaaatatcagatactccgagcaggatggtaggatggctcatgccttaatgtgatccgagtggcttctccaagcagagatgttgacctgcagaacatctcagaaggaacacacctatatgagttcaactgctagtcacagtctatgaggtttgggcgatcactagatactcatgaaaggcctggagtttgacttatatgctccaaacagaggggatgcgaacggcagcccagtaccagtcaaggttctgagtgaaacctgatcacacaaaactgacaattcaaggcatagtccattgttcagttgtggtctgatgtagctcatttcctaggtggaagttcaacttaacagtctccaccaaaaccctggtatatcaaacaggcacaacattgagaacatttcttatgagccttgaaacttggtggggattgttagaataattgggctaggcccaacttatcctattaaatctcaaaggcccataataagtgttaaggataataataccacctcaggatttaagcgaggaatatctcaacctaaatagggagttattggaggccccctgttgactggttgaggtggaggtcggaatgccacacgcgcgcgcgcgccaggccgaggccgtgggcgtgggcgtgggcgaggcgtggcgtgcctggctggcggcggcgtgcgtgcgtcacgtcgctattcttttgcagccactaaccacgttcccacgactctctccgcaacagcgcgtccacgttcccacgactgcctctctctcctgagagataaggaggccgcgagtccgatctgttccggacacttgcttctttcccggtgttagttcctcctcctccgcgccagtgctattatcgcttcctcgcttctgatctcttgcgcgcacgagagattggaaggagcagtgcctccgaaaccacatcttcgcctgagatctgcaccgggtaggcgggtgatcaggcttttggggagtgcctcccgcacgactgctcgccatgtctggagttgccgccgccgctgctggaggagatggcagaggtggtgcgccgccaggagctggagctggaggtggtgcgccaggagctggagccggtgccgcgaacgacaacatcaacggaggcaattctgcctcacaatccagcggagggccatcctcggagtatatccttctcctattccctttgttagcgctatcgctttactgttatgtgctctatgttcctgttcctgacattcatgatgcctctagcatgttattgcgttactgtaatgttcctgttcctgacattcatgatgcgcatggtatgctactggttatgttaagagcaccctacaccgcttatgccatgattattgctttaacattttggattaaaatatgccgattcatgactatatttccaacaatccaaaaatctgataggtcatttttggtagttggctttgctgctgcactgaaaccacatgcttttgatgattctaactataagagatggaaagcacgtgcactactgtggttgacagcgatgcagtgcttctatgtttcacggggcaaacgaagtgaaccacctctttctcctgaggaagaggctaagttcgaggcttcggattgcctgttccgtggagcattgatcagtgtactcactgacaacatagtggacgtgtacatgcacatgccttccgggaaggatatgtgggatgcacttgaggccaagttcagagtttctgacgctggcagtgagctgtatgtcatggagcagttatatgactacaagatggtcgatgaccgttctgtagtagaacaagctcatgagattcaaatgctggctaaggaacttgagaacaacaactgtgagttgccggacaagtttgtggcgggtggcattattgccaaactgccaccttcttggtcggactttgccacttctctaaagcacaagagacaagagttcagtgtttctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaacattaagaagaaaggtaagggaaagtcaaagggagactgctttgtgtgtggcaagtctgggcattgggccaaggactgtcctgagcgcaaagacaggaagtctgccaacatggtcattagcgagggcggaggaacatcagggtacggtaaaatattacctacagttctctctgttcttcactcacctgattggtgggtggacactggtgctaatattcatgtatgtgctgacatttctctgttttcttcttatcaggtcgggagaggttcctccttgttgatgggaaacgggtcgcttgcggctgttcatggtgttggtacggtcgatctgaagtttacttcgggaaagaccgtgcagctgaagaatgtgcagcatgtcccttcaataaagaagaatcttgttagcggctctctattgtgtagagaaggttttagacttgtgtttgagtccaataaatgtgccgtatctaaatatgggacttttgttggaaaaggttatgacagcagaggcttgttccgcttttctttgaatgacatgtgtaataatcataatgctgtgaaccatattagcgagaatgatgagtctaatgtgtggcattcgcgactctgtcatgtgaatttcggttgtatgacgcgcttagctaacatgagttgaattccaaaattcactttggtcaaaggttccaagtgccatacttgcgttcaatcgaaacaaactcgcaagcctcacaaggcatctgaggcgaggaatttggcacctctagaacttgttcattccgatttgtgcgaaatgaacggcgtgttgactaaaaggggaaagaaatatttcatgacactgatggatgattgcactagattttgctatgtgtatctattgaaaacaaaggatgaggcattgcattactttaaaatctataaagctgagatagaaaaccaacttgaaaggaaaatcaaacggttgaggtctgatagaggtggggagtatttttccaatgagtttgcatctttttgcgaagagtttagaattattcatgaaaggacgcctccctattcaccccaatcaaatgggatggccgaaagaaagaaccatactctaattgagatggtgaatgctatgttagacactgcggggctttccaaggaatggtggggtgaggcagttttgaccgcctgtcatgtcctgaataaaattccaatgaagcataaggaagtaacaccattcgaggaatggcaaaggaagaaattaaatctctcatacctacaaacatggggctgtttggccaaggtaaatgtacctatagccaaaaagcggaaacttggaccaaatactgttgattgtgtgttccttggttatgctattcacagtgtgggttatagattcttaatagtaaactttggtgtacccgacatgcatgtt

SEQ ID NO: 67756 - DNA, 7266 bp, Oryza sativa
ccgtcattgggaggctataaaaggacttcacttcctcactctgtacatacacctcaagcaagagttctctcatattctctcaagttagtttagtgttctcaagctagtggaataggaatagagtagaaatcggagtccagaagccttcggaagagttcgggtatggctctagtagctcttctgttctcttttgtaagctttgtacttttattagaatactcttctttatacatttatggtattggaatactttccaagtatatgaatgccaaatttacactatgttcatgttatactgattatactgctagcttatctaggagatgctttggtacgtgtgtagtgtttgcttatgcaattactatatgtcatgacgatgatattagagtaatatctggtagtttaggcgtggtgtctagattatgggatatcattatttggggttatatgctgcggatgagaggtgggccgttgatggtgacagctcagtacggtaatcctccgcatatgtatataatcctaagttaatttcctggggatgatactccttcgtatttagccccggttgtatagtcatgatgggctgtcgtaaggaactcggaagtcaggggtggcttctcaaagtcccaggagggcatcggatatagggtattagctagtatgtcagataactaggatgtatgtaaactatgtatattagaagtataggaatatattctctttctattttctttccacttagtttagatattatagtatgagaatgagtagcttcctacttatgtgtcactctacccttggatttatcttaatccctgcttagactatgattattacaagtaacatataaattattagtcaggttctctctactatgatcttcccatgggattaaataaatatgatacccttggaatactctcgggtgaaatgctacaatggtatatccgtgcgcttgcggatgaactctgtaatcataatataccaagagtatttctgcgccattattgggaattatatttctgctaatgtcgttaagaaataccaataattaatcagcaaatgcctcttaactatagcacacaggctacatcagaacactgaatcatcaaccacaccagaacaccgtatcaattcacaagtcgtctcttagtttaacttaggtacatagagatatacctagaatagtggatcaaaccactttagacttgatgagtaaacgttaatcctgtcaaactcgcagctaacaattcaaatcgataagggaaaagcgcaactcgctaaataccaatcgattcaaactcggagaatcatcaacacgagcacaacaatgcgagctcttcccattaccttcaaatcacacacaaaataacatagaaacactaactggagaagcgccgtagattgccctctcatgaatcaatcacatgcttgcaaataggcatatctaggaaaaaagaacttataagagcaacacaagagaaaaatgctcaaaaggacctactcaacactagaaagaaaaagaagtatgtccttttttttctcaacatcaacgaaacaaaaagataggcacggaaatagtgaaacatgagcctcatgttgactacgagtctcagcacggaccctaaagcaaaatcgaatggccatcgatcaacacaaaaccattgacataggcccacacctagtcagctcaatcgaaatacaacccacgagcccacattggctagggatctagctagagcccacgaaagctaaataaactcgtctgagcacatgtggcccgatgtgtcacaagcacaaatcactgaacaaaacggtgacaaattcaaaatcctagtaattatagccgttggaaatgaaaagaaacgattgaaccatttaaaataaaaagaaaccgtcaaattattcaaaatatataagaaatcagtacattaatagtagtagatatacaatccaaaagactacaaactttatatgtccattgcatctgataacactagccatgtatgccaaaaaaaaacaatgctagtgaatttaaaccaagtctagtccactctactgtgtaaccctaccgatgccagctagcagcaaaacccccccacaaaaacacctgaaatcaaagcataccataatacaccagtcaccgactggtgggtccgacgaccgaactccgccccatggcccacctgccagccgcacgtccccccggagaaactggcgcttcggatgcccctttccaaaactagccgttgcggcctcactcggcctctcccccacacatcgcacgggtcaccccgctcgctccgctccccctcgatttatttttctttttattttctctctctatctctctctcccctacaaacgaacgctgaaacgcacaccgagccggagagaattcaaactgtactacgtagtagtactagcgctagcactagcgagcggtggttgagcggcgcatcgcacgcgccgcccttgaccagcgacggcgagaagctcctccgcctccgcctcctcgtcgtcgggcgcgcgcccaccgccggcggcggctctcggcggcagcaggcagcggcagtggcctcgatcggcgggttgcgcggtcggatccccaatccccgggctgcgctggtgagtggttttcctcagctgcttctgcttgtccccgtgcgtctccctctcttccgagccccctggttctgctctgcctgcggccggcgccgttttcccgccgggcccgacggagtagccgagaggtggtgagtccgtaaggagggggggtgcagatgctggcggcggcggaaccggccgatctgccgctgtggcctcccgtgcgttcgcgcggcgcggcggatggagaacggaagttggtcgggtttgccgctcggaggttacagggcgggttcgtccatgaaaggaatgctgtttattttggcgctaactcgtggaattttttgtttgtgaactcagtttaccagattgcaatttccatacatgaatatacttgctagattttttttaagatcggtatctacttgctagattgagctttccaaatattaatacacttcgtctccctctcattttatttcttaccaattttgctttgcgtgtttttctcggcccatggccctaatctgaaattgtggggttttttttggaggtggggagaggggatccgaagtttttgaattcggtaccatttcgtaatttagattggggtgtatctgaatgtgacccgagcgatgcagataacacatttcttcttatgaagattacatcttattggcacagctttatgtatgaaattgagtaattttcgccccacgctataattttaggaaaaaacacccgcacatgtgcagatgtgcttgccttgtttagtgccgtccattcattcgtttttcattttaaaatttaacattaatggtggtaatagatctccttgtaatactactcataatggtgaagtaaaacatgcaatttactccgtttgtaataaatgaaatatttgtgtgttgactatgtaatttatttcctttgtaatagtgaaatagttgtgttggctaggtcagcacattgttgctgcagagctatcttcccggaattgtttgccaatattatgtgcaactgtgtgataaattgaatctgaccattttttgccttgtgccagcttcgtgagaaggctgggttcttgctgttttccccagacttcaaggaatctgcaatttactagcgaaaatgggtgtatcaagacctccaagcacccctgcatcaaagattgagcgcacaccgatgtcgaccccaacccctggtggcagcactagggtcaaggaggagaagatttttgtcacagtgagggtgcgaccattgagcaagaaagaactggccttgaaggatcaggtggcatgggagtgcgatgataaccagacaattttgtacaagggccccccacaggatcgggctgcacccacctcttacactttcggtaggcttttcagtgatctattcatgactgcatatctcaagcaattatgtttgtagtgacactcttgatcaatgacttcatatctcaatcctataagtttgaagttacctcagtagctaaattgactaatttaaattccatcttacccttccagacaaggtgtttggaccagcttcccagacagaagtggtgtatgaagagggagctaaggatgttgctatgtctgcattgacaggcattaatggtaaattaattctcactcagtagtttgaataaagttgaatgatcctttatctactctttattctttaccttcctttgttttgcagccaccatttttgcctatggtcaaaccagcagtggtaagacattcaccatgagaggcgtcacagagagtgctgtaaatgatatatacaggcacatagaaaatgtgagtttttttatacatggagcaacaaaatcatgctatctatattgctttctaaaatgcacataacacataattgtttcttgcttttgttgattgcatagactcctgagagggactttatcatcaagatatctgctatggaaatttacaatgagattgtgaaggatcttctacgacctgagtctaccaatcttcgcttgttagatgatcctgaggtttgtttccagttcgacagagtctatgcactgcccccacatattctcttgcatgccatgattatcctttaataaattgttatggtttgacagaaaggaacaattgtagaaaaactggaagaagaaattgccaaggatagccaacatcttaggcatctaatcagtatttgtgaaggtaactactatctgtatatattgtcttaacttattttttcaagaagaaccagaagaaatgggttgccttatttacttttttttttgttgacgcggtagcctattgcttatgatgtctttatgactgcagaacaaagacaggttggggagactgcactaaatgacaccagttcacgttcccaccagatcattaggctggtatatataaaaataagcctccatgtttatgttagatctttttcatgaaagtgagaaaaataattattgtgcattatctctatccagacagttgagagtaggctccgtgaagtgtcaggatgtgttaaatcttttgtggctaatctggtaagcataacgtcctcattttgcaatggtgtacatgctgtttttttaatctcaataatatgtgttgctttttcacagaattttgttgatcttgctggaagtgaacgagctgcacaaacacatgcagttggcgcaagactgaaagaaggctgccatataaatcgcagcttactgactcttactactgtcatcagaaagctaaggtatgattttctaaagaaagaaagaaaaaactctgggtctattatctcttatctgcaccaatcttgaaagtagtcgctgagttacctcgatgcactcatgggttagtctcagttctaatgttatctgttgatttgtaatgatatcagtatgttaatgatgtatcttatctcctaatgaatttctaaaacatgctaatgagattcatcagatcaaaatattcccaggccactttgtttaagtgggaggcaattgctctgtactctgtcctattgccactatactgtttaatcattctgcatatttagaactaaagtgagttttattaaaatctcatagctgcaacacagttaattgtaagttcttgaatgtgttggctaagtgacattggtatggcaggactaataagcagcattgtgtatttgcagtgtcatgaacatgttaaactagacaatttatttgcagtgtcatgaacacgttaaactagataatttatttgcagtgtcatgctaatacacagtttgagacctcttttctacttagataatttactgcatatttgtatttttaccgtttcttggtttgaacaggaaactataatgaagtatatctttattgggaatattagcagactgactctaaattttcaatgcagctcggataaaagaagtggacacataccctatcgagactcgaagttgacacgcattctccagctttctttgggtggaaatgcaagaacagccatcatctgtaccatgagtccagcgcaaacacatgtagaacaatctagaaatactctattctttgcaacctgtgccaaggaggttacgaataatgcaaaagttaatatggtaagatctgtgactgtgatgcatcatttatttacttatgagaatgcaaatcttcatcccttgggccttggtacgtacaggtggtatcagataagcaattggtgaagcacctacagatggaagttgctagactcgaagctgagctgagaacccctgatcgtgcctcctcttctgagatcattataatggaaagggacaggaagattagacaggtaatgtctatgctcaaggatgaagttcactggaatcatttccattttgtaactgacctaattaagtgaacactgcagatggaaaaagaaatggaggaactcaagaagcaaagagacaatgcacagttgaaacttgaagaattacagaagaagatgggtgataatcagccagtgagtatttgccctttccttgcaaatttacttttctttcaaaggatatcagccagtcagaaccacattcatttactgtcaacctaatctttccgaaacccatgttttcttttagggatggaatccttttgactcaccacaaaggacacggaaatgcctcacatattctggatcactacagccaagtaacaaaatgaagatacggagctcgattagacaatcagccactgctccatttatgttaaagcatgaaattcgcaagcttgagcagctacaacagcagcttgaggttgaggctaaccgagctattgaagtactgcacaaagaagtcgaatgccataaacatggcaatcaagatgcagcagaaactattgctaaactacaggctgaaatcagggggatgcaatctgtcagatctgacagagatgttgacatgatcacagatgaaggaaatggatctgatttgaaagaagaaattagtagacttcatatgcaagacaatgatattgcaaaacttgaggctaaactagaaaatgtacagaggtctattgatagattggtgatgtcacttccaaatgttggcacacaatgtaacgagactacaccaaagtccaacagagcaaagaagaagaagaggatgcttcttccactgggcgtgagcaacataaacagaccaaat

SEQ ID NO: 67757 - DNA, 18070 bp, Oryza sativa
tcagaggaaaatgcaggatctctacaggatggtcctgattcatgggacagattatttaaggagcagatgcagcacattatccaactgtgggatctctgtcatgtatcaatcatacacaggacccagttctacttattattcaggggggatagggctgatcagatatatattgaagtcgaagttagaagactgacatggttgcaacagcattttgctgaggtgggcgatgcaagtcctgcagctggtgatgactccacaatttctttagcctcaaggtaaatattagcctttacttctttgagttttacgggctatgttagttaattccagaaaaagaaaatagtgttggaaggtctaaaaaagagtcatgtcccctaggcctttaaaatggatgttgctggaagcaaaaccttgtaatctgttttctcacagtagttttatcctctgtaaaagaacacttactgagaaaccttatatgttgatagtgaagatggagcttagttatctgatagaaaagccttaacatgaatgtttttccgagtcaaatgtttcattagtcataactgatatcgaatcgtgatatataaaccaattatctgatttcatgttgcagtatcaaggcattgaggaatgagcgagaattcctcgcgagaaggatgggctcaaggctgacagaagaagagcgagagcgcctcttcatcaaatggcaggtgcccctggaggcgaagcagcggaagctccagcttgtgaacaggctctggacagaccccaatgaccaagctcacattgatgagagcgccgatatagtggccaggctggttggtttctgtgagggtggtaacatcagcaaggagatgtttgagctcaattttgcagtccctgcaagtaggaagccatggctgatgggttggcagcccatttcaaacatgatcagggagaagacacaactttggtaagcagagatatgcccatcttccttgttaagatgaggtagaaggatcatataatctcataaaaattttggtgctctggaccaaaggtgaagtggctgagcttctgggttggtcaaggccaggattgacagggggtgaattgatgcaagcatggtgccaacatgcttcagtctgtgtagaatcttctcttgaacctgtattcttctttcatcaccagtgtagagagacttggatgttctcatattctttattaagtagtgttaagaaatgattccgttccaaattttgcccccaaattgatgatcaaaagttcgtcttgccatgtggttaaaggctgaatcatttaaagaatgcatagagatatttccactctttctcacaggaacacatggagttcaggaaccaggatctcgcggagttagaaaatattgtggttctcgctgtacaacgaggacctctccttttggcttgtgctatttgttccgctttctggattgttctagcgtctttctagttccagattcttctttcttggcgagtaacttctcgtcagacatcttccttttagttttgttagtcaacctcgtctgcatgagttatcagtgattttgaacaacttcattgctgaagttttcttccatgttctcttggatggtataacgatcttggactccatatttgagtgatgataactcttccgtgttgatgaaggctttggtgattttgggaatagtgctatggcactcattaaagcgttgtatgaagtccctaagagcaggtacaatagcaggctataagccagctataaccacgtatcgagaagaaaagagaaaagagagaagaaagcgggctacagatttgtagccggctgcaatacgttatgagtgtatgagagataggaccggatattaatgatgtcgtatatttttataggtaactattgtatgaatgggctattagattggctatagatgatttggagccaggctatactattgaacttgctataaggggttcaccgtttctctgtcttgttgcatggtggtcatcctcgatttggatgcctcttgtatgtgccctggaaattggtgaaattggcaaaattggccacgaattgatagagctttgcccatgatccaatcgaagatttgggaagatgcatgagccatgagcaggcagggcctttcaatgtagtggataggtagtttaccaaaacgttgtcgttgcgccagctgcatagaggatggtagaatagatgtgaaggaattcctctagatctgataaaaaaaggttgagttcttagattattgatgacaacgggctacccgatcttccattaggtggggataaaaatcgatttggcaaacacttacacacacaatccagcgattgcagcaccatggtacatgacacctcaattgcaaataaatgattaggcacttgaagttggagttctacaaatcgaattagctgcgaaattatatttggcataataatctaagcaaaatccaactctaaacaataatggctactaaataaaataaatatgattagagatatcctagggttagccctagggtgcacaccaccttgggcttagcgcaagtccgcacagacaccattactaggcccaaggctcaaatatagatggaagtcacaaagcacacaggcacacagtacgtgcaaaacttgctggtaatcagtcaaatacaacttgcaaagtaacaattagaaacacaagtgttgcataaagatgacaaaatgagagcgcatgcaacatgattccatttcattactcttccataagattttcttcggtctgctgctgagaaactttgaccacgacctttgtcttttgtgttgacagcatggtatccttcttcgggagcatttgaatatcctgttccaactccttagcatctctctccctttgctttgtcttaccctgtttttgcctgttaaaagttcagtgcatatgttaagcaaagagataatttcaagaattaacagactgagccaaaagaacagatgccaacctctctgtaatatgttttttatggcgttcatgtctaatctttgtaataagagggatagccttaagagtttgtgcagtgacattccggtcatagcgctctggtctgttcctcttcctctcaaactcaaaggtggagtcctgatttcaaacgattcagatgtggttcacagcatagaaagtggttcacagcatagaaaatgtgctctctacttaatactgaacgaaaatagaacaagcaaatacctgcgtcatgtccttcccatgcaagcatctgtatgcttttgtccatttaaccttacgaggattcctcttcatcttaaaatttttatggcattttgaccggcaaaagcggaagatctgcaagggaaaaaaaatgttgttacagcataccgacaaaatccagcttgttataggaatgcaagggaagatctgcaagggaaaaaaaatgttacattcctataaccgacaaaaaaaatgttgttacagcataccgacaaaatgtttgttactgacataattaatttaattgattttacttatatattgtgtaaaagaattcatatgttcttgtggcttattttgaaagagaacagtgttgatattcagaaaggcccagctttaggcatccatcactattccaaccataaaatataagagaaaaggactgaatgagaaacataggcatcaaatttaacaatggttgttcatgtccacttaaattcattgctactggtggagccagaaaatcttcatgcgttcagctaacaggagctcaaatattatcacaaattacagagcattttcataagattataatggggattatggagcaaggcatagggctcaagccctaactacccctctgcccccctactatgaaacacgagaaataaggcagcaatattcatttctctagatcaaaatgaatgaaataaaaaaagttcaactaaagggacctaaagtgaacttatttcatacggagcgtaaacgcggtccatgaggcggcccaatagtgtgggcggcctaggaatagaatcgggacaacttaagggacctaaagtgaacttattccatgtggcggcctgggagtggcatttggcccgacgcgggagaagctgtagccatacgatctgatggacggtcctgattgatcccgacctatataaaagttcaacagcccaaccctaaccctaaaaacatttcccctcccccttctctctcaacggtggcggcggcgcctctccccctccgcctctcctcctttcccaaccccaccggcggcaccgctctatctccccctcttcccttccggcgggagatggaggcggcaggtaggggctgcgccctcccttccggtgggagggagacggcaggcaggggcagctccctcacctccgccggatctaacgggaggggaggcggctctccttccgcaggcagcggcgcctctccaccctcacctcctctccctcgccatggggccgcgggagggctcgacggtggcgggcggcgctttcccctccgacggatccaggaggggaggtggtggcggcccagcgtcccagcggccccttccaccggatccagtgggaggggagcagccggcggcccgacatccctgcaatggcggtggcggttcggcggcaccctcccctttcggcgtcagcgttttcttagtgttttcttgtgttcttgaatttgatgcagactcattttttgccatcgatcgcacgtgcggtggaaaattttagatagattgaatcggactttccttttttttcatgttttttttgcccttttctcgctattgcggatgacggaaacgttttcaattttttaagtagtagagatagagatatatatagataaggacctaaattttttaatttggtatataggtatatttgggggagaagaaattgcaaaaattggactgcgctctaaaatttaaaagatgagtggtgcttttgcaaaatttatggcctcaccagttggttcacttattcggttttcatgtttttctttaaaatagaccggtcggttttttcatagtaaaaaactaagtccagataaggtcaccagatcggatcagatcgagggatccctcatatcgatcccctttgtcgttctttctctcctattctcgttttctccatcgttctctctctttctcgcatcttcctccccctcctcaatccggctcttccctcccccttcctgctacgtccatcctcctactctccgttcatgcgcacctcctcctctcgagaggctcgccaacgacggcagccaccatggccgggagaggcgaggatgtgctccaccgcgaccaatcctccccagtcactttgccgccggcgctagggccaatgacggccgagagggcttcctccttagcttcttcacctgccggctttgcggtggggcgagaagcggctgcggccacaactagaggtagtgggggagagggggcgggaggtggcagggggagttgctcccccaccagcatctcaccgctccctttccttctcatcagggtgccgccgccccgctcctcgccagatccggtgggtcgatggctcccggcggcatggcaggtcgacggctccctggccgcttggcgggtcagctgctccccggcacagcggctgcgcggtggatcctcagtggcgcagcatcttcccgatggagcggtggctcaggatctggccccgagctcgggacctccacggcagcgaggcgacgaggggcagtggtggcctcccactcgctccttcctctcctctcaatcatctcttgtgttgatattttgtctcttgagttgatattttgtgatgattccgatttgagaaaaatgacatagcatttcagtccatttgggagtgcaataattaatataatggaaccagcaggagaatctagcggcccacatctctttgatgactgacataattaatgtaattacttttactataatatggtctaaaaaattcatatgttctagcagcttattttggacgaaagcagcgttgttatccaacagacctcagcttttagcatccaccactattaaaaccataaagcaggagaaaaatactgaatgagaaacatatgtgtcaaagtaataaatttaacaacgattattttgtccactactccagttaattcattggtactatgaaaaacaagaaaaaagacaggaacatgacacagtacattgttaaattggatggataaacataggtgtggaagaaagtgaagaagtatataccaccattggactactctatacattgggtggaaatgggacaactagctctctgagactctgaacaaagcaaaagagatggagagagagagagccagtgacacatgcagtagggccaccatgggttggataaccatatatttgtttataaatactatggcaatgaaaactgaggtgtttaggtaacaacaaatcttgtagtttgataatcatattttttgggttacataaatctgcattctgccctaactcttgttcttctgaaaattgagcccacagctgttacattcatcccaacgttttacaaattctaaattccttctgtctttctagcttctattcttcaacccttccagaccaatatatctttgttggtttgtgtagtttaggcgttagtttcaacgctaatgacatgggcaggcaatgcgaggtgtgactacacaatgagggtcacatactgcaaacaaaaaatgctgcaaagtactacaaaacacacacagattggtctaagcaagtacaaccgtggtacctaaatcccttcagggactgctgtattcaaattctgtagcatcctagaaaggataatttcttcctcaagaaaacccgagcacagaagggcgcgcttctccaccgtaaaacgtaacatactgtacatgaaaatgagaaagaaagagcaaaaggcaggatgaccgcgcgaaccttggcgtcgttgcggacgaactggatgccgtggccggggtagatggtggaggagcagaaccagcacttctccaacctcatcgcgccccgcctccttccttgccgccggactaccggccctccgaaatcgcagcggcactacacaagaaaccaccggtaagacacactccgatcggagctcgcacaatccggccgcggaccacgagagagtaggatgggatcaaatcaaaccctagggggagagcagggcggcgccgcggcggggacgagagcgagagagagagaccgacggcgcaagggttcgtgagattactagcaggtggaaggaagggccgggctttatatgggccggcacctgatgggccttcgtcatttcggcccatttgaaatttgcaacgtgtccacatcagacacaccagcggtctgtagccgagctgacgtcagcgcgcgcctagatcctctccgtcgatctcctcctctttcttcctcctctcttcccttccaaaaatcacacgccttcgcctctctcgtctcgtccgagtttccgacccgacccaccggcctctctcgagatccaccgaccaccgcatgcggcgggagcgcgcctcgtcgccggcggctgattgaccgggtggggcgccggcgaccgcccaccaccagatcccgaggtgatggaggcgacgggggcgggggcgggggaggagcggtgggcgtcgctgtgcaactgcgtggtgaacttcctgctggaggagaggtaccacctcacggcgctcgagctgttgcaggagctgcaggaggacggccgccacgcgcacgcgctccgcctccgctccttcttctccgaccccgcgctgttcccgcccgacctcgtcgcccgcgcgtcctccgcgccgcccggtgagcccctgcgtcccccgcatttgcacccccccttcccccccaacccttttcctcagctggctggatctcgcggcgtagtggcgctccctgcttcctgtgttgccattatgttcataatatccctgcattacgtccgaattggcgctgttgaattcatcttgttgttggtatgttaggtgtatgtgccttggtgctcgacttacattctacagacgatttggttggttagttacttcgcagttgaaggggcattattaatttgaacagtacaattaaatttacttagaccacacaaggcgtggcagtttcattgtttatgtcaccgtttgcaactacttaataatatcattaaaattgagtagcatatggattatgggccaagcaatgctatcagaacaaataaattacaggtaaatgtttgggtctgttcttggtataactcaacaatctactcacttttttgtgcaagcttatccatgtacactagatgcggtgtttgtgttcaatctaatgttctaacatctgtcattgagtctgtgaggtgattatctctatgtttttattgacaggtgctgatccacagagcttgctggaagagaaaatagcggcagaagaaaagttggccctcactgattatgatctccggctagccagagaagatctttccaggttgaagcttgagttacaaaagcagaaagaatcttctcctgatggctcaaatgctaccggtatgtaaccttgaaatgacaaatatagcgtgatattgtgtttcatgtgatggcatggagcaaaaactattgttttctgtttttacattctttgattgaagtggaatcaatagttaaagcatttggtactcagataagtgccaaaagtgaaaattatctcattattctgtggcttacatattgaactttgaaaattccatctcatgtgaggatgaaatatggctgtgatacgcgagagggtgtttatctcagtgatctttgggaattgggattgtattgaacaatattgtccttgttgtcatggcatttgcttgtcagctggaggctatatggtttaaaggaaataagaagaagtaccatggacataaagggtaacaggaaataaacaaaagacaggtctgatttgaaggttataagcattaatgtggcttatgctgggggtatctgtaggaacttttacactcaacaattcaataaggttgaacagaactgatgcattggctttgatcagttttccacaaacaagcttgagatattctagttacttttaagtaaaacacttgcctcttcaagggccactagcttgcggtgagcgctctgctgcagatttattggtgacatctaattatctagcttttactagataattcaaagtgagtcatcattcatcgtgttcattgctaactgatagacatacatatataagaggggaggtcctactgacagcgcgcatcatagcttttaactggtttttgagacaataaattgtactttttagcattttttgcactgtaccttaattatgaggtaatgatcaatatcagggcacacataccagctggagagtgcacagtttgagttatgctagtaactatgtactgctaaatgtaaatctactggcactggaacatagatccttgtatgattttttgacctacaatatgcatgtatttatttatgttaatttgttgattatgtgagcttaagaagctgaaaaagtttccatgaaaacaaatccatgctagacctatcttgtgcttgtaagatgatttatccatttggcatgctgggcctctttcagatgctttgacaaatgaaggatctagccatcatgacaaaagggatgccaaaatttcaacattaggtcctcttaaggataatgaacggaaagatctgaactgtgctgtcaaagaatacttgcttttggctgggtatcgacttgcagccatgactttcattgaggaggtctgtatcatattttctcttagaatttattattctttcatggcttcctcttgttgttaagtttattagggtttgtttatctgtttctcatgcaaaaagtcaaaattatggaacttcacgtcaaagtcacgtccttttctcaacaaaataaattcatgcaaattctgttcatggttgataggatgtgtatctagtagcatcacaaaaaattcatgggaatgtatgtacagaaagttatcttttaaaagaacatatatggatgatcctttcccagccttatttcatggttgtaaattttcaaatgaagtttgcatatcgccaaatgtaatttctacagatctgttcacacatacctatcccttgaaaatttgataggcataattagtagaagcttcattctgtggaatgaacactaggtgggtcccataagtgcttcaaagttccaacagtaaaaagtgctggcaaatcaattatgaatcaaacaaaacagtagaatgaacagttcagcttgtgtgcctgacgaccttcgtaaagcttactagatcattctgattgcaggttcctgatcaggaccttgatgtttggattaacagttcagcttgtgtgcctgatgcccttcgtcgttactactatcagtatctttcatctaccacagaggctgcagaggtgattccatggagttgcttaatgttcctacaaaagctgctaattgtttactgactacagcttgatgcattacagtgttacatgcgacaatattagatcctggtacatgtttgtttttaattccatcaatgtgtgctaagaatacacattatatttactccaaatcatattggaatgaatcttttccttaccaacatacttcaatgaaaagggctggaaatttgtggtaactagatcatatgcttcatcaatcctttgacagaatccaagtaacgtgctaataggaagggcctacatcatattcaagtttagtaataattacattctatggagtatgcatatagttgacacatttatcttattcatgaacaatgtgcaatccagttatagtgacacaaaatgaaataaaaccgctgcataagccatgagtcaatgttcatttcataaagtgcagtgcaagagtattttaaaattgattttcgagaatcaataagtagcaggattagcattcgatgcatttgatatgtttaacatttttctgtgaccattttgaggtatcacaatatttgactagccctagatgttattgcagtaacaatcataaacctgggggtttctagtgcattttagattcttatccaagacttgtatcatggtccaacgtgattaggatcacttggtcattcttcgtaattgggaaaacaggcaccacagaagtacatgactgagcattaaagactctgtttttccttgcaagcccataacttccatatattcttaagtcatcacttttattacatatcacaggaaaagatttctattctccgcgaaaatgagacgctactgaaggacaatgaaagtcttggtgctgaaaaagatgctttgataaagagcagggaagtggctaatagtcagattgctgctttaagaaagtctttggaagctgcacacaaggacataaaagagaaggagaaaacggtaatgatctctcagaaataacccagttatcttatacttcaattcttctgaacattgctacactgacattttaagaaaggttcaagacttgaagcaatcattggatgtccagaggaaggagttgaatgattgtagagctgaaattacgtcccttaagatgcatattgaagggactaggtcaagtaaacgattatcttctggagatactgatggtttaattcctgccaattctatggaagaaatagtagtgctgagcagtgaacatgacaatctaaaaggatccgaatccataacaagtaagctagcatcggaggtgagtctagctgagggtaaaaagaaagatcatgaaaatatggaaagtagccttgaaggttccccaggtccagaagcagaagtttcctgctcaactgctgagaacagtggctatggcacttcaggagaagataaatctggcacaaacacttgctttgaagatttatctgtcaatggcaatctgcatggatctggtaatagccagggggattcagatagcatatctgtttatctaactgacgataaagttcataccgagaaagtagagagtccttataaacaaaaatcatcagataagatggttagtgacttgatatatattcggtctgtatgaagttttcacatttatttctttgcaaatttcattaagcaaactatttttatccaaccatgcaggctttggagactatcaaaatagtttcggatgctcttccaaagattgttccttatgtgcttataaaccatcgtgaggtttacctgtaacccttgtagtttgtttcaatctttatataagtataacttatgttacttgctgcactgttgtaggagcttcttccgttgatcatctgtgccatagaaaaacatccagatagtgatgtacgtgattccttaactcatacgttgttcaatctaatcaaacgtcctgatggacaacagagacgcatcataatggatgtaagttcctacaattgcaataattggtgcatggcacatgcacttctcatgatgcagcttgcaaacttatagtactaggttaaattgtggttattcacataactgttttcctcttcacgcaggcttgtgtggagcttgctaagagtgtaggtgagatgaggacagaaactgagttacttccacaatgttgggaacaggtatttgacaatttgtggcagatattttaacctttttaggtatataatattacataatgctaaattggttgatgtttagataaatcaccaatatgaggagcgtaggttgcttgttgcccagtcctgtggagaattagcagtatatgttcgtcctgagatacgtgattcccttatcttatccattgtgcaacaacttgttgaagattctgcaacggttgtaagggaagctgcaacacataacctcacattgctgcttcctctgtttccaaatctggataaatattataaggtaagtcctgcaaatgcttagagccaataactgggaaatttggtttcttataattagttaaatttaacccgtcagaacttcctttttttagtggagaatatatgttttgattgaaagcttgctgcgctacaaatcaatgaaacataatacttattttggaagtcctcttaatttcctgtttgtttggtaggttgaggagctaatgttccagttggtctgtgacccttcgggggctgttgtgaatgttgctctcaaggaacttgttcctgctgttgtaagatggggagataaactggatcagatattgagaatcttactggcacatatcctggcatccgctcaggtatacatgtttgtaaattttgggaaccttatagtttctttgaagtgccacatgtgttctgacacaattgttatgcttcagcgctgtccgcccgtttcaggggttgaaggtgcaatagactctcatctccgtgttttaggagagcaagagcgttggaacattgatgtcctcctccgcatgttgaccgagttgctaccatttattcaccagaaagctatatctacttgcccgtttgctgctgatccttctacaggcactatgccagaaagctacttctcaaaatcctgcctaaaactgtatgcagcgtaagttgtcttcctctgtaatattgtgtgaaaactttactactccctctcttcttaaatgtatgacgtttttgaaattgaacggtctccaaagtgtatatttgatcattattttcagcagttatgcacatgaaggaacttgtaaaaacatgatatcttcaaagtatatgcagtggcatcattttcgaatggctaatctagataggtttagttatatcagtggtcaaaattaggatgtttattgcacgatcaatttaatcgaaccatcagagtttatttatcttctatcaactaattgtgtcctgggacacttgacagaggtgacacagagtggtcagcatttgaatggatgcacactgagtgtctaccggatttgatcaagcttgcttgcctgttgcctgctaaagaggataacttaagaacggtgatcaggaaggtaaattctacagatcacatcaacacctatgcatatccttccatcatggtatcatgtataaaattctgaccaatcatttcctgaaacttttttagtacctattggatgtatcgggacgttatggcatagattatctggaacacgttatgctacctgtatttcttgtagcagcgggggatattgacagcagtgatttcacctattttcctctggcaacccagtctagagttcgtggtaagtatcctgtattaatatggcaaggctgtttggtttaaattttcctttgttcaacatttgtatgtattgtgtttaaatcttgcaggtttgcgtccaaaaacttctattgccgaaaaacttggaattgtgtgtgtccttccattgttgttatctggtattttgggttatccttcaaaacgtcaacaattagaagaatatttgagaaaattacttatccagaacacgaaggatggttcattttctatgcatcacactgctgagatcattgacgcagttcggttcctttggttcgtgctttaactaactgaatccataatgcagccagtgtcacgatgttgttgatatgctctatgttaatgtgtctcacttattatcattatgtagcatgtttgaggagcaccatgttgctgtatttaatattgtgtgggagatggttgtgatctctgatgccaacctaaaaaccaatgctgcagctctactgaaagcacttgtaagcgtatcattaattcattacaagaatgcattggtagtttcttagagggttgaccacctttgccttcttggttccatatgttcctcatggtatccttgattgttttaacacacaggtaccctacatcagtgtgaaagtagcatcaactcatgttttgccagcacttataacccttggttctgatcaaaacttgacggtaaaatatgctagtatagaagcatttggagctgttgctcagcattttaaaaatgacatggtatgtatacatcttcatttattttctttgatactttatgtacttcgtgcattgccttaaagacttgctgtcaggttgttgacaagatacgaattcaaatggatgcttttcttgaagatggatcacatgaagctactgtttctgttattcgtgcacttgcagtggcagtgccacatacaacagatagactacgtgaatatatcctatcaaccgcatttaatttctaaagtctttaccattttttcatgattcattagattgcttgtgtgttctgttttctttgacattacatacatcttttaactaagatatttaagctaacgagcgccccacctactggaaatgatattgagcggcgtcgtgagatagcaaatgtattctgtgaagcactgcgtgctgtggatgctacaggttagccttatccaaaactagctaatccttcccttataccacaaccctgtaactttggtcaagtcggcatctgcatgtattttcagtatattttgtttatatttcaagatgcgtttgaaaagtatttagcaatgacatattatatcaggaattccatttacattagtttgttcacttgcatatccaactttgatcccatattagcttgttactgtcatattctgtcttaaactatcaagtcatttttcagtttttacaatgtccaatgttaggtataactatgggttcttaccatagcatactagtaaaaataaaactatgtaacggaagtatttgtgtgacaaacccaaatacattggtttcatacagttaatccatacaatttggcatgtctattaatggtgaatgttttgaaaggttgactgtatccttgattacctaatatagagatggagtaccatcttgtacatggtaaattgatgaagccaacagaagcttttgaacaatagactatgttttcatttgcaaatccattctaaataatttcagttttcaacatcacagggcagaattaaggcataaacttataagtaaatacagctgtgctgttgcttgagagtgaagcaatcatgccctttctgtgttgtagttaaatctttacaagcatatattgtaccttcggtttacttccataagacaatttagtttgacactcttcaaaattaaaatttaaccattgatgtctcataatatgtagttataaaagatgtaaaactagcgttgtgtgaaagcattttgaatatgatccttgcggtgtatttttcatactgaaagtacttataatctggctaattgtttgtcaaagtctaaaaggttgaccttttgaaatcaaaatacaacttataaaagtgaacaaaatgaatggaatgattaattaattatattttcttttttttgaacaaaacttaattatattttgtttagaggggtagaacatgttaccagtgttgacagaatcaacaactcctttggcttttgattcacaccagtttattagttgttagtagagcactgcccagtcatggtttaactagggactttaattgatgatatttagtaaaacccatagtcataagtctgttttggcttggccatatagtttaatctgccatttcttacatgtgttttctcttatttgttgcagatcttcctgctacaagcgtacgtgatctgcttttgccgtcaatacagaacttgttaaaagatctggatgctctagaccctgcacacaaggaagcactagaagttatagcccgcgaaaggtcgggaggtaaacttgagagccttggcaaggtaatgggagcacatcttgggattgcatcatcgatgagcagcttctttggtgagagcagcctccttgtgaagaaagagagcggggaacaacatgatactgctgccacgaccccctctcagcctaccccacaaactcagcaagagaacacaaggtttggtcgtataatgctgggtggttttggagatatgttacgaggcaaagcaaaaggcagcgatgagcccagttaaaatttaacaaatacatgcccagttgttaattcttcatatttttttccagctccattttctctggtaacatgtgctttttcacaaccatcaaggtggaaattctttttattcattgttggtaaggcggggaggtcacggtagacagaaaatacattttccgttgctgagagtaaagcatacatatttttgttgtaatcctaggtcaaactttctgtatagaaaacaggtaaatcatgttgtacattctgatcagagtacagttttagtaatgcaaactttacactgagttactcgtttatggttcatgactccaaattagcgtccaaacatctgatgtgataggaactaaactggatccaaataccaccttagtcagcggttgtcttctttgagagtgccgctgtcatagacttgttcagatttatacgtgccaaacaatgttctttgtaacaatctgcatgttaagttcatggattcatgaaccttgagttcagcacttagggcatctacaatcaaagctactccattggtactctcactaactgaagccactccatcccaatggaggatacctgtagctggactcttcaaaatctgaagcaactggatggagatactctaagggcatccacaatgtgagccactcctaaagtgtcctcactagaggatacttgtagggaaactcccctcacaatgaatgatacccctagtagcccacgagtgtccctaaccaaaaaaaacccacgtaggtattttactatactacccctctcttcttctcgcgtcgtccgcctccctaatctcctccacctcgcgccgtcgccggtcggggggcagcagatccggcgcctacggatctgcatcccccctcctggccagattgggaaggagatggtggcggccgtcgctcgtcgccgtcgctgtcgcctccgactcctccccactgccagcaacgagaccgagggtggaaggggaaatttgtggagcaggagccgtgtccacgagccacgccctcctccaacgcgtagcctcgagcggggctccagaaaagcagccgaggcac

SEQ ID NO: 67758 - DNA, 9777 bp, Oryza sativa
tctgtgcagtcacattgaagaggaagggagaggtgagaaatgagagagagaaacattttggacttgtttaagcattttgttggctcggagtccaaagtgatgagacgtgtacagagagagagggagaagtgaaagaaactgcccactccatctccatctcctcttcactctccgctgctctcgtcctgctccgatttcttgctctttatggcagggtgagtggaagatcgaatctcagatctaatccttgcgttcttgctcagcgaggatggaagaggagaagagaaggcgaggcagagaaagaggaggagtgcgacgcaactcaaggcgacggcgagggaggggggcgagggtgaatagggaaatacgggggtagggagcgttgtccacgagctacttccctagccacggtgcgcccaatgcggagcctggctctgtggctccgccaaaagtggccgaggggcgcgttcccccgcgagcaagcgcgcatctctggctctctcctaggggacgacgcgggttcgaaaggcaatgaaagccggatggtgtgagctaggactacgacccagagccacccattgctcatgctctcagaaggagacctcataatcttgagattcttaaagggaatccataagtatgttttaagatgaatgaccatttgactagaagcagatggttgctattaacattaccgaaaattcaatactacgctattgcactaaacaaagttgcaggtgcataacttcacggagtaaatccaaatctaaagatttgaatgttagctaagagattctacatttctactggtattgaccagatgaaagagagagtatgtgtttactatatctataaactagatgaataccctgccacgttgctgtgggaaattaagttgcataatatgtacaaataagatgaaatatgaatattaaaactaaaacaaattgatacttataaattttgaggcctaaaaatgattgagattacttggtgttatgagagaagaaagaagagacaatttgaactatagatttgtcatccaatggctaaaaataattaaggtgatgtggcttaataagagaagagaaaaataacattaactacacttagtggggatttctataagtatatagggtgaccagagctattgatttattttctttttttttaaaaaaaaagggtttggtttgcgtttaaatctacattcttgtttggtttgcctcgtggggtttgtgagtttgtgtcatctatccatgttgtcttgagatactatgaaaattaagatactatgtgagatcggaattgtttcggcttgatataatcgtaagatactagcattcatatcgccagtatcgggataactccaaagtccaccaaaccttgcggtggcggtcgcagtggcaggaatcgagaagaaagagtacacaacaacatgtttcaagaaagccagataagagcaaggataatagtaagctataagcctattataagcttacgtaaataagagaggtaacagaaaaaatcaagggtgttggctctcatacaagagctagcttaacacaagcttcaggacaaatacattaaatgtataagtgagatagagaggagaagaaaattgtagccaattttatagctaatatattttatatgttggctttaaaataaactaattgtaggaagtgagctctactattaggctgtgtttgctttctagtttctcatgaaaaagatactgtttagcagtttgaaaaacgtacgcggaacacgaggatatgagcagggaaaagttgggagaaagaactcaccattaatccattatccttgctctaaccacgactcggaaggcagcggctgccggctggaaccggagctaaatacagcgtttatcccgtcatagatatcccatgcaatgcgcaatgcggcggccgccgccgctcgccgcgctgctccgccgcctctcctcccacccgtccgactctcccgtagtccatgctaccctcatcaagtcttcctccctctccagccctatcccggccaccgccctccagccctcctcactgcctacgccaacgcgggcctcccagccgccgcgtcccgcctgttcgacgaaatgcccgcccgggacgccgtcgcctggaacgcgcgccccggcaccgcagcgtacgccttccggggaatggccaccgcgcggttcgcgcccacggccgcgaccctctgcaccatggccctccgccctggctgtcagcctgtcaggtccacgcgcgctgcgttcttgcatgccaggacgatgtcatcagggcgacggcgcttgtggatctctatatgagctatgtccttgttgaggaagcgatgaggttgttcatgtgcacagtgcactgtgcacggattgccaaaaggatgttgttctgtacaacgctgttttttcaggctgtgtggagaacagcagatcattcatggacgctttcttgattctggggaggattgagcttaatggaattgcgctgacatgtgctctcactgcctgctcagcgacagcgaatttgatgtacagtatgctggtgcagtgcaaggctgtccgtcatgggtctacttcacagacgatcttatgtaatgcactcattgatatgtatgcaaaatgtgggcggacaatggctgctcgcattgtgtttgaccaaatggcttgcaggaacgtggtttcctggtccagtatgattgatgcttacagttgccatggtcatggagaagcagcattaggtttgtttaaaaggatggagaaagttgcaccagtggtcttgccaaatgaagttacatttctcgctgttctttcagcttgtggacaatctggtcttgtggatgaagggggagctatgttgcatttgatgaaaagacaatatgggattaatccgggaccagagcactatgcatgttttattgatctattaggccgtgcaggccagaatgatgaggcatggtatctctattgtagtttcattataacccgaagtgagctttctggttccatctgtgtggctatgttgaatgcatgtaaagctaacatggatgtgttgagaggcaacaaagtagctctgcaccttctggaggttgacccagaaaatccaggaagtcatgtgctaatatcaaattttcatgctgttgctagacaatggtctgaatcggatgaaccaaggaggattatattggacaagggtagtctgggagtacagctgatcgacttcaactcatggtattaggacttgatgagtgatattgtcgtatggacttacaagggcaataagtggggaaggggaacaattcggttcagttttttactgtgggtacgagattatatggtagggccaattttttttcgcactagtgtaagtttgtaaagcagtcatcttgagaaatatgaaattaagcattgtacttagcttatctatgttagtaaatatgctatgaactacattacttttgttcatccttaaatatttttggattttttgttgcaatgacaacagttgtgccattggacatgatgaaaaaatatgtgcgatttaacatcgacacattgttttgtgtcaaaaactaaaatattccaagagtgacataaaatatgtctctatcctctagcggtacatgtgaatgtgttttaagattttaaaaatgattttattgtttcagataactatcctctgatatatagatcaattccagttatgtcttatcatttcacatattgttatctttttatacatttgaggcttttcttgttctgaaattttgttcaaacaactgagatcacttgatgtgacattgatagcataattcatttttaacctggatattaattttttatgtgattaaatttttggagtattctagtcaccaacttcagcacagatgtagcaaacataggaaggtggccaactattgaagttgcatgatctgaatgataaataaagactaaacgatatgatcatgtaatgaaactgcttggcatagtcaaatatattgttaaaagatgctataccggtttgattactttgttttggtagtgtggtaaattcttattagcttccttaaggggcacatacaagattccaagcctagtagtctgctatttagattacttgttttttttctattacttagaggagcacttatgatgcttggttctctgtagtcaattatccctgataattatgattagatcagtgaactgttctcttttgtaggaaagactggtctcgaactagttctatggtgacagagtctgccagcactgaacgaactgtctactggaaataatatgctgctacttctgcctgagacactggaggtgaactttagcaggtagtgccccattttgggaccccttttctgattaaatttggtaaatgaacaaggttctgcacattctcttccttttagcaacagatcttaaattggtatgactcgaagaatggtctcttcctttgagcaatagtatgactgaaatattgaagaatggttctactaccaaatacttattcaatgtatattgaagaatggttctactatcaaatacttcttcaatgtgttcccagtcctgacattgatcagttagttcctgctgaggaatgttttccttataactaaataatcttttgagctgcaatcatgtacagaaactatatttgaatctttggtaggttcattgcttgttgcccaaagctttttgaacaaccgatgcttcagatttatattcgtaaaatgtaaaataaacatcatttatcatatgatgtgttggattgcaatttctaaaaatgcacagaccgactgaaatcctagtattgcaggtttgcagtactaggtcaagaactcaagatgctttccaggctttcctaagggatcctggagctgcatgaagttggttttgaaagttttcaagaaatagtcaagtaagatatgtatgctcaagaagtattgtgttgcattgatgataacaaccaagttcatattctctattcatccataaataatcccgtagttctcccaaatgaaatcagaaatactcaccacacccatggtgctataagggtaagaccttttctttgcccttttattgtaaataaattgtggactttatgttttaacttgcattctagcaatttattctcatttttgtattttcaagcttttagctaatcatacaatgagtgcatcaatgttggaaatgtaaacggtggttgtaatggcttaaatatttcatccaacctactgcttttttattctggggtgtatgctttttgtatttcttggcatagttttgtccatgcccattcttggtttttgacttagtacaatctgttaacactcatcttttaaacctcaatggattgatgaatcacgtaacacatagaggtatttttcagtagtagtccacaaaactcgagagacgaggagtgtaagacacaagacttaactgcttcagcccgatatttgaaaattgttgcttcagatattccttgtgcttattttggcttgtgatatcaaagccatgatgcaaatacgatgggcgtatttgtttgaagaatttgctgccctcacggagtttccctttcccaaattccaattcactaggtatcatctatttaccactttcagaaagtccaaaccttgttaatattacctgttaataatcgtaaaagtatcggacttcattgttgtctgacttaatatttgttatgttcgatattcgactccagtttttccattattgttcttttcctttaggttcaaatgataggaagcctagttggtcactaaataggtgtggtccatggtggccctagatcttttcatataagaagctacgtagtatcacagtatgaagattttctgctttaacaatcttgtcaagctgattctggacatttcatattctttgcacctaattggggggttccatctccatgtgcacctgctgctccactttttgaaatttcattttcaatattttttttctctcagtgatttacataccatgagttgtgatatttttatttacactatcaatctcaacgtttattgctgaatattttgataggactcacctcatatttgtgttgtcacttctaacgcaaacctccatccatgctattccagaaaatgatagtggtaaagctgaggtttctgaatctcaagaagaattttcatgtctctttcttggtcccacaagtgacatgctaaaattgtgccagctggaaagaaaccctaatgcatactggttgattactctttgatcatattagctcatgaaagcgacctttgattgcttgaagcttgctgtttctcaccatttatcaatggtggatcacgagccaaagtcagtccaatgtaatatttgcagttatcgtgtttagttcttcaacatttcactcttttgtttgtagctgtaggccattggcgcaactcaagtgtgcaatgtcatccttctcaactctatgtattttatcatgttactcctaccacccgaagattggcatacttcgagattacaccgtgcatccatgtatgagagacctacagtaccatttggtccctggcattacatgactggctcattgtcaatgggcatggtcctttgcccccacatgttgctgctgctttgcctactaagtgatgggctgttgagacttcccttttgcaggaacatacattggtccccccatctcttgctccatacagtttccacaatgtctgtttcatttgtgttgtgtctgaaaggtctgaaaaccagaagccacctttttttttttttgcagtttaaaacttcagggataaagcctgcattcaatcatctacgaaggtaatttcttcagatcccctttttccaattttcccacaagagaggaaaagaagttccattggtatttggggcacttccatgatgctgtatgccatttcctgtatcactaggatgaagaaacaactgtctctgatagcatccttgccatatcatttgcaccacacctcaagggccctccataaatataatgtgtgcatgcacttcagcttgtttggtacatatgcattgcatatatgcttatatatacatcatgatatcagaaatatcacatcaagagagttcaaaagcctagtccttgctggttgacgccacacatccatcttgctcatgttcttatctaataattgcaactacattctaagttgcaaattgatgatgatcaaagccatatattacaaatatgtcggcatcttttcttccctttgcggattaaaactgcacataaactttcatccttccatttgcaaggtacacttcgaatcttttctatgcaacatgtctatttcctccaccatcaagagggacatgctgcttcttgttacaggtaatcaacaccctaaagctccttgaaacaaaagaagagcattttacccaaggtgtggattgaatgaatatcctgaattgaagatttcacaagagcaatttctcaatccaaacttggaggcaaaccctgccttttgaagttttttcggaggttcgtcccttttagctttctctggtaggtcatcaacggcctaattcagtacttgataccataatggacatcatcatttatgtgtcactctcatagttgttaggtgttcattagctccagcacaagcaattatctgtaaccagcgtgtgaaggttgtactgaacgatgaaagttaatgcagttctctcttctaatatagattttatattatggttatatgttagtaaatgcagaattagaacaataaactccagaccaaaagtaacagtgccaaagaggaaagtgcatgaatatttgtcacgaactcttggaacactcttaaaaaaaactattggaggtttggaaatggactcactaagtgaggttgctcagcttttgctagaaaagcaagcactattaagcaaagaatagggtacatccgtacagttcagtattttctgtttcgacaaagctagtatcagtaatattaaaaaaaacaatcaatgggtagcacatgacctaaagtcccaaacacgtacagtgcctggtgtttaacattcacgtgttagacgaaaaggtttttgcaagtactgtatattttatctttggtaatgatgggatcaatggaactgattcagatcctctttttttttagttcctacatatggtgcttcaataccatgcctattttcgtagccatgcatttatgttttctcattaaaaaatcatgctggattattgtagctaaagaaacaggttttccttcttggaggtttaagcaatttgtcaatcatcgccatcaattgtgctatggtaatttataagtaaatattgattacttgaagttaatgccatataaatcccttgataatgttgtcccccccccaaaaaaaaaaggctttttaagcgaaaatgacattactagaataatttgtcaaggaacatacttttacatcattatattctttacatccattaagttgttagaaaaaggcaatggtctcagaagcatgtatcttggtgtaaaacataggtctatgcttgacatcgatgagaccttgtagattctgatcacttggcaatgaaaaacaagttcttcttaagttggcaacgcatcgttagcaagggccaaggagggaaaatagtttgcttaatagtaaataaacaatatgtctacttcaaaaggataaacgatatatttggttcaaaaggtaaatagtagagattgcactcacctcttaaatttgtgtaccgcaggtgcaatttactcatagattattttattatataattgtattacacaatgtgacatattttatctcccataaatataaatatatgtgttttatatactttggccgatcgcaatcaatttaagattgcgtgctttgtccggctggtaatatcagagacggcaccgccacattgtcacacgacttttttttttgacgcaaaatggtgaagagactctaccttataacctgtatttaacggtgggtcaaagatacagaaattgaaagaaaaaaggaatagagaaaaggtaacatggagaggagggatgagagaaagaaaataaaaatacagcaaaagaagagagaattccagtataagaaagaagaagagaaaaggagaaataaagagatgttacaacattgatcagctgattacagttgcaatatggagaatcagaatcgtaaatcttactgaggactagtccaatatagcaagaaaatgattcgtttgggtacgtacggaagaatagttgatatatcatcaagtaccatctaacgatttggaagatctgtgatgatttctcttcagtaaacattaagtgcgttctgtttatatagtatatgtaaattatgcttttctgcagcaacattgtgaaatttctacagtaacattatgcttttgatttcagggctacttggatcttagagagttccgtaggaattttggcagattgaaatactaaggaatttttttttctaagtaggttgtttagaacataggttttggatgttgccaaattcctttggattcaattcctatacctcaattcaataggaaattagggcaacaccaatgtatttggcaaactagtctatagatgtgggacccacacctgagagtcatagttttagaaaccaccacaatatgtgcaattaaggtgggtcccactaaaggcaaaaaaaaaaatcagccggagctgaagctgcaggctgcagtatgcatgcacctggcataacta

SEQ ID NO: 67759 - DNA, 1941 bp, Oryza sativa
tgcacaatgtgttaagatagctgaatggaattttttatttcctatggactggttttcatgtacattgtggatgcccttagcacatgagctcaaccttcattttctttttactttgagaaatccaatgcaactcctctctgtctctcctctctagaatccatccaaaaaaccgaattgtttttctatgagccatccaaatacatcatcttttaaattcatgtgtgattcactccgacatgatattccaatccacaatactcgaccagtacttgcaacttattgttttcatcatactgttttagggtctgtttggcacagttccagctccacctctcctagagttggtgttcagccaaatagtttcagctccacctaaaataggagcacagcgctctcacaaaatgagctagagagatggaactaggtttaagctgctccacaactccacttcaaacccaactcctggaactaagggcctgtttgatacagctccaactcctaaatataactccaggagttgagtctggagtagagttgtggagttgcctaaacccagctccacaactccagtacattttgtgagaaagctacacccaactccactcccagttttggtggagctgaactgttaggctaaactccagctctaggaggggtggagctggagctagagctgtgctaaataggacctaaatttaggagttggagctctaccaaacaacaaactctgatgaactcttaagtaagtgaataggatatgattatggcttctttgtaatgcaagattttgaaaaatacagggacaaaaaatatgtaggaatatgatgtcatatccaatagaatcctatcggattcgaaaacaacgaaatgttagaggtagtgtctttaatcaaggtttttttttttcaatgaaaaaccatgaagttttgaggtttcgacgagcaacaaaagcctgagtgaaattttgaatggtatttgggaattcaaattcaaacaataaattttatcaaaatttgattgaattttgcaaaaaaaatcatattgttggaggttgagatccaacactcagttagaaagttgaaccctactttgaatatttcataggaaataaaacacataattttttcaggaattagagagagtgtagagagagagagagagagagaggaagtgtttgtttttctatggaatgagggacataggaaaccatttcgtaggatttcagaagtttcattcctatgttccaaaggatctcattagaaataatttccaaggattcaaatcctctaaatttcctgcgaaattccttcaattgatgcatctactttggtttttgcctacgtgtatacacatcaacggtgcaaaatacattcgacataaaaattgcacttggctacatatgtagacttcaacactccagccacgctacaactggctattgtttaaatgctcccagatgtctatttcctggagttaataaataggattaaattagctagatatatgcatttactttgatatataatacccatattgattgaaaacaacgatccaaaacacatttgacgtgaaaattgtattggttggcatgaaaatggtacagatgattttcctccgaaatgaatgagaaattctttcgtccctccaacgaaagggtactcactcaaagataaaatccagtgatcccttttgtgtaaatggtggcttctctggggtgagaaaaaaaacaaattcaactattatctgacaatccccacaacaacagagcttcattgtgggcaaggtggagcttggccccccaataattatgcactaacactgtacaacaaaacctataagatttagagcaatatcgtagtgattaagtttcaattatctgaacaaaccaacaaattattatgaagtaaggctgtgtttgggaggatagtttggaaactcacc

SEQ ID NO: 67760 - DNA, 1021 bp, Oryza sativa
gatcctaccctcgcggccgcggcccagcgcaaatcagacggactcccctacctcctcctccgacgagaaatttcccatcggaggccgtcgtctccgtctccccgtttgctactccggcgccggcgaggccacctcggtcgtttccctccctcctccacccactcgccttcccggccgccgcggagctctgcccccccccactctccctacgtctagctgcgctacttgttgtctcccccacctctcttcctctgccgccgcacagcttgccttcctcgtcgtctcgtctccttcagcgccggcgagaagccccccggccgccgagcttgccccgtctccggcggctaggcgctgccgcctcctgaccacgcgggttttctgcccctgccgctgaccccacccaccgccggcttgctagggcttattggataagatgtcgtccaagaagaactactacaaggagaagatgatgcggcggaagtaagtatcatttcatttgaaagatgtatttatgcatttattttgcaatatttcaactgattcgatgtagagacataatcgatatgttttggaactgtaggagaaatttattagaagttgattgttaaaaagaatatatcagaagttgcaacctgtgatgatatagttactgtttgcttgcaaaatagtttttgagatccagattctatgtagtagtgtgatttcgtgaatttttggaatgaaaacaaacgactgaagtcattgttcttgcagttaatcctatagccaccttgttagactgtgattagggtctaagggatcatacaagttgcctcactcactgaaccatcccacttaactagatgtctcgttcgctttcaacacactgacttgcattactataaaaagaaaggaattaggttcagtggtgactcctttacccatctgaaaaagttacctgcatgactgcccttatgtgtccgtattgtaggagtatatacatatcacaagctgttgatccagcagaatggcatttaagtgg

SEQ ID NO: 67761 - DNA, 2912 bp, Oryza sativa
  unsure (1)..(2912): unsure at all n locations
tatcttaaaggtgatctggaacatacacatttggtcaaaggcttggactatgctctacttcacaaagtacgaagtgaaatagaaaagaagcctgaagcagaagatggaaaggatacacagtcaaggtacttcccaccatactgcagctttagtttcacgccatttaattatactttctcttgatagttttgtaataatgagaagtattgtagacaagctatcagatccatgtttcatttcaaatgctgtaatatattgaaaacagtggctatcacttgcataatttttatgaaagcgcagagttgattccattaattattttgtgatacaacaaattgtcaaccttttttaggcctagtcctatttcttgtaatgggaggtgaagttaagagagagatccatttttctcttgttggaattttagtaggtgttttcctgttttgttgtggatgaatactgtcaagcagaattgttctgcgcatttcaattattcataattttactatgctttatagtggctgctggatcattctcagtgaaacatgatgttctgtacagcattctcattggaataatacaacaattgcttataggcatttctcttgatttgggatgtagcactatgaaaatatggtctcatgtccttcgtccttgtctggacgcacttcgtgagtttgtatttaactaggatacatatatttagcctgtgaatttgtgttgtacaggtctacaaaagaagatcaagcagtctcattccgcactgcagctgcaaaggtaggtttccttttaatttacaatagaattgatgttggctgcttatattattgaccatgtaatgtaatgtaacatggacactaaaagcagttcttggttcattgcagtctgtctatcaatggatcataaagccacaaagcatcataaagtcgaatgaaatgtttcttcctggtcggatggcatttatttacaacatggtacctccttcaaagttcccccttatgttaattacattttttttgtaattggtggtggccattttccttcataatatgatactacaatatattattttattttcatctctcatcaggattcatctgtacgaaacatgatgctgctatgttgcaaataaacgttattgctatttcaatttcgaatttttcaattctgtgctagcatgtaaatgataacatgcttatgttttgtcagcttttatagtatacatgatgcatgactatgtttcatgatgtattattgtttgtttctctgctcatcacctggaatgcagtacaatcaacatgctcaaactctcacttcactccacaatatgcaaacaagagaagaaataaaggaaggatgaaagaactcttcaaatatcatacttatagactatagtatagtattgcggttacatgtgtctggtgcaatgatttttatgtcatgcacatttaaattgtgattgcgatgcatcatggcttcaatgattactaatatacagtatgttcactatgaccatgatccatcttacaagtcagaaatcatcactagatcatattttgtatgcataatgttttcatttaatggatttaaccttccaaatgattttctgataataagagtaaaggtgttcgcattgcctattattgtggcatgtccagtactattgatttatgctatttgcaaataatttttttcatcattccctgctttgatttgaactacgggttttagctggagagtgattaatttcattaatgaaaccaggaggatggacttaccaatgatattccgacaacacttcacaggagcaaagctgattgctctgttccagaggtattatggcaatacatcatatgccacattgaagtttcctgaaatttattattttcctcagtattcttcttgcttatgcaggagatggtaactgtcagtgtggatggttctgtacttgataggattgctaaaatcatgtcataccttcgacttggatcatctgggaaagtcttgaagaaaaagaaaaaggagagggacacaaaaggtatgttacttgaaaattaaaatggattttgtgcagtggaagttgactgaaaaactaagtgacattaggaaaatgttcttggttaagataatatgtgaaatacgctgaaatgatttgtttggaagctgatacttgcattgtgaaaaaaagaaaagaaaagtatgattggtacttttttccacaatggttgagtcttgtttcaattgttttatagtctcacgtcaataatttaagtttgggtattttaagttatgaccatatgttacacgtttgttttacattatgaacgaattaattagttcacttaatgtatttgcaatgtatgtactttctcatccatatcttcacttgctttgctcgatgaagttagatatcttgattcttgttacgcagggaagaacagtttagcaagtggtgactacgatgaggtagctagacctggccaaactaatgggtctgctctgaaacatcaatttgaaaaggatatgccaccgccgccaccccctcgaaataataatttaagcaaaaatgagaaaccgtctgctccagttgctagagcagatgaagatgacatttttgttggagatggggtttactattctgttcctaacaaggaaatgagccagagccctgtctctgaagatatggatgagtccccacataaccatcagaagcagtcctatttcactgaagagaaacctatctatgggcccatcccaccatctgaccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 67762 - DNA, 2855 bp, Oryza sativa
  unsure (1)..(2855): unsure at all n locations
nnnnnnnnnnnnnnnnnnnnnnnnnnnnnnnnnnnnnnnnnnnnnnnnnnnnnnntatgcagtcattttgcccttgtttatggaagaagcaaaacttactagaggcaccaatattattctacttccctctctgtagtcaacagcaaaatacaatatgatctatagtatgatattacaataggaaatctcaagagtatagcaaatgttttctttaaaacaatcttgatcacatttgatttcattttaattttaatggcactggttcatgtacttagacagccccaaaactagtgagccaaaccaaagtataaactgtattttggtgaagggtacactaacgtgggacagcccaactggatattacataggtacacaatgttgttgtgttcgtgtatagtggctatgtacttccatccctcttttcatgctccttccattgctgtgggtgtcaccatatttttgtactttggagtcagtaaagcttcatgtgcggcgggcatactttggactattaaggtttccaatacaacttgaacttaggaatgaccctattatcattttttaatacaatcgtgacttgagttagatgaatgtccaaagagcaactttatatgccttctgcagccaataggtacatggtttagtacaactagtgaatgctcataacgatttccttttcttttatgatcttgactgcccatgatactttgcctgccatttctttgaactgaactatgacttaagttatttcagatacagatgggcatcattgttttccttggtgcaggatacaagatggtgtattctgaaagcatgacggaggatggactgaaggaagcttatttgtgattcccttctggaactaatcacaactgcctaagcaataacaaccatatttgaaaattctgctgcaacactgtatgttatattgttagacttgaacgccaagctgaaattgtattttggcattgccttttttctgagagagacctctctcctcaaatttctgttaaaaatttgttgcacgattaaaattatcatggccaaattttgattttcctgcatgatctagttgcaaactgtgttttacgtttgggtacatttgtctacattttttgaatggaatattggagttcatcgttgaatttgctactgtcataatatatcataatatagtgcatagttcttttcttctcatatacaagttggtttgtgtataatgcaagcatgtccaactgctcaagaagcaattgaggtttgcaagtatttgtggttgacgaatagcattttgcgttcctccgtgaattgttaactccagtctgagaggaaaccggagccttgcaaatgggtcatggagtattgacgatgggatcagaaagtgttaatcaaataccatcggcacttcttggcgtgccagacacatctgttctagaagcagaatcggaatccgttcattccggtcaaatagaaacagagcagtatcttggtgaaaactgctgcatcaatcgataatacaatgttctattttttctgtaactgtcataaacaatgttctggaagaaagcaaatgcgaagaaaaagggaacatgaaatcaaagtttggatttcttttaagctgaaaagaaattcaaagcgtggaaacgaatttgaccgcgtgacgcgtgggatgaagaggagaggagacaagggaaaaaagaaccttctggaggccggtttaggcacggcttttcttttttgtcttgcttcattctaaaataataacttcattttgtcttgtcttctgatttatctaattttaatatatttgtcccttggtttttataatctcgattagaattctcgttactataattgtcctataaatttagtgagatcaaagaatgtattgttgattttcgtcttttaagcatgaattagggggcttctttatagaatgtaagtatggtgttatccgggtagtgatgtgtgtgcgtatgcgtttaccatgtaataaaaaatgtctctaatattataaactcaaatgtaataattacttacaaataactgagaaaaaaaaagtaaattttagaaaaactgtaattatagtgagaaaactattagtttgctgcaacattagcatcatatttcagtttgttgtaattataccgtaggaaatcatcataaaactgtaactttgcgtagtatgtgtaggtgataacagtaagcttgggccacgtaaaagtatagttttgtaataattttgtataatatcattgcaacaaaccgaaaataggttattaatattgctgcaaactgatagttttgcactatagttatagtttttttgaaatttaaaaaaaaaaagatctactatacaccctccgtttaaaaataagttcattcgtaggaatttatatacaacgtttgacctttttcttatttaaaaattatttatgataagtattttgttgccattagacaataaaatacgaataattactttatgtataaattatgttttttaaatattttttataaaatatttaaataagtctagtggttaaacgttagatataaaaaccaaagtgaagatgtttttgaaccgagcgagtagatccaaacgccatcattccctggtgcggccgaaaccggtggtggtggtggaggggaccggtccaaacccgcggatgtcagcatccaccgtttcgcatcgcggattaactgtgttgctggaggcaggcaaggcatatgctgcgattccacgtttttttcttctcccaaataaaaaggcgtcttcgttattgtattggattccagagtgtgaaagctaggaacacacaacccacacgcctcgctgcctcgattgattgattgat

SEQ ID NO: 67763 - DNA, 1487 bp, Oryza sativa
acaccatctcctcctgcctcaaggccggcatgtcgggtaacggatcagccagcttcgatctcctcttacctccacccattgcgcactgttctaatctaatcctttcttcgtgtgtggcggaaattgcagttgccaggttcgatttctcgtggggagacgctgagtaccaccaggaaaccctcgaaaacctcaagctcgccatcaagtccaccaagaagctctgtgctgtgagttctcctgacaattcattcatgatctactagttagtcttgctgtctactaacatttgggagtcctctcgttgttgcgcaggtcatgctcgacactgtcggcccggagttgcaggtggtgaacaagagtgaggctgcaatctcccttgaagcgaatggcactgttgttctcacccctgaccaggggcaggaggcctcctccgaattgctgcccatcaacttctccgggcttgctaaggtataccttcagtagttcagtgttatttatatgaaatattatgattgtttttacttttgttgcaatcagatcggtccttgactgtttcctagagaaattttgtatgttaccattacgtcaccgcaatttgtagcatctgctatgtgaaaaaaattgactctttttgtcctttgcaggctctgaaaccaggtgctacaatttttgtggggcaatacttgttcactggcagtgagactacttcagtttggttagaggtaaaaatcttcagcatgctaaaactggtgttctgtgtttgtgatgtgtaatgtgttacgtccttgttagtaggatgtgcttgctgtctacattttctgatacctaatctccattctgcttgatataggtttctgaagttaaaggagatgatgtggtttgtgtgataaaaaattcggctactctggctggttcactgttcaccctgcattgttctcagattcatatcgacttacctacactgtctgatgaggacaaggaggtaaggatcgatcttatctcttagctaactgtagcaatatgaatatttctagtaaaactattattatttctgaagtttgattccctcactcaaaccatctgtagtagtggtattaaagcttaagagtatgcactgattccaggttatcagaagatggggagctccaaacaagattgacttcctctctctgtcttatacaagacacgcggaagatgtgcgacaggttagtgactaattacagtatggatagagatgcattttcctcatatttcctgtttgcccgttgtgcttgaaagttttgcaagtctactgtacagtgaaaatattgcatgtctatattccaatatatactctcctctacctcttcatttggtatttgggaagaaattctaaacagtgctggaatttctccttacattacaggcacgtgagttcctctcaaagttaggcgaccttagccaaactcagatttttgccaaaattgagaatgttgaggtatttgcaa

SEQ ID NO: 67764 - DNA, 1167 bp, Oryza sativa
taaaacagcttagagagtcaataaacccctgatacaagagctaagctccccaacacatacaatcattactcaaaagaggagtctaatcacaacaccactaggcttcgatcctcattctgtagttccatccatacatggagaagaactcaaggactgttagtcccaacctcttgcaatattcgtttaccatgttgctatcatcttccttaagaagcacaaatcaaagccttgcccaatatgagcatctgaaaatcacctctcagcctcacgccgccgcaaagacgtatgcatctaccgtctactttctctatcttagaaaaaaaaatcaacttctaaatacgttggatacgatcggacgttgttgattttttttatgttaccaatgcattctagtaaaaaaaaaatggaatggccaaaaccaacatctacccaccagcgatgcagccatcgatctctggctgccatcgaggagtatactgtatactcgatactcgagagactctgccagctgccatgatgtgcgtgtgctgtgcccggacgtggctgcacataaacagcttccagtccagatcgtcctgggaggtcggagaattgaactccgaacccccgctcggcccatccatgggccttcctaacataatacgcctgggcctacaagccaaaggcacaactcgcatcccacgcccccatggcccacaaaccaccacaaagaaaagatcggccgcatcgggccatcgccgcatcgatcgccttccgcgccgccacgccgcagcggcggactgacgacgccgtccgccgcgctccggcgtcccgctcgccgccggccttctaccatgacgatccgcaggtacacggcgcccgctgaccctagcccgcactagcagccacaagcggagacagctctgccgcactcacacggtcctgaaatcctgatgagaccttgtatgatgaacttttttttttagccctagatatgcagcgtgcctggaggtgtagatcacacgcaacgcaagtcccaacggctaggctcgatgatgagatgcttctgtttctttcccgattcacaggttaaactctcttcattcctcttatgggttttttttaaaaaaattaattcacatcatcagggcaccctgtaactacgcgttgatcaaacattgatttgac

SEQ ID NO: 67765 - DNA, 3890 bp, Oryza sativa
acttgtgctgaccatgttggagatgcaaaggccagccacttttaatcagaattttaactaaagttgacaagtccccatttgatccctttacaatgtatccataccacaaattaaactcttggaacacaatttggaagaactaaagaagaatcccattagcactgaatcacatggctagattctctctgcagtccacaggtcgtgcagaaaaatcagcaaatccgtgggtcttaagtcttatctaatcctgtgggcgcccattggttttgcaacaattaaacaaggatattttggtcagtacttcactactcggaacggattcaactaagccacacacaactatatataaaaaaaagatcaaaacaaaaggtaagggtttgcaacaagaccgaagagataaatagaatgcaaaagaatgacttattttttcatattttacagatgaaccttatccgggaccatgataattaagccgttccattcaattcaaagatgaggttgaagttgcagccacccagcttgctactgcagaagctgactgcacaactaatgtgcatttacatagactaatactgactcactgagaccctgtttagatgggactaaaacttttaagtccttatcacatcggatatttgtcactaattataaatattaaacgtagactattaataaaacccataaataatcttggactaattcacgagacgaatctattgagcctaattaatccatgattagcctttataatgctacagtaaacattctctaattatatattaattaggcttaaaaattttgtctcgcaaattagctttcatttatgtaattagttttgtaagtagtctatatttaatactctaaattagtgtctaaatacagagactaaagttaaatccctggatccaaacaccacctcagtcttatttccataatatcgatttgacaataaattgcgtacaactttttatctttcttcctccttttcttttttgtttttgttttcctttaagacgacattgttaattggcataattgcacaacaaggttttgccctgctgagcaatcaatgtcagagttttagctgtgccacagccccacaaggctcatttttgtatatgagggttttttatgtctctaaaaagttttttttaaaaaatcagcctatatgaaaggactgatttagtataaatgtgagtttcattttattttcttgtatttgtgtaaaacaaactgaaacgtcaaatggttttagcaaaacaatttgtcaaatgcttcatcgttctcctcctattgtgtcaccatgtcaagctcttcgcaaaaatgttagccacttgtgttcgttttgttttcctttccattttgtattgcaaggagagtgacttgccaatgattccttactccttggactctaggatattcttcttttttagcaatgagcatatggtgtattgtgtactacgtagggtgtcacacgatatagcaaactgggttttcttttattcttttacttgtttatacatgggactatcaacatatgtcatggcttgcgtaagttcgatattttaatgcacataattcgaattagactattaacttgagtccaaaataatggagtgttgcttttgtgcatacagacaaataaactgaataaaatacaaacgtagcatgtccggtggaaagttctaaaacttctattatctttatgttctttttatatttggattggatattcaaaatggtttaatgaaaggtgtaacatagtatgtaggttaatcaataatgtacctaaaatgaaaattagttcaacttagctactctttccattcccaaatataaacatttttgatatttaaattttgtacacgctcgaggaatggtaatttttggtaacgaagaacaagcactatacaatgcagatcagtttggcaacaagaagactgcatacattattttccggaagaattatgtatggttaaaagacatgaatattaaggaatgacctaatatcaaataattagatgaaggtatgcttcgaacccagattatctagctcactatcttgtgtagctagccagaaaacccctaggcgtttctcgaattatgtttggttaagaaattcattgggctaagactgaaaaaaaagcttacattaattaataagacctctaaatctatctacacctatattaattagacactctgaaagagcttatgtgttaaccagaaagaattaattgttgattaggtggatcgtgctatcacaacctagataatctgtgtaatgcatgggctggtgactttatgaaattaagtcctaaattcaacaaaattggctcggctcagagcagatactcgacttttctcgtccgctcagaggaaaatattattctctgaagacgtaattaacgatgagtcgatgactcatccctttgtcatccaattaatcatctaactgagttaattgattatccacttgttttcttctctaacgtaccaaagcgacatgtatggtgctggattcttgattccctgagtgaccaaaaaaatatcatttcgtttcttgcaaattctttttgtgcataattgagcgtacccgacgggaatggggaattagatgttttagtgcaagtcaattttaagacagatcattacgaactaaagggatgtttaatggtgtggacgaatttggggtgctacgtcagtcgttttctctacaacactacaacagtgtcgtagttcatgctgtccacttatcagcttgtggaggtggattctcctccgcttattttgcgattgctcaatcagcagatctggtcatgagatgctgcatagattattggggaatttgcaaattttttgatctttttttttattttacaagaatgccattcgaatgacaattccggtcataatttcctaatgacgattcaaatcgtggtaaatttgctgttgcccctagattatttgaatcatttttgcggtttgagtgaggaataattttcggtttgtggaaggtagaggtatactttggcattaatagggaggaatttaactatttaccatttttaggtttgttatttatccaaatgcccctcttaggtttgcgcttaattatttgctcccggagagagatgatttcttaactatttgccatttttgcctacgtgatatgcccgcgtggaaagcatcgtagaccccacccgtcatcccctcccctatcattcttctccacctccggtcgtcgaggtctccgtgctggcgagccccacccatggccaccacctggagcacccggattggggaggcgcactaggagagaccgtcgaggtcgaggaagaaggagagggcgcgggggtcgatggtagtcgtcggcaggatcagatgcggcggatggagggcgagcggtggcgatggtgacgacggctcatcctgatcctcccatcgcgaggacggggatcggatgcagtgggtggagggcgagcggcggcggcgacaacggctcgtcccgctccccccattgcggggatggggatcggatgcggcgggtggagggcgagcggcagcggcggccacgagcggcgagcgacggtggagaagaaggataggggagggctgacgagtggggtccacgatactttccacgcgggcacgccacgtaggccacagcggcaaatagttaagaaatcatctcttcagtggtaaattattaagcgcaagcctaagaggagcatttagataagtggcaaacctaaaagtggcaaatagttaaattccccttaacaggaggaattatactctttgaactaaaagatatacctatataaatattatgtagtgacacatatttgatgactgatattgcattaacagatagttggggagggaaa

SEQ ID NO: 67766 - DNA, 8334 bp, Oryza sativa
aacaagtgtcactcacaagaaatcgtgcaagatgcatccaatatattccatcaccatcctcacctcatctccttcgtccttgtttgcttccctcgcttcacctatcaacttcttcaccatgcttcacctaatcaaattagcagctactggcttcagagttctttttttctttgaacgaattagtcaatgtgatatgattctctagaaatatctcggttccgtttcttccattctcgcatccattttttcctgacggcccaattgttgattgtccagattagtaacagagtttaaaactttgtttcagaaaaaaaaatcatttatatatttttcttgctaggaagaaaaggtatcaaagttgtaacatctcgtgtccaacatttgcactcaatgactcttcatggactctttatggctgtgttaacctttggagcagagggttagggagtattttacccagaaacgttgatgatttagtctgggttcggcagctgtggattagaagaaaaactctttcgttgtgtgcgtgcatgcttcccaagcagttaaatggtacgtttttcataaaatatttatatagaaaagttattttaaataatcatattaatttattttttttaaatttaaaatagttaatactcaataatcatgtagtaatatttacattgttttgcgtattcttctcgatcttctcctctcatcttaaacacaacatatagtctattgttaacattctttgtaccttctttgattataaaatttatttgtaagtatgccgtatgttttgacgttatgcatctaactatggagacgtccaaagtgttctcagcgtagttctacgattttgatataattgactaattaaaacttacactccattaaaagtacagacataagctggtgtttttgacacgcccatgtgcacgagacgttttgttttagtcaggagaaaaacaattaaagaagattaatcggaggttaacacacaagaaaacgtcagtgcggcccccacgtaaacagagctccattgcttgggtttgtggctatataaagcagcttctcctcctccatttctccatccatccagtgtgagctccgtttcttgctccatccatctatccatccaaggagtgtggaacgccacacgtattttttttttatctatgctaatctgatcattagcagaggagagttttagcagtaggattggattaaattggagtagtttcatagtttgtgtgtagtgatcttaattagctttgattagacagacagtacagtagagtagaggatgttggctgtgttcagcggcgcggtggtggaggtgccggcggagctggtggccgccggcagccggacgccgtcgcccaagacgcgggcgtcggagctggtcggccgcttcctcgccgccgccgagccggccgtgtccctgcagctcggcgaccttggccacctcgcctactcccacgccaaccaatccctcctccgcccaaggtatactagctgctgcttctactctgcttcagctgaaattgctgaaaaaacatctgccgttttctttaccctgaactccccaagtcctggatttcacgagatctagctaagaacagagccaagaattgattgctctctgtggctagatcagttaactgttcatcctgagaggctgagacagagtcatttactctgaatttgttcttcagttagtgtctcggtgaagtctcatggtgatgagatttaatagttagtctctgcaagaagacaatctaagttggtggttgagataagcttttgcaagttgcaacaggctcactgttcttggcaacactagtcactgcgtggtgggcgacagcttttcatccaaggggaaaaaaaaatctgaggacatgttgctgaaatgattttttgtgcccacctgaaatggtttgagtgatgaggtgggctctcctagtaccataggtcatgtggacatgtctcacaactcacaagatctgacaaaaaaaaattctcaggtttggtaaaaacatatgcttaaaatgaattatcgatctgaaaaacaagtttatgtacagtaacttaaactgttattttacataataaactggtttcttcaataacttaagcctggttttttggttgtggcttgagtcaataattggagaggtacaaaggctttttgctttcggaagacagagtaatagatacaactctctaatccatttctgtaggtgaggaggcaaggctaccaaacctcctccttcatctatagttttttgttttatctatagaccacacgactgagatcatcgggattttactgataattaggtgattaactatggcatacgtttatttatttcagaaggtagaaagctaatcgaacaagaaaatggacgaaaaggaactgtcaaagaggtgtagtttgccatgctgctatggtacctagatctctttacggtcaaatgattggtgcttccataggaaaaacaagaggagaacaagacaggaaagaaagttaaatcaatgtttacatgaacattgccacatatatttcgatgaaagaaggccaccgcatcaccttttgttattttgcatgtccacatcaagccaccttccacagatacaaaggtttcaattgacttcacaacaaacgggcctcatattcttcatcaggcggctaatgattggactaattatagttttaagaaaatggacaaacctgttttgtcaagcctatttcttaattataaaaacttaaaaaggataaacatgacagtatttggcaagctactaggttgcttttaaaaacctctttgtttatgcctttcctttagttgttgtgccattcacatggcttagttcatagtaggagtgtaggacacttagcacttggtggctactgcttaccagaagactctatccggttttgatacccacagatctgaaagaaaggaaagctgaacaagggggccatgctgtcaattcagcactatgatttgtggggcctgattacccttttttcatatcttatctagtactactaggcagattcactgaagaagtatcatccaaggaattccactcctttactccattcattataccagtacaaaatatatgcttccttttcagcaagtttaggtatctaattcttgatgttaggtgcatcttgcattaagtcatagatgttccacctaattttgcattctgcactgaagtaccatgtccttcaggcattcaagaatggctgaactgataacaccaaacatactaattttcttaaattttgttgtggatgccagtttttttttatcatagggttggaaagcatctataattttacagctgctcactgagaacatacaactgcatttgtgcagatcctttgcatcaaaagatgacattttctgcctgtttgagggagtcctggacaatctgggcaggctgagccagcagtatggcctgtccaagggcgccaatgaggtgctcctggttatcgaggcgtacaagacgctgagagacagagcaccttaccctgctagcttcatgctctcgcagctcaccggcagctacgcctttgtgctcttcgacaagtccacctcttctctccttgtggcctctgtgagttcttcatctcgaggcaaccgacagttacatgctgttgctcaaacacttgcattgacagtgcttggtgatttggttggtttagcttactgattatgacgtgatcttgtgctggcaattgttgtctcaggatccagagggcaaggtgcctctgttctgggggataactgctgatggatctgttgccttctctaacgacattgacctgcttaaaggatcatgtggcaagtcacttgcacctttcccacaaggtaatgtttgaatcatagtccttttatgttgccaatcattgcaaatgacatttaaaatggggcatttagtataaaattgtgggtcagttgaatcttcactgctcaaatatgtgcaaagagccatttttggttatgctcactaattacatgcattctgactgcaggttgcttctattccaatgctcttggaggcttgaagtgctatgagaacccaaagaacaaggtgactgctgttcctgcaaatgaagaagagatctgtggtgcaaccttcaaggtaaaaaggaaattgatttcttgccaagaatataatgttgagggaaactattttgatccctcgaggggatcctaattaacttgactcaataaaacagaactccttttttcatcatttgcatttgatctgaactcattcgacctttctggatgcattgctaggttgagagcgccactgcaatcctcacagctctgcactaggatgatgtttcggtgtccggtcgttgtacatggtggtggtgtaacatagttgcaactgatctgtatcatcttttcataaaagagaagtactgcctgcatggcaagtgcttcagtgttctgggtgtgtagtatgatctctgtacctttgttgttcaagcaggaatgaactccaggccggctgtgatcagttgaatgtagttctgttgcaaataacctgtccttgtcagttgttactatggatgtctgtttgatgtagtgatgttgtagatcactgcatttcatgaactttggtcaactagtagcaagaacagagtgcagaaataagcaatgttcagagtagaggtggccaaacgggccgggccaaacgggcggcccggggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcggcacggcacggcccgcggcacggcacggcccgtttcgccggcggcccgtcaggccgaaagcgggccagcggcgcacgcgccaggccgaaagcagggacagggcgggcggcggtcgaatgggaaggcgccacgtggcactaacggctatttgaccgttcaaatttgaaaataaccgttgggaggctaaaaaattcataaaaatttcgaaaaaattccaaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcataatggatccgaactttccataccagtcgccgtcgttcaccttgggtgatttcgaccccaactacatgtcgaggtttgacgatacctccggatcggctccaactccaccatctgtgaggaggtaccggttcatacggctgtcgttgaggaggtaccggttcaggcggcgacagcttcggaaggattttccggaaccgcgagcggaagtgtttcgacacacaccggctcgaagagatcgagaacctccggtgtgtggcaaaacttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatatagaagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaatttcaccaatttctagaaactttttatgattgtactctaactttgtcacaagtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgcttttgcttttgttttagatcctaggtgtaaattaaggggattatctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacatcaataaaggtcattactatttttaacaaattcttttgcaatattttcgcaagtgtggatttatctttaaattatttcaaaataataaatcacaatctatatttttaaatttttcaacacaacaaaaaaataccattttttcttttttttaacattagcaaatcattacttttttaaaaaacttttatttccattttttaaataccattttttaacattagtaaatcattacttttttttaaacattttatttccatttttaattttttttccttatacatttcctttgctttttttttaaaaaaaaacactgtgcactggcggcctggcggctggcggcctggcggcctggcggccagtgcagctcagctgccggcctgccttcacgggccgccgtgccccgaacggcccgtgggccgcaggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggacccgtgcccgtgccgggccgggccgtgccgcccgtttggacacctatagtt

SEQ ID NO: 67767 - DNA, 2265 bp, Oryza sativa
aagcaatgttcagagagagttattctgattgtggaatctgaaccacctgttctttccttctgcttatatttggttcagtaaatcggtaaacaaggtctgattcagtttgagacactggatgactggaatcgggagctagcaagctggagctggatgcacgtcttgggacatgatatccgtatgaagaaattgccttggatgtgatcgatcgatagaccacctgctctttctcaaaaatcaaaatttctgcttcatatattcgtcgctggcatccgcagcttgcaccatatactgtgctcgcctctgtccgcttgattgttcaaccgcacgttctcgatcggacggttcccgtgttggggggggggggatccaacgtaagtgcaagggggactcgagtcccccctacacccacaaaacccatggataccctccggagcacccccttcaattttttcatcataaataataaactaaaggtctctagatgactggaggttgaaaaaactgtgtaattgagtccccccaatttttttgttcctagatccgccccggggggggggggctaatgcgcgacacgcgactacctgctactatgtactgtactagtctattactagtagtactactactacactcctattactaatactactactataatactactactacattatggttatgatactactaatattactactataatatatttttgatgtataaaaaatatacacatatacaaactttatatacgtacgtatacaaagttcgtatatgtgacgtatataaagtttgcatgcacgtacacaaggtttgtatgcacgtctataaagtttgcatgcacgtatacaaactttttatagatatacgtaaatgctaaaaaatcgaaaagaaaaaaaacggaaagaaaaaaactggaaagaaaaccgtaaaaaactgaaaagaaaaaagtaaaaacagaaaaaaaaaacaacgggaaaaaccgtgcgccccacccctacgcatgcccgcgcgcgccacatgcctcgccgcgggggagggggggtggtggcggcggctgatcgctcattagcgattttggttcccgtgagcccaagagaataattccccgaaccccatgaacagcaatttttttaagccttgcttttgttacagacgacatttggcctttgttcgaacactgagtcattcatagttcagataaaaattgtactaggagattagccatagtggttgataccagttttggggtgtttgctgaattcgtgccacttgggggtccgttagaatcagctgaaagaactgagctgattatggctcgtgaaatgaaacaaaccagtatgagtaattaaatattactaactattaccaatataaaaatcgagttatttgatttttttaaagaattttttacatataaaatatttgcatggaatgcgccgtttaatattttaagaaacatgctaacagaaaacggggtagccccaccatatcagcacttccgaactatcacactcaagaaatcaaaatttctgtttcatatttgtcgctggcatccgcagcttgcacgatatactgtgctcgagtgctcgactctgtccgctttgttctcaaaaagaaaaaaaaaagatgctccaatctgttcagattgatggtggatgcgatgaagtgatctggccttacactaaacataagtcctttactgccaagtcaatgtacaatctgctaacctttgggggattaaggattcagacatgtaggctgtttggaagagtagaattcctctcaaaatcaagcattttctatatttatctgggagaggaaaacttccttgtgctaatcaattagttaaaaggaaatggaagggtgggaatgagctttgtaaactctaggaaaactgaaacttctgaccatattctgtttcactgccctttagctttgtttgcttggtgtgtgattgaagaggccttgcatttgagaaggagacatatttcattctgggattgcactgggtttgtttgggataggggggagaagatggtttggatggtcttattggccagtgtatgctgggcttcgtggctaataaatgattgggcttttaaggactttccggtttcttctcctttacagggttatttacaggtcactctcgcttgcacagaagtggaaggtgttcctaaggggagaagagcaaaaggtgctggatggctggcatgaagccattctggacaaattgtatcaagtgaagccgtctgttct

SEQ ID NO: 67768 - DNA, 1488 bp, Oryza sativa
ccgtattcgtgtatgagcatattcgattcttattcgtattcgagataatccgtatttgtttccatattcgagctatccgtattcgttttcgtatccggtaaaaaatatgaaaacgaatatggtataagcattatccgtccgtatccgctccgttttcatccctatatgatggtacgttaaactacttcttttgttctaaattctgttctaaaatatatgaatttctgatattcaaattcgttgaaggcaagctatgagaaccttcgacctattctgctaaagcagcagcgacaacaacaaataagcctgatgaaaggcacaaggtaaaagccaggctacacgaagccagaggctaaaccgctgaggctgtgtttattttacaccaaaattaaaagtttggttgaaattgtaacgatgtgacggaaaagttagaagtttgtttgtgtaggaaagttttgatgtgatgaaaaagttaaagtttgaagaattattttgaaactaaacacggcgtgagtaaagcaccaggtggcaataccttgacagcaaagcgaagcaagccagggcagctcactgaagaagagaagcgaggaggcagcgaagcatgttcggcttgacatgccaaaacaaggggaggcctagtaaacggccccatgcgactctaataagacccatagaccgatcagatggaccaaagagaacagttaccctttgtagatgtcactatcagagaaacaatcatgtaaatttactagtgcactaaattataagattataaatccggattataaatatataaaccgactccaattggtgtgtctaatagagggtcggatttttaaattactatacaattattgctttccattccattccacaaagtttaaaaatacaactgaaatgattaaaaggggatcttttgatctaaccttattagttgttaaataacttagaagtttttatattttaaaacagagcgagtaattattaactgactgaggacaaaacaaaagggaaaacgatggcatgcaggaagattcggattgtttgttctagcagtagctaattaatggccgcttttgttctctctttccacaacatgagatatacatgaggctattctcgacccaatagctagaatggtgtccatagcattaaataagatgccacttaaaataaaaaatgatgtggcaagtgaataaataaggaaagagaaaaaatgtcttgcatgagacatagtttctacacaacatctaagatatcatgtgagataatgagcattaaatttaattatgaaataatagtgtttgcattggaaaaatggtgtctagtactagttttttttatgatgtgaagtttatggaaaatatatctagtgttttgggttgggaaggcctgatcgactttcacagtgcacttgaaaagaacgcatgcatgtttaatctaaggagcatttgctaattgatcagtaatagtactagtattagcatg

SEQ ID NO: 67769 - DNA, 3174 bp, Oryza sativa
atgtttagagctggggtcaattgtatagctggtttttaaactttactagtatttgtgccatttaagtctttgtactcttgaaatgtagaattaagagtaaagtgaacatacggtctctaatcatatactccctccgttctaaaaaaagacaaacccaggtttccgtgtccaacgtttgaccatccttcttatttgaaaaaaatataaaaaaattaaaaagataagccacgcataaaatattaatcatattttatcatctaataacaatgaaaatatgaattataaaaaaatttcatataagacggacagtcaaagttgaacacggaaatccagggtttaccttttttgggacagagggagtacatgtgtactacctagatcactgaactcttaaaatgtattttcgggtctctcaacttttctcgggtctcatgtagattcgaacaggctccaacccactccgtgtgctgacgtggcatgccatggtggtccctacgtgtcagtagaacccatacgctagtcacatatagaaaaagtttaagaacattttttttctcctctcttctttcatttatttcttcaaaattaaaaacatccttttctcctctctctctctctcctctttttcttttaaaaaatatttttttctctatgtgactaacatgtgaaactcattgacatgtaagttatatggtgccataccatttcacagagcgggttgaaacccgtttgaacctatatatcactcttaacaagtttgaagacctaaacatatattttgagagtttagggatctaaatgacatattcgtacaagtttaagggccacccatgcacttcactctagaattaatattgtaaactttgtcttactcatcactttaaccaaacagtcgcctactcacttttgtgccccaacgtagagccacaatgggtccaacagagcttcccatgcatgccctctcaaagggagtagtatatagcatggttgaaatgagccatgcataaaaatcaaatcaatacccaaaatccctagttctcgtggtgtccctaattcatcgcctacaactcaccgttagcaaatccctaactctctttgagccccaatttactatccctaattcaaaatgccgtaagagcaagtttaatagtatagctaactactagcttcaaatcaactatagtcaacttaatagccaattcatacaatagttacttacaaacatatagtacactattaatatatggtcccatatatcatatacacattgtgtcttgaagtccgtactacatctagctataaatatgtaactcactgctcttctctcctcttttatatcctcaatataggtttatagctgacttatagtctactgttgtacctgctctaattgctttgattcgacacctcggccattggatccttcaattctattgttgtcaccaatgtttgctcaagtttggtggtgtttgaatcttctgaagataaagattaagtgtttcacacaaaaagaggtggtaataacgtgtgattaattgagtattaattattataaacttgaaaaatagattaatatgatattttagaacaactttcatatagaaatttttcgtatgaaacataccgtttaacagtttgaaaagcgtgccacgaaaatccaaaatttcatccactgcttgtagcggaaacgaacaggaccaaaggttgtcacacagtgttggcttgtgaagcagaagcgcttcagcgatggtttggattagtgatgaacacaaggcgggatgtagatcgttttgcagtagtactaatgaagtagcagtggccgacatgtggatccagatccatacatcaatttatgctactgcatcagcaatccccaccgcaccagtgaggacctatttgtttcgagatttaaaaccgctcctcaccggttcaccaaaatcagtatcctgttcaagtcaaaaaggacatccatgacagtgaatcatagcccgtgaaaatggattatttcagatcattccatcgcgtgcatttccagcctttctctgcgcctttgcgctggccaccctttgcctagctagtcgcacgttacctttatacttcctccattctaaaatgttcgacgccgttgattttttaaaaatatttggacattcgtgtttttttagataatggatattttatacccggcttcatctatcaaaagatagactcatgccaattataacaaacgttcttacagagtaacacttggaaacaaaaccgagataaaagttcagacgactaaagaccgatgtgtctagctgataaccatccattggaactaaaaaattgcaaagctgatgactcaagatgttgcgatgccgcgatcaactgtgaacgcagatcctcatgccgttgcagcttcgcccattggcgtaaccaatgcgtacccctgaatagtacctgcaaaaaagatttcggtccgtaattgtcaaacactaactcgtttgttgttaaccaaactgtccagaaaagcgctgctgctgcagttaacagtaaagtattttgttttttattaccccccttagaccactgttggaataactcaactaagtttgatggggtacttataccaaacaaaatatgaaccgctcgccacaagaacttggcaatatagcaatcaaaaaacaggtgttgaattgactcaggctgatgacagaaagcgcattttaaatcaccatgccaattcctcctagctaaattatctttagtaagaatgacacctttctttaagtaccacaaaaaaatttttatttttgaagggaccttaatttgccaaatatcctgtgaaactctaataccattactgattagtgcagcatacatcgatttgacagtaaaatttcctgaggcctgcaaagaccacacaaacgagtcacccccatcctgtaataatacttcctgtatggaagcaagcactctattccatctactaagattcgctcccaccaaattccgcctaaacgaaatattcagaggggacgaactaagtactttggccacagagtcatttttccttctaacaatattaaacaatgatggaaatctgtcctttaaaggtttattacccagccacgtatcgcaccaaaatctcgtttgcgatccatctttgattttgaacgatcccaagcccag

SEQ ID NO: 67770 - DNA, 1777 bp, Oryza sativa
acatgtttgtggtgtttaaattcacatgattccactcaataggggtttaaatcctggtgtggtgtatgccaatattacatatatgagtgtgcataagaatatcttaggaagaacatgtaactgtttttctatttcataacaaattaatagagtgcacaacataacccttaataatcaaagaattttagtgacagtgtaaaaattacattagttgatggtttgaatattataacaacgaggctgtgttcgggaggcgaggttgggaaccttgcctcctgacacggaaaacgaagcacgtgattatagtgagactaattaagtattagcctaaaaaacttgaaaaatggatcaatatgatttttttaaagcaactttcatatagaaaactttttaaaaaaatgcaccgtttagcagtttgaaaagcgtgcatgcggaaaacgagagaagtgagctgggaaagaggggtaaagaacacagcctaagtgatttcgcgtacatagcaatgctattgtaaatgattggagaattggagaggcgtattctcgttgcatgactggtttgattacactcatgcatgtttgtatataatcataacaagtcatcagatttagtagctgtacttcttttgataaatctttttggtaaattttcatatgatcctactcccattgttcctagcttattagcccaaagctttcacatctgaaaaaggcacaccgagtcaggggcgaaggcaggcctggaacaatttgagcttgggtcctaggtttgcctctacaatgatgattaaattctcttaattcactatgtaattttttttaggaaattaatactctattagttaaaccctacttagccctaggttaataatttctagctccatcattgcaccgaatggaacttcgcatatctgagtgagagccatgccccgagtgctgctttcttcggtaaatagttcgttaagtgtcaattataaaggaaggaatggagtattaactcgcactaatccttatcgtcatcattctcttcttcatcatcatcaccaccacgagaaacgtctaagggtattttggctagctcaccgaggtgataagctagtcggtatgggtttatagcctcaccccttctaattatttgatattaggtcattccctaatattcatgtttttatcatcatcaccatcgccagttcgccaccatcttcattgtgcctcattgacagtgagctcgaattacggctgtgttcttttggaggggttgggaactcctcccctccgcacggaaaacggaacgatagattaacacgtgattaattaagtattagctataaaaaattttaataaaaagattaatatgatttttaaagcaactttcctatataaatttttcacaaaacgcgtaccgtctagcagtttgaaaatcgtgcatgcggaaaacgagggaaagaacatagcccttctcgacgaactggaggagcaccccctccttgtactccatccttatgtcctgcattgatcgagcgatcgattgatgaagcgcgcgtggatgattattagagcagccgtaatggtaaagtaagctgctctctataaaacttgtccacctcatctatagactattttatagtaaaccatcttaatggtgtgtctacaaggatatctatagctgtttttaatacttgcatgtacatatgaaagacaatgatcattcgtgaataccatccctgtaactacacatgtggctacatgaaaaaaaaacacagaaacatgattcactt

SEQ ID NO: 67771 - DNA, 3871 bp, Oryza sativa
acaataactgaatgttttgtcttgatacctgttcagtgttcagtcacgaagtctcaaccatgtgcataattttttttccctttctaaactacatgatttaaaaattgatcatagcaattgatagtcgataggaattactatcgattttttttggcagaatagtctaggtcatttgtactgattgctctattttatccacatttactagactattgttctgttagcatgcaagttgagcattgaatttttgctactgacaggaaagaactcaggttaaatgtttgatttcacataaccaaaaaaaaaagcaatggagaggcagatgatctggtaagaacaactgatgggtgcagcactgcacaagatagtaatctttttatgacttcatccattcaggtatatacgcatatatccattcaggtatatatgcgtaagaacaactgatgaggcagatttctctactattattgatagcgtacactatgcacacattaatttaatggtggaatagtcattgtcgttaaaacaattaacaacggcgcaatatcaccatcgttaaataaataacaaggacactatcgtggattctatattttgaagaaagtttcactcaaaagtgaatcagatatgaatcagtactgcaagaaataagtatgtcttgtcatatcaattttttttaccacgcaaagaaatattttatttaccgctctaatggatcgttggatgtattttgactgccttggccatctggtggtgttggtacggcacccatccaagctccatatggggaaacaaatgaattaatctgcagtggaggtgctgtccaccaacctacgtcagaagcacaccatcattagttttctgttgatgacctattcactagaggctggaccaacggagacgacggcggaaagtgcgattttacttggaacagccatggcttcaccagacaaagggaaggcgacgccgggcttcactacaccaccccaccaaggaacgccgggaggcaaagcttgaggcgttggaggagcaatctcccgcttggatctatggctcatcacttgaggtttgaggagatatgaggattagggatgagtttcaggaagactgagcgacaagcggtggatttatggattaggggcaaacttggcttgggtctaccgcgggaataagagggtgatttggcgcataaactacgcgggaagattagcagccatggggatttggcgccctagagaagaggagagcgcgcgaggaggaagacgcaggggcgtgcagggaacacccgatcccctttggcgagaaaacgcgttgaatagcggcagcttgtgtcgatacggtgtcgttgcgagtctcgatttgtgtatatcggctctcgccaggtctgtagagagctgtgttctctttcctaatttattgtctttcacctaggagagattgatgacatggatttttgtagagtgcttaacggcacctgttgcggctgcccttagcctttgccgccgatatcgatcggatctccgactcgggacacaagtatgtcttaaaatcgcatcattaatcttaatttagatataagttaatgatcttgtgtgcttccatagttccatcaatcttgtttcctgttgagtgcattattaagcgcgcgcatcactagtcttagttagatataataatcatcttgtatgttttcatcaatcttgtttcttgtcgagtgcattaagccctatgctggaatttgtaatttttaagggacaaaccacttcaaactttcgatgagagagagcaggaaacatagtatcattgctagcaacaaacaaatattaattccgcaccaaatactgtcccaaacaaatgagtagtccatatcccactaaacagtagtattacttcactcaaataagaaacaaatatgaattatgcatcaagcactgttccctgctgttttttagataatggattaagaaaccggcctctacatccaactgttccctgctgttgatcggtgaagtttcatttcgtcgtcagatggaagggctcgtgaaatactgctgtcattgtttgcttggccagtaaatagaaggcgcttatttcatcctgttgaatatacaattggcgaactaaatctcctgtgttggttgaacctttattctgtttgttactcgggtaattacaacttggactttgttgattctgcttcacgcagttgtgcgtacatatctgcgatttcttttgcaaagtatgccttagcttgcggtcttttgatctgcaacatcattgagatagagaattagcaccttaggtatcgagatctcctgcaacagaattaacgggcctaccttgaatgttggggtgaggagaccattttctagtgtgaaaggctcagcaacaagggtaacagctttggcaaattcaaaacctcttagctggtacagtaagtaagcacagagagatagataaggatcatacacatcatacagaacttttacttattaagagagcatgtaaggtaagaactaagaagtgaaaattaaacctgtgcctcctttccaatagagtccatgtcagccaggacagcagctcttgcccttgtatcagcgcatagctgtcttaaatcctcgtactgtaggttagaaagggaagatcataacataagcaggcaatgcggatgtaaggagctctatttgtagttctgttttttaataaataaaggcagtgtttgtgtagtgaactggaaaatatataataacatacaagaaggtaatctgctgatttggagaaactgggctgtacaaatgtatagtatgtactctttacttcaaaaaaaaggtcagcacatttacctggattccttccgatgcagcccaagccttcaacacctctggttcaactgctactacggcaaccaaagaagagtttaaactatcacctgcattcaaatcaacggcttagaatatacatggtaaataattagtacgtaataaccaatataagatcatgaatattaccatatataaagcactgcgcaataaacttgcacttagcatagacattctcaatcttctcgggagctatgtattctccttgagctaacttgaaaatgttctttttccttgagaaaagaaaattgcatcaattaaaatttaataagaaaagtaatcagacgaaacagagttccaggggaataaattaaaatagatagcctaaaaaattgtgtggaaagaggataaataattacagacaaaaagatttcagaatagagttgtggttatttctcaaaaaacatccatgcattacaacatttcgcaattgaaagctgtctgctacaataacagtagaggatagttaaggtttgctcttcgatcagtagatgaggagttaatatcttgcttttactttagtcttttagcacactagttttaaccttatcaagtccctaccatcttagtatatggtatgtattcacagaactacaaaatacagcaaattctataatttagaatagcagtgagctttcacatattagagtttcatcaccaaccatgcaaatctcatataacaaacaatataatggtgagaagaaaatagtagaagctgaatgaagatttcaagtatgcattaatatttaacaacttaatttagcaatcactgatctggatatcattaggaaactgcaaggaagctaaaagtaagtcctaagatgtacaccctctctttggaagatttgaagcatagaaaaaattgtgtgtttaacagcattaatctcagtgtaactacagttatccaaacagtgaccaatgaatgttggatcatgcccagggcttcttagggagtttcctaataggtcgcttgggtgaggttgttttttagt

SEQ ID NO: 67772 - DNA, 4420 bp, Oryza sativa
atctgaaatttccctagcgaggatgctaacagtagagagtgggaattttgtctcaaactccgtagaaactagaattctgtcaagcttctcaaaagtttgattttgtaagtgatttgcccaagtaaaagatctccctgatgactccaattctctaagattcaaagtgtcaattactgcattgaacagaaatggccatctatcgttaaagttatcattatttttctcctgtgggttacgaagtatattaaagtcaccacctacaactgtaggtatggtttctttagagcaaactcgtactaattcagagagaaaatgaccttttaaatcagactgtgctggaccatatacagaaatcaaattaaatttaaaatcatctgctctctgtcttaatttaaagcgaatgaaaaaatctccttcctcaatttctccaatgtcaagaaacagcaaattaacacctagaatcataccaccagagcgccccctaggggccatgcagtgccagatgaaatctctgccagcacaaatattatttaatgttgactgaggaaaagaggctctgcccgtctctgataaagcaataaagtctagattttgctccttagttagatcagacaaaaatttatatttttgttattcaaaaaatttaagtaattattaattcttgtcctatcatttgatttatggttaaatatacttttatgtatacgtatagtttttacatattttacaaaagtttttaaataagacgaacgattaaacatgtttaaaaaagtcaacggcgttaaacattgccgttaaacatttagagaaagtgggagtaatcggtagaacctggataattggacagtggagtggtgtctgtcggtgcggcttctcgatcgggtgcgcacggtgagtgaacgtgatcgatcgatcgatcgatcgcccggggcatcgtgggaggatcccgggatccacacgaccagatcgtaaagaggagaatgtgtgtgtgatgtgcgcgcgtgccggcattcggccgaatgctgtggtgaacggccggcggcggcggcacatggacggagttagtagtacattgattgcttcgatccatgatccaaaccaaccaacgacctgtgatgaatgctgagcctcgccgattggccgtcgctgtctgttccatcggtgagaaagtccaaatcacgtcgttatccgccgcacctctatgctagcgcttagctcaggacaaggcaagaatgatctactccctccgccccaaagtataagaacataaaatcagatcaaacatttaaacattttttagtcctgtgaatctgaacaaacaaccagtctagattcgtagtactagaaaatatctcatctggtactagattcttaggccatagccaacgctccatgctagaccgtggtctcacctctcccgagatgaatatttgcgccacgttagagggagtcgcaccccaggagaggttgcgaaccttagcagaggtgcgggtagtttcgtcagaccacggctctgacatgcaaggaaaaggtgaggaagcgcgttggggagaggcctcgccctgtgccgtcaccctgcgccgttgcaattaactcactcccgcgcattgctgccatgaacgaggtcgagaagggccttcccggcggcgcatcggaggatgacagtaaggtgcttcatcgcgagaagacgccgccggtgactgacgcctctatctgcaccgttgttggctatttcgtcgccccaaccattgttccaggcagctccgtcgccgaagtcatcggaccgttgcccggatccctattgcgtcggctcgatctccacctccaccgccccccgccgtggcgatcgagtcaggcaacactgaggggagagaggggagaggcagagagacggcgtcgccggagacgagaggggcgaggcatgcgtgaggaagaggagcgaccggcgaggcgtgcgggcgcgtggaggaagaagagcgatatgtgcggcgctgcgcgtggggtaaggaagggattggatgggctgagagaatatgacaatgggccatgtactaatacgcaattttttctctacacaaagggctgacatagaaaaatgtttatgggacccacttcaaagtacggagaatggttgcttaagccgggtcttggaccgcttttgctctcgtggatagtggggatgttgcctgcgttggtcttagccttatattttgggacgaaaagagtactaggactgggcaaaggttgctttgctgggcttcgcagatctctgcgagtaaatttcaacatgagaaaacatacgctgattggtactctgtttaactgtttttgaaaggcgcactgttactcctactccactcgcttcaatttcggctcgtcagcgcaagatcagacgatcttgatttactccggaatttcctctgaaatctgtcaacatattgttgttccttttttttcccatttgtttgattgtttgacatggcttctgaaacttcctccccttgttaaacccacttcacagctagaatcgcacagaatacggaaatgttaaacaccggtatcccgtttgggctcgatcgggacaggacaatttttttagcaatcaccagaaatcatcacgagcttatccgagtcccactcccaagagagacacaatgtttcttgtgcttatccgagtcccactcacaattctctcaccgtgggcatggcgcgtgagatctcgctggcgccaacggcggcggtggaggagccggcggcggcacctgctcgcgtccgccggcggcggcagctccacctcttcagtgtcgccgctgaagtgcacgaggtcagtgtgggagagcggcgtgagcgtggtggtggcgccgacgccggcgcccaccgtgttttcttcggttgacagtctccatcaacaggaggttcttcattttcttgctttaagcagtgtcaagaaaatcggtgacatgaattggtacgagcatatagatgatacatcgatcgaatctgatatgaacttattcatgtccactccctgtacatatatttgatctggaagttgacggaagcaaaaatcgtttccccatatataaacaaatgaagtgtattacatggggtaaacctttttgtggagtaaataccagccatgatactgaggaggatcatgacacctcccaagtatcacatgatcgtacttaggtataatctatgaaactcacatgaaccatgataccagtcatgatactgagaagaatcatgatacctccctcatatcacatgatccttctaaggtatcatctatgaaatatgatgataccagacatgatacctgagcagaatcatgaaacctcctacatatcacatgatccttctaaggtatcatctatgaaacctgatgataccagacatgatacctgagcagaattatgatacctccaacgtatcacatgatcttcctaagatatcatcagtgaaacatgataataccatccatgatactgaggaggatcatgatacctcccaggtatcacatgatcatccttaagtatcatatgtgaaacccacagaaaccatgatagcatacatgatatgtaagtaggatcatgtgatacttcacaggtatcacacataatgatactttgcagtatcatgtatgaaactttcaggtatcacacaagatgatatatacctagcgagggatcatgtgtgaaaccttcaggtttcatgataccgagaaggatcgtgatacctcctaggtatcacatgactctactaatgtatcatccatgaaacccgtaggcaccatgatagaagccaagatactcactgtcttgatggtgttactctcattcacagatttttcctgcatatcacctcgattcttagactgggccttctcaacatgttgtcctcccattggtgtcaagttcattgatgcaagctttggtgtcaagttcattgatgcaagctttctcagctaaaccttgtattgttttgattgcaagatcatatccttgtaaaacacgattccgaggatgtttcatggggaagcagaagagccagcggacggcgaggcttccgctggaaagaagcgaggaatcgcgcgccgcaattccgaggaggtttcactgggatgtagaggagctggcggatgatgctcgcgccggtggaaggaagcgaggaatcacgcgctttctaggaggatttgccatgatgcggagaagccggcggacggtgcgcgtgccagcgggaggaagcaaggaatcgcgcgcgaaggcgcgcgcttccgaggaggtttcgctgagatgtagggaagccggcgtttggcgagcgcttgtcgtcgttcacgttttgctgcaatgcacgcaggtggcggacgacagttgctgagagcgatgtgatattggtaccagaatcgtcccctttt

SEQ ID NO: 67773 - DNA, 10891 bp, Oryza sativa
ttgaaaccacagacaaacatcttcttgctgcctatacaatcaacggatccatccccaacctatcaattgccctcacaatccctcacatttatccgttcctatcactgttcataagtctatttgaaaaagaggaagaaaaagaaagaactgtccgtaagactattctgctactctcatgtccttctctgtcgacaaaaccggcaacagattgttcaggttaaggcacggtaagattattactactcctaccgtgcatgagagagagatagagagagagagagagagagagcagggcctacgcttaaagccgccattattgcggcacccctcccctgccacaataaagctaccacttcaaaccagctatatggacagctatcctaacactctactactacacagggagagatgatcactttgaagcaaacaagaatagcaacctcagcctctgcaatgattcagtgcagttgcaccccccaaaacatggcccggaactcgcagcttatttttttgacctatacggctaataacttttctcatgtgtgttccatgcgtaacaaataagcatcgaatctaaatcagacactttaaatactcatatagctaactctttaattgatttggatagttaaactaggtccttgctctaacgctctttattttaccatctccaaaataacaaaggacccacatgtcagtctctactagcattcgttcttccttttctttctccccctcttcctcttcacccgctggggcaatggacgagccgacaacgcgaggccacggcagggtcgctgggcagcatagcagtgggtcgcggcgataggggcggtgacggagggcggcggcagaggcgaggcatacaacggcggcagtaaattggcacgggtgagacaaatggctgcgacaagggcgaggtgatgggtggcagtgacatggggcgaggcagcggacggtagcgagacaggcgagccgggtacaggaagcgacggacgacaacgggatagacgagttgcagagggaaagcaacaatattatatcggcgtgggttaggcgagccagacgatggcagacatagggcaatgacggtaggggcaaggcagatggcggcggaggcagcaacggcgaggcagcgagcgacagcaggggtgaggttgccggagagaagaaggggcttgtgggagagaaatttggtgtggggtccaccatttggcaagtgggtatggatggccagatttggctagttaggagagggatttggccatccaaatagcttggtaaatcgaatagagagtctgttggagtatgttgttttgctagatttgccaaaattcggcttggagagcaatttggaaaggctattggagacttggagttgctctaacgaatggaacaatggattaacatacatgcttcctaagctctcaaactatgtgatttttaaagccttttatgtacttctgtaataaatttatttttagtttcttctatttatcccaagttcatttttagagaaattattacatcggagtttgtgaaagtagtgaataattatatttaaagtagatatagtcagaaatagttgcattaggatttgataaagtaggggtattctattttttggttttgtattggtatatgtgggatatgtgaaaaatgatcttattttggtacagaggtactccgtccgctaatataaacatttttatagttgaacacaaatattaagaaaataggtataatcaaatgggcgaaggttgtgattggtttagtggtgaaggtaggtgaggaaattgaatgttagagtgttgtgattgattggaaagataatgttggtgaagaaattgttatattttagggcaaatatttaatgctagaagttgctaaatcttgggacgaagggaatattaagtttataataacgaatactccctctgtcaaaaagaattcaatcatggggatgaatctgaacatagggcttgtttggttcaataccctaccaaaatatagtttttgcactaccaatttattggtagggtagagttgtatatggttcgaggccaatttagaaccaagctttgagtagaatatagaaaatatcaaattggatattggcaatgcccatgatttggtttcaaaccaaaactgtcatatacactgttcaaactaccaaaatattggtagggcacgttttggcactaatccaaaacggcccatagtgcatgttaggtttatttgcaagattaattttttccttctgaaaaaggagggaatacgctatttgtgccgttgaatagggattataaattatttaatcatttagcgcaaaagaacaaacctcccaactgccatttagtgaaagagaagggattgtactatatatttcacacaaaacaatccctaatactttgaaacccgtgtaaatcccaacaaacataactccttctccttcactttttctctcactacgccacacaatacacaacctcctacaccatcgctgccccatgatgacgttgcttggcttcgccgattggacggaaaatgtcaatgaatccaacaagccccctacaatctcttacttcccttccgcaagccaatggcgacgaggtgcctctatctgttttgccctcgccaccaacaccaacccactattcgttgtcgaccgtgcggcttcgttgccaccgccgtcgtctcggcgtctactgcctcccacgatctcctccctcccctcctcccactgccctctcacccgtattttaacgtgggaccctagtttgtaggtcattgatgggagttttgtgtgtccccagtgttaaagaagaagggaggtcgttagagctaggggagaaaggtttgaaacacgaatcgtgaagcacatttgatgatccaaaatctataatatttaggtatagattttctgtcgatagaaggtaaagctatcctgaaaaagaatgccctagcattccattccacatcatcacttgcccacttgagagttgagatccttcctcctactccaccggatcgctttggagaaagctgttgcctacttggacaaactcaacgcaaactgaagtttacattagggcatcatcaatgtttgtggtgtagtgtaatcttaaggtgggccctataaatagtgagccattgttatagccatacccataatgctatggttagaatttagccacaagatggccacatagaattgaaaaataattgtttcatctcttgttcatgaagtgaatgagagagaaaaaatattttctttttgcttgtggtagaacttaagcataaggtgcaccctaagctaatgctactttccacaatgtatatagctcactttacaagtgcaatcattatcttaaagttatctttttcatacattgtggttgcccttagtagaaaagaaaggggaattaaacggctgcttgttcgaagctggtacaatcatcgtggcgaggggcctctagtagtttaatggaggcgtgattaatgatggtaatctacggcacggcatgtttttggttccaattggggacagcggattaatctaatccgagggagggatgattgctgctgctgatgctgctggtcccaacagtggagcacccctgatacggagcagagcgtgaggttcctgcgcgaaatccagtggggatggatccaccattcacgacaactaacatcgaatctcaagcatcgagtgtgcggcaaataccatgccaattaaacaaaaaaaaacttgtactgctatctctgtagccctctaaataatgacggtactaagatccgtttaggtgaagaaaaatgtggtcaggacagtggtatgatactgtatttactattccaaggcttaattagcagcagtacactagcagtactgcatactgtagaaaagttcagacaattgtttctctgatcgagtctgaatgctactgcatacgatattttttttctcactttttaccgcggtagtagttgggggtggaatcaatcgttgtgagggagagggaccaggcagtgctatgaacaggcaggcagaagcagtggtgcttactgtggtcataggattgaaatgtgcaattctggtgtaagccaacctgaatgcagctgctgctgataggggacagcgctatcttaccccatcaataatgtaagtgcagggtgcaggaaaaaggttgcaaccatggccaaaactgcagcagtatgactctctcttcctccccctcctcacacatggaccaccaccaccacaaccatcatcatgatcaatccatcccctctcctccatctccattgcattgctcccacaattatcattgttatcaccttcctcaccttgggatggagtattatagtctttcttctctcataaccaaggaagaaagaatagcatggcattgagtagacaacattccactactagtggcatgtaaaaagagctctgtagctaggcaaccctccactgtcacagtcacaaaggcacaaacaaacatttggcaacacattttgctttgcacattgttcatctaccatgcatcaccacaacaccttatggagcaagaaggaaaccaccaccaccaccttccttctcgaattataaagcaccatcatcatcatcatctcttatgaaaaactatagataattactatacctaccttcgccttcaaggaagttgagttctcctttaaaagaaaggtgaaaacgagctaagtaaaaaagaaaaaagaaaaagaagaaaaaaagaagagcgatctagatgggactcatttcccatggtgtatactggttgactgatcctgagagcatctctcaaccatcatgatggcgatcacctgtgacctgatgagcttcttcctcagactcctggttggttcactttcttgaacaacaaaatgagcagcagcaacaggaggaggaagaaagcaatccggacactggagacctcacatcaccgagcagctgttcgggttctcgtcgctgaagtagttgtagggatcggcatgcgggtgcggctgcattgggtagtgcatcgggtacggcatcggcggccggccgtacccgtaccccatcgccgggtaccccgccggagcagcgccgccgccgtggccatggtgaccgtggtgaccatggtggccgtggccgttcatcatcatctgctgctgctgctgctgctgctgctgcatcatggccatgtactgctgctgggccatggggttcccggccgccgccgcggcctgcagcatctcgggcccggacggcatgccgccgccgccctggtagaacgctgccggtggcatgccctgcacggcgccggcgcccatgtgggggtggtggcccatgggcatgggcatgggcccgccgcccatctggcccattccggggaaaccggcactgccgcccatcatgttcggcctcatcatcatggcctgctgctgcgccggcatgccgcccatcggcccaccgacaccgccgccctggccgccgccgcccttcttcccctgagcagggtggttgccgccgccgttcggggcgcctcctccccccttggcgttgttcggctgcccgccgccgttcttgccgccgccaccttggttctgcttggcaccggagtctttcttgccgccgccagcggcgttgttggcgttccccttgatctgcacggggatctcgttgccaccgccgcccttcttgccgccattgccggcgccgccgccgttgttgccacccttcttgtcgccgccaccaccggcgtttggtggcggcatggccatctgcttcatcatcttgggatcgtcgaagtagtcgtcgtcgaggccgtcgtcgtcgaaatcgtcctcgtcatcgaactcgtcgaactcgtcatcaaactcgctgccatcgtcgccgaagtcatcctcgggaggaggaaggttgaacttgacggacttggggtccttgatcggcgcggccgccgcgaacggcgccatcttggcggcgtccatgaactgcggcaacttcagccccttcatctgcagctgctgctgcagctgctgaatctgctgcggcgtcggctgcggcatctgcggcggcatcatcatcttcacgtctttgctgccgcctccaccgttgccaccaccgccgccgccgccgccccccttctggcccttgccgccggcgtccttgggctggcccttgccgccgccatccttgggctggcccttgccgccgccgccgtcaaggtggagcttctgaaactggttgttcaccgccgccaccccgaccttggaaccccatagctccgccggcttgccggccttgttgagcttcttgataatggtggccggatccaccaggccggacaccgtcaccttcccctgctcagcgtcaatgctagtctggtacacacctgcagagataaatccaacgagcgtttcactcagaaacagggagtaaaaaatcacccagaaaattaaacaaccatatagctgatgaaaacaatttggttttaaaaaatttctctgtttttcataccttcaatcttgtggaggatcttcttgaccttcttctggcacccatcacagtggatgttcactttcagcacacaagtctgggaatttgggaggaacagagaaacacaggtttaccaaaacggcaaaaacagagatgttttcgaagaaaacatagcaggagacatgggaggagcacaaagtgaaaaacaaaagctagctgcccctgcctgatgaaaatggcagcaaaaacaaggagaaaaaacagaatgtctgtatcaccactagttctggttttgagttgaaaagaagcaaaaaagaagaagaaaaaactgacctgaatcttcaggacttcctccttactcatccctgaccacctcaagtgcggctccccccaccaacacaagcacaagagaggcctcctcacagatctggcacataagagtcctcaaatcagggacataacaacaacatgaagaagacagcagcaaccagcaaacattgccttctctcaagaaaaaaaaaactctatgatgagcaaaaacagagaagaaaaatgccttcttgctgaagataagttaatggcctccaatataatatctctccttcacacactcacacaaagagtaagtgctatggagagagagaaacatagacaggattattagagttttgcgtgtttgcagaaaaccaagagggatgggggggctcctattaacccggtggtccagagcagaagaaggaagagaaggaggagcaagaagagagcctcttctctctactccacactactcctgcaaagcttaatataaacacacaggcaacaccatctcctcctccttacccttttattttgctttcgccttcggcagtgcagcctgcctggaagaaggcctttctcttttgcaccctccacacagattgtgaaggaagggaagcctggggctcttgcaaaagacttgaagagaagagagattaaataccactttgtcacatgtcagtaagtacagggagatgttcaacatgtgaggtactcagatgttacacccaagcttgcgatgtcggtttttttttttttgcttttttgtaaaagtgtccaggaaatgttgctctcctgataatttcatattagcccctctagcctctgtagtattatgtagcattttggtcctgggtttcttgtgttcacctgttcatcaggtcaaaaagatttttctgaatagttctagagggacttgtgaaaatttagcaaattgtacgtaggagaacaacgacgtacacaaatatgatccatgcagatattaatattttacgtgaaaaatccatgcaaccattcaaaccattggttgatgcacgagcgcttgtcctattcggtcgtaactcgtaacatatttcgtaccactgacgaataaggtagctttaaatgatccaattgtgaaacgtgtagtcgttatgattcgccaacgtcattgcaatgcccgtacaaaaagatatattacattttagttttgtcgcacgccacattatttgtcggcatagacgttacataattaaagaaaccattttcggttatatacgacaacaactggccgacttcataaactcgacaaatccgtgttgccagaaaccgatgaaataggcacaccccgtttgctcccgtttatcatcctactacttcaactcaaataaggaattaacatggaaatgcagagcaaaaataggagaactccattacatgacttttttttttactctgggcaaaaggactcaaccataattaccctcttacgaagggactaatgcgcaaaagaagacgaggagggggttccctgtgctgatcacgcccggtcaatcatgtaacacgcggctttggggcatcgcacgctgtgcaggcaaggcaaggcaaatgtggtccgtagacgcgccgcggccacgccctctcatctctatctctctactctatctcccctggctgcgccgcgccgcgctgccgtggcgagcgagccgtgcgcggcgtgggctgcgcgcgcggtacgtcgtccactactgcaaaccgccgcgagcgagacgatgatgcggtcacaccatcctcgcgtcgcgccgtggcgtggcgtacgtagcgcgaggcggagcggcagcctgcatccatccccaagcctgtggtgtcagaggagggtggtgagcacaataactactcaggctttctttttattgatgacgccccttgtttggcctttgctcctctgcagtctgcatgcgtttccaccctgattttcttggtccactcttccgttactgcctttttcactactcctactctccaaaaggaagagggagaaaaaacggctttggtcacgctgtgacggatggacggttcagggctcatgcggagtagcagggtattgcagtgcagctgttgttgtggccgatcgtttggatccatcgattcgaggatcggtcgtggctttgttttgacgttgctgacggacgcgaatggcagcagcagagggatcgatcgatcgatcgatccatggatgggtgacagtttgcgcgtcgctgtcgccgcgcttcttctgctcgtgcgtgacatgcacactgttcgtctgtgcgagggtgcgcttgactgttccctccacacggcatcggcgctaaaatatcatatgatcagttccagcattcgagccatgtatatggactacatgatcgatcgatcgatcaagcagggaacagttgggttcaggttcagagaggattggcacgactctgtgtttcgtaaatccgttgaatctttggagatactactagtattacaatatcaagcaaagaaaactactgtatctgtcacaagccaagatactggtactgtactgggtgtagttgagctagagatatgattgcatcatcacgagcaaatcgaggttactatggatttgttcgtatagtctcatctttgacgaagaggcgccgcaccggtcatgcatgctgctggagctagactgatgtcagggtatttgaggtggtgctagagctacactgatgtcagggtatttgacggtttgcactagccactgatttttcaacctgcggaaatttgctgtcatccatccattccatgggttacagatacatctactggtagctgtacatgcatgcatatacgcatgcgctcctaactgatcgactaatctctgtatgcatttgctagtatcgtgtttggcagtccaaggcaagatcatcagtatcgggatacatatgtatcgtagattcgtagtttctatgatattatctgggtgaaacgatacatgttggttttaggatcgttttcagtgtatcacattagtatcggaatatggagtgtaagattgttagaatcgctctagtatcgagatactaaccgtttaaaattagacattatttgaattcaaaaaatcaaaactatctaaatgcatttgtgttcatgtatctttaaaatcaatgtaaataaaactattagcattagtggatgattttctctttgacatatctctctttattatggtatatattattattactttttttagagtggctatatataattaatataaattaatattaaattattttttaagaaaaatatcatagtatcatggagctaagttggatccagatactaacaacctttgtccagaggctagttggacacacatgcatatatatccatgagtcccatcatttcacctccagttgattatatgatgtactacccccgtccaaaaatatagcaatgagacatgtccagatacattatcctggacccatcctaggttgctatattttgggacggagagagtatggtttattagtaataaaaaacaatgtatagtttaaaatttttatatatgtatttttagcgacttaaaaattaatattaaaaaaaacaacgatgaaaaatgatcaaaattgactttaaaatttatattttaaatttcaattttagcagcagccgataaacgttcatgcctgtacacatacttttttttttaagagaaaggcagcaatgtacaaatacttgattactactacaagaggacatatggcagtagtcgacatatatacacgtacagcgtacttgaattttgtacacatgtagtaattgcttgctcgcattcaggcttactactgtacaaccacaccctgaatgcagtactgcatatccgtgtgactctccagtctccactagtgaagtatttgttctctctcccatatgagaacaagaggctttatgatcatctagtcattgacactagcaataaattggctcgacgtattcttttgcagctgtgcttgcgttaacccatctccataaaactccaagagccaaacagaaaaaaagaaagagataagagtgatc

SEQ ID NO: 67774 - DNA, 1071 bp, Oryza sativa
catatgcattttggtggtgttcgcctacttagctgcagcctacagggtcagccaccgccatgcaggaatcagtcggtgacatgttttttgactgatcatgctttgtcagaatgtgaatgccatatgcaggagtagatgtagatcactgcatgcatttttttttgcaatcctgcgtactccctccgtataaaaataaacaaacatagtacgaagtgtgataatataaatatcgatagattatatatcgtggaagaggattttgatccctcgaagagatatctcctcgttgtttgcatatcacttaaatggttataaaaaaatttaagaagatgtattaatatgtgatatatcactccacaaacatgcaaataaaaattcaacttctagatctcgcaacgaaaaaaacaaatttgactctgaatatacgttaactagctgtggttcaatttgttttttcgttacgagatgtagaagttgaatttgaacttgtatgtttgtggagtgttatatcacatattaatacaccttcccaatttttttcaattttttttattaccatttaagtgacatacaaagaacgaggggatatcctctcgagggattaaaacagtttccctatatatcgtactagatttgtttcttgttttagaatgaagggagtacgtgcttatgttctgaattctgtgattgaactaccgaaccgaatatatgatcatatcggtcgatcatggcttggcttcggacatgtatggaaagcaaggaatggtttttggccggctttgcacttgtgaatccaagtgacagcaactgaactcacaagacaatactccaggtcgatcgtcgacatcagctacgactctgacgtacgcctacggaatcgatgcaaagagatcagttgtcctatactataactttagctaattgcaaatggttatatacacttcattggataccgacgtgttcctacaagacgcgacatacattcatgtcggcacgtcaggttcatgagcccatgtttgatcatgaaacgtcacaaagctttgctatgattcatcatttgcaacgatcggt

SEQ ID NO: 67775 - DNA, 6389 bp, Oryza sativa
aagcagattattgaattgaactatgggcatctacgtacgtagcaggggctggaccagttgctgtgttgatctggatcaaaccaggccggcttggtcgccatgtttgggccacatacagtacggtacagctctgaactgatgtatgagcgtctgtatagtcttgtcgtcgtcatgggcctccgggaccacgcgtaggtacggggttgtttggttggtatactcatatcaccaaaacttaccacacttcatttagctaatatgcctaacatgtggctaacaaaattgaagccacacttcagccatagaagagcaaacttgccacacttttatgtgccaatgacatgtgggatccacatcatggtgaaggaatcttgccataagtgtggcacgaaccaaacagatgcctaacttagtcaaacctagctaacttgagttgtggcacagtgaggcaaattgtagtagtgaaccaaacagcccctacgtacgtataacagcccctacgtacgtatacatatacgtacgcggctcatctgatcaaactttcttttcgagtgtgttgaaacgcgtgggcctcataggtatcatgtatagtatgcaaacctggatggattgcaataggatccacatgtcagtgagcaatatgtatatagtactgtgaagaatctgaattggtattttatactctctccggtttcataattcttgacgttttagataaggttgaagtttaacttttgtaacaataacttcaaaatatctagtttaaagaaattagaacaacatatatagatgtcttttaaagtactataaaaaaagtaaacatgtatctatttatttatttattgtatatattttaatagaaaaataaagttaaaaatatattttggagaatggagagcgtgttattgttagaattatggaaccggatggagtactaaccaacaaccaattgatgcagtgatgatgatgacaatcatgttatcacacaccgtatggaactaactgataagtggcttgtaatggatggtaggtacaatacacagatgcaaatttggatggagtgccatcagaagctagaacagcaaacaacaaattaatagtgcacttgcttgattggaagctaaaactggaagaataatcatcatcagttcatcaccaaatcctgtacgtaaatgtgtgcttacgagtgaaattgatacccaagaatattatgtggggtgtggtttcaataggttttcagtgagagaaaatgatgttcagttattaagaaagtaccttgaggtatttaaatttcacactaaaaatactcgatccgtcctaaaatataaaaatctaggactgaacagtctgtccagatttcctagtactagcaaatgtcacatccaattttagtttcttatattttagaatggagagagtacctaatacttaaaagtatcaaattttgaattagaaaatatgatactagtagaagacaataagggttgttttggtttgaagccctaccaaaattttagtaatgccaaaacttggcacagcaccaacaaaattttggtagggttgtgttttttctaactctattgaattggtaagatttggcctcaatccaaatagctaatatgtactattcaaaactaccaaataattggtagggtaagaattggcctcaatccaaacatgccctaaaattttattcactggtctttgtagacatgtgagtatgatgtacggcttccgtgcaacttgtaaaatgattaaaaaaaagagcatatgcacatgacgataacgtccaaattaatcatccagagcacgagctgagatgtctggagtctggacagaactagccctagtgatagtgctaccactgctgtacatgaagtgtactacatcagtagtagtacgtactgaaggcgaagggcgcggtgtacgtaccatggtgcagtgagagcggatcgatgatcgatcgatcaacctggtgagagtggccgatcagcgtagatgtccccatgactccatgcatgcagcgcgaatgcgatggattcatcgatgtgtagtgcacggctgcttccaggcttgacagcaacagatcgctcgcgacgcggccaccgcgggatgctgccggcgcgccgcaaaatgctcctcgatcggggccggaaatccacgcgatcctggcgtatgtgaaactagctggcttggatagaagaacgccctcaacacccaagtacacggctagcccgatctcgatctgcccttctgagggacttctgatgtgaagttagaggatcgtggtggctgatatgtaggtcccactactcatggatccacctattagtgatcacgtcatgaggcaattcacgtcagaagaaccgattcccttctcagttgagtcttgtgaatcatgatgaccgatctagagtactcacattcacaaaagcctgtgggtgtacagtaggaacagtactgtgagatcacgcacgctggccggccgttgttggagctgtcagtcaaattggagtgacacgcaccgtacatttgggcatttggcgtcgtggaactgcggcaagaacaagatcccgtgacgcgataaccgatctaactactactagtactgtgactgcaactggcgccgtttgccgcagccaccacgcacacactacacgtaccttacgaaaatccgtagtgcgaggctccaccggcttcgtcgtaccaaattcctgccatctttcgctgcctactccattccatatgggagtatcgtcctgtacagctacgctttattctcttcccttccgatcccgttgcagggaggcagggaccaatggacctgtcattcatggtccggcagcctatacagcccagcaatcagcagaccacgcttgctattacaagcaaatactcctaaaaacaaatacgtaccagtactaaggctatgtttagttaacatcaaaattaaaagtttaattaaaattgaaacgatgtaacggaaaagttgaaagtttgtgtgtacaaaagttttgatgtgatgaaaaagttgaaagtttgaagaaaaagttgggaactaaaccaggcctaaattttcttttacaaaactcttacaaataatggtctcacccatttaacgagagtcatagaaaatttagatatgtaacacatgatattatattagtaaaatttagtacgtgtaaacttttccgataataaccacgtacatgctcactactccctctgttttataatgtaatactttctagcattgctcatattcatatagatgttaatgaatctacacacacacacacatgtacgtggtgtgtgtacaaaatatatatgaatatgaataaatgctagaaagacttacaatgaaacggaggaagtatctcataattctcatcttacttggtcccttatccaagtaatgacttagtctctttgtctcaaaaatataaacttttggtatgcaatcctcgggatgtggattttcatctctcaaggggatatcctcttgtttgcatgtcatctaaatagttataaaaaataaaaaaaaatgacaacatagattaatacgaaatatatcactccacaaacatgcaaaactaaattcaacttctataagttgcaacaaaaataacaaattaaactgaaaatagttaccgcacattcgcaacgaagttgaatttaaacttacatgcttgtggagtgatatatttcatattaatttatattactattttttcatattttttatgactatttaggtgatatgcacgaaacgagggatatctctagagggatgattttactttccccaatcctccgccctgattgctgaaagctgagtcctcgagatcacgggccgatttgtttggagcagtatgggccgtgcgcctcgggcagtgctactcgcgaaagcccaaccctcgcagccggcccatcacagactatggattccatcacctatcacctcttcagtcttcacccacgtccctcgacaccccgtccattctccttcgcgcgccgcccgcgccgtcgcccatcgcggcggcgatctccaccaccgggagcagctggcggtgccgacggcccgcgtcctctgctcttcttccgccgcaaaatcctcccctccatcgactcctcgcgacttcgtccgctgatctccatccatccatccaccgtgtactacccgtcgtcctgctgctttccgtccgcctccggtgagcacccgtgccaacgcgacgcacgtcctctttctttctcatccctctcgttctatgccccgatagatccaccccttgtgaattggagatctgaaaaagattttgtaagaaaacaattgtgcttagttctagaatgacattgtggatttttatatttgtgtatatatattttttggtaataactgttttgagtcctgtccaacaaactcattgagtgaagagtatttactcttttacttctgtataaagttgattttggagcttacaggaaagcttataaggtcatgggtcatcatcgtggacataaaacctgtatttgtgaccttttaattattactagtatatctgtgttagttttatggtgctgctttgctgttctgatccacattttgcgccttttcttgacaaaaaattatgcttcagtgctgggaagatgtggatgggtggttatgatctcagaagaaacttgaagagggatgaaaaaactgattttgtcggaatggattcaaagaagcaaagaaatgcttctcttgcaagaaaaaaggaggaagagtttgcaatgaaggagagacatctgagtccttgatttcaggtttgccggtgcttcctttttctgcatgtatcttatagctctcgccgagcattcacagttgtgttgtatcatgtttgtttaactaggtaacttgcacttcaagtctaatgaaggtgtcttcaggagtgagttcagtggagaagtcgcatctaatatgtctaaaagtgttgtttcacttgctctgcttgatggtgattatatgtgctgttatacccttcttacttttccaggcatatatatataaacaccgctatttgttaatgattaacaattacagtcctgtgtaggggacacagtgttatttgtatgctcaggcatggttgtacaacgtgatggacatgttataaagttgctgacctcagcaagcttgcttaaagcttttaatgatgaaagtcaagaccatgataacttgaaggttggtgctggtaatcattcagttgactagttgtgttcattgcttactcttcacctgattcttcattgtaggtcgaagtgcaccataaagacgctgttgtcatagggtctttgagagaatatcatttagatcataacatggctgctgtcgtcgtcgagaacttacctgatcttcgccctgtgcctttcaacaatgttcagaaatttgtaccacatagcatggtagtagctctaggccgtgatatctctggaaaattaatggccacaggtgggttgttgattggtggttcaagcggatcatacaatcctaagcttatgtcgtcgacttgtaaattctctgaggtacacctgttcttttatcacttgaagtacacacttgcatgattacaataaaaatgtttaatctgtttgttttatacatatctgaggagataagatgatgatttttcctacataactcttattccatttcctttattttgtccagttcaaccagtgtggcctgtaatcctgttctgtttggtgccaggtttatgaaggcgggccactttttgattttgatggggactttcttggcatgaacctttccctcactactgagggaaccttatttgtgccaggggatagagttcttgatcagcttgtgaattggatactccatcatgaggttaaatttgctgcacggttagcggctttgaaggcattgaggtatgttttgcatattctgaatgggacacatatcctgctcctccctgccatacgtgatttaatgcgtttagctgttttttatgccaaacagcttatgagacttgctggttttgcaataatgtggatagttgggtgttgttccttttgtagggtttttgacattgtagttcctctgcagtttcaatgtgttatgttacccttaatagcaatatgattctcttccacctatatcaagatgtttctgtgtccaattggcacatgccatcgctgccctgtactagattagtcatatgttccaatgtttatcgatatttgtctaattttattagagaaaggaacattttgtccagatttagtggtcacactgctatgatgcctcctgatactggatgtttttttataacatttgctcaattctctcgttttcttgaaatagttttatgcatactactccaggtctt

SEQ ID NO: 67776 - DNA, 4484 bp, Oryza sativa
tctttttgtgtaagtgctttgatgatgtgctccttccagtcacaaaataatgatgttcacatgtagtcaaaccaattaactttgaccatagtaattatttcaaacggtaagttttgtgtgtataaaactgatagagtaaattatcataatattacactagtttaactttttcgtggcttttatgaagttaatttttttgatagaattatgaagttaaaatttaaagttctgccatgttgaccttgaaaagccaaaaacttgattctttagtaaacgtagggaatattgtacaaattcatgtttcacacaattaatttcgttttttttttgttgaagcaggttcagtcaaatcataattttcaatttaattatttgttgtgtttaataggactgttgctgaacataggcatggtaatccatctgatgtgcttgattggaagatcgttggagatgacagtgttttccctgctaggtattatgatgcattgctttactgtatcacgttcaatgttagtataaatttgttgataacagaaaattactgaatgacagatggttggtacctaagccgtattggtgttatcctgaatttctggtccagcataaacttgcagttaaaatgagtagaatcgagaccattccgtgttgaattgctctccatatcatatcttgtgaacctatttaacgtcgagagaccttatttaaattgtcggtatgttcagtgtttataagttgtgtttacatttggacaaagtgctctgagttttgagcccgactgcccgagggccatccgatccgaccagtgatggacgtcctacggggtcttttcacagccaaattcaatccttacattttttataagctcaaaaacatatagggtgtgtttagttcacgtcaaaattgaaagtttagttgaaattggaacgatgcgatggaaaagttggaagtttgtttgtgtagaaaaattttgatgtgatgaaaaagttgaaagtttgaagaaaaaatttggaactaaactcggacgtagtatgaaattcagcctttgaacgcgtgcaagctagtagcttcgctcgtcatcctcgaacctgacgatgaagaggtattctcagatctgacttctaagccccttattcttgagccagagagagggtggatcggaagggaggagagatcgggagggagggggggatcggatgagaaggggagggttaaagttcaaaatgccaatatttgaaaagcaatatctcacaagatatgtattattttttaaaatcgctcccactacagtaaattaggaattgaaacaaaaatatataggttaaaagtctcaaatgctaaccatatacttgttactgcacaaaagtaaaagtgttactgcactgaaggtatacgttaccacgtgtttatgcagtaacactatccaaaaaatacagtaaaacgccatgtagtaacatcatgatgcgattgtagtaatgtacaacagacaagtagtaacaagtaatagtatagtattactacttgtggagagacaatatctctcaagtgatgtaaggttttttaaaaccgtttgcaccatgatgctagaaaaaaagagctaatcaaaagtagatccgtcatgactatatttcaactatattttaacgctgttactgcaagtaagacacagtgttactgcatagaggtcgtcgtgttactgcaccgtcctgggacgagagctgagaagaggtgggtggtggggggagttagtaggcgggtttgaccggtgggaggggcctttaaccgaggtgggaggtgggttttgggccttggtaaggaggggaggtgggtgtgacccttgggagggaggctgttctatacccggaagaatagtttttctatatatatgtgtgtgtgtgtaacggactcaaattttcagggaaaaatttttgcaaaatatttcaagtcatgctcttctcgattcttcctttgagtaatctcacttttgatcttttctttgacttggatctaaactttatttgctaagttaaaagctttctttaaaatccctttttaaattttacaaaacctttccgtttattttatttaatctttaactttggctctaaattatatttcctttgaatccattcccgaacatctccagcaaatactctttcaattcccgttcaaccatctctagaacacatgaaatattaatctctctagaattaatatcttttcatttagagcttactacactaccaccaaatccacttttatcttccaccaaatacttcccctttgatctctacccaaacacatgaattatcaattcttattttctccagaaccaatacctttcctttggatctccacctaaatattcccatagtccataaaatatcattgtcaatctccctaagttaatatacctatcccttagaatttattaatcaaccaccaattccgtccgtagaaaaattcccatccacatatactggaggttaaaatcccaaaatttatccaaagttagtagataaattaattatattttctttccatttgactattttaaattttaaaatattagagaaaatattttgtgatgagttctatatttggttcttattgaattcttttaaaattggagcatctttatttttatccttttcaaatttatatctcaaaaataaatatcttgattttattttaaacagtatttcaaactccttttacttcaaaaaccttatattcgaatttattttataaagtttaaaagaccctcaaacattcctcttttaaattttatctcctttaagatatatttaaaaccttccattcaaaaattcccctagttttcaatttcttttgaattctatttaaattcattgtccaagttcaaaaagtccacatactcccttaggttccattacctttgaatcccatctaaattccttgaccatatccttggcacaaagaataatatattcctaaaataattgctcttgtgctaaggaaattccaacttatattcttcactcaatttccccttttagccaaaaatatacataataccaattttagaattcaaatcctatttattgccttcaactaattcccttctatattcccaaaaatattttgaggaatattattaatttcccttcctatttgagtgcttccaaataaattccctcaaactccacctctaaatattgcactcaaataaattaagaaatctcttttatgaactctttccaaattcaaattctttgtaaaacctagctatccaaatcaagtattcaaattagacttctttctttttgtcatcgggccgaaactccgttctttcttccttttggcccaatcttttatcttttatttttttcctcctccctcttgggctgccggcccagctaagccgagccggtccaattcggaccatagcccagccgcctctctcctcctccttccaggtgtgcgtgttgtacacgcgcacggcgcacgccgcctcaaactcccttccgtcgtcacgaagtaatcggcgccgtcttttcttccttcacgccagcgtcgccgtggtcaagccgtcgaccgcctccagaaccgcctctccccaccgcccctctcccctataaatagccggccatccctccccttctttacatacaaacagagctccatctttctctctcttgccatgtccggccgtcgccgtcgtcggccgatctccttcaccggagcttcgaaagccaaacccttgcgccaccaactccgcctcgccgaggtgattccattttttcctatttcccctctcctttagccactgccacaagcactaccggcaccaccatagccggccagagctgagctcttgctgccgccgttccggccattctatttactccctatgccttccaccgacctccccggatgcatagcgagcgggaacacgcttgtccgccgccgtcgaggccattaaaccaccgaagcaccggtgccctgtgccctcttcccctctgttgttgctcgggagaagaaacagaaggaaggagagaagaacgggaggaagaagaagagacatatgacagtgggccccgctgcacagtaaacttcctcttttatttgatttcaatctttagacaaccgtatctttccaaccacaaatccaattccagtgaacctttgatctaaattcatctaatttcaaaccctcccttttgataccaaatttcctatttaaaattttgtttaaatacccttttaatttaaacctatttgatttatcttaaatccctttaattttaaaatttcttattttatttaaaaccatttttaaattaaattatctttaaatatcatttctttatttatttaattaccttttctttatttcttttaaaataccattttaaattttatttctttaatatattttttaaaaaactctatttgaattcaaatttctttaaaccattcttttacaatccttagccaccaaaaag

SEQ ID NO: 67777 - DNA, 12584 bp, Oryza sativa
agcatcgactagacgagccgatatttagccgttatgctaccaaccttagcatcggctaaccactccaaatatctaaccgtcgtgctactctattctagcaccgactagaaaaccaaatccaccaaatcaaccccacctatccattttatccttttcctcaattccaacatttagaaaccaaaacctctcttttgttttccaaactaaaatttattttgaaccattcctttttccttcgccttgctccaattttatttattatttggtttttatcatttctttgtagcaatttgcttataggctttatttgctatcttttcgtattcgtacgttagaccgtacagcaagttttatcagcatccaaggagctgacgtggacccagatggctacgctaaagccgcaagaaatcttaaggtgcaaggaaagacataattaaaatttgatcatatagaaaacttgatatgatcttcatatttaatttgatgcataataccttactcttttaacatctcatgggtagatgttaaatgcttttaagcatgattgcatgagaacatagaaagaagcattggttatcattttatgtgatttactattccaaacaactttacaaacttaggaatccaattaaaatgggcatttatgagttgagattataaatgctgtgattatgaatgttgatgaagtttgtgatgttggtgtggggagtttggaaagttttgggtggtttaaccggattataattacccccttataccatggaaatgacatagttgcgtccatccacacaatcaagtaattggacttagcgtagtacattgtcccactatatgaaagactgttgggtggctctatgagcggttttggggtgaacttgcgtaaggagtttgggcggcagtgtttcacaacagtgggattcatgaaagtgtgacgatatagataccttgcctaggcctggcaagagttcgaccactatgatgaaccaagaccccactgtgtagtaactagtagtaagtgggaccttcgaacggctctggtgtccttagccttgcaaattgttgacatcgtgtgggtaaagctggacagtctctgcagaggtgaattaaatcattcgaatgtgccatactcccggttctgcagttgtgtcatcagggtgattcctactcctgaagtataagtagttttaaaattaaagagttgaggataaagatgatttatggtttttattattcctttactttatttttgtttatttattcatatctactcacctttaattatttataatatgtcttgttgagtacataagtactcacccttgcataatttgacatatagaggaaacgtgctaacaaggagatcggaaggaagcgagattttacggcaacgacaagtttatctaggctagtctacactcgagcttttgcctgtggagttatttgaattctttggagtttattagctgtagttttagtagttgaagagcttaggagtttagtagtttagcactttagatttttcttgtattttcaaataaggatattttagtttggatcttttcaacctttaacaattgtataattagcttgtataaccaaatttgtataattaattgaaagctgatctgtatatcaatctgtgatcgaaatcctggacgatcacgagatcgaaatcctggacgatcacgaatgaattttcggggcaccaagcctaaattgggtgtccccacagtgtgtatatatgtctaaattcattaacatcaatatgaatgtgggaaatgttaaaatgacttacattgtgaaacggagagagtatataagaaacactgccaaaactccaaaactgggcaatactgtcaaataaccaaaattttgacattaaatttggtaagattcattttggatacaatctaaatattcccgttcttttggtgaagcgtcctccctcccctctcatgcttcaagaagcatctccgtcggatttgaccatgctaaaaaagtcttgattttgtgagctcgacctgctgtcaggaatagaattgtcacacataaaaaaatgagttattttaggtaatggtcaatttagcaatcgttatgggcagtagctaatgatggagatgcctatttggacggacattgtctcctgaacagacttgttccatgccctttcttgtgctagttgtagggaccaatgacatgtcattccatgatccagcaggcaatagagcccagaaactcacaaacctggcaatttcaaccaatacagacagacaaggcatgcagatttaacaccaggatttggaggtcacgactcacgatcagtgaggcagtgaccaatcttgcattcaaatatgttaagatgataatatcgataatttacatgtgtacatcctaaacagaacctaaatcggcatgttttgccaatacacggcacatgttaatgggactttttcttcatccttaggaagctaaccaatgtgattctggagggagcacctgtgcctgatctcttcttgattgctgtcgttttacacagctttccatctcttacggtagtcgtggttgtagatgatacattatagaactgcatacatacaagttgtgttcaagttctaaaaacgtctggatgaagatttcacttcttctcaagaactgctggagagcaattacctcgcatacaccgtgcaaaagcaatctctgaaatgggtcctggacattcagtacaagcatatctttaccactagtgtcttcgatgaaggtcctaactcgttcctgcaaatgtgaaaaacagataaaccaatataaaacagctactgaatgaccagcaagtgcagcacattatgcttctcaagtacttatgcaatacaacccaaatgcaaaatcatattgtaattattaatttccacttgcattcacatagcatgtgagtgcatacatcaaaagtttcacagaaatgccaaatgccgacaaattagaactcaaccacctcatttctgactgataacatgtcgtaacacaaaatcaggtcacccttgtttatggctgaagcctgagcagtagaagagtagaactgcttccttttcattaagaagataactgtactaaaaattgtagagacagagatgcaagagcaaacaggatgtcgtttaaaaagcttaggtaccccaatggtttatactttgtaatagaaagccaagagacagatgcatgtttatatggttgcgaaggaatattctagatcttagatgtatgtaaagaaatctgagaccctcaaaagtggcaatcattttagatctagatgttctttagatggtccaaactggtgtaacaagatagatattctaatgcaattgaacactagaaacaaaaactccaaggaccctaatttgcaccagattgtttgttaaaagacatctcatttgttcctggagaatagtgcttaaacttttatagttgtaatcattgatcacaataaaaatccatcaacactactagaagtagataacacaggaggatatactgtcagtttttataacataaatatcatttgatcctttaaaactacaaaaccagaaagatgcaatctgatgcagcaaaccaaaaactctcaaaagcaaacaaatgttagcaactgttgtgacaaacagaaacacaaaaaggttaattcaatgagatagaaagccatacttcgtatatttcaagaagatctgggaggaaatttctctttatggcttctcttgtttgacgatctatatgatgccaagaattgagagcaaccaattcatctctgtccaaatggttcttctgttttgtagaagactgtttcatctgttgcaccaatcgtgcctacagatgaaaagcacagtaagtaaaatggatccataaaaaagtgcacatgatacctaatgctatgcagctcttatttctcattgcacagagtagcaacacactagtatacctcaacatccatgtcaatactcctgaaggcatcccattcaccgacacttgtcctgcagaatgcagaaacgggcagttcctcacctacatgcagaacatagatcggtgtaatatagaaatgaaatgttccctatctctataatagtacatgaaaaatgtaacctgactataatgcctgcattaaatgtcaatgcaattaaagtgcacaactgatcataagtgtttaaggaaaaaagtgacaaacagggaaactggatagcatacagcattctcacgaatccgtacatttttagttaatgacataattcttgttaaagttaacgtgtgcatgctgtaaggaaaaaaaattgtttctcattctaatgtcaacacatagtaaagagtatgcataacatggattttatcttcttcataacttattactactctctaaacagaatgaaacattcaatgacttagtaccccctaaacagaatgaaacattcgatggccaggctgtaagacatgcaatatggtgttaaaaaatgtgagcagcactggatcttaccccatggtggaggagcaaaaaggcctttgatttcttccacatgaagacgggggacaagttcaatgagcaaccggtcattcaaccacctacgagatctccgattactaacctgtgcaacattgcaatctataaaccatcaacccgcatattcttaatgtcaaagataacaacatactgtatcaaatataacagggtttttttttctgagctgctattccatagatcatcatccatttctcataacagggatcaaaccataatttcattcaatcataaaactagcagcaaaggaacaaaatcacttttttattttccctaataggatgagccgcctcaccttggcggccatgtcctcaagaacttcaatcttcctctcaatcatctgcccacgcgacttgacggcatctccacctaagttcacaaaatcgaacaagggttaaaaatcgcttgcgtcaggacgcattggggggcaattcggagatacaaaaaaggaatctacctttggcggagtcgaacaaggaggcgtagaactcctcctccctccgcagcagatccgcgctcgccatgctcgacttccccgtgcttctcgcgatcaattcctctcctccgccggcaaggcaggcctcttgctccgattccgggatgtgcgtgttctagggctaaaattggggaatcgcaaacggtgtcggtgtctcggtgatcgctaggggagggggaatatgcggcggaatcgcggatgcgactgtgcgacctagcagatcgcagtgggccgagaagcccacagttgtggagagcaactagtttgggcctaatgtgatgggcctcccaagcaaatgaaactgaaaaaagtgcaccgaaggtccctcaacttgtcagcgagataaaaaacgtcctccaaccgcaaaaccaccttaactatacaaaaccggtcacccgaggtccttcagcagttttgatcctggttttagtctacgtggcagctgagttagcgtggaccccacgtgggccccacgtgtcagccaaccactctctctctcccctcttctctcacttatctcctctcgggtaagccggggcgggtggggaggaggtcgccggggcggccggcgacgcggcagcggcagcacgaggcgatgcggccggcaacaaggtggcgggagccggggcagcgccgcatccacgatcgcctgccgctgttctcctgccgtcacccggaactccgacgtcggcaaattctaacgacgcccactagctagtctgaccaccatgagcagactccctcaggattccacgaggtagcgagcaaggacctgctcctcctcctcgtcacggcgccggcgccgacggcgcgtgcatcacgctctagtacgtctccaacgtcatcatccacaacatccatgtccacgactgcgtccccgccggcaacgcgaacgtgcgcgcatcgccgacgcactatgggtggcgcacccgctccgatggcgacggcatctcgctctactcggcgcgcgacgtgtgggtggaccactgcgcgctgtcgcggtgcgccgacgggctcatcgacgccatcatggggtcgacggcgatcaccgtgtcgaacagctacttctcgcaccacaacgaggtgatgctgctggggcacagcgacgagtacctgctggactcggcgatgcaggtgaccatcgcgttcaaccacttcgggatccagctcgtgcagcggatgccattgtttgccgtgttcttggcttgttttgcttgtgagttgtgatagcagaagaggggaaaaatgttttttttgtgtgtgtgtgtgttggattggatttcgtctgtttgtttctcattttgtttcccgccgtcgcgtcgccggccacgtcgcctcgtgctccagccgccgcggcgtcgccggccgtcccggcgacctcctccccatccgccctggcttgcccgagaggagagaagggagagagatgggagagaagaggggagagagagtggttggctgacacgtggggcccacatgggtcccacgctgactcagctgccacgtagatcaaaaccgggatcaaaacagccgaaggatctcgggtgatcggttttgtatagtcaagggacctcgcatatctggttttgcggttcaaggacgtttttttatctcgctgataagttgagggacctttggtgcactttttccaatgaaacttgtgacgcctaggcccaaggggataagcatgggtgccccaggactaatggttctttttttggtattctcattcgagatattcttaatttgtttccatccaacaaaaagtatctcaagataccattatctcatggtatcaaatcgtttccgatcgtcggataaaacaatgcacatcctgcccagttagatctaacgattaaaaacgatttgatatcggtaccttacgttattttttattggattgaagcaaatatcttcttacaaagaacactgttctatctatccctataactcatttacctatttgtaatcactttttaatttaatatttaactatttgtcatccatatatcaataacatgtggatcctcatatttatgatatgtatgtccagtgataaatagttaattgccacctataaaattgacaaatataagggctcatatgttgttgatatatgggtgacaaataatttaatatcaaatttacaaatggcaaatagttaaatgtacattaatcacgtccctgcctgatctcttaaaccacctctctttaaatcctgctgattgctggtctcatggatcatcttctctagtgagacaccgattctttgggtctcacgagtcacgtgcgtgggtgtttcttggtgtcaaactcgacctgtgtttgattgctcgaatgtacttagcctggctcgtatgtcttatccaggttgagtttggccttggttggtaaaatgcaataaaatgcaatagagggtgtttggttgtatgcattagatgagcctggtttatctgagatgttgtttagttggttggataagaaaatttatacgcaagagattgtgtttggttgctcgtatgtaccttgaatccaattatgttttttctattgtaagagtataatcctaccaagtatatagaaataataatgtcttaagttcataacacttggggtgagttcttatgaacaatttacaactacagctttctcattctctataaacacgcgctttaaaaccgttaaacatcagcgatacgttttatgtaaaaaccttatatataaaagattcctttagaaaaattcaaataaacctattatgtcttagtttcagttcccaacaaacatacaagctgaactgctcggtcgaactcgaacccagcctatacgactgtcatttctgaagccaagcaatacgaagctttgtttgaggctttgagctgctacatgaatggatccccaacgatagcgcataacaaaagatctactagtatcagtcacacgataatagcattctgaagctgtcgctattaaaagtcgttgttgccactcgaatggaaccatattctatgaacgtttcctcctcaattatccgcaaaacagaaatcacgtgtgtttgtctcagttcgtcctctcctctcctatttttctgttctacaagccctgtgctggcgcgtcaaaatatccttgcagtcttaggctaaatttagttctaaactttttctttaaacttccaactttttcattacatttacacaaataaactttcaacttttccgtcaatcgttccaattttaatcaaacttccaattttgacatgaactaaacacatccttacacgaagtaccactgttttactttgttttggatgactagatgatttgtgatgattatctaatggtaggaacgaattggttaactattatacttttttaaaaaataatgtattgaaagtttttgaaagcttagcaagcttttcatgagaatagaacagcaggctggctgacccgttcgcggaagatggaagacgacgttgccgtccatcccaacacgcaacgccgccggccgcaacgcgccggtttccggtccgatccgcttcacacccaccacgtctgcaggccagccgcacgacgcaagcaaaagaaaaaaaaaacaaacagaccggataagattacctactactctcttagaaatacgaatctaaactataaaccttatttttttcttataaaaatataatattttacattaatttccgttagcacgttttcaaactatataagttttgtgtgaaaaatttctatataagctttaaaatacatccattcgtcaagtttgtcataattaaaatttaattaattatactacatgtcaatagttttttcgttttacgtgcactaacttaatctgcgtctttactagttttaaacatcatttatttgttccactaatatcgtttagatttataattttaagaatgcaaactagttataagtaagacgaagggagtaagagttatatgtctttcccaaacagctaaaaaaaggccgaaaaacagcggagatttctatggaattcgtctagaaagctgcgaatcttcccttaggattcgcttatccttgccaaatcctctccaaattcaaagcatcacttatttttttttttaaaaaaaacggcaaacacgagtccatgagaccacgagtgacgacgagtagtcctccacccctacgcctcgccttctcctctcttcttttcccacgcaaacgccggagacagaggaggagacaagagtccaagaccaatgcgaggcaacggcagggggcgggaggaggaggggaactccccaatgggccgccggttgcgggccgtctcggcccacctcctgccgccggcgtccaccaccaccaccaccggcggcgttgacctcgccgccaaccccaccgccggcgagtacgcgcacggtatgtcgtatcttcagtcccgtgtggtgatgcccgcgattcggatctctttggggttggattcccagctggtcgagcagactagcacttttgcttttagataataatctaaaattgtttctgattcccaaacggtggtggtaatacgcgtcgcaacactgtgttcatcggatttagttatggtcgtgtggagaggtttcgcttttctgaatttgtgctgccgagtccgcgcatcagttccatacttccgttgcttagctcggtagtatccttctcgctattggattagagtaatcgcttctaaagctccctttatatatctaaaaaattaaaaatatttagagtattcgcttgtgtgctgaataaaggtaaaagggatgaggccttttcttcctttttttagtatgccggcacacgaaagttgtggacttgtggattccccaactactgcatgtttgatttatctttcttgacaaaacagcctttttttagtttgtaactcaatgtcatagcttctccagtgcagggctacagtgctgtgctccctgagaagttgcagaccgggaagtggaatgtataccggtaggttatttatatttttggctgcatttgcttatgttgcagctcacaattgctgtttccaatcttgcaggaatgcgaagacacctcttaggttaatagatagattccctgatacccctgatattgcaacgcttcatgataatttcgtgtaagaatcctcgaaatctcatttgagcatccggcttttatttcttaatattattctcaacttggcgaagtctcagttatttacaaaatgttatgctatgatttatcaaattcttgttttgaattgtcagcaaacatgtgagtgcacaaacatagagttaagcaaaatgaacgctagttctgttttccctaggatgaattgtatcaggaggattcttaggaaaatctgattacataaaaagaattattggcaagggaagctgttctttaagctattttattgaaaccttggagccggaaaatgtttgtatctataagggaaaagtgagttaacctttatctattgttagatccacagcctgaatgcagatggtttttatctgatggttttatgaaagctgataaatttagatctgttgcaggctacatgctttacaagaaaattattattcttcaaatttaagttctgtgctaagttctgaggcaatataccccaaattgcgcaggtatgcagttgagacctttagggactgtagatacctgggcacaagaatctgcgctgatggaacagttggggagtaaggattagttcctggatatatgtgttattattggcttttgtagctttgttcaaatcttttaaatgatatatgtatggaactttgcagctacaaatggatgacatatggagaagctagtacaaacaggactgcaataggttctggtcttatttatcatggaatacctgaagtgagtcataatggtcgcaacaagtaccgtccttctttttttaactagtagcaggcagatcttgtcacacatggacaatgatataacatttgtatttacacttagagagtcccttttttttttaacttgctttattttttttaactctgaaccagggtgcatgcattggtttgtattttataaacagacctgagtggatcatagttgatcatgcctgtgcagcatattcattcgtgtctgtgccactttatgacactcttggtatgcactattcaccaaatgatcatctatatccttatcattcatctagcaacaatatttatgtaatctgcaggtccagatgcagttcagttcattgtcaaccatgcgacagtagaagctattttctgtgtgcctcaaacactaagcactgtgagctttaaccccttatctcagccttgtatagttattagtttatacaatcattaaaatttgcacttttcatgtcactggtaccagccattaactactgaaggtggcaagtagctagttatttccaggaaatagatctgtgctttcaggtgctgatctcatcctgctatgaacacacaatgtcaaaagactgcacactgcataaactgcatgctcatcatactgtttgttcttaaccatatccacatacgcacatgatcaatgggctgagcgctgggccctgaccatgaaatatgtttatgtggattctgatccttgtttcaaacactacatcagtttgtacctttaatttaatcatgatatattctttggaatgaagtatttttatgtttgcttatgtatatgtctctatttattgcagctgttaagctttataactcaaatgccatgtgttcgccttatagtggtaagttcgaaccatttataattagtatgttcaatcgagcagtcatgattttttaagaatctttgttctgttttttttttcttaacttgttttgtataggtaattggtggagacaatgcaaatatgccatctaccccaacatctactggagtggaaattataatttactccagactactcaaccaggtgaatttgctacatgatccttcagtttttgaaaactatattgtactaccttcatctcaaaatataagaacttttggggttgaacaagggtattaaggaagtatgtggagttaaatggcagaaggttttgattgatcgaaaagaggaagtagatggataaattaaatgagggaagattgcgattggttgaaaaaagaacgtaggtggagaagttgctatattttgggacaaacttagaatgctaaaagttgctatatttttggatagagggagtatatgggatactagtcttaacacctcatatagttttagagatgtctgcaccagatgagtttactaacactatatattgttcattgtatttgttctattccacgcaaaaaatgtatttgttctccaatttcagtcaaccgaatcaaactgcataccagttgactgcactccgtcatgtatgttgctctgattaaatttagacttgttccaaatgatttatccatatcagacaaagttgatgtggcatctagtttccacttatatttgtgtgagcagtgtgcctacgttttcattttctttcttatggacacacatagtatgtgcatt

SEQ ID NO: 67778 - DNA, 709 bp, Oryza sativa
tgatgattaatggccggtggtggtggtggtttacttggagtaggagggtggtgcgacgaaatcagccgccgccgtcgccgtcgccgccaccagcggacgaagacgtattaccgttcgaagagtacccgccgccatcgtccgacgaagaggaggaggaggagatcaaccaccccacgccacagacctccaacgaggcggctgacaggcgccctggattactcccggcctcgcgcaaggccatacagggcctgcgtgaggtgacggcggccggcgcgggagaagacgagtgcgccgtgtgcctgcaggatttcgaggcgggcgacaagctcaggatgatgccctgctgccacaccttccaccagcgctgcatcttcgactggctccgcctcagctgcatctgtcctctctgccgccacactctgcccacgcagaatgtggaggacgacaggcttgggcgcgctgcccacacagtggcaggatcaaccggctgatgaaccagccgaaaaggcttctaattttgttccagttcacctgctagaaatcattagcagtaagcagataggtgatttctctgttccaacatttatcttcccatgaatgtaaatctacgaagcatgttgctgtgacggtctactccagatgagcagtactctgaggcatgttatttatcttctctactgaatgtcaaaactataagtgcaatgccatg

SEQ ID NO: 67779 - DNA, 1083 bp, Oryza sativa
  unsure (1)..(1083): unsure at all n locations
tgatgtgtggccatacctgtctaataaatatggtgaaatcaagcttactaatactattagtattctggtttaagttaatttgctagtgccttttcaaacctgttgtgcacccatttctatcgtctattcatgccagtgcatacagcaattcctaaacatgttctgtgttctgctaaaactgagagcttaatactgtacttctcatttgtaaacttcaggtatatacacatcaatattgtcaaactatttcctttgatgttataccaaattggttctactaaacattacatttagctgatttatcttgttttgcaacaaatttgatgtatgatagagttcttcctagaattgtatcgcgtggaacaatttggatttctgtagcacataaaacatcttactatttaattttaatgtgagccagccaaactttgaaccttgatgtgctctggagttagttttcactatttctcaatttggttccggcttcatagcttgntaatctttcacttttttggtcctcagatcagggaagacccagttggctcacactctatgtgtctccactcaggttcatttttaatacatgtntttgtcatcaccaccttactgccatagattcagtgaattattttctttttttttgttcataaactgcagcttccaattcacatgcatggggggaacgggaaggttgcttacattgacactgagggaacattgtatcttttgaatttacttagcaatagcttcatctgatccatccattcaatggatttatttgcatttctgtatctctccaacttgtttccttaatggagttttcagccggcctgaacgaattgtgccaattgctgagagatttgggatggatgccaatgctgttcttgataacgtatggcccttaatttgactttaccatttcaggcctaacaaagaagctatctgttatatttgcatctatttcttgtttagatcatatatgctcgtgcatacacctatgagcaccagtacaacttgctccttggcctcgctgccaagatggctgaagagcctttcaggcttctggtaggcatggcttaacat

SEQ ID NO: 67780 - DNA, 1165 bp, Oryza sativa
cagctgttccaacaaaccaacattttactcaacattccaggatctgcaagaacccaaggcttgaaagatagcatggatatatgtaagatctgtgcaactctgtagatctccccaagagcaataaagtaatgagcacctgtgcaaccaacagaaggcatgttagttgatcatctttctgcaagcaaatgattaccgaaaaaacaaattatacagctctgctcattattcagagtcccaccttgagaaattactgtttcgccaacatttgcatgacaagattcctgccaaatcatcgcaccatgctgcaattcttgggcacaggacagaagcatactgtaccatgcactgacataatcacattgctcctctttggatgctatttccaaggtacgaaggattgacacgctgtgcttatagagtttaacagctgaactcatgtcttccagtgcctacgttgagtatcatatcaagaaatttcaataacccaatcaagatcatgtcatgactcatggaaacaagggcagaaggtaatggcaaacagaaacattaagtgcacatacgtatactgaaatcaagcaaaatgacatgtcatctatgaatcactttgcctggtacaatctatatatcactttggaggcaagttcaatgcagcttatagaaaagcacaatatcattttcacatttaattatgtttatcatctacaaaagaaaatgtgcatgtgactactgaagactatccgccaaagaatttaagaaaacaagtgtactgatctaaagtaacttgatataaattacaagatttgacagtgtaataaaaaaaacattttttcttttttgtcaaaaagcaggatatataaatgcctaaagacaataaggtgtatagagtctatagacaatgagacaaaaattatatttcctagataaggatgcttaccattgctattatttctgttaaatggtattctttatcaaaatccttcaaatgatcctctttggcactgttaagcagctcagaaatgcaaacatcctttgaaggatgttcatctttgcaaaaacctttcgcaagtgaagaatcttgtaattccttgcaaatttcctggagattatggaaaatgattaaacaaaatattatgtttaattcatgttttgcactgaacaataatat

SEQ ID NO: 67781 - DNA, 14351 bp, Oryza sativa
ttcttgtactgggatattaccgtcaatgattcttctctcagcttatggtagaaatcaatcaaaatcctatcacttgctgatttaattgaatggttttcatctgttccaaatgaagagttctgatcactgatcattagtctgtatcacatggggaaaaagggggtgaatgtggagccgaaataccatgaatactcaccatttcagtattagagaacatatcagaagagctttgcacactttctgaagaacattgcataatgtggacagcatcaatcggttcactttctttgtacaggtcgagtatggctgcattattgggtggaaaataactaaaggccttcacactttgtccagcggactcacgagttccaacatgatctgtagtttgaacattgttcaaattttcgctaacactagtaaataatgaccagccctcctggtcgctgctcattgactttggtacatcctgacaaaataaaaagattcagaccaatcagtggagaaggccatagacatatcaagacctaatacagaaaaaaaaactagaaagaggtcataacaggatttctaatgctagaatttcagaaatttttttttaatcaaaagatatataaggataaaattcatcctttgtttagcagggactagggaattcttataacaatgtctgtgtgctgttaaatttactactccgtaagtcagaattttatactatgtatacagattgtaataggcaataaaaatccttctaggcagcttgactgttcaacttgaagaatacaatcacatgatttattgatttaatttcgtgaggcaggtcgtaacgacaatttcatcgaaggttagctccaaaattttctgaagtgggattatttgcaattgatgaattgtctcattttaacagtttccacctattttgccttccaccgacaattgccattggatggatccccatgagctgaaaacgagttgcattcatcaggtttgttgtgagtgcaacatcacaataaaccaaccgatatgttattttcagaccgtgatgattcatgattgtcactacatggttggtcggccatacatcccatcaaatttctgaaaggtagttaaggtcacaaggttagcatcatcaacagtaagaaaggctcacctgagtaagatccccatgggcttgtctgccgccatcctgtacagcatccgacgaagaagaaggcgccgcggccttgaattcccagccatcatcttcgaatccgtcaccatcctcctcctcctcctccgccgccgctaccgctgacccctcctgtgtacccacctccgcggcgtcggtggaggagggttgcgggtgagatccatagaggccggcgatgaggtccttgagatcagccggcttcgatccattggaggacgcgtgcgacgctccccgctgatccgcagccgtcggcggcagctcggccggtccctcctcctcctcctcgtcctcgtcggcgccgaacagggagagggggagcgggccccgcggcttctcccaggagggcggcttctccgccggggccgccgccgacgagccaccatccggattggatccgaggcggctgtcgacgaagtcaccccagtcgtcgtcgtaggcgccgaaggcgtcgaaggcggcggcggcggcgggctggggatcggcgaaggcgaagtcgccgaaatcgaggtcgtcgtcgaggaacggggcgggcggcggcgggaacgcgacggcgtccatcggggaggtggggttggggggaggtgcaatcagcaatggcgggtgcgtgcgtgcgtgcgagagatgagatggtgggcggttggaggagaagaggacggaaagcaagagggaggctcgatggtggagccgttgatcaagttgccattgccaagctgtattccatcgtcagcgccagcaaagagaatgtgtttttttttcttattttccttttttaggaaaataatttctttgatttctttcattggctttgctaggttggcctattgctggcacctgaaatgttgaaatgccaactttgagagacagatgtgctatttcaaacattggcaataaacacaccaaaattgaaagtttaatggaaattggaacgatgtgacggaaaagttagaagtttgtgtgtgtaggaaagttttgatgtgatggaaaagttaaaagtttgaagaaaaagttgggaactaaaccaggtcgaaataagaatatgcatgtttctcaaatttatatggttctatcgtttgttctttcagcttattagccgtagctaaactttgaattaaaacttggttttagaggtgatttttatttttttttattgtagtttgttttacataattagattttaagccaaaatattacttgtaagttttttttttctaataagcgttgacttataatcaattttttgcgatttacgtaaaatactttttgtatatatgagtttccttagaaaagtggttttcaatttatttttaactttataatatttaattaattcatttataccatcaaaataatcgtaacaaatcattcaactattcagcaccgcataacataccaaatcattgacaccataaaggcaatgtattgttcataggaaaaatgtctgaacttttagctcccaaagctcaagtcacaatgcagtgaaggactgaaggcacaaaaatgccgagagattgtagaatttgacaccgattgcgtgcagttcaacactcccaactacttgtagtagaattcccagcctacagtacaatgagtccatgttttggtcgtcaaatcgtcagttctgcactatccgttcctattcattcattcttgggtttgaacagttttatgagataaccaatcaaggacacgagccactgccagaagcgaacgatggaatttgacgccttcggtttgggttcgggccttggaccaaagaggcctttgtacagctccttctgtttttggtacagagctttatcctgttccgcgagagaccgaagctcacgctggatctccttgtcttctggggaatgtttcttggctttcaggaagtcctccctcgctgattctgtctgaccaagttcagctcttgcttttcctcgtctgaacaatgctttcacattgttttcatcctctgccaacacctgaagaataggattatgagttcatcatccagtcaataattattcggtttcggaaaaagggggaaaaattcttcacttgatgaattgccaggtcagttacgtcatgaaattagtgagggttgtcttacaaaaataagttgaggaaaatataggcaactgcactatattcttcactttttggtccaagcgtctagttaccataataatatcatgttgtatgtctttattgtctgaaagtcaaatcaaaatcctaattcatctgaagctatacacaaaccgactggtgtgagtgtgacagcatgagttttaatagattgaactttatgcaaacaaaaaaaacttacaatactacactgtgcgatagcttcatcgaatctcttcagtttgattaggcatgcggccatgttgagatgacatggatttttcacagccaaggccatatctctgtatttcccgaacaattgaaacatgaagtcatctcccatgtatgcaatcgcctgtaaagaggaggagctagaggattacgattagagaatcatctcacaacagttgaagaaggacaactaaccatttcatattgctgcatggcctcctcaaacttcttttctttgaaatactcattgccctcaatcttcctcctgtccgctgcttcaatcctttcctctactgtcatgtcacttcgggctttcccctgcagttgtacacaatttgtaaggttccttagaacatccaaatcaccttgaaaaccataaataaaatgaaaccaaccaacaatagtctcagattactatcagaaataataaggataagcattatgttgggtggagatggtaagaaggatgtttccctacctctttgacatcatcaaacccaataagttcaacttcatataaaagatctgccattggagggacatttgggaatgaaaagctcccttctttcccatagcctagctcccagccaacatgcaacagtgcacgctccccacttctcatgttaccaacaccaatgcctaaaccagacatttgttttttctctgtcggtaaaaagagaaaaaggcttttattccatatgtgataatcactgataaatcccaggtatactctacatgctcaagagtgtccaaaagatatttgtaggaaagttatatagttaccctgtacctgtattgtatatttagtgaaccatcagaaaacagggggggaaatatattagtaataaaaatataactatttagtctttatgtccttgcaagttgtcaatcgccctcacacacacacacacacacccaaaaaaaaaactagaatatcaatagcaagttgaaagttgctgatcgatcaactgattttcaaaacccttattagaatcatagattatttgtggcactataagatcagaatggcataagagtaagctatttgatgtgtatcatctatagaaggcatgcatgcagtgtagaagaactagggataaaatgaagtatcattattttcaccttttccaattactagttcaatgggatgctgttcttgccaagtatcctcgaatttatgcagagagccttgaacccaagctctatagtgcactgtaacagaaaaaacagaaacaaacattatgcagatgctctccttctgaataagtatatacatggtctgagaatggaagattgatctgtaatagacagacgttgacatgcttatacaaatgatggacgtgccacttggtaagaagtgctcaaagctgatgattcatagcaaagcacaagtgcatgactagttttaaatatcatttgctctaagttgttatgagtttggtgctgctatgtgccacactagttattagtaagcctgtggtgttagagaaggctgtgcgtacatcgaattgttcatcctaaaatactgttaagtatttcatgatttctggtatctgaataagaagctctttccacagaaagttccagtactggcaatttagttaaaaagaagtgtacaaaaaagaaacagagagctaggagatagtacaacagagcataaatactgagcccctagtacatgtaactttacaaatgtatgttctgagcccctgatacacagagaataagttctcttattatggaacttccatagaaacaacaacgagatgaaatgtgatgataagacaaatgctaatgaaggtggaatatattagcctcattctataaatcaccaggataaatatagggaatgatcaaaccatttatgacatacaaaagcacgtcgcgaactttgatggtttcttgccatggccttctttgatgacttgttttttaactttgtcatgaaggacctccatattagaggaaaccacaggtgggacagagccatcttgcggaggttcagtatgcacaaaagaagcttcctctacagttatctcattatcacttgaacctgaaaaaccaggatacgggttaagaacaaagggaaattgaagcatgtttaataaagtactccctattttaatacaaattctggttctatactggtcatgttgtaatgtagggtcgaagtactatatccaatgttcagtttccaatagtgcgtgtttgttgattagaaggaaagggacaacgtgagctacatttttcgctgtctagtatccactatcatgtagcacgccgaaccatttaagctcctcttaggactccagcctccaggcatgcaggggttttcttttccagatttctgttggaagtgaattgttttaaagcaggccagagaaaaaaaggacaatagacataatccatatggttactgattgttcctgtagacctatacagaaatcaactgtatcgttctatacagttgaagcaaattcagaaatcgatttatacttgaacttgtttctccggattcatcaaaacaaagggagaaagggatgccatgtcataattaatttcactattaggtctaccagtacaatttagcatttgatttgagcatcatttggggtacttgtatcaaggtggaaactgcaaaacgatttgaattctgcctgcgtgctcgggagctcaaactaatccaagcacataatctatacgccttccttttggatcccaacaaaaagaaaaagaacattctacaccgaaattcagaaacaaagcacatccacagagcaatagccacgcggggctggtacggggtagagtggggcaggcgagagaaaagggaggctcaccagaggaggcgggatcggcggcggcggcgggtgccggcggcgagccctcttcttcctccaccacagccatcgcgcgcgtgcacggtggtttggttgggtttgggggcttccgagctccgaggcggacggttcgaggagatgagactgagaagtcaaacagttgagaataccacgagagactccagcagcagcagccgccagcgagacgtcgccgtccggccgccgcttgatgcgggcttcccttttcgacgcggccgtatcaaggaatccccatgacgccaagctctacgctattggtccaacttcatgaagaaattcttattgcacttaagaatttatcactcgtaatccctccgtactcgtaaagtcgtttataacagcgacacggtctccaaaacacaactttgacttcttttttctataaaaatatttattgaaaagtgatatatgtatacttttatgaaagtatttttcaagacaaatctattcatataatttttatattttcaaactcaacaacttaagtgttattcatgatttatattcccaaggtttgacttaaacattgtcctaaacgacttcctttataagtatggagagagtaacttataactcgtggaattcttatatattcatgatatgtggattcagtgataaatacttaattgtcattttaagagtgacaaatagcaaaatttctctttcttacgagcctcattcaatttctgttgttcttttcacggttcaattaaataattatttatgtactttataatcataatatgttttgtaattaaatttctatcataatcttatatttatcccctttttctgttttcttaatattgtgcttcgaaggaaccttaagttcccaacaactgatgtaatatactaccttgatctaaaagtcttcttcgtatttctttaattactaagaccaagaagaaactacctcatccgattaatactccatatttagcaaaattctcagcatacatgcaatggtgttggactgttggaggatggctggtcggttccgaaataaacttaattcattgttgctaaacaaagatatactctcttcattcaagtcttggatacatagaaattacaaataggaaaataaaatagtaagaaaaatttaggtggagggaatatatatttcactacaactagacatctcttgttagctgaagtaacaagtataaaaacagaccagaaccagtagtacttgttttttagataatagatttatattaaacccagcctatacacaagtagtacttgttagctgaagtaaccagtagtgcccatcttacagtgcagaccaaaatccataactctacaactaaacttggtagtcggctgcagtgaattacagaattgcgtcaaccgggacaggatgccggcaagatggggcagcactacggcagcgtgccgtgacagacaaacgtgctggctccattcatcatcagacaaacgtgtaagatcgggcagaaacgatcccaactggccaactatgcgttctatccagaggcagcagctgaaataatgcacatgctctgaaacagtcacagctactcacaatgctccccttgaatcgaaacagtcacgtttctcgcggattgtagtagaattatatatttacatcattcattgctggagctcctagctagctatgctcacctcataacctctctgtatgaaataccaagatagcatatcaccttggcaatacaggctaagctactacagatcagagcagagcggtgcagcttcctgccaaccaactctaaaatgttccaaaaatgtgtccactcactaggataactactattacctactcgttgggaagtgaatggatcagctgaggagcagcatcacccaagacactggatgaagctttgttctgtcctgatgagctgctggatttacttccctcttcaaattgtcaagttgtacttatttagctttcgccagccagctttcagtgttttggtgccaacaagaggtacattttgacctatcatagattgtcttttcaacaagaggttgtagacaagctcattccaggtatcagggactccaggcaagcaccagtggctgcaatcttgcctgtagagagggacagggcctgaaggactcaggtgtactgagacgtgcccatctttccgttgagccgtcatctgagtcacgttcagtatatccaacccgagaagcttgggcctgaagctgttccctagtacatcatttacggggttaagaaaatcagcccattgctccaatgatttaactggtgtcacatccggatgagtttccaaatgacaatttcctccagtcttccagtcaccacctctgcacaaaatatggattactaaagttgagtttgacagatcatttgaagcacatgttgtttgtgcatccaaaaaaaacattatcaacatgaagctaaagcactaatttccagccaaaagtgaatggccaagagattgcagaatagttctgcttttaaagcatctttgtcaacatgacgatggtttattgttgattgtcttactatatatggtactcagtcaagcatttcaatggaaactatgcacatatgttgctattattgtgaaagcagacactaaggtacctgactacaaaatttaagcaagtatccaaatcatattcttagaacaatatcccaagactgtcaaataatgcttgagcaaggaaatagttgaacaatcacatcactgtcgagtttgtgttttacggacctgaaatgcacaggagcatatgtacggaagatgacatgggtcttgcttgagttaacctcattgtgaagccaaccaaacaatgtctgtatggatcttttgtaagcatctccgacagtcatgtccattttaactgcatccccttcttgaaaataggtgccactgatacaagacataacagtaagagtgtaaggcttatgccatgtatattacagatatgcaattatgttaacttaaaattttgctcaaaagcagaacaaattgctcagaaccatctatcagtcatcatatatgaattagagaacataactacagaactatagtttagatattaatgcttaccttctgattgttttctcgtagttccaccagtgcccagtgttaaggatcaatacatcagcatccctccactggccccggtcagacaaccaatccatggcatctaccctaattgtatatttaacaaccccaggagctccaggtggggcacgcccttgaaggactataaaaggagatctgtaatattccacggtgcaattgtagtctctaaacttgaaaattaagaaacccatgtgttttgtgatgggattcccattaacttcgaagatggagctcttatcaggaacagcaacagagagcatacaaagaagagattcccactggttccgcccaattgaatcaccaacaaatactactcttttgtttctcaacttctccagcatatttctggcatcaaatctaagaaatcaaagaaaataatggtgaaatcagaatatgatatcagtaatgcttaattggatatgtgaattattcataacaatacttcttgatctacaagcatcagtgaggcatcatttacatgctcaaaagaaaatgaaattacaaggtcacaatcatcttcttttttttcctttatggactgttttattgagaaatcaaaggtgccccaaaagtttttattttaaaaaaaagggttaaaatcagatgttccactgttttctcataaaaaatatttatatgtttaccatagtatgtaatacagtctaatgtgttacagtaagcaattatgaaggataacaaattttccaacatgtaaaagctaccgatagtgatgataacaagaatcagtattttttctttcttctgcaaaaggcagaaacccaatctgagaatagctatacttttctgaaacagaagagacaacttttcctttctgtaagaaagacagcttaaccgaacatatagaacactggactctgacaacaaacaagacgaggtcacatttccatcaaggcaaaacaaaggtgaaagatggcaacaccatgaaagctacagacagactactaattaaacaacactagtttaactaatttatctctcggaggcctaaccatgcgcataacattgttttctaacccagtggggagcataaggcatcgagtttccaatcgcggtgcacagttcctaagtgcggtggtcgtcaacctcatttcctgtgcaaataatctaatgctcacaagggttcagattataatatgcacactcaccgatccaatctcaccaggtatcctgctaaaagggcccaaagtcagaactacatctgcaaattaacaatcattctaccaacaatgctacatgtatgagtgctagactgaaccaagtttatccatcttgagttctttacttctccaagcccaacaaattaggtgtcacccaaactagccaacgattcatatctccattactcgaaaacaatgcgcatccgaaattcatactcgatccaccaacaatgcttatgcaccattctgaatgtttggattgcagcaagagatttcgcttgagatgtctagatttctccttcacgagattgctaaagtagacaatcgagtagattcatctaaacccccaaacccccaccaaatccaaccgagcggaagcgtacaagcaagaacttaatcgaacaaaccgaccaacctggggagatcgcagcgcgacggcctccaccgccacttggagtaggacgcgtcggggcggccgttctcggagcaccggaacccgacgtccaggaaggggcagtccgtggagtggtagagcgggtagctgtcgttccacacccactccccgtcgaacaggtcgcactcctcctcctcctccccctcggcgcgcgcctccaccgccgccgcctcggccgcgatggagaccccgccgctccagagcttcccgggggccgccgacagcgcgaggccgacggccgccgagcagcggagcgaggcggcgcagaggagcagcaccagcgcggcggcggcggccaccgccacggcgagccccgccatcctggccttctccagcaccggcctcttcgtgacccgccccgccagccgcttagccgccgccgccgccaccaccaccgccatctcgatctgctcctccacccagcgcgcctcgcttcctggcagcagcgaggtagcgtacgggactacgggcgcgacgtcactgagacgggaggttgtgcgtggccgccattaaaggcgaagtggaggtctccaagaggaagaggaggatttgagagggagatgagtatttgctttctgttttagttcggcgatttttgattggaaagcgatgcgtctactaggagtaggagtagtcatttgccataacggctgtggttagtggtgcggtttggccgcgtaggagtagtagagtagcaataaattcgggcgtggtggggagaggaggagtgagtacatgtcaagtactcgtactattaaatcgagttggatctaatttgtgttgcaactgctgatgaccccttgattcgaacgaaaatcatatgaatcttggagtatttatatttttataggattttttctatatagcccttaaagttaaaggaatgaatcatatagtcctatgtaattcctatgtaatatttcattccatgcaagttttatagaaaatttaacataatgtagaacctgagaaagttttctttaagtctttatccctcttcaaattcatatgtatttctttcggtccaaccaaacggttattcatttgttttttctatgttttctaatcatctattttatgaatcatgtctttttcatattcttctatttttcctctatttttctattcatgctattcaaataggcctttgtttttgttttgataagcactatggttgtgattgttaattttattttatttttttatcgggatgaccgaaggaagttatctgaatcttattatggatgcttgtcaaattatgggcacatgatttttatgcagcaaaatgcaagtattggcatgtgcagttgaataatttatgcttaggaatatcaatcttcatttatcccgtgagcacccctactttatccgtcctaaaataaatcaaattaaaataggatatgacataaactagtagtaatgaatctagaattattatacttaggattattttctatatatatatatatatatatatatatatatatatatatatatatacatatatatacatacattatatacatacatatatatatatatatacatatatatacatacattatatatatacatatatatatatatatatatatatatgtttcaaccatagaaattcgacattgttgcatattttatattgttatgttgcaatgtttttttttaaaaaaaaatgcaaatgatgttgtttggatgtctcaataagtttttttttaatgtttcactagtatatgtgtaaatgttgcacgtggtattatttgattgtttcaataagtattgtgtgatgttacaccagttcattcacaaatgttgcacttgatgttatttggatgtttcagtaaatatttcgtgatgtctcaatagttataacttgatgtgccatgtattatacaagaatatctagttagaaatataattatatatttttattagaaatataagtatgggagatcttgttttaaagatttaattgtaacaaatatagaggtacaatcaaatatcaaaaaagataattaatttatgaagaaaaatagtttaaagttcattaaaaggttggttagagaagagtgagaatatgtttaccatgcacctaggtgtgtatgtgcagcagcttgcgacagtgcatgcaggaggggagtagtgcatgacccacaacaacatgtatggggtagttgtgacttgtgagtgatgtgaataagtagggatgcgagagtctgatgtgttgctttagttaaggattgttttcccttttcaagaacacagttaggatagtcaagtctggaaggaaaagtccactttgacgagtgagcctaataagcagctaacgccctgcgcctggctatgggtgatcgagcctatgcgagcacgagaatcgcgagtggaaagcaacgagaaagcatggctagatcgcgcgaatttgacccaccaagaattgtagcccatgttcgtggatctaggggtctgtttagattgtagccaaaataaaccatattaaatttcggcaatgccaaaattttaggaagatgataatattgtcaaaattttggcaggatttcttatgtatttaccatatttgacaacaaactaaacgtagacttttttttgataacttttaaaaaaaatggtttggttgaaaatagcatcaaagtaacatgccataagacaagcaacctaggtgcatgtgcatcccatagacttgtattaggcttgtttgagtttaagtccactcgatttaattgagcttttaaaaaaataacaaagaaaaaaagtaaaaacaatttataacatgaaacgcaagtactattatacatggaattcagcctatcaagggccataacaagaagcaaaaggaataagtttactttaggtccctctatttgtcggtcagtgagattttcgttccttaaccgcaaaaccgggtacgacccgtcccccaacttatgaaaccgagcaaacgagctccctcggcggtatagagggcggttttggccgatgtggcatctacgtggcacctacatggctcctttgactaggtcttcgtcccatgtggcaatgacgtggtgcttacgtggcaatttcatcccggaaaaataataaaaattgtgggacccatatgttagctacaaaaaaataataaaaaaggtgggcccatgtggtcccacatatcagcctccctcttctctctatccccccctctctcccctcccacactac

SEQ ID NO: 67782 - DNA, 3580 bp, Oryza sativa
gcgcaaggacaagggagagccgagaggaagaagaggaagagccaagagtagagagggagaggggaggggagccggcgttgtcagcgtcgttccgcccaccgccgcccacccctccgcccacagccgctcccgccgcccaccgccggccgccgctcccaccgcccaccacccgccacccgccatcgctccacccaccgcccgcaatcgctccgtccaccgcccgccgccgctgcgcccttgtcgctccgcccaccacccgctgccgcttcatttcacgctgctgctgctccgcttcctcccgccgcccgccgtcgctccgtccaccgcccactgccgcgccgcttcgctccgtcgccgctcgcccttctctcctggcaatgtatgggatagagagaagagggaggctgacatgtgggaccacacgggccacaccttttttattaattttttgtgtagctgacatatgggtcccattatttttattattttttcgagataaaattgccacgtaatcgctacgtcaatgccacgtgggacggagacctagtcaaaggctccacgtagacgccatgtcaaccaaaactgccctccatactgccgagggatcttgtttgcccaattttcgtaagttgggggatgggtcgtacccggttttgcggttaagggacgaaaatcagactgaccgacaaatagagggatctaaagtgaacttattccagacgcaaaattgtcggtgctggcccatggaactaaaaccagctcttgggccaaaccaggccaggccgattgtccctcacgccaaaccatcacgtgtgcgcttcgaccttcctccctcgcgatgggacccaccaagttcggcaccgccccattccctctccgcgtcggcgtcccgtctgttcgctacgcacgcactcactcactccccaaattccccaccacattcccccgcgattccctccactccccactcggcagctcgccattccaccaccaccgcgccgccgcggcgcatcgggccatggcgcccgccgccgccgccgcgtgcgccgcctccgtccgcgccgacccgccgggcatcctcgactacggcgccatccacgcctgcctcctgggcggggaccgccgcgcctccctcccggcgctcgcgctcctcctcctcctccacttccgcgtcctcgccgccgccgcggggacccacttctcccccgcggtctcccgcctcgcggcccgcctccgcctctccccgtccatggccgccgtcacgctcctcgcgctcggcaacggcgcccccgatgcgttcgcctccgccgccgcgctcggcggggccggcgggatgcggcgtgcggggctcgccgcgatcctctccgccggagccttcgtctccgcgttcgtcgtcggggccgtcgcgctcatcgccgcgccgttcgctgtcccgcccgcgtcgttcgcccgcgacgtcttcttctacctcctcgccgcctccggcctcttctacatctaccttagcgccgagatatacctctggcaggccatcgggctcgtgctcttctacgtcttcttcgtgggcttagtggtatacatggatttggatgctgaggggaaggcggtgagcaccaccgagctggaggtggtgaatggcattggtcgcgtggtgatggacttgccggtaacagtggaggatcgcaagcaacaacaccctactttgtgcacgatgttcagtaaggtaatgctccaatgagtggctcccgttagtttgttttgtctccactgtggttaatatagtattgagtagtcagggacaagtattctaatataaatagtttctttggtattcatttgaagatggtcgtaaaccgtcaatttgtttatgtgcaactgacaactgtgcaagattgttgacttacccttctagtttgaactcactgactgtattgtactcatttagggtaagctttagtttaatggtccaacttgtttgttatgcttttctatggttcaatttgtacaaacgattctagtatagatagttactttcgaagtgcacttgacttgaaaatacagtactaatgtgaacagtgctataagctgctgattggtttatgttcaagagtgttaacttcaccctggtagtttgcaattactggctgcaatcaacagcgagaaacagattactttatggctagtagaaactttagtagtgagccaatgttcccctgaaaaaatagttgttttatacaatacccatacaattgtagatattaagtagaaacaaacattaaatactttgataactcagtagtacactttgacagaaaggtaactggtaacaatgctgcaattcatggtgtgtttgtgtactttgataattttaagtagattttttcatgatgcaacctattctgatttactatatgcacaggataatgtacttttaacatagatacaattactcagcacactgagtgctaatgtacatttgatataaataggattactcagtgtactgaataatgtatcatgctaaacaagctaagtccttttagctgcaccaacatcatgccttgctgggatcaattcgctatgagtttatttatctgtatgtgattaggcagcttatgataaatattcccatttatagtaatggttgaagttagtaatgtcagctttgctactatgacaagaatgcatcgactactgtattgaatatatacaattgcttaatgatcaaaagatttttaaacttaacagacttgctgattgtttaactttgtttttatgaggaaatcgatggcatgttctggcaaatcctaagttctcatttccaattttttgtgacatttagctccttgtttcttattagactttgctaaaacatgaatattttcctctcggcatctgcattttcatgacactgattgtcatctacccctggcaggtgacaaaagtttgggagtggcctgtagcatttcttcttaagctcacaataccatcaacgcttcctactgaatggaacaaattttatgtttgtgcaaacatctgtctatgtcctctcctactcctgtattctttcagttcattcattccatttgatagccgaatagtatttcttctccctcaaagtcgtttccccatctggtccgtggtgcttttcgtgagcatttctttagccctgtcccacttcatttttgagaaagaagccccaataactgaaaacattgcaagcaccacaatttcctttgtaatgagtgtcttctggatctcaaccatggctggagagctcctgaactgccttgcagcaatcggagtcattatggatttccctccagctatacttggcatgacggtcttggcttgggggaattcggtgggtgacctcgttgctgatgtagctttggcaaagtctggccagccgacaatagccattgctggctgctttgctggtccaatgttcaatatgctggttggactgggaactgcacttgtaatacaaacagccagggtgtaccccaaagcttatgtactcgaattccatgttggaattgttgttgcatttgtatttcttcttttgagcctgatgggc

SEQ ID NO: 67783 - DNA, 1554 bp, Oryza sativa
tcttctccatatctatccatcgaccatcgcaggctacttcccggcacagttcccctctcctgatctcctctagctcatgccatagtcgccactcgccactgctgcaatggctactgaaaaactaccaatgccacaggccaaaaaccaaaaagtatagcacaggtacactcgaaggatcgacgcgaggtgaggaagttaccgatgcaacggaccaaaagccaaaatctaaccccgctcgcaccagatatgcacccttcgtttctatacgctcgacggactcgacgcccgggacccggccgagaacgggcgaacaacgatcggattcaggatgtctcggggggtcggagagaattagtgctggtttggtttgtggcctaaattagtcttaccaatttttgtcaatgtcaaattttgataacttttggcatagctaattttggcaaaggtaaaattgtgtttggattaaagccaaaatagtctaaattaaccgttgaaatggcctattttcttagtcatgccaaaatttggctccaaaccaaatagacaataaataatattgaaattgccaaatattggtaaggccaatataggcctcaaaccaaaccaacccttaaactccgcctctccatctgacccacataagggcaggcctactttacgtggagcaacctgcatacgcgtgggccggccttactagttactagtctaaggcttaattcggagagcgctacgtgtcggacgtatggcgcgagacgaaaaatcggacgtctcgcgcgaccgtccgatcgatgcacaagtgtgctagccatccatcatgcatgtatcaagccatccatcatgcatgtatcaaacgaattttatactattttttctcttaaaatatttatccaaatcataatccaattgcaccattaaatccgttgcaattaaatctttaaaacaagacaacacatgaatataatccgatgaaaataattagcttattattgaattatttttaaatgttgcacgctgttgcgctgagtatattgtaattgtttcactaagtagatcgaaaatgttttatcgaacgttgttttaccttatataaaaataatgtttcagcgaatagcgaaaggatgtttcaattcactacaacatttgatctatacgtagtgaaacatcatgagtacattaggtgaaacatttttaaattaaaaaaaaatcggacggtcaaatgttgcagttgaccaacaagtgaaacattatattatatatatggtgaaaaaaaaattagcaactggaacatttaaatattttatgaaacatgatgaaaatgcacgttgaaacatgtcgctgtcacacatgaaacaacaagtattaacggattgaaacacatgtttttcttttatcaaaatataatcaagcgatatcttattataaaaatttaattacaacgaatacaatggtgtgatcggatcatagattgaataggtaatttaagagaaaaatcattttgaagcttgctaaaatacatgcatgtatgcatgcatgaggtggagagagagtagtagt

SEQ ID NO: 67784 - DNA, 8637 bp, Oryza sativa
tttgaagatcaaaactttcctctagtatttaagaagaggggtcattttgaccaaggaatatttggtgaaaagaaaatggaagggtagcactaagtattgcttttgtagttctaataaatgaatacatctattttttagtgccaaattgtgagaaatatgtggaatgccgtatattatttttggaattcaacagccagctagtgttttgctaatattcttgctaataggctaaattcaacctaggctaaaacatattttttttcgtaggcattgcagctatatgttgggccatatggcaccaaaactatctactttttagatggtttcattggaactcattgggcgcgcttggtcctcatttttaagaggaagacagtaccttgatgaaagacgggttcaaaattttggaagctattgtgttggatttctttataaattgcaaaaccagaagttgccattaccagtttatttgacctcctcaagcggttttgacaatggttttattagacctgatggctacgtagcgttactattgaaaatatattttaaaaaaaacaatgtgacccataatttggctgccatgtagatctaatactcgcaagcaactggtacatgggctttacccgcaaaaaaatcattgaggtttcatctctgggcaattagcacggctgcagcggtatcctgtcctatggcgaagatcaccattcactagtgaactagcaaatgagttgttcccttgtttaatgtgaagatgaaaattctgccccgaaagatgtgtagtgaaactgtaaaaataaatttcttttgcacttcaattgttccactgtaagatgcggtcaaatttgacattgttttcaaaactaacatgtgacttaacatctcatatatgataatatttgtagcgacgaaatcataaagattggaaaaaaattgaagtgtcaaacccaatcatattttgttcgttgaataaaaattaatttatattagactaattaatggtcaaatatatcgagcgttgaacattaaaatacatgtttgtcttaatctatgggatggatggagtataaacttgtagatacaagcataaaattaaaaccattatatcataccaatgaaatgtatatcttatagaacatccctgactccctgtacaatgggggagtaaaatttttactcactgtgttcgagtaaaacattatatatcacgtgctgcatgtgattcagaacgtccatgtataaaacacactaacattaataaggcatgcttcttgaaaagtacagcaagaacattttactccgggaaagtgtaccaactatttggcttgctaatttcaaatgaattgaactaaaatccggtgaaaatccaatgaatttctgttccaagtggaacacacaatcaaccaacgaccacgaaatcactggagaagaccatgctctgtccctacctttgtctatggcttcaatcagaaccggtaagctagtggctctaaccgatccctcagtgcataacatagtacaatcggcgctgaaggctcgttccaggaaggagcagaggtcacttacgagtgttttgatgctgcctgaacatttcacctggtccgtggctgtagcaatccacccagcaatgttgcaaaacttacacccatattcaactcgacagcactgagatcattcaattcccaaagcctcccattctcacgaaaggagaataataaccaagagaggctgggtaatatttaaaaaatacattgcagtagagcaagtaacaaatgtgggtgtgcttcacttcggctttatgctaacaatgtgttgtttggtgttgacttcctatcttccactccttgagccaatacagttcccattttcttcatttattgtaaaaaggacctgcaccctctggttccttgatctcctatatatcaaaagttcatatactgagaaacaaagatatgcatatgctattgccgatgtttagataaggctatgagctcttacatggtagtagctacaacataattaagccacaaattgcaatagtacagcctagatagttgtacttttgtgcttgtttctgccttcatgtgtgtatcagcctagtaggctgaatattagaccttttttttttcaaaactacgtgcaaacaaagacgctcatataaacatatgcccactcactcctttgaacatacacatatacatcttatccttatgagttcatccgaaaactagactgttatattttgaaattgataaagtcaccgcggatgtcttactatcgaggggtactatgtcatctactaccgtagcaaattattaggataggactagtgcatatatagaaagggtaggattggctccagtaatttctaaatatacaggccaaatagaggttaaagtactaaatattttacacgagacattttgccgcacactcaccttcttgtcgtcttattttgaagtggacatagtgatttgttttcagtagtttgtattcggaagaagaaaatacacaatgccacatgaagttaacactaatagaaagggcagtaatgtttaatggagaggaggaatcgaagtcgggcagctctcctttgtgcaaagcttgccgcactacagtatgggagtggggaagtatctccaccgaagctgaatggaagttaggcccgtttagcaaggctctacgttatatctctcgtggagctagagataaactagatcaaccgattttagctcattcgaaaaaagaagcggagtatgctagagtgatatttaaaaaataaactagaggggtcgagtgagattcgagtcgtttcatagctccacatcaaattctacttttggatttagatttaagagttgaagcctgccaaacgggccccaagaatggcaatagctctgacctgtatgttgcaagctcatgatgggctgaatgcctgaatgagatggtgtgccgcgttcctcgtaactactacctcgctcatctcaactacttcaagggaaaaattttcgcctttaacatggtcgcccttagtgtactggcctccgtctaatataaggaccatcaccatttcggtgcgacttgtgaaccagtgagtcgctccgttgtttaatgtggagatggaaccttttttaaccaaaaaatgtgcagcgaaacaacaattttcctactttcttcacccgtaaaaagtaaaacttgtagcccaggtacaactgtgtaaattactgtacatttaacgcatacttcttgagaaagtacaccaccagcatttcgatcactccgtgcaagtgtacaaattgtacaaactatattagcagcctaagaattttcacgagcaagcatgcatgcatatacgttgatcaatcctgtgtccaaccaatcacacactgcaaggagacgcacggcgatctctcaacgactccctgatgtgtgagatgaatccgtgtgattctcacaagccctctcgtggagaagctcctgcagatgcgcgttcctggccatctcctcctccacctccgtgctcagctcctgcaccctcttctccagctccctcacgtacccaaccagcatctcctccctccccgccgtctcgccgccgcctccgccatcgccttctagcacctgcatcaccatgtccctctgcatctccaagctccccaagatggtcaccaggtggggaaccgccacgtcgcttgagccatcgttgccatcctgcctccgccgctgttcttgctcgtgctcgaccatgtcgtcgtcgttgtcgtggtggaaggggaagcatggctgctgctgctgctgctccggtggcttgtcggtggggtcgagctcgaagctctcctcgttgaagttccagccgctgatgcgtcggttcttggcggcgacgacgttgctgccgctgctggcgtggcggcacggggagacgcagcgcgcgccgcgggcgcagccgcagagctgggtggagtccctgcacctctcctcgacggtggggacggcgtcgagcacgttgcggacgaggtagtcgtagtccctggagcggcaccccttgaagaacgggtggcggaggagcttctccgccgacggccgcttcgccggctcctggcacaggcacgacgacaccatgtccttgaacgccttggagaacttcttcttcttcctcgccgccgacgacgagccctcggaggaggaggaggaggcgtcgacctcgaggcggacgcggctggtgatccgcatcagcatcgacttggacggcggcaggtgggagagcggcggccggccgtgcgcgagctccagcgccgtgatgccgaacgaccagatgtcggccttgatgccgtacccgacgtgggagtggatcacctccggcgccatccagtacggcgtcccggccatgtcgttgaagcacgacgagctcagcgccgcccccgacggcggcggcgcgtggtttatcgggccggagaacgcggacgacgtcgatggcgcggtctcgtagatggacgcggacacgccgaagtcggcgagcttgaccgacccgtcggagtcgacgaggatgttgccggccttgatgtcgcggtggatgcggccctgctcgtgcaggtagcacagcgcgcggagcgtgtccctgagcacgacggcgatgcactgctccggcaggccgtcggggaagccgtgggagaggatggagtggagcgagccggcggccatgaacggcatgaccacccagaggtggctaccgacggtgaaggagcagtgcgcgcggagcacgttgcggtgcgacagcagcgccatggccttcgcctcgcgccacacctcgtccaggttggcgcgcgaccgctccaggtcgatcgccttgatggccaccaccgccgaccccagcggcacgcacgccgccttgtacaccaccgcgctcacgccgctcccgatcttgcacagcagccggtacgacccggcgtcgagcgggtacctcgcctgctgatggtgatggtggtcgtcgcctccaactgatccggccgcggccgccatggctggcggcagcggcggccggagcaaggacagaagttgtagcatcagtcggtctcgcatagcggcggtgtcacgtacgagagagacgatgactaattaatatacggcgcgaacgtgtaacgagcggcggctcgtgatcgtcgttagctgctaatcatctcaggcgagagctgaggtggttgttcggtttaattagcaccgtgcgtgcatgtgaagaggtggtaaaaaggcaaggcgcgtagcgattcgggtggcggtgtcacgaagagctgggggaatctcgtgaagctttggatagttagttggtgttaattatggtgtgtgattgtgaatgcgacgaacgggccaggcaccactgtacactacaccagcgtccagtgaccgatgatgatgtctgtccatttgtggataattgttttactttctccccgtcctaaatacatgatctgttccaaaacttacgaagtggtgccatgaagtggtgtcatttatatccgtgaatctaaaaattatatatttagatccgtgaatttggtttagtgtactatatatccccaattaatccaattgtctttcgaccgcggctgactgtcaccgtggcaccacacgcaagtaacatctttgtgcttagcccgttctgcatatactttctcgcataacttaacctgaccaataacctgaatccttcaaaatatcccaatcaactagggtttcgacagcgatgttagcaacggaaccgggcaggcggcgaggtagcggctgtggcagccaagtgcacgcagtgaggttagcggcgagaggcagcgcagtgcgatggcgcagtgcagcccggttaaaggcagtaggcggcgcagtgtggttttgcatgctcggcatcccatgtattctccaatacagtcgctggaagaagctatcgttgatcaagtgctcgtcgtgtaaagagaagaccatcgtggatcgcacaatgatgacgatggagatagtttcactatgatagaaggtgttagtccttgcggttgctggcataaaaggtactccttgtttttcatgtcttaaatactctagtcataaaaaaaaattagaaaaatcataagattaacttaatgcgcgagatatcttaattcgcaagaaatcaatatttaacttttagaattgtagaaaaaagaacaaattaaagtccatagttatgtttgttatttttgttacaagttatagaagttaaatttggatttacatgcttgtaatgtgacatatcacatactacctccttttcaaaatgtacgatatcgttgacttttcacgtaacatttgaccattcatcttatttaaaaatttaatataaatatgtaaaagtataagttaatattatatttgtatttgatgataaaacaagttacaacaaaataaataatatttatttttttaatgcgatgaatgatcaaaagtcaatgtcgtcgtacatttttaaataaagggagtattaatctatcataataatttgtttttaattttttaataactatttaaatgatatgtaaaaaagaaagggatattaatgcgaggggaaaaggatacttcacaaaaaaaaattatttgttttgtgggatacataaaaggacattattttagatacctgataaataaagaatacgaagagaagctttctccaatgacagatgtggtacataaaaaaagcaaaacgcacgtcagtttttcatagggatacactaccacactttgaagcaagcctaaggatgcgtatattttctgtcagtcccgcaaaggactcacagaaaattatattctgtcggtgcacccacagggatatattttctgacggtaaaaccaatttttccgtggatttcgctcctacatagtaggtcgagtctggtagtggaacttgtgtcgtgtgtatgatttgaaaccaagatgacttatcgtagcaaatattggtgcgttcgacaactttcacagcattttgcagcagcacgcataattaagataaacctttaatcgagtaagtaattattaaaaaattaaaaatgatattatttgatttttttttaaaaaaaacgttcatatattaaaattattgtacaaaatataccatttaacagtttgaaaacatattaagggaaaacgagaaagtagacatttaaagttgatgaaaaaaacttagctccagttttacactgattaaagtgccacgtaggcatgcacaggtaggcgtcacgttggcaacataatactcaccgtgccaagattgtgaggagcggaggaggaggatgcagcggttgggcagcacgacggcgagcgttgccgcggcctcccgccggccaccggcgtcgagggagtggagagaatggacgtcgagcggcggcggcatgaagggagccgtgccgtcgcgcgtccctcctcctcgccgcagctcatccaatgccgccgtcgcagcgtcgtccctgacgtggatcgatcggctccccaggcggaggcgtccggcaatcctggatctgacatttggtgggtggcgcccggcaacagaattattcccggccgttgctggcgtccgggtggccagccagacctcagttccagagcccgacgactgatgggctgattacttgaggtggtgttcggacgaaaacgctaatccgcgaccggtcgcgcatcgcgcgcggagaggagcggcggacggcgcgtgtacggtattcccttttttttgttttttttttcttccggcgcgtgtacggtttcttttttttttcgttttttctgttttcttccgtatttttggtttctttttcctttgttttcgtttttttgttttcttccctatttttggtttctttttcttttttttcttttttatcgttttcagttttttcggtttttataaagtttgtatacgtgtatataaagtttgtatacgtgtacataaagtttgtatacgtgtatttttttattttttttatttacgtatacaaagtttgtatacacatatataaagtttatatacatgtatacaaagtttatatacagtacataaagtttgtatacgtgtatacgaatatacgtgatgttttttttagttttttatattttttaatatgtacgtatacaaagtttgtacacgttgtatataaagtctgtatacatcatatataaagtttagacactactttagactagtcgcgcattagccccccccccggtgtttggatccagagacttaactttagaccctgtatttagacattaatttagagtattaaatatagactacttacaaaactaattatataaatgaaagctaattcgcgagacaaattttttaagcctaattaatccataattagagaatgtttatcgtagcatcacataggctaatcatggattaattatgcttaatagattcgtctcgcgaattaatccaagattatagatgggttttattaatagtctacgtttaatatttataattagtgttcaaacatccgatgtgatagggacttaaaagttttagtcccatcaaaatagggtcttatctccaatttttttttagagagagagagagaggatttagtgaatcttttcattgaaattcagcggagtaaacagtggagt

SEQ ID NO: 67785 - DNA, 1371 bp, Oryza sativa
tgtgcgcatccgtttggatgtgaagggcgttgaaaatgcggccgatccccaaaaaccaccgatggatggaacagcagcctgccatatctggaattcttgattgtgaccgtaaagctactgaggaaagctgccgctgctaccactgcagaaaccacgccaccgatcgcaatacaagctgaagagcgttaagaatcagccgaagccaaaatttaaattctaaaacttaattttgtagctaatttaataataattttaatataataattttcattgatttctaaggttgcgttcgatccagctggttcccaacccctctctcttgttttccgcacacacgcaaactgctaaatggtgtgtgttttgtaaaaagtttatatacgaaagtttaaaaaaaatcatattgacacattttttttaaaaaaatagtaaatatttaatcaatcacaggttaatggaccgttccgttttctgtgccagaagatagcgttcccaacctagggaaactaacgcaacctaagtcgctaagaacacagtagtactttcgtgtcatagagggtgtttagatccagaggtgtaaagttttggcgtgtcacatcggatattatatagggtgtcgcatggggtgtttgggcactagtaaaaaaactaattacagaatccgtcaataaaccgcgagacaaatttattaagcctaattaatccatcattagcaatatttactgtagtaccacattgtcaaataatggagcaattaggcttaaaaattcgtctcgtaaattagttgcaatatgtgcaattagctacttttttagcctatatttacttcatgcaggtgttcaaacgttcgatgtaacggggtgaaaaattttggggtggaaactaaacaggcccataattgcccagcaccctaaacaacaccatatataataacctaatatgacacgctaaaactttacacccatagcttccccttataaagagtttgaggcaattacaaatttaccactattttgaatcgttattacaagactgtcactagaaaattgcaaaaatgctactagaactatcgttcgagtgacatacttgtaatattgaaaaaatcggtggcaaatttacaaataccgcgaagagtttttggtcaatcggttgaaagggctgaactgagcaaggaaaaagcgacgtccacgcagcagcaaagccagcaaggcagcaacgatggcgcgggcgcggctgcgcgtcgcggcgggaagcttcttggaaagggaaggcgagacgagacggacgcgggtaagtacgtacggggtttggacctgcaaatctgcaatgggcaagtgggttgggcaactatagccttggctgggcttgggttta

SEQ ID NO: 67786 - DNA, 7741 bp, Oryza sativa
  unsure (1)..(7741): unsure at all n locations
attcctgcagcccttttaaaaaaaacaccaaactacatgaaagaaacttacaatttatacagatttacaatattactagatgtaaacaagtattcaaactcagataaaataaagtaaaaccatatatgtaaccacaaaattaagtaaaattgtatattacataccaatgtaatttcggcttatggatgtgtaattttttttactgaaattttgaaatctagcaataccgtatatataaaagtatatttgacctctgcattatccatatgaccatagacccaatattttttcagtaacacagtacaagcgtagtcgcttataacacgggcatgatcacccctataaacgcacatccccgcaccttacccctatgagcgccttcaaaatgatgggtcgttatatcttaaaattgacctagtcatcatgaacatttcgctattgatgggtacgttacttaccactgaaaaaaataattaaccgtaaataagagcatccgtatcaagtctaaaacttaaatacatgtgggttgattaaagaaaacataaccagttgagtcatgcacaattcgcacagacctaatatttgaacccggttgtacatagtacacattaacacggttgagttttattttttgaatgcgaacagggatgagttattagctcatgaacattcctaccagtgttttaccgttatctctactgatactgataccgttcagtttttataatcaattactccctccctcccaaaatatagcaacctagaatcggatgnaacgtattcatatttcatccgatttagaatncgttccatccgattctaggttgctatattctgagacggagggagtagtttttatgacaattgacggtggggatgattaatttacttgctttgtgttttacacctttcgagagatctttgacttcctgtaattcattctttttaattacttgtttcatgttttacacggttttagatgtctttgacttcctgtaatttatttttatttttttaccgaggatgaagagtgaggagagatcttgactttgctttcttgcttaatttagttgagcatcgacggagatatcatcgagagatcgacttgatccacctgaaaacgatatatttaccattccttcctgaacttgctgatcttccatgtgaaaaagccaccattttttactctgtttagcacctctccacctctgattcgatcttattacttttgcctttgctttcttttttttttaaaatctccacatcattttcagtttttcacgagatcattcagatctgtagagctttccaagggagcagcagcttcctctcactgtcacctcataatgaagatgctttgtgtatagttgtgtgatgtgttcgtcatctcgtctccttgtagctacgcttgtgtcggtgcagcagccagtatggttttctttttttaaccatgcatttaggttaattaatctcatttcaccgattaatttgcctgtgtgaatttgagattaagtagggaggaggcattaactagagccggcacataatgaaggctgatgtgaatggatagatgtttttgcagggcatggagagccatactggtataaacggtgtggcattgaagatttcacattacctgttgaactacgcggccatgtcacgaggagttaatgacagcatttagattatcataaaattttcaagttcttcttcttttttaaaaaaacatgtttgacagggccagagaagtttcagcaaatatatggattattccagctctgatcaagttatgtgttaaattacgagcaacgactaataagccgtagaaaaatgaagagaacaaatttataagttttttttaaaaaaaaatgtaggttctaaatttgaaattggtgtgatttgtaagacaataatcagacgacgagactttcaaaaaaaaggaagtcttttgacatgtgcacaccgacaggccattttgcttgcaatgcacacgaagaattgggacagtgctttggcatctgaaaacgccacgttgtcgtccctcacgatccaacgttgatcttggctcatgattgcttctcgatcaattctttctttttttttaagaatttcattactactactgtacaggggtactggtactagtatacatactcctctcgtactattaaaggaagtcgtttaagataatatttaagtaaaatcttaaaaatataaatcatgaatagtttttaaattattgagtctgaaaatataaaaactatatgaatagatttagctttcataaaaatatatatgccacttttcaataaatatttttatagaaacaaaaaattaaaattatgttttagagatcgcatcgctgttcaaaacgactttctatgcagctgaagtcaaggcatctgactgtagacttcatatggatgtatcagatgaccacgtggcacgttcttacagggtcccacctacagctgctgtgcagtatgcctcccctcactgcacctgatcccaattcctcaccgacgaatgctacgaaatgaaacgaataatggtcgcctttttttggcacatgaataatggcctcctgaatgtacctttcgatttgaaggttttcacaggagtttcaaagaattcaaatccttagatgtttgtttctctaagaaaaaaaatgtacgaattacccccctcccccctaactattgcgacagtacgaattaccacataaaccacaaaaccagacatattacaccttaaactattgataccggatgaactcccccgcccccctcccccctccgactcaatcctgagctgtttttctcctacgtggcatacacatgacgtcgacgtggaaatccaatcagcaaaaagaaataaaagaaaatatagggcccacctatcattacctctcttcccctcccccctcactccctcgggcgtgcgtggacgggctatgggcggcggcggcggcgcgcgaacgggcggttggcatgcggggggtggcgacaaagcgcgagaatggcacgcgggcggcaagcggtgaggagggcgttggaggaggcgggcttcgttgtcatcgtcgtggggagaggggcagatgaggttggaggatgcaccagcgagggagcgccctcctcgccgcaacccgccgcctctcgcgccctctccgtgagtccgcaacactatagccccatcgcctctagcgccctcctcgccgacgcccgtagcccgcggtccgcgtcccgcaccctccctccgcccacccccccccacccccgcccgcgcgcaacgccgtgtgctcgacctgcactggacgacccaaaccctatcaagaacgtcgccgccgctgctgtcagggttatggataccacatacttaatagtagttgactaaatctcggcaggacccaccacataccatgtcttatacggaaacaatattcgaatataggaggagttccgcataaggaaggataactagagttctacatgaaaatgacaaggactactcggattgtatccatattggtttccctagttctacttggacaagaggacacctatgggtataaatacaaagccccctaggaggagagtgaacacggaacaacagaagccacaacatacaagccaacatacgccaagacaagacactagatatcgacttcagagataggcatgactagtcccctacggtgcctacggataccgtcaggagagatatagcgttgtctctgatctcgccggatgcggattcgaggaggaaggctaccctgttgtcgactacgagtcagacattcagaccgccatgtcgacaacacttagataggctaccccaaatattgtacgagtgtgattatggtgaataagagcaataccggcttcggccaataggatgaagggttattacctgacaattcagggggcccgaacctgtataaaaatcctcgtctccgtctcttttacctcaatctcgcatatatcctggtatcaatgatccccatactatgcaaataccggaatcgtgacatcaaacgtcgacagctgccgccacgctggtcgacgccgcccaccactcggagccaggtgacgacacgcggagggagaagctgaggacaaagagagatgaggccatgtcgacccgtcgctgccgcccaccacacgcggagggagaagccgaggatgaagagagacacggccatgtcgacccgctgctgtgcacgctgaccacccgacggcccgagagaggggtgagagagagagagagagaccgatgaccccaggttgaagatgatgatgacgaactcagacggggtggtggtgatggcggcggtcgccgggggctcggagcagaagggcggagacgacctccgcctccaccctcgccacttcgccgccctccatcgcgacaggggggcagcaaggcggcgcggcagcagggggacacgggctcagccacgcccaccgcctgccgcgcccctggcacgcccatcgccggccaccaacttgtcgctcccaacgatatctgagacagagatagagagagattgagaggaagaggggaagagagaggtgggagagtatgacaggtgggccccagcatttaaaaaaaatgatgactagattaccacgtgaacgttatgtaggacaataccgatttggattgggtcgaggggggttattcgtccagtatagatatttcaggatataaaatgtctgattttgtggttcaggggtaattcatattgtcgtcatagttcgggacgtaatttgtactttttttctttttttctaattatccaggttgtttggaagatagcattaaggatagccgaattcatttggattgcatctatgtttttagattcctttgggatctgcgagcacatatatttcaatattgttccttttctattcctatctttccaaagaataaattgcacattataccagcttctatttctttataagtggccctcgtggaagtagagatcgagcttatcggccaccatggctagcgctaaagatgcggattaggggcaaccatgtgaaggagagaaagagcttggggttcaacctgatttgaaggaattatcactaaggtcgcggcattgcgcccaagcttgtggaagtttggaagagcatggcagtgagatcgtcctcaaatatagggttctgcctgatttggaggaaaaaaaaacaaaaacttttcaaccatcacatcgaatgtttggacacatgcatagagtattaaatttagaaaaaaaaaaccaattacacagtttgtgtgtaaattacgagacaaatcttttaagcttaattgcgccatgatttgacaatatagtgctacggtaaacatttactaatgacggattaattaggcttaacaaatccgtctcgcggttttctggtgaaatctgtaatttgttttgttattaggctacgtttaatactttaaatgtgtgtttgtatatccgatatgataaccaaacccaaaaaaatttcataaactaaacaaggcctaaggttgtggcaggtagcttgcaatggtggtcgttggttggcttgaaatagtgatgacaaaaaggacaaatgtagcctaactagagacaaagggattgcaagtttacctgattcaaagtaaaaaaaacatgagaacaggtatgttctatgttgcaactgtggtaaagaagccctagaagcgcaggaagagaaccgatggcaaaatgtgtgatgttgttccttataattgagggcaacgaagaacaaaatagtcatgtgaaaaaattaaaccatttactaggaacaaaactcgagaaacatttaggggttttccgactagcttcgcaaggtggttggctagacaacctgagttcgatgtctcacctcttctaattatttaatattaggtcatgccctaatattcacgtctttttttattagtgacaaaacttcatgcgaaatttaaacagaacataatttctgttttttagaactaaccaaggttgtcattatcccattcgtatctagtatcttacgatattatgatcctaccgagacgaaacgatccgatcccacctagtatcctaatttttataatatcgcgatcctactattcattactacacgatcctacaaaatcttatatggtatcccgattctacgatccctacaatactacaatattatttaaaataacatggtttaaaaaataatgtaactaaatatactcaaatttatatgaaaatcagttcaatatatcaaaaccaacgtggtttctcttgataaatgtctttatttgcatgacatatatcattactatattttttatatagaatggctatatataattaatataaatattaattaaaattaaaaaaaatctcatagtatcccgatactacgatacgatcctacgattcgatattactttgagcaaaatgatactcccaccatctatttttgatagtcatatttccaaatctgaaaattttatttttgataggcatatttcaatccaacaacctatcatcttaatgattttctcgaatttaatgcgtgactctccattcttccacacatgattggctatatgggctttgagaaatgtaaatattaatgaatcgcttgtttacgaggaatgactagtagcatgcttaaatgaatgataagtagaattacttatcattggtctgtgtatcaagatgaaatatgactatcaaaagtagatggagggagtactacttagtatcccgatcctgacaaccttggaactaacataatttctgttgagttactcacagttaacccaagtgccactccttatcagatggtctcaatcccaattaaacaaaccaacatgaggtaaacatgtaaaagctatacttaaaaaaagaagagaaccatcctaggcatgattaattacactcccttccaatagcatcaccacttgcaaatctttcttttttaccctaaaatagcatactatgcgctacttgtagtaaaaacgccaaacgtgccggtaatcccatcctcacgcgaagttaagcatttaacccccttccattaatcacgcgtcctctctcaaacccgtttagtaccactcctgtacgcgtcacgtgtctgaagtctgaacacgctttcccccctcccaaaaagcctttgacagtttgaccccccagtttgacgcgcctctccacgcgccgcgccacgccacgccacgccacgccacgccacgccacgccgcgccgcgccgtatataaaacgcgcgcgcgcgcgctctcctctcagtctctcacacgcaaacgcgaacacgcgaggacatggacgacatggccaagctagctcagatgccgcgcgctcctctgctcgtcctgctgctgatgctgggggtcggcgcggcggtggccgtgccggagtacagggaggcgccgcacttcaccaactcggcggcggcgcggtgcccgccgccgctgccggcgacggacgcggacgcggcgtgctcgccgcacgcggcggtgcacgtggccatgacgctggacgcgccgtacctgaggggcaccatggccgcggtgctctccgtcctccgccacgcctcctgcccggagtccgtccacttccacttcctcgcctcctcctcctcgtcgccggaggcggcggcggcggtgcgggagctgagggacaccgtgcgggcgtcgttcccgtcgctggcgttccgggtgtacccgttcgacgagtcccgc

SEQ ID NO: 67787 - DNA, 4463 bp, Oryza sativa
ctgcagcccgtggatggagctgcagagacgggtgcgcatctacgagctgggctcgctgccgccgttcctcctcgtgttcgccggccgcatcgccgccgtcgaccaccgctggaaccagcacggcctcggcggcgacaactaccgggggctctgccgcggcctgcacgccggcgccgtcagcctcctgcactggagcggcaaggggaagccatgggacaggctcgacgccggcaagccgtgcccgctcgacgccgtctgggccaagtacgacctgctccggccggcggcggcgatcgagacctcgtgagatcgactgagctgctcgccttttttttgtttttttagaagaagaaagaatgtgttggttctttggttgttcatagatcatcagagatgtttatgccaagtgtaaatattgtttagaggaatgaacagtgatgatgccaacttttttgatctaaagtttcgagtttttattagatttgaatttcttaagcttttgtgtgtgcccttgtggatgttgtgttcttcgtttggcatgcatgcattgttggtttttaaaaattttatttttgtctacatttctcctagctagctatatatataatggtgccaattagtgtaaataattaatggttgctactatatatactacggggcaaggtttgcactcagttgcctactttggcctgatcttttaattatggcgattgtgcatgtgtctatttcaaacatttttcttgttgttttcaatcaatttggccaatttttaaacactttaacaacgagctgctcttcctttaattaaagcctatgttcttttgtgcctcccactaattttgggcttgattagtggcgaaagctcgtttttagcataatgggtgaagagtgattgtcggattaactgatgcgaccgcgcccatttgccttttgttttatttttatgtgctttttatctttgtgctcccacgccgagctaattatattcacacacactttattagctagatatacaattggatttggaacagcatccatgtggccaccgtggatttcagaaccaagaaaataaaaattccacgaactgagttagctcggcatgttagattctttgggggtagaacatattcattgtattcaattttttatatgcctgtttgtatttatagctaattatttttccatctattgatagtgatgtactcgtcgataacaaaatggatgtgatgaatttattaatcttaacatatgttgatttaatcttgataatgcttgtagagacgagtgtatgcattaatgttgtgtttagaaaattcaaataatcaggaaccaagaaaattagagaaatgtgaggtgtaaaaggatggtttgattcctcttcaaattaaaaaaaatggctgcttcagtgcgtcgccttttgaattaattcggagggctgttttactgcatttgacaaattttaaatatgccgcttacaatctttccagttgtcctggcctgacaacaattgaacagtttcagtttgttgcatacattaaaatttggatcaaactatataataccttcgtcccaaaatataacaaaatccaaaaaaaaaaaatagactcgtcttattattacgaatctaaacagaatatggcaaaagaagatgagattatacatattctatctgtccagatttacaataataaaatgagagtgacatcctagattattttattttagcatgaagaaagtatctacataaccccataaaaaaacctagtccactctttaccgatgcaaatctgtacccaaaaatgaacagtataaagtagcaaccaaactttaacttgtgtgcccttttctccatttcctattcttttaggccagtttctaattggcgcttaaaaaggttttgtgcccaagctgatccgggcactgttccggggcttgctttggaccccccgacatgattgcgccgtcgatcgagttggtgacaatccaacaattaatccatccgggggtatgtgcagcgatggcgccgtttcgaccggggccgtgtacaccgttaggcctgcacttttggaggccattatgtgcatctctcagcctagtatctatctatctatctatctatctatctttgtatagctcatcgatcgatcatcttttttcccgatttgatattttgatttgcggtggcatctccactcctactgatccaatctcctctcctcctccccaagattgatgtcgatcgatccatcgttttatgatcttttcttcgacttgcgcccggctcaaacctgcaatggataatggataaaaattaaatacatataccgatatacgtaacataagaaaaccattagcgtatgattaattaagttttaatatttttaagcttgagaattggatttatatggtattttaaagcaacctatataaaaagttttaatatgaaacatacagtttagtttgaagaacgtgctaacaagaatcaaatatgtatcttaatcagaaaacatgtatcttaatcagaaaacaacgagaccaaattagctaatgattcgctgttatggctgcaactaggagatggagggtactcgcatgctgcggatggccagctcccaatgcgtggtcacaataggggaacgagttttaatcctttgacagaatgttccaagtgtgtactccatttttgcatagcttggtcatgtctcatcagtgctagccacacgcccgcaccccaagtgtcacgctctatggaaaggattaatgcgacagtttttcgaaaagtatggaaaggatttgtgcaagttgggatttttgtgttttatacattgttctaggttgttggaattaaatttgcgcattccatcaagacaaatctattcatataatttttacattttcaaacttaacaacttaagagttattcatgatttatattcctaaggtttgacttaaacatggttctaaacaatttcctttacaagtacgaaggaagtagtttggttatgcgtgcatcttagttacagagaggctagtagtattcttagtacgatattatatcatcttatataattgatggggtttaatattttttattatcttagaaaattatgccatggccaaaaaaaagcagcaggtaagttgcttgcgtgatgttggatttggcttgggacgctgcagatcctttggcgagtggattatcactagatgcagtacgtacgtacatgcgcgggatcgtgctgttaacttcactaggataacaagaagatacacacttcttgcaaaaaaaggagaagcaaaagaaaaaagttgcttgcaaatatgcacttcgttttctttgcacttatattaatattcagtgctgttttttttccttttttgagattgagagagacatgcaatgtttattcggtgtcacattgtgagatgtgagagttccaacttgcaagttgtaagtgcttacgtattctgtgtgatcagcagataagatcccggttaacgtaaaaggaaaagttcacttttaagttctttgtctaagtgtttagtttgaatcgtgtcccttaatatcctttctctctcgaaatcaatgcaaacgagattccaaacggtattaaggtcagtttcaactcacgtgacatctatatggtttgttgacttagtctttatcctacaaggcattacatgcgaaaataaaaataaaatccctaattcgggacctacatgtcaccgagatatccttcatctacttctccctctcttcttacacatgttgtattcaaggtggtgagctcaacgagaggtgctcgtcggcgtcgacgccaacaccggcgatacatcagcctcctcatgagttgcgttggaggaggatcaccaccattgcctggacacatttcgcccatgtttgatggggcgctcattggcgttgatgtcaacaatgacaacacaactcatggcttccctatggtggaggtgcaggtgccagcctatcagaccccctctcgtcgacgttcaaggcaagtggcagactatgttgcgtgaagctcgttccccagcactgcccgtggtggtggagggcagcaggccttagatcgggcgcgcgacaggactccattgtcctagaaccccaagccttgccactgcgggaggaaggcatgaggtggggcgagaaggaggagcttggtggtggcatccacctcggtgcgctaaacaagctggagttggcaacgatgaaggacgacactgacgagaggccagcatataaaggaagcgctgctgagggactagcggggaggccgacgagcttcctccaccttctccgaacgctagcgccaccatcctgtgtccactaggcttgtgggtcatgggctcacggcatggatttgggcccatcgaccacagtgtgatcccaccacctcctatccttgttccatgagggcaccaaccgtgtgggatctcaacaggaacat

SEQ ID NO: 67788 - DNA, 1842 bp, Oryza sativa
  unsure (1)..(1842): unsure at all n locations
tgcatcacaagaagaagccgcaagaggacatgcaggacccagtgcagacggcagcagcagcaatgagcacaacaatgcagactacggatccccaagcacagctcgacatccatccccattcctgtatgtctgccagacttcacaatattgcatacattggacaatctgttaattgaaatgaaaaaaaaaaaagaagagcaccacctcttctccagttaaattcagtcaagatatcaattccagtataattttgttatgatgaagagtaatacatgtgttttccatgtgaattgtagcgtgtgaatcagcatgtgcacctgaggtatacatggaagcatcaccaaggcaaaattcaccactcccgagcccaactgcacacaatgaacaacaatacttcaagatcagcagcaggtttaagtcagaaatgaaggaagccatgctgagggaatcgaagcagctgcgtgtcaacacaaccaaaccgaagactgtaacatttgcgccaatcttagaacagggggcagaaactgtaaaaaatgattggcacagaaaagaactgtgggaaacagcaaccgagatattcagtcatgcatatgctatagtctatgaggcagtcctcaggatggtctctataatccaagacgcaatgttatcatataatttggcagaaggcaaatgttagagaagatcatatcgttcaatagatacctgatgctgaagctggcacctggagaaggtgataaagtactctcaaaagtcattactgaggctgccctcgatatgttttatgcctggtgtgtgaatgttgagaggcctttggtacagagggcaaagaagtgttttcttggtttctgccagaaaggagagaagagttacctccatcctgttgcactgtccacccatccttgtgtttatgaaggtaagtttcaccaagtatgcaagggtagtcctatctgcagaatattattatagggtttagcaataacttgaagcctgtgcaatgaagatgcagaagaattctcattagagaattgactacggcttgaagcacgagatcaagactctatgaaacaacataagtagagagagatgtttaccttacaatgtccgaagaccggaggcgaagacagagtgtttgccccaagtatactttgttcatagaattacatcataccttacaatggcaggctgcatgtgaaaccaaaaggaggtttatgtggctgtgtaccagaaactaatgtacaagattgcaatcttaagtgtctcttcagataaagctcagtaccagagattagattcacaatcagtgaccacaaattccacaatgtaggcagaacagaaatattgaaacaaaacgaaaatcctccaactgcagaactacaattactctggaaagaagtatatatttctttgaacgagcaactagccctcacattcttgtcttatttattttggacataaccatgccatgattagcacaaaaagaacacacaagtagttcaaactagaaagtttaccagcttatattcatattacaaagaaaataaaatacatcttgctccaaatcactgttacaaacatgccatctcagcccttttaatgggacaccattcagaattatgagttcagtacatacattgtgtatattaacatccgcacatactataatgacagcaggcctgtcagtctctcactgcagctcgtaggacgaaaaggtaaatccagaatctttctcattggtacacttcagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 67789 - DNA, 18725 bp, Oryza sativa
aaaagtgtagttcactcaacctctctgctcaagctaatgttgagtcgtgtttctttcaaaattttgggcttgggcttacaggtttccattacttggaaccaatactcctagtgtttccttcatcttgtattggatgtatcatgtatggctgacaaaattttggggcatttataacaaagtaaatttaagtagcatgtactgtatatggactgaaagagacaattacaacgatgtacttttgtaatatataattcatttgttgtaaaacatacatgaattttgaaaaatttatgatcaaagataaaagtatatgacataggacaaaactagaatgagaagtaatgtgaaatggaaggaatatatgatacttgattttctttcaaactttgaccaataatattgatggtggcgctaatactcgcaatgcgcgcataatattagtttgagcgttgcacaacgtttccttcttctggtttttccctttttttaccacccaccttaatttcctctgtcgcgtttcttttgttttttaccaccccaccttccatgtttcttttttttttacttttccatctcatccgtgctccatcaaagggcccggtaaaatattaaccatccagatttttccctctttcattccttctttctggttcttctgttttcacgttttagtaaaatatttaccgtctattttttctttggaaattttctgttttcctagtgtctccccacgtttaaaaagtaatgaatttactttgtggagttttccatttacttcagcctcccacatctgcccattaaaaagtaacaaatttactcgcatgaatgtcccattcaaaagtaacaaatttacttgcatgaatgccccccattgtacaacaccattcctagacgacagtaaaagaattactaccagcttacaatactagtaattcttttaccagtattataaatatttagacttcgtggtctgtgagtaaaacaattaccactttcctctcgatatagcccatgatctcgtagccaccgtgtagtaatatgtttattgatgtgttcaatatatagtataagagcaaaaactgatactaagagtattgttaatctgttcacaaaatggtcgtacgaatgaaaaaaattacaggctcaattacacacgagtgataaaattactcacaggtgaatcaaactagaaaagaagaaaaatgattcagccaaaaatccatggtgaagttgggatcctggtggctttgcttgatcttgctataaggatgtaaatgctggtgtgtgtcttgtgactggtactggagattggagagggcaaccgagtggcgagcggtagtcgacgatggaatcatggaaggatgtagcggcatggtatagacatgagctcgacgttatgcagtagcagccatctatcatctagcaagcacgaaaaaaatgtaaaaacattcttgttcatgtcatacagacgacgagaaaaagaaaaatagctaacaaccttcatcacaggcagactccaccctatcctttgcaaccagccacatggagcacgatgtgcaaatgtaggacttgtgcagcccatcagttcagatcgggtaatattggagattgcacgttaatttgatttgcaaaaagaaatttgggcttcatgcgtgaaggtgaaggagagtatgcagatgcaaattggagtttcgtttccttacttgcttgttttgtcaatgtcgccgacgtggaacagccgccggttgttgctcttggcccaggtgaacacctccttgctggttaaggtgttgtccggtgttcggtagcgaggcccgaagtagcgccttcgcctcaaccgccgctggccaccgccatcaaccgccatggtgatgtcctcctcctccatggtgcgtcaccaatctgtgggttgtgatggtgggtcgattcagatccaagaaaaaggaaaaaatgaagtgggggcaagagtggttggtttgtacggaaaaaatagaatatatactggaaacagggaagttgtttttatcaaagtaaatcgtttacttcgataatggtgggagcgggatgacgggacgtggcgtaggatcggaagcatggaaattgtttttatcgtagtaaatcgtttattctgataactgtgggagcgggatgacgggacgtggggtgaggtgacctgagctgatacatgtttggcgctcggaatactgcgctcctagtagtatctctataatatttatccaattacttagttaactaaattgaaaatagtaccactagatctatcatcaaaattactttcaccatgtctagtatgttagtctatttatacaaatatttctaaaaaaggacgaatactcaaataattttaaaaagtcaatttcatgatatattaaaaaacaaagggtgtgtgggcatgttatcgttaagctatactacaacgaggttcccttacaaaaactttaccactagaaattaacatgctagttgttaagtcaaatattattatgtaaaagaaattaagttgtttagtcaaatatcggttcttcctttgaagaggcatgtacattcctccgcttttgatcagcataagcacctaacaacgagtttgaaaaccgagtaatatgcagtgagccagtgaggctacccatgcatgccggtgatactaaactcccgtgtgcctcccatttccatcagtgttctgaacatttgaaactagcaaccacatccgcatgacaaatcaaaccatggaaccttttgaggaaacggccatgagtgaagctctgaaggagaaacaaacttaagctagtacaggtgtacatcaatcgatcagtttcttcttgttcttgtataaatatattatttttgaaaccaaagctaggctaagctggtgttatattcagaaggatcagaaagtatttaaagttcaccaaacaatgatggaaacagaaggaaggggaagaacaaaacaagaacagaaacacgctaatacagaaatttaagccgatattctcacgatggttcttttataaatatatatcatgctggctgtgtatatcgtggccaccttaattaattatttcaagtaggtggctacctttaaattaagattgtctctctgctactaggggattcacgtagtacatattggtgtatgcagctgtaaagaagagtttgtggaagatattgtggtacaacaaatgagagctgtgtgctacatcggaggaaaaagatctatcgtttgtagcgaaaacgggtaaatgtgtctctcaactgtagaggatgcctctgcttgtgctctttccctattcagatgagccttaatcttgtctcatccccgttttttctctcacatctatactttctataaagttaaagcccagtaaatctaaagctcaatatgcaaccatgccacatcatcaccaactagcaataattgcatatttaatctcatgcaagtaaacaacatcatctataatttatttaattttataaatcaaaatgcaagcatatccaatcatcaccccttatatcatttgcacagtattttaacaaatctatatatcactttttacaatatttaacatatatttatcaatatgtttcacactaaagcacaggtatcatttgactgataaaccctaatgttttattttttttctttttacacctaaattgattgtcaaaaaaaatatattaagaattgcttagtaatttctgcagcaaagcgcggggaatcacctagtattatgaattacagtggacatgcttcctaagtttatgttttttgaaaaaaaatatctatatataaattacttagagtacattttagaataacttttgagcttcataataattaattcactcaattgtaccctcaaatatttctactatcttacaagtggagtcatccttctccttccaacccctactcccaatgctcagcgtgtccatacacgaaatgtaagtaccattccttcctagttttatgggcccgacccatcaacgtacgggctccaagtctattcctaattatatggacctgatccgtgataacgcatggcataaaactagttataaaaagaaaatcaaataatcctcacccattcatccgttcagcccttctgaaccggacaacactatctgctgagttgttccactatgttgtctgttgcctattgcccactttgttgtgcgttgcccacaatagaaggagcactgccaatggaaggaacatatgtcttcttcgcaggtggtgctaggtaacttgctcggccttctcgccagcgatcgttgcctcgcaccatggaagttcacagcagctgtcgtcggcacaatcggcacgaagaattcctgtatgcctcccatttccaatggtgccctcaacacaacagatcaattaatgttatttatggattcctttgaagaaatgggagggactgtaaaacaagcttatacaaggaaccgactgctgattgctcgctgcattttttttattgcacttccattgcattgtttgatcttcttttcttgttttcacttccacatgtgtgtaggaagagttctgttagacagtgccaccggcatatggcaatggtgtaaattgtgccatacgggctagtaattgtaagtggtagttgtggtgataaatgatggctaactcaacatgaacagataactgatctgtcatattttggtcatccatacaaatctatttattttgtgccaaaatataacaatttaggtatgaattagactctttcttgtactacgaatctgggcaggaggtctatccacattcgttgtagtaggatgtatctaatttatgcctaaattgttatattttagaacaaagggaataacaaattgtagcatcttataattacaatgtttcatttgttttgtgtatcaaatggtggatgtctcaaatgtttttgctgaacatgccacttatacaacaattggaaagctgaccgtgttctctctttctctttttttttttcactgtatctcctcgtattgtcttgtataaggattttccatgcgtgttcatctattctaccgtgcaaatacaaacagcatgaaagcaaaaaaattgctactcctatgtcccatctggggtttcattgtgtgtgtgtgtaatacaccagaggaagcttaggttaggtttgtagtgactgtcccatttccccatttgggaattgatcaccacctacacctatcttgtggctccaaacacggaaaacgaattgaagcaacagatcatatagttgatttttccagtacaagtgcgtcaaaagtatagagtttcattgtgcgtctcttgcacttatgcaaatgttgtgctggtttgtcagcctttgtcttactacatccgtttcatattataagactttctagccgtaacaaaaaaaattctgacaaatttttgcctttaaaactgtcatatttttttacttttttttgctacggctaaaatgtaatgaatttaaatatgagactttgtcgatatgtgtagtactattaagagcaaatgtccaaccttttgtggaatttttcgtgatatttgctagttggtgtgtatggagtgtgcacgagaagtttgtgtgtataggatatgttcccttttaaaagagtatagaaagtgacaaacttaggtatacttggcatttgccataattaagtgccaggccataggtaaagaaatattgaagtaactgcctagtactccacatgtctttttcttaggtcaaagtctctaaattgtactacttcaacaataatttatactacaatatatttacagcatccaacaagtttgtaatatatggtgaatgtatgtttagggatgaatctcgtaacatgactttcatgtgtgcaatcaaataatttagaaatatatttaatctcaatcttttacagatatgttcgaaggtatgtctaaaagatatttaatctcaatgttttttttggtttacaaaacataactttctgctgaacctagagcttcccatcagtaatatggaaaatcacaactgtacatagaacacaaccaagcaaaaactaatagtggtctttcttttgttttccccaataaaaaggagatctggaaactgaagttatcgtcaaccacgtaggtaaagtcagcacttaaattggtgcgagtgcagtacatgagtgtttcttgcaaattttaccaccgagaaaaagctacacccaacgtcccaaccttagagaagtttgttaagtcaaagatggagtatcgagaacagcacctagctcacctagcatgctggcctaagttcgacttcgtttgaaagcaagttttctcaccattttcttctctatcaataccggatgctaggttcctcctttgtattccaaacattttttttcttttttttttaaaaaagatggagtatcaaacttgcgatataacgcatacatcttcttggcttaaagcctaccgttccagctattaccagatggaacctcagaatccggagtagtgatgaattaatgtgcacatcgataccatgaactcccaatttacctcctatttccataagtgttttcaagtcgacaccgaacattgcaaccataaccacatgagaaatcaacaacggatccaagttctcttagaagaatggggctattgaagttaatgtcatgaaggagaaatgagcttaagctagtaaaagaaacctcctcctttcctagacccttctgggtgcatatatatcttggccaccttctgtgccattgggccaaatctttggagtaataagaagattcattattatgagctataagaaagagttggcgagaaatatgtttagagtatggacatgtgggcaatagctcgatctttgattgcatttatttttctagagaaaaatggttgatcacaattaataagtgataagcaggtgcaattatagatggccaaatgggttgcttggcccgggcacaaccgggctcgggcctgagatcagtcgggccagcacggctccacctacacgctgggggtgggccaggcctacccacctgcagcaccaacggcctagacatggccctataaggcttgggccatgtcgggccagcctgaaggcacgcatgtgtactgtgctcctcattgaaaaaagtctgttttgcctcccttatttctttgggccctctaatatgcctaataagtctattttgcttccgtcaactatttgcctccttggtctttggaccgtgccgttccaggcaacccaccgtgccgaggcagaggccctggcacgggcttgacaccagtcaggcggtgccatgcctgggtcgggccaaaaccttatgccatgggctaggccatcgggcctcacgccttttggccaactatgggtgcaaaatggtagatgacagacaactcaaaattacaacttagcatgtagctgtccagtgtctgttgtacttgcctcttgcacgtagtagaattaatttttatggtactaggccatccaaactgaaataaaagaataaaatcacagagtgcatgagtaaccattacatctccctgaggaagagatcgagatcagagtactgataacttaatttttgcatgttgtctaatccaaatatttcactcataatctcatccaaaaggggacagagatagaatgagccaagtcaaaaacttataatcttttcctaatctttcctatggaatgagcatggcggccactacggttctccctgtttctttctaattcatctttcatttttcttcggaatttccgctttagatgattttctgtccttcggtgttagcatttcgtgttgtccttcttcgaaattattattgattttctatttcttaggtaactgtacatacttttttctggaattacttttgttggtttctaccttctagttagcacggtgatacatggccgtggcccgcgggtacggggtacgatagtcgacggaagagcccacagatatccaatcacctgctgtcgcactcgaacggctgtcaatttcttgtgggattgtagaatggaccttttgagcagcctatggggaattttttacatgacggattcccatatgcctcctatttccattgctgctctcactcaacatgctatggggattaaccacacagaagatcagcaatggatccaattgctctttcaagaaacaggagtgaatgtaaatcgaggtaacacaagaatccttgcagagtcgctcgctgtattatgtctccactgccaggagactagaagcttaggtttgcaagtatatataagaggagttggtcagacattgccagtgtcaatagcacaatcatgcatcttatacttctcccgtacacaaatacaacaaattaaacgaagggtttaaattttttccataattaccaggaatcccatggagtactacttccacccaactattcctcatttaggtgttgtttgaatcttctgaagatgaagatgaagattaactgtttcacgcaaaacgaggtggtaatagcgtgtgctcaattgagttttaattattataaacttgaaaaacggattaatctgatattttagaacaatttttatatagaaaattttcgcacgacgaaacgcacagtttaacagtttgaaaagtgtgccatgaaaatccaaaacttcatccagtgtttgcagtggaaacaaacggggccttaattgttcatctatttttatccctaaacaccctttcgctccccatcatgggttctgtcaaggggatttcgcgagatggccgagcaatgatgtgatttgcccgcaacacttccgtaatcatgattatggagtaatacacatgataaatgatgaaactatccttgataaatgacgtttagtccattaagtagcttctaaatggggtctcccatatttttaaagtccgtgtagaaatttttgaagagtatagagcacacatcatataaacttgtactgctggtaaactccatataaaacttgtcccatattaaacattagaaactgaatttgtcttgattgaacgttaacagagacggaggaccccatacgacagggtgggccagctggccagctagccaccagcccaaatccccaccccccaaatgtgtgtactccctcccataaaaaaatacgaatcctacaagcccgaggtaaatttagaacagatagcgaaaaattaaaatgtcctcaccaaagtacaaagtatacccattaattaacactaaaaaagacaacaaggaaattcaaagtggctctgcttccatcgccgaccctctccctccgccgcagctgcattgcatctgagcaagttctatccatccgcgcatacaaggctgcttcagttgcatacaacagcatgcatgcaaggccgcttcccacagcaatgaagccgcacaggcacactgtctcgtgcatcacatcctcccctgctatgtcgtgtgccagtagaaactccgatggctccgctgcatccggctgcatccgggccgtctccatctgtcgccgtcgctggaagcggatcaaccgtcccaaaacactgccaccgcggcaccgccacggccacatccgagcttatggctgtgtttagattggtccaaagtttaaaatttggttaaaattgaagacgatgtgaccgaaaagttgtgtatgtatgaaaggtttgatgtgatggaaagttggaagtttggaaaaaaattttggctgtgtttagttcaatccaaagtttggattttggttaaaattggagatgatgtgactgaaaagttgtgtgtgtatgacaggttgatgtgatgaaaaagtactgaagtttggatctaaattttgaatctaaacacagcctttacaactaaacacaccctatgcatccaggtcgtcgtgcaaggtcgtgaggagggtgggagggactctggctgggaacttaaccacatagcaaacaaccagctctagatttctcccattgtatctttcacggtgaacacaaaccgaggcttttcgaaacagatggtacgaatagcaaagaaataacacatggaacaaaaaattaagttaatcaaccaaaaaatttagttcccacaatatactctccatgcagccacatttgaatgagctaataggggcaaattatcgcgattactatttgtgcaacgaagatttcttttaaaaacacattattcatcactatttcctagataactgttttccaaactatctgttaactttataatatattagtttgtccctataaacaattaactatccctgacaagctgcattgtctaacaagaacaggtcccctattcagccaacgatttgatcagaaccatcgagtcatagctagtaatattttttgatcaaaagctcaatgcttgcacaagcacaagtggcactgtacgcacggtgcccatctagagacagtgtgactggatcttccaaaggggcacccactcgtgtgggagaccaattgagatcccctactgtagacgacctacatccgtgggagaccgctcggcgtggcagaggtaattcacgagagagtccgtccgcaacaatgagccttttctccttggccagcaggcacagatgtgacttgtgagccaccggaatcgtttccagagcctcccgttccgatgtactttttctgtcctaaaaaaataaaatatattagacgtaacacattctagtaatacgaatctcattctataatagattttgttttttctttgtgagatgcaagtctatcccataaaaaaatctaacttatggtaacgcagattgcgagcagagagcaccggctgccacgatactggtctatatgatctttttgtgggcagcaaactgaagcgttggacagtgttgatttgattattgtgctgaaggctaacaatgtgtttggtttttaagcgcccaccttctaggtttgcgctccctagagccaaaacatacagccttttcccttcattttatagtgaaggatgcgcttatatgcttttgcaatgaaaaaactgcatggatattaaacctcatgagtggcccatattaaaagttacgttttatacttataagttatttttgactttttcttaagtctagcttaaaagtacttcctccgtcccaaaaaaaaagacaaaccctggtttccgtgcccaacgtttgaccgtccgtcttatttgaaaaaaatatgaaaaaaattaaaaagacaagtcacgcacaaagtattaatcatgttttatcatctaacaataataaaaatatgaattataaaaaaatttcatataagacggacaatcaaagttggacacggaaatccaaggtttgtcttttttttgggacggagggagtaagtttataaaaaaacatagaaacatttttatacaaaataaacataatattaaaatatattcaacattatatttaatgaaattaatttgatgctataactattgctacattttttttatatactttatcaaatttagagaagtttgatttataaaataatcaaatcgactgaaatggagataatccttagcaaattaattatcgttaggaaggggcaattttgtccttaagaaagttatccagttactccgtctctcgatggaagcttatcccttcgccggctcggtgcaccaaatcgcgatagcagcgtcatcggcttcctccgccgcgccaaggatgtgaagcaatgatggcattctcagccttggcccttggggaaacaattggcttcaagaaggtgtgtttttacgttaaaattgaaagtttggttgaaattgaaatgatgtgacagaaaattggaagtttatgtgtgtagaaaagtttgacgtgataaaaaagttgaaagtttgaaaaaatgtttggaactaaactcggcctcaattaatgtctgctttctacaaaaggattaaattcggcccagcgttcggcagttggagccgcgcgtgggcgcggggctggcggcgctgcctcgcgtcgcgacctcaacctcccacattgatcaatcgcggccccatcttttccggaataaaacaaaccggcatattcataaataaaaaataatttgtgaaatttttttatatacgtaccaaaagtaaatgctgaaaaataaacaacgatgaagaaaatcctaaaatttaagattgaaaatttgagttttgacagataagtataaacataaagcggaaatatgtctccaaaagaacaacattgagttactatcggccaaattaacttttacttcagaccactcgtgagctttaatatccgtgcattttttttctctaagaagtatagaagcataacttttaaacaatatcataaaaaaatcaaatataaaaatattttacactaatcgtattgattagaaactcggtaaacgtgtgcatttattcattcatcaaccttcagcaatcatttcaccaaataatcttttcagttgtcactcatttagactttaatttatgaaagtattttgaacccactatcatattacaaacaaggttttaattgttatatattattatgtctcgttttcttttctcttccgattgtctcatttaaagtaatccaaatgttatattatatttttttctccaatccatttgttttcctattctccaaatcctgcattaccttggctatctgttttggcattaggaaagcacgagggaccacctggggacgtggtgcaacaggttggtcattagagaagcctaagaaggagcctcttattttggaggacgagacttctctgatcgtaaaataagaagtacatgaccattggcgtgtgagcctatgaatgtgggccccacctatcagggacccatgttcctttaactttacgtcagatgagctcggtccctcttataaaggttgcacaaaacaagttccagactcctcctgttcccatattcacacacctgttcgtcaggggttaactcttaactgaaggcagcatggcagaccagaagctggactcacatctcacaatgtgaatggagaacactattcttctcaaagtcatagggccaccatattgcgctcaatctcacgatattttgtttctaggagtagctagcacgggaaccaccattgcccggttgctcgctccatatgatattttaattttttggatgagagctcactccatatgtttgcaaggccaacctttatttatggcagtcaagtagtttgtttgttgttttcttgagagctcggtcatagtagtttgatgtactcaatgactatagatgaagaggaaatgtctggtgctctattttacagtgataatatttaaagttgtattagaataaatgtcgaatatattagccctaatagatccattacaattggacttagagttataatagatggtaggcttaacaatagaagactttttctgtccttttcccaatgttatgcttagcagtcacagatctctgctagtaacctaaacccacactagcgccacagagcaatcacgcatatgacggtgctaattaattcgttaaattcatcgcgatatttttatctgctgcagttgtgctgtgagtttgatcaaccatcattgctgggactcgtcgtaccagctctccaccatccggtgacccctgcctggctgctgctcgtcggcgccgatcctcagatgatcgccgcagccattttacgacgcatgtatcgctgctcgacgggattcgccgttcctcctcgagcagcaggcgtccaggagagcgacacgacggtatcggatgatttccaaaggcagcgtcccattcccatcgatctgaggcacgagcatcagttgccggccgtgctacctagctaagtagtcggtcgatcggacagtgtgtgttgaggcgatcgatggctagctagctccagaatgaatgcatgcgtcagatgaggagcaaacgatcgagtgtgtgtttcttctgccgttttgttctaaccttccaggcctgcactgcctgtacagtactcctggaaacaacacacagctagctagcttgtgtgttacattcattttatagtgaaggagttatatcatcttgaaacagagtaatgcgtgaaactgctcctacatctgagtacatggggccttgggctcttgcacccaatatatgattgattatatataggccacgtttggtataattctggatcccagatttcttagagctgatcagtattcccagttttataaatctatatatttgaatatacgactaagttgataacatttagatgattcattttgtttttaatttaaatgaaatataaaattttaaaccactgtagtttgcgtacaaacttcaaatcctacgtggatttaggatctggagctatgccataatctgggctttcactgatggagaagtggtttttactcccagttcgtaatcccctatagtcctggttttccaaccgggactaaatatcgctatctttagtcccgggtgaaataactgggagtaaaaatacatttttagtcccgaaagataaagccaggctagatccggttgctcatttattttttttcttcattgtttttaatatattaatttcactccatccccgtccccaaaatcacaaatcaattatccccgaatcgtaaaatctcaaatcgattagggatcgattatcacctccaaattctcaaatcgatcatctccaaatacatcacaaaatctttaaaaaattacatcacaacttctaaaaaattcatcataaatacatcacacacaaatcaaatacatcttagatccgaatcacaaattctcaaaaaaaaagaaaataacctaaatacggtgcctacgccctctgccgcgtcggccgccccctcgccggctgctagcgcgccgcccgccgccacgccgccgcctgcagatcagaagtggggaggagggggagggagaggagaaggagagaaagagatagggtgtgaggagaggagatagaaccgggaagaaggaggagatatgtacctcgatccgatccgcgcgcacgcctctccgcgtatgtcgatcttttttcggtaacaccaatcagaactacaaataaatctttagtcatggttggtaacaccaacaaggagtaaagaaaatatagggggtctgacaccgcctgtcctcttttgaactgggactaaaaatgatcttgactaaagatcaaaaagtacccctgaacttataagccgggactaaaggtgctttttagtcccggtttttaatacaaccaggactattgtgaaatctggtcgaccgaccaaagatggtctactcagcaattttctttctccttttttttttgttgcataatacaaccgtttacctactgatttgttttttaataatgaaagtgtgttgcatccctggcttatatgtcatagggcacctaaccacctagcgactgaacaatgaaaaaggtatattctgacttcaatgatcaggatgcaaattggaaagttaaattgccgggtagcattagaatggggcccagacgcccagtactattgaaaattcatccgatccgcttcagcatattttcatcagtttgcccagtagtactattgaaatttgtgactcatatatacatgttttaatttagcctggtttaataattcacaatcgatggtgtatgagcaatgaacgcgtgcttagaggcttggtcacttaatgctcccgaatcaaacattccatgaatccatgccaaagaaccgagtgctggcctaattaaaagtcatggatacattgctccatggtcagtacatgtgaaaaacttgcagactaaaactttagttcaaaaaacgactgaacgataaaagagtccacatcattgtgctttgattttgttttctcctcatgctatcctagctacaattcatctttccttaaatttgtaaacaatacgaagtttgctccacttagaactcaaccactgaaacgtctgtaaattaaattagcgatcttgacaaattcacgagtatatgtgtccatcaatggcgagctccatggactaattcccatgggagacaaagtcggcgcagcatgtggaactccggcaaccgtcccgtgcgtgggagtggcagagactccggcctccggctcgatccaggtattacaactggagctggtacttgatcgagaatgctgtactcgtccatggcaagaataatcagcgcggggggcactatcagttcgtcacacaggtgagaaaaaatgcttgttgaaatgcacttgatagtgcagtggtaaggggtgtgtgattttaaccccgaggttacatgtttagttctcaacatatttacaatttttttttaaaaaatatttggaaagatgtctctccctccaaatctcgattttttgagaagaaactacttgtcagggagaccagttcgttcccaccatcatcattcccagtgcttctcattctcacatacatagccgcggcgttaatatttggtagaaaagtaagagaataaccaaagcgtaacatttggtgaaattcgaaagaacatttggagcgagcaccaacacatggagctgatgagatgtagacatctgcacacttgtgcttttatgccaatgttgtgtcgtgaatgcctctgtatttaatttccactcctcattcctcgcagcccttttgcttcatttaatttagggtgtgtttagttcacaccaaaattgaaaatttggttgaaattagaacaatgttcaacaaaccaataaagctactatgagtaataggaccggtggccccttacctaaagctttattgaaaatttggttgaaattattgtgggtccgattaatgtgagaatttctaggctatgagagcgaatgtgtaggctcctttttctattcctttaataatataatagatagatggaatataacatcccggcctttgctaaaaaaagctacaacccaatattacagtctagcactcaaaataagtgtagtccaaaaataatatcaaccagcatataaagataaaaatatccaataaaatatatggagaacacattattgaagtctatttatgaatctccatccataattggtaaaaagctacataaccatcgactcaagctttctgcatgcaacttttaaaagatctatcagatccattttgtttaataccaaacttgtcttgccattttttctagttgcttcaacaatacttgctagctactatagccgttggcttttcacataacatttgatcattcattttattttaaaatttattataatatgtaaaaatatatgttaagattatagtttcttttatgataaaaaaattcacaaaaaataaatgatatttctatatttttaataagatgaatgatcaaacgtcacatcaaaagttaacggtgtcatacattaaaaaacagagtgtatatttgtattacaaccaatactaaaccataccaatatggttgatacaaaccggcccttagcactctttttttagttttgtcccaagtcaagtttgaccatttttatagagaaatatcaacgtttacaatattaaattagttttattaaatgcatcattaaatatgtattttatagtatatttgtttttaatttagaaatattgctaactcctataaatttaatcgaacttaaagaatttaacttaaaacaaacccaacatgttagaaaggaggaaagcacacaaaacttgttacgtgatacacatatacaagtttttagccaagctatatatgacctattccaacctttgatccaggctccaatccaaacaaatgtagtggctccaatcgatccctcagtcaatattgggctggtgcaggaagatgcagacggccccaagtagcctcttgatgctactccaatcaatgctatggcaattcacaaaagaacgttgcaaagcctaactctacagtcgatcggactgcgctcagatcattcccaaagtctcccaatctcaaaacagaaaaatattgatcaaaagcccgggtaatgtttaacagaatataatgccaaagagcgagcaacagatcgatgctggtgatgatatatcttacagtgcttcacttctgcttttatgcttaggatgtgttgtttggtgttgcttcatatcttctactcttttggagccaggacatcctctagttgcttaatctctcctctaatcaaaggtcctatacttctatttatggagatatatatggagtaactagctagatagttgtactttgagcatacatttgattgattattgacactagcagatttttagatgagactcatgcatatataggagggtaggattggttgtggtattaattaattcctaaatatacagattaacatatgttgaagttttgaatatttcgcatgaaacattttcatacatatatacatacactactgatccatcttatctaaagaaaatacactactgatgcatatttccttttaattttgaaacatttttgcaatggttgtatttgaaaaaatttgcaacccgaagtgcatgttcaacagtagcgagctctctatagtgttaaattatctatagtctacaccatacatgtccaggctgaacagagtcagcacggaggagaaactaatcctgctcggtccttgcgagccagcactccgtgcaaggttgcaggctacgccaggtgcaagaacgattggaaggtagatgttgcaattcagcaaaaagttttgtttaaga

SEQ ID NO: 67790 - DNA, 1887 bp, Oryza sativa
aaatggttaccattgcaatttttctattgaggggattcccttaatgttttgttgtcatctgtgtcttgtcgagtctttctggagggtttgttttctaagcctatcaggctggcgcaaatttcttgtatatactttgcttatgatttttttctttttaatgatttgacataactcctttcttatgttaaagaaaatgttgagggcttgttatttctctcctcgaatatatgaaatggcagagctcctgtctgttccctcgaaaaaaaagaaagacatgatgaacagatgatttgcattttcttaaccttgtatgcaaattggacaatataaatgatattttgctgccatgatgtgatgatgtccttttactaaaggtcctattacatttatatatggagaaacaaagtcacgcgtatataaaatgtacttttgtaaaatttaagagtaacgagctctaaatattttgttcaaaacattttggtattcttgaacccttgtagccttctagttttgcagtgatcatggcaacacatattttcagcggcactgaatgattttttttttgaataaatcgaagagcatcaatttcattgaatggagcaggaaacggcactgaaatatcaagaacactggaactttttttggtgctggtaccctggttgagattccacatgcttcccatttctacagccacttgagtaatagtatgggtcctctcttcctcttcttattttcattcccaaatatggagtgaaggaaaatagcaaggaactgagcagcttgccggtatatatgatattgatatatataactcaccatgcatcatgtaggtagtgatagccatagactataaatgacataccaacaagaaacataaagagcattcccaaatcaggaacacacatgacatgattttgatggttagcacttaactttgtagtaagcatagttaacagtaaccaagttatgtaatgtcgttgggctagactatgaggctagtgggcctgttcgtctgcctgtgctgcggctgcggtgcagccggcaccaacggtgccacacacacatggcgcagccgcagccgccgcagatagacagccgaataggcccagtatttgttatcttaaaaataaataaaagaagataggtgctacggagttgtgttgctttggatagacgtgtgatagtgcgagcctagctttgccttgctagttttccggcagctggtaggtcttgccttcgttacaacttgactatgaagtcatacaaccagcggtggagcgaggcccagcaaatcctaggttgatgcgacactgctcaagcgggtggtagaatatgcaagcccctttcaacgcaagaagtagaaggtgagggcttcgttcttgatgccagtgcaatcgatactcctggtccatggctgtagcaatttaccacacaatgttgcaaatcctacacctacaactacccgttctgcattggaattattcccgaagccttccattctcatgctcgtcgaagaatttgactttcatactagtgggaagagaaggagaagaacaatcaaaagggctaggtaatatttcacaggatgtctggagtgagaaccgtatatataatacaacacaacccatctgcagtatagtatgtctatatatatcctactacattttctcacttatgtaatgtgctaattaaagatgtgttgttggtgttgccttatatcttccactctgtagagccaagattatccccgtttacttcttttattgtacaaaagtaactgcatcattgtacaaaagtaactgcatcgtttggttcttgccagtcctcgaggtggtaccattcgcttggccagctcttgccactccttctagcgagacaactatattt

SEQ ID NO: 67791 - DNA, 1155 bp, Oryza sativa
atatatacaactatccaaccagcactgaaaccattcccaaagccttccattctcatgttcgtcagagaactagaatttcaaaattagtgggaagagaaggataagatcataacaaccaaaagggctaggtaatatttgataggatgtatggagtgagcaacatgtacgggagatgacatcctaggtattgtactttcacttattctttttgctaacgttgtgttggtggtgttgccttcatatctttcactccatggagccaagacaatcccctttttcttcatttattgtacaacaatagctgcacccttttgttgctcaccattatttcctcaatattaaaaggcatatactcctaaccatagaaaaataaaggcatgcataaactctgtggttgtgcaggtagctaggcccattggttcttggtagtaactaaaacataatgaagccacacattgcaagtgttacatgccttcgtatgcgtgtctttcactagcagattattaggacaaggataatacatatatagtacggtaggattggctagcacggtgtattaattcctaatagtatacatgctaacacatattaagaatagtttgctcgaaatatttgaataaacattgatcctgattgccttttaattttgaattggacaacggttgtaaagtgtacttggggaagaaagttcaatggcacaggaagtcgtccgacactaaggagcggtagggacaaattggtgcccctcgtgccgttgaatgagagggaaatctccatcgaagctgaacagaagtgagaaatggctgccgctctgacctccatgtttgctagctcttagctgcggtcacactgaacaagatcgaggaagagatcaaggagcttgccattaagattgattagtatccaataggcatcacaattggagaatccaaattacaaaattttcttccatgtttaatgcttgtaattctgttgagattccacatgcctcctatttcccattggcccgtgagaaatagtactctgtgttatcttccactacctaagcaatgagtacaactatacacaagatgatataaatgtaagtcattgtgcatatcttgtagttgtagccagtgatgggtggagtcatggaaacgataaataaacgtaccg

SEQ ID NO: 67792 - DNA, 826 bp, Oryza sativa
attagatcagcatacttttcaaatgcatgccaattcccactcctgtttgcaaatgcgataacattaaggttatcagctcgtattgccagcatcgtgatgtcatcccctcttccagttagatttgtcatcttcatcgatgccggtggatggtacaacctctgtcggtcaagaaatatgtataatcaacatgtagtccacttgaggtgcgaatggtagatgcaagaagtgtttgaaggatggagcagtaagagcccctaaagaagtcatgctgcaaatttcgaagggaggccaccaaatactgaaaacgagaaaggagaattatatgagctcataggacagacaagagacacaagaactaaattagtacatcgaatgcaaccacaagaaatgcctttatgcatacctctgaaagagttcatttggctgcaatgacgatctcacgggagaaacaaggcacgtgataaccaccaccttaatcataacaaccatgttgatatgtgccattgatgctcgttgagaagcgttgagaagagagaggattgtgctagcttgtggctatgcaaggttggactgaggaacagagaagattcaatttgtggggagaatgcaccggcatacaaggaaaacagtttacctttaagtagtcaagcaatcattgttgttgggctgccgttgtatagtgtcatttgcatgatctcgtttaagaataggcaaggcatgatattacatgcatacaatgtgggacaacattagttcgctggcaaaaaattttacaacatgtcatatcaaacgtttggatacatatatggagtattaaacatagaaa

SEQ ID NO: 67793 - DNA, 1650 bp, Oryza sativa
gaaaagtgactgaaatttaattcaggttggcccatctcttgaagatcaccttccttgcaaagcttctgtttaatttgccccgttcactctacaaattcagattgatttagagattgtccccttccctctacaatttcctattgaattcgagattgtctacaactgaagataatcaattatccccaaaaagttgtccaactcgttaatcacaaagacgcttaacaaactaactaactaaccagctccgtctaaaaccgatcgagtttttcatgtacagctaggtcatagcatgccaaatttctgtgcatcaccgcactaaccaaagcacacctaccaaaaccatttcctagtacacgaacgacgtcgcggtctccgcaacttgtctcccattactgtgacctgtacctgaaccagctgctgctgctgccgccgcctacaattccaaacccaattccaacacatgaatgtctcaccaagagcaagcagcaatgcaaccagggttcgcaacagggacggatctagcgtggaacggcgagggttcaaacttcgaacccttcactatcaacaccgtgaccaggagagccctctgaaattttctgtcatacgtaccttaaaagaagtgttggagttttaactaatttattcagtctctcttgctatctttctgaatccgcctctagttcacaatctcaatactagataaaaatcacttgcaagcggtatctccattaataaaccaataaagacagataaaatccagacatatcttgtcaaaagttttaatctacttcgatttttctttaacttaataaaaaattaagccgatcccaaaaaataataatccggatttcgtggtttctagatagatcgtaaacctgaatgcaactatgcaaactaaagccaatgagtccaaagatggctttgacgggcaggtcaaacaggtaaactcgccgtcaactattaggctcggaattaggtacgtgcaccaccactgtgtgattaggatctcaggatgatctgctaaaattagtcgcccatttgtaaattcgaagtcagagttggggtcagaggctggacgatggtgcgaccacgagcctgagaaactggacagttttttttgccttttgaagcgtctaattttggagccgtcgtttgcagaaaagaaagttcacaggtaagccagctgttagaccggactagcatacatctcaccgtcaagaaagctctgttcgtcaactgatttcagttcatcaaccacgaagctgattgacccgacaagctgcagaaaaagggaccaaagcagtcgtaaaatcatgctggtaaaccaaagtaatgtagtagttatattacttacatatgcagctggattacttgctgataagttttatatacgattcaccgtgttgatctggcatcacgcacagctaggattagcggctgatcagatccttccaaactgactaggataattaaagctggtattgttgtccactaagcacacatcaacttaatctatttctatgattagtaagagttgatatcgccggactgataaggctgtgtttcggcgcattaggtttctaacatccactccctcgttgtccacacatgcttctgaaactgataagcggtgttttttttaaaaaaaaa

SEQ ID NO: 67794 - DNA, 5266 bp, Oryza sativa
atccaagcacactagcacagagcacattcatgtgctaccaacacagcgtttcttctcctctcgaacaaacaaccgtctcattcgatacgagtttaatgagcttagagattcatcattgaccctcgtcttttagcatgctaggaggccacattcgagagtgtgtgttttgtaacatgtaactgcgaaaaaaaaaagaacaatctcactcccaatcacaaaaaattgcagactgaaacggtaccagaagagttgttttgactgtttgagagagctgccgagcatgtcactgacactgttagtagtattctcttgacacatggccactccatgatggacgtcacattgtcactacctgattggtagtactcctttgccagacgtactgcgactcttcctctgtgcacattttgaggtcttaaaatatccggtatttatcttttcgtttatacttatatttattagctaaaatttaatttttaaccttaaatttgtagtcgatcttgaaattttttcatcgtaatttattttcagcctttacttctagatcattaaaaacacacatataaaagttttattcataaattattcttcgtttacggcgggggcttcaagcatgcaagcaagcaaaattggccagatcacttaggccttgtttagataaaaaaattttagcaaaaaagatcacatcaaatgtttggacacatgcataaggcattaaatgtggggaaaaaaaaccaatagcatagtttgtatgtaaattgtgaaacaaatctttttagcctaattacgccatgatttgacaatgtgatgctatagtaaatatttactaataacagataaattaggcttaataaattcgtctcgcagtttacaggtgaaatctgtaatttgttttcttattagtctacgttaatttgttttgttattagtctatgtttaatacttcaaatttccgtctgtatacttcaaaaactttaggcctgttcactttgattgaaaaaaaaaccttaccaaaatttggcattgccaaaattgctaaaattttgataagatttcttatatagttactaaaatttggcaacaaactaaatgtagccacttttttgataattttaacaaaatttggtaaggttgaaaataacatcaaagtgaacatcaaagtgaaaaataacatcaaagtgaacagaccctttacacccaaataaaactaaacacaccctcactcccgtacaagggtagtacaacccattttctgagagagccgtactacacgttacatgattgagagaggatcgaaaccgactccaaatgagtagtcgaccattcattttttttgcgaatctctcctgttgataatcttatgagagggcacaaactgcaaatgatctgtccacgtacattctggataaagaaggcgatcaacatttttttggataggcatccaagcgcagagccagtgcacatcctgcgtgacaaaatatctcatttcctgatcacagattgcgggcagaaacatcccagaatagtttgtcatttccagatcacagattgcgagcagaaacatcccagaatagtttgagaaaacagccgaggggcaacaatccaaactcaaacctgatcggccatcatattttcttaccattcttcaaatattcaactgacattggcactccctgacataatgacatatatcaaataactcttaccaagaattatattgtatcttctgttcaagactataataatatcagcacactgactgtcaagcatcaatgtatataaactggaaattggtgcaaattgcaagcaagagtttgggaagaactattcttacatgtatacaacacatggagacaacatcccaataattgtacatcatatccatcaaaacagtcaaaactaaaaaaagaaaagaaaataaaatggctcctcctaattatagtactacatatgaggctataaaaagccagatgcttatcctacatctacatgcaaatattctatgaacacttcatgtaaatacgcaaaataacttatgccacatttggcaggaagaaactgcacgcaccacaacgccacagggatatgctggcaattcttttaccatcttctatcaccaggtgaatctgttaacaatcttaaaatgcaagaaggcttgcaaccacaagaaatccaaccatgattagcagggccttcaggtagatgtctgcctgctgcggttgctccagtggtccttgtcgagggacaccgtgggcggcatgacccatatgtccgccatggaatccatgaccatggccatacccatagtgaaacccacaggctgtgcataaggatttgcatctggaaatccatgcacttggagctaagcatagggaataggcctccaaacgcagctgagaatgcataattcccccaccgtgcattagccaatggtactccagtgcccatgaaccatggattggcattagcattaggattggcatgggcaaaattgttgttaggatcggcctgtggagctgtggcaggcctctggccagttgggcggttaggaatgtcagcctcgggtatgttctttgaccttggatcgacgcggtccttgccacgcccataaaggggaacgagcttatcctcttcaacgacagctttgcacaccgggcactctggagagtgtgcgtggatgtgcaaccacctgtaaatacatggccagcagaagaggtggccacagagagtaactattggttcttgtggcaattcaaagcagatattgcattcaaagctccccccagctgcatcgccattggtgccgctgcttgtagattccccaacattggctgccatcttgctgtttcttcaaagtgcaagaagctgaattgccaatgaaactacaatcaccaacaatgctagaaatagctatgcaaaactgatagaatatattaggagtactatgtaatataatggctactagcaacaattacgaagttgctccgccagctactagcatgtggtcatacataaggatccagcattaaacgataaaaatctcatgagtttgagcaaaacataaaaaaggtataagccaacaagaacacaaccaagaaagattccccaaattcgtgccggtaaagaggacagctgatgatcagaaaccctcccaacaacctcaattttgtttcacacaattatataggatcatctagaataagatgctgacgatccacaaggatggaatcaacaatctaagcataaataaacaacacaaggaaataaaacatctaggaatatctcccacgttggaggataaaatcacacgctagaagaagacgggattatccataagcccgatctatttctaccgtaatcgcagaacaattaaaaaaaatcccaattctctaggaaaaccaacccgcgtatgaacaactagcaaacaacagatcgccataaacaacaaaccaaatctacgcctgaatcggccagtgccccctccgaatcgaccaccggccccgaacccaaatccgaatcgcacaaacccagcatacaagcacccaagcaaccgcgagacgagaggagagggtgggggcaagcgggaagcggcatcacctcctcctcctctcggcgagcgtggggatccgcgacgcggcggcggcggcggcgtggctcgatccgacggcgaggccacgcgggggaaggcgaggcgaggcgaggcgacgacgatgacctggacgcggccgcgtggggggaggacgaggagtataaagttaggggtcgcgcggggggcccacatggaagaatctagaatccggggacgctttcgcggcggttcacccccgctttaccctgcgaaattccggggcgggaggcgttttccgtgaagggaaacggaaactctcccccgctggatcaagaaagtacagtacttgttgaaagttgaaactgccttcacactcgctcacgcaaggtatcacgctgatcgtgctttgaatgctggaagcgtgtgttgcaagggatatgatgctctgtcgatggtactaatattcagccccaccgtttgccttattctaagaaataaatccaaatcaatatatttgcaaacgtaaaataatttataaataaaatttttatacacatgttcttagcgatttaaaacaaagactgaaaaataacctacaatgaaaaactctaaaattaacctccaatttaaaaatgaaaactgtaaattatagctgataagtatcaatataagcgaaaagatgagatcgattgttacccatcaatgttattagaaaaacacacattatatactccctttatatcttctttttaacgttatatacatttagaaattaccgtagtattttcggtactcatcggttgcctatattttttaataagtcaaaatggtttattagaaaataaaaattaatttacatgtacaattttatatatgtgttattagtgcgacttaaaagtcaatgtagaaaataaaccacattgaaattatcttaaaattaactttaaaaattaaatttaaaaatttaaaatttgactttcactttaacttattagggcaatccatggagctctcaataattctatgaatttatccgttgtccaacttatatatatcggacacgaaaactatcgcacccctcccatcgctacgagcacgagttatattgtgaactattttattaacaaccatgttagtctcccattacttttacagcagattgttattagtatataccagttataaaagaaaagattaattgttactataccagactatttaacggcacaaactttgatataatctctaatatgtttgatatatacctatgaacattattagtttcatcgagtattttccagctagcaatagcatgccgcatcacattcttgggcagaactaggctcaatctcatcatcttgcaagcaattccaaatgcctcccgttcatatgtactatagactataattttgttgtcatttgatagatttgatatgtctatcaaatgacaacaaacaaagagcagtactgccgttaacaattcaatacttgaagaaaaataattcttcaacaaacaaagagcagggcgcgttcgttgttggctctctgtgtgatatcagtctataaatttaaccaaaagttgggcaactaccatgtacttgtcaaggaccttcgttataagttcttggcaattggtccgtgtgaccattaagtatttccttgtccaatgtcaaagactatcgctttttacctgtctta

SEQ ID NO: 67795 - DNA, 1006 bp, Oryza sativa
ttatgacaaaagcaccggtgatatctactgcaatatttcctaaatatgactagcgagatttttttttctcaacagcatcaaaacaaatatgtcccgccgttaagttttcgatcgtttcacctgtgtctagggtgataaaggacctaacaaagttagtatataaaatttaagagctaatctaaaatagaataggctgaattttaattaatttttgaccttaaaaatattcgagagcctggtacatgggtcttgacccattgccaccgctacctgtgtggctgtcatggaagcataggggcatttgattttaaggaaacttgtaaaaacaccacaaatatcaccttgagtttgttgcaaatacccctctcgtaagtcatttttgtttgagattacccccaagtgccgttactcgtccattcttggggccacaaacccacgaccgtggtggtcattgtgtctagcgtggacgatgacatgatcgtggaatccctacttatggtgtctagcatgtagttggacggtgatagtccagagtcttcgctcttaagcattgagattgctggaagatgagctattacacttgtctcatgggattcaacagtgacttgtttctttggttagattcaaaatgagaaagatgagctcagtatagcacacattattgggaaagaaaatgtatatgtccatcgaaaagtgcgctgagtcatgtaacacacatgaaaagatgcaagactgcgagatctgccttcaaccaatccatttggaaagcgtggcccccaccaaaatgcaaattcttttcctggctcgtcacccaaaatagactttggacaactgacagactcaagaaaagaggttggcaaaatcagaagatttgtccgctgtgctacataatcaatgaatcatcggtccaccttctgacacactgtagagttaccaagagggtatggatagaaatacaaaggtggaccaaactgacctccaaatgagcaaatggagtgactacgac

SEQ ID NO: 67796 - DNA, 776 bp, Oryza sativa
tgaggagaaagtacgtgcggtcaaccgtcaccgccgatgtaatgccgtaattattgtgtacacgatgtaaactattttggatgtattgattatccatataaatcaattgatgtatggcataatttactatcattcatatgctacatttaattgactatcattcatatgctaattataattgactagagaatttttaaaagtattaaattattcatgtggcatttacagatgttaattagagtttttcacaatttaatttactatctttcatatgctacttatatatgactattcgaatttttaaaaggtttaaatcatgcatgtggcatttacatatgttaattacagtttttaacatttaatttaatataattcctacgctaagtatatatgatgattataatttttattaattttaaatcatgcagtatgtacatacatatcttaattagagtttttaccaatttaataatatcattcatatgctaagtatatatgattattggaatttttattaattttaagtcatatatttgcttattacgatttatccacttaatttattacagacaaaaataatttttcgaagtaattgtcattaatctttgtactttaaataatgttaatgcattaacttctattttagaaacacatatgtaagcgaaaataatatgcagtgctataatctttagtcccggttcttaaccctaaccgggtttaaaaataatttggaaatagcgggaaaagatctttactcctggttgatgagaacaacc

SEQ ID NO: 67797 - DNA, 11028 bp, Oryza sativa
cgatcgatctctctcggcctctctccttcgccgccactgcctacggcaaatccccgcgccccgacgccgccgtatctcgccgtcgtctcgagctcgtcgtcctcgccgccgcctccgcctcctccgccgccgcgcatctctggggtgagagccgccgccgcctctcccttcatcgatctccaatctcgatctctctctccgtcgcgccgcccgccacgagacgccgcgccacgacgacgccgcgccacgccgacgccgcgccacgctgccgccggcacgccacgccgccgccttcgccgccgctcgcgcaacgccgccgccgccacgccatgccgccgccttcgccgccgcgcaacgccgccgacgcatgcaacgccacgccgccgccgccgtcggcacgccgtcgccacgccgccgcgccaagcgccggcccaatgccgccacaccgccgttaacgaacacgtgaacgagaacgaacacgtcaacgtacgtcgagaacgtgaacgagaacgagaacgatcgaacgaacgagagcgagaacgagaacgatcgaacgaattaacgtgaacgagaacgacaacgaacgtgaacgagaatgaacgtgaatgagaacgagcgaacgaatgtgaacgtgaaatgcaatatatatatatgttacttcgcatttatcctaatacatattttttgtatcttgcagaaaagacatgttgtcggagtcgtccctcaagccggagtggaagagctagccgtagaaggaattcgtgcaggcaagtgacataataatataaatgattgttatatttgtaatgcaattaagaatattagacttgtaattagacttagcatataagattgtgtagtgttctaatattatttgagttttaatataagattattttattgcaaattagacttagtatgtaattattgactacggaattggtgcgactcctagcaattgactattgtagtcttaattagacttagcatatacgcacgaaacacttagcatacatgactattttagtcttagcatgtaatattatttgagttttaatataagattattttatttgtaattagacttagtatataattattaactacggaattggtgcgactcctagcaattgacaattttagtcttaattagacttagcatatacgacagaacacttagcatatacatgactattttagtcttagcatgtaatattatttgagttttaatataagattattttatttgtaattagacttagtatataattatttactagctagggttgtataatatacgtcacctagacttagcttatatcacgattgtaattagacttagcacgtaaggttgtgtagggttctaatgtacgacatttacacttagcatacatgacttagattgttaaaacataaatgttcgtgacttagcagatatttcttatatcaacagatggctgactgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttgtacaaaagagggcacgcgggcaacgaggtgtagcgaagaagcttgagggtcggcacatcataacgtaagtgaaagaagatggacgtcctagtgccccggccgaagccgccaagaactatgtacgtcacagcggttgggttgtgcgggataacgtgactgtcaatacggtgtactggcgaagaacaagggcacgcggagatcatgagagctttgtcccagattcggagaaagagatgctgtggaccacaatgctcgagacattcacccttcccacgggtacagaggacaaagtgaaaaggtggactctgaagaaaatggcagaatagtttcagagctttaagggagagctgtacaagaaatatatcctgaaggggcagacaccgaacttcaacacattcccaaagctaagggatcactgggacgagttcgttgcatataagacaggtgaacaagggcaggcgatgatggaaagaaacaaagaaaatgccaccaagaagaagtaccatcaccacttggggtcaggaggctatagcgtcgcgatgccgaagtgggaggagatggaggctaacttgattgagaggggtatcgaaccggcaaccgccaattggccggaacgatcgaagttctggtactatgctcacggtggaacgctcaacccagctgatggctcactggtcttcggcgatcagatacgagaggctgcgcgatgactaacagatgcagtggaagcctcctctcagggcacgttccgaccggacagagatagggatgagctgacactcgccctgcagactccagagcatccaggacgaacacgagggaaaggggtgattccttggaagattggtttcaaggtggacatccacacgtacaggagtcggatgaggagtaagagagataccgaggcgaagattgcagatctagagttccgggtatcgagctacgaactcagcatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagccacatattccttacaagaacttatcaataaaggtaagctcgtagtttatatattttagatttagccattccgctagttgctgcttatatatgttgattactaataaataatctctcacaacatgaaggtggcgtcgggcatggccatcccaactaacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcaggatcctgcaccgtctcctcctcatgatcctccagcaccgtctccacctcaggctccagcaccgactcctcctcaggatcctgcaccgactcctcctcgggctcctacacctactcctccgcaagcttctcttccggcaccttcaaagtcaagggccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcgtactatgagcgaacgctgaagaaagcatattctggaaagtccaaaacagtccctcagcttggagagcaaccaaaccaggagatcgagccgttggtgaccggtaaagaaatgacgatagaagaatttattactgacaccggtctaactacggatcaattgctaggagtcgcacaaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacagacttcttgcaaggagatgacattctctggatcaatttcaagggaatctacgaactatactagctggacgcactcgacgtctctattatgagttgctggattttgtaagtatatcgttcagttagatttcttactatacgtctcctttaattaattaggtccttgtatataagtagactatagaaaataatatactcccttttatcgttgtagaatggagatttaaagggcccgacggcggagggttttcgatactggattcatcgaccctcggagagtaaatgtcgcaatgctcgaccaatatccacaagaaacagaggacaatctcgtccatctcctgaaggcgcagcattacaagacgttcatactattgccgtacaacacagagttagtttaattttactgtcttcctacatactaaatttcattcccgtacgaacttgctaagtgtttcatatgtaatgcatcccacgcacattgcagattccactgggtgcttttactcttcgacctgtcggcctgcaccgtcaacgtatatgactcaatggataaaaaagagtctacgtttaacaaggttttcgaacttatacacaggtaccgtcataagttcctctgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgatttaaatacatacaagtgtatattaattagatctctcgttgtttgtcatttatttgtagtgcgtaaagcaaaagcagggaactaacttgtgcggctattacgtgtgcgagtattgccactgccttgcagaccaaatcatcaccacaagagagctcgatgtacgtacaaataaattcaaaatttcattacgtaacgatttcttgtttaattactaatcaatttcatacattcatatagtttatcgcatgagggataacctgaccacacacaaggaatttatcgcggcggttcaagaacaactcatgggattcatcaacgaagaaatccttgatcccaagggtgaattctactatgacggaaacacaattcaccggtccttagtttctgagctagcagcgagtactactactacgtcgaaatcgtagctagctaggacatataatggattataattaatacatgactacatatgtttctatatgcatgtgtacacattttctataatgtaaatatattttggtcatatatatatatacacatatgcattggcctaacatatatatgtataaatatatatatgcatgaacatatgtgctgtatatatatatatatataaaatatgtatgcatatatatgtattgaaacatatatatgcatggtttatatatatatatatatatatatatatataaaccatgcagcaacagggccatgcaaaaaaaaaaggtcagctcgatctttagtcccggttggtgaagatcgatctttagtcccggttatttcacccgggactaaagatagcgatctttagttctggattggtactcccggtttggaaaccgggactaaagaggagttacaaaccgggactacaaagggtttctccaccagtgcatgttttatccaactacagtccatccgtagataatagagttcttggagttgcactagcaactatgattgttacgctaccggaagcgatatgacttagaaatatccgtaaccgacagctcaaaggatggttcacaggaacccgtcttacccttgatgaggcaaaggaagtacttgaatggcgaacaatgacatgtggagtccttatttgccacaagaatgggaggtggggcaacagtacaccaagagatgaggccgtggaattgttcaatgctttacagattgtaagcaataatggtgcgtttgaacgcctcggtgtaatggtttggcctagccagggtttcaaaaaccgccgggggcccggttaccgccacccggcggtacggcggttaccggcggtaaccgcggtaaccgcgcaaaaccgcgacaaatttacaaatcgaaatttgaattcaaaaattcgggcaaaccgcgcggtttggcgcggttaccgtgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttgatttttttcttttttttttaaatttttgaatttggacgaattttattaaaccgtaccgcgcggtacgggtaaccgtacccccgcggtacgggcggtaaccgtggtaaccgcgcggttaccggcggtttttcacaccctgggcctagctaccatagatgctcagaaccagttttggatgacaaacaaatcctaaaatcaaggaggatatgaacaggatggcgcaaaggagggggtgatccatattttagttttctatatttaccatttcagagtggtatctctatatatgtaataactagatttgctcttcataatttaataaaagattgttgttcctcatataatttgtacttgcatatgcatatcatgcaaagtctgttcttaagcaagagttcattctgattgcatttttcaactgtatcgccacaatgttcattctgttgtacatccgcaccttcccctcactaaatcgtcttaatttgttccttttgtgatgatgttacagtttttaattttttttccctttcctttgtactatatacttgtatgcagtgcaacaacgcttgtccatgattactagccttttaattaactagatgtcgtcattaaacaagagaataagcccttgttacaattattattttttgaataaattaatcgattggaaggaggggatgcttgttgtctaaatatagagaagggtagacacacctacaccttatactacctacatccttcaatatatggtgctagttagttcaaaattaaactaaccaacggcttaataaaatcagagggagtacatactatagaaacacactacatatggccaagctcctaccttatgttattacgcaccgacacacgtatttactctactatagaaacacattacacatggccctatctctgcaggagctcgtacgtatgtctttttctcacataaaaagagcatcggtggaaaggagagcaacatctctttccaagtccaccgcaaaatgaattggaaaaatgtgttttgtgttggctctaggaatccaagcataaaaaggagaggatcaagataacacggaatatgttttctaggtgactggtaggaataggaggcatgttgaatcctatcggaaggaagaatgcaatattcgtgtaggaaactccaagtcctcgcctagcaatctagcatgaaggaagaatttgcattattcttgtcgaccatcgcagattagcagagagggctgcgtgtaggggccctagtttgcattacttttgttgaagaaaaacagattggatgcagtaggaataaacgacagatcgcataggctacccacttaggcccctaattaatataagtgccaatgagcaagccatgaagcactaggacaatttatcgagcatcagttgttcattcattttatctacataagttttatattgaaattgccaattgattaaaaattatagtagtactaatcctgattttaggaaatttaggagctctgttcaatcgcggcctctggctgcacccgttaatctacacttaattaaaaaaaatgtaaggctcccgggtagaattttcgtccgtcaacgaaaaattcttcctcgcgtgtgcgatcgatcccgcttcaatccgtctccgatggcaaaagaaaaataaaagaaaaaaatcgtcgcggtgacaaccttgcttctggccctgcccccgtgcgccttgattcgagtccgcataaaatttggacctaaatccaagagaaaactactaaaaaaacacaataacagatttcaacaacaacaataacacaagaatatcaatcacaaggacaccaagaaaacaccgacgtcggaagaggagggtgccgctgtcgccgccgaacagccacagggacgctaggtcgccaccggctcccctcccgctggattcggcggaggggaggggtgccaccatcgctgggacgtcgggccgccaccttctcccctcccctcccgttggatccgagatgtcgtaccaccgccgcctcctctcccgctggatccggcggaggagagggcgtcgtccctgcccgccgcctcccctccggccggacgggagggcgctgctgcctaccgccgcccgccaccgtcgagccgtcccgcggccccatggcgagagagaggaggcgaaggacggagaggcgccgccgccatcgccgcctgctgccgtcaccgaggagtagctcgcgggtagagggagagggagagaggaggcggagagaatgggagaggagaggagaggagagtagaggataagggagagcagctcgtgggcggaggggcgccagtggcagctcgtctggtgctgcatctcggcgccaacgacagcggcaccggacgagcgcggaggggcgacggtggcagctcgtgggtggagggccgccggcgacgggcggagcagctgctgcatccccaagcctagcggcggcaccgggtgagcgtggaggagcaacaatagcagctcgcaggtggaggggcgacgacgacgaagcgggcgcgtatcgtggagcccgttggcaacattgggcaggagcttccagatctggtacatccctctctctcaaacctctccaccgctgttgaggactcactttcgccggcggccagcgacgatgacgatgggcggaggtcgttccgaaactccggatgggggcgggagctcgacccaaagtggcggttgcgatttggcgtggcgttcctctctcctgttttagcgatccactacttttggtgtagccgatggagtatccgctggaggccgatttttcactcccatccgctatttctcagattttaaatgctggggatgctcctagtctctgttagccaccctagttggagtagtttattcgtttttatgttcccattaatatgcctgttttttgtgctcacaagctggattctccttcaaagagggagttgtagtagaaaaccgaaaaagtggactcaatgatgactcatcgtgaaggcatgtctgatacataaaacacatacttccttcgttttataatgtaagactttttaacattgtccacattcataaagatgtgaattaatgtaaaaattcatatgtctaaattcattaactaggaagttctatattgtgaaacggatggagtagtatatacgtacctggtgtatctatatggctcccctggcggcctggcctctgagagtgtatggccttcgtgcaatcgtgctactctttgcgccggtcttcttgcactgttggatcaaaaaccaacggccgacataactccacgtgtccatggatcgccgtacaattaaatcatttctgcaccaaattcccgtcttgggcccaaattggcatgggtggaaatttccaacggatagaaatccatcagtttgcctcgcggaggcacgacgataagatcgctttcattcgtacagtgtggacctcctaccgttcaatcaattaacaaaagaagaaaatagaaaagaaatcaatgtagtgcaaatcctatatacatatgcaaatcatccccactactagaaattctctgcttcctggtgcttccacgtcaccccattttatccccaccgttcgatctcaatcaagcgatcgaccttccacctggctttcccccatcccgcatcgcacatctcctctcccgcatctcgctgcttcgccagccccacacgcatcgacccctctctcccgcatcgctcctctcctctcccgcgtctcgctcggccgcttcccaccggatctctcgccgcaccacatcgacccgagcccccaccaccacatctcttttagcaccgggttccgcttcgcctcctcctcctcctagcaccactttgcgcgccggttccgctttgcctcccccttctaccgctatcgattccctcctggcccctgccacatctccggtcgtctttgccgaaaattaatttgtttcccacggtttcttcctcccctcgaaccgtcggcctcctagcctcctccacttcaagaaattagaagggcattcgcctgcttggtcggctccaaatgggaaatagcacgctaaaatcacctcctgcagccgcaggtaatgtccacgtccaattctcctcccacagccgcaggtatggttcttcctggtctggaaccagataggtcttcatctgcttattttttcttcttatttagaaaagtattagtcacacaattttgtttgctacttaccctcacagtgacacaatatcaagtgatagatttggtttcggtattctccagcctattgcgaaaggaattttggttccctctatttggtcaggtattgaaatttacttaatttgtttacttccttgaattttttacgaggactcgaagatcaaatgtatgtaaacctaattactctaagactaggtgtattactctaagctgcactgaacctatcatttgttttgctttgccttcagattgcaagtcattaccctcggcagattatgtaccaacactgtagaatctaatggcttcggactatgttcacaggatttgcagaaatataatatctatgtccatcataagatacaagcttcataagaggtaaggcaatttctttcgtagttcaagtttcttctcacgtgaattatgacaattaagctcaaaggtcacactgtgattagttcagtgacaaactta

SEQ ID NO: 67798 - DNA, 13022 bp, Oryza sativa
aaacacatatgctacataaaagaacttttaataactaattaataaataagtatcaactttttatatcatatgtaaaagtaaatttgtcacaaataatatggtgcatcacatactcataaatataatagtctcatccaataaatttttacattccaacaatatacttcattaatttattatgtttcttcatagcaaagggcaaaatggactttttcaaaagaatttaacggtcaactagcggaaaaggacatggaagggatccaaactaaaattcaggggtatgtaagagattgagcaaaattcaggggtatagaagggattaggtgaactttcatgggtacataggggattttctctataaggtatatattcttctctattttccattgtacattcagtcttataagctacagtttagtgattgatgttacttcattcttcaggtcggtgttcttttggattggactatggtggatgctctttgtgattgcagcattcttctatattcactcaaattttagatctaaaggttagtgcagctacttatcttcggttgtacagatttttcattccaaaatacttaaagtggtttcgtttttattaatacacactttgcaccccggatgaatgattaaatttcttatcagccggacttggattatcaatacaatgtagtgaaaattaagatgggtaggtatgttaatagcatatagatttggtgctagcggcaagcacatcatgttttttttgtcagagcacaaaagaagaccatttacaaataaacagggagtcaaggacattgtttaggtatttcacattgcccatttgcaaatctatttccataatatttctgcatatttcaagatattcaacctcatcatcttttgtcttttcaggacatgtatgtaactactttgtgtgcaggacctcttcaaacaagggaaaaatgttatgagagttatacagctcgagggtaatggcaaaacacatttcaccaagatgaaattggatctttgcttttatttaccctacctattatatatgctgcccttttttcgtactagaagcctcaagcttcaaactttgagtgatttagctcatcactgacacttggatgctaaggataaagaacaatgctattttttttgtgtttgtggcttaacatagccttttcagattaagacataattactaggctttatctaacatggtctagctaagatacaaggatcaaatttgataagaaccgctatgtgtttacttgattttcaaaatgccacaactgcttagggcatagggtgtttggttccatgaagttatcaaaaatcaattgaagtcagagccttactttttaattgaagtagaatgtacagttcaactattactttgtcatataagcagattattcaaattcgcgattgtgctttgtgttttttaccaattctctgttttttcctacttaaatcagtcaaccaatttaattttttaagtttattactataaattcccgctgcaacgcgcagggtatcatctagttacatataaagtgaaaacctcaaaactatttcctctgtttcatattataagagtttctagcattacatctatatgaatgtgggcaatgctagaaagtcgtataatctgaaacggaggtagtatcattgtatcttaaaatgaacatatatgatttggacacgtcaccaagagtgaaatatttacacctagtaaaattattactcatggttgaatcttgaagagaaacccccaaaggtctggctagcttcacaaggtgatgggctaaacgatttatgttcgaaggctcaccccttctaattatttaatattaaatcattccttaatattcacgtcatggttgaatctaggagtaaaattttactcttgataacgtgaccatatctcaagtatccatttttttaatccaacgatagtttgcaggttttcatcacacatgtggtttgcaatatactccctccgtttcaaaatatttgacaccgttaactttttaacacatgtttgaccgttcgtcttattaaaaaaatgtaaaatatgtaaaactatacatgtacataaaagtatatttaacaatgaatcaaatgatatgaaaagaataaataattacttaaattttttgaataagacaaatggtcaaacacgtacttaaaaagtcaacggtgtcaaatattttgaaatggagggagtatatatttcccgtttatcaacggccttaagcaaaagatgaacgttgttgtcagcggtcactgatcagttgtgctgaggagacagggcccacaactccacatacaaggtcaggacctattccaaaggcccaattcataaggggatactctaccaggattgggtttcgttcaggttctctcgggcaagtttacgtacggtgcgctgcgctgggccttgcttgctttctggttgggcttccgaccaaaacctcccatgcaattccggtccatcatagcccatgacatgtcgtccgtcgcagcgtgccgtcgcgatcgcggatacgcgatggcatggcttggcatgccaccacgcgcacggcctcatctcggtttcttcactcggacgcggtgttggctttaatcagcgcgcgacagtggatagctttgccagtccaagtcagacgtgtaccgtgtcgagaagtcatcatgtgatctttttttttaattattactccctccgtttcaaaatatttgacaccgttaactttttagcacatgtttgaccgttcgtcttattaaaaaaaatttgtgaaatatgtaaaactatatgtgtacatgaaactatatttaacaatgaatcaaatgatataaaaataataaataattacttaaaatttttaaataaaacgaatggttaaacatgtacttaaaaagtcaataatgtcaaatattttaaaaacggagggagtccgcagcactatattatcggttgtcaaggatgcttacgtccgcgggataatcgatatcggctgtctccgtttctctactacacgggggctgctattcttctctcgtcgtccacactcgttgtagttggagtagtttattcgtttttaaatatctttttcaaataattcttccgtctaattttaaatgtaactatgagtttctgtgttttattttagttgtccgtcttatttaatttatttttataattagtatttttgttgtaacgagatgataaaacataaataatactttatgcgttacttacgtttttatatttttttcaataatatttaaataagacggatgattaaagttgggcacggaaattcatggctgctcttaaaatgggacggattagttttttcattcttaggagggattcttcttgaaagagggagtagaagaaaaattggtcagaatgatggttctcacttcaccatcgtgaaggcatgtctcatgcacaaaacgcagatcagtatacgtagtgtatctatattgttgaatagtcccatattggttgtggaagggcaaaggacctaagatataagtgggggagcccctcacctcaatggctagcttttggggtgggaaagatcatttacgatcctacaattggtatcagaaccaggctaggttaacatctctggcttgatggacacgtgtgaaggcctgatggaccgtgggcggtagggcccggatacggtgaaggggcggtgaagagctgagagacaccaatgtgtgaagggttgtggaagggcaaaggacctaagatataagtgggggagtccctcacctaaatggctagcttttggggtggaaaacgccctttacgatcctacatatgtagcactgctccgtgagtcttatgacattcctgcgatcgtgctactcttaacgttggttttcttgcactgttggatcaaaaaccaacggcacacgtaactccacgtgtccatggatcgccatagaattcaatcatctactctttctccccttctgccccaaattcccgtgcaggccccaagttggcatggatggaaatttccaacgaatagaaatccatcagcttgcctcgccggggacacgacgataagatcaattatcaaaaaagaaaatagaaaagaaatcaatccgtttgcccattcgcacagtgtggacctcctaccgttcaatcaattatcaaaaggagaaaatagaacataaaacaatccgtttgcccatttcaagtcaattcgaagaagaagtcttccaaacaaaattaaactacacaatgatttgcaagactaacacaagggtttaacccaactttctctcacctcatctcggaatttcactatttccattctcctccatctactattaaactagctaccactagccgtctaaaccagaagcaaagcttcgtcaaggctgcatcccagcattccggcttgcagggccatcgcccatggccacggccggcgagcggcggggcgcgcgcaagtcccgcgtcgcgggggcggccgtgctgcgcgctctgcgccgcgcccgcgacctctacgtccggggcgccaggggcttcggcaagttcgtcgtggcggcgaaccccagggcgggcgtcgtcggccggccgacgtcgagggtgttcggcgtcggcgagctcaactccgagcaggagctgcgggagctcgtgcgcggcgccggcgccatgtgggcgacgcgcggtgcggccgcggacgcgggagctggcggcaagaaggcggatgctggggctggcgcgccggcggcgtggcgcggccgcgggacggcgccgctcgggaggatcgaagaggacggcgccctcctcgtgcatggcaccaagtagctagacagatggcataggggagtggattctaatccctcgagaggatatctcctcgtatacctttttcttttaaattcgatgcaaatagttgtaaaaatttctgaaaaaaattgacaatgtagagtataatgatacctactagtccactaaaatttatattcaaattcgatctacacatcgagaaacaaaaaagataaatttagatataaacagtacgctactattcatacgctgaatttgtcttttttatatctcgacgtgtgagttgagtttggacgtaagattttgtgaagttgcatatatatgttgtataaatgttgtcaaatttttccagaacttttcataacagtttagatggtttttgagcaaatgagggtacatcccctcgagggattagaatagtttcccatggcatagatgttccgaacaaaagaaaaaaacgagaatgtttcaaatcggttatcagtgattactactgtaccatactaccatatcttcagtgatttgaggtttatacaaggagtttctttacgtttctctgtactcatgcagcctgaaagattttcgatccgggacaaacttctctgttactatcacttattataaaaagttttatcgtcactttattcaacaatattaaatttaatgaagtttttacccgttatccctagccgggctgtggctccaccctatagatggccataaaacccgagaccccgacgacacggcccgagttttattgggccgtgccttgaccatagatagacacggcccggtcaggcgtgtaggtcaggctgtgccggcctaactgaccttgtcctagaccccgtcgtgcctgagccatgctaggccggacggcctataatccagccctgatcatactactgatccaaagagtaaattctaggcgcacttggaattgattaactagagtgcagcggcaagtgatcttttcttttcggggtaatccttattatttgacgaagtaaaactaacggtgtactatgccctagtataataactgagggaataaaaaaggcctttgcaaatacatgcgtcatttttagcaggcactctccagccaaaaattaactttgttcagtaccatactatacatgcttcacaaatactaacctatacatgcatgtacacacaatgtcatgtaaaattaaaccaagaaaattatctcttaacatgtcatctgaagtaacatattttttcggttctccacacaaacttacagcaccaaaacatgctaattgtaagatgatctcctaattacgagctttcataatgctcccctgtatccaacacggtctatacataaaagatgcatacatgtcttgaatatacaaatgatcataaggttttgggaacgtactacccaaattttgaaccttcgagctattaaaatgataggcaagtcctctttgcatctcttggttcagaaagataacttctttatagggatggaatcccaagattgaaagatttctacggcatcgtacttcatttggatttgcagcgtcaagaatatatatcatcgttatcggagtcccattcaaatttatttactcgtactaccacttctttcacatctttctcgatatcaatgatttctgtacgaggcattgtcatattcatagcaatatctccgggtgatgtattccttgtaagcttcgtagtactcctcagcgccattttgactggaatgtccaaagtagttcttgtagtgcaaagtccacggaccatcattttgtatacagatttcctgacaccctagaaggaactaagatagatccttgtcatgcttaagttcccatgtcatctgaccacatgacttgttgaggaacgaaacacgtagtcgatgctcattatctattaatgcatagtgcacacccctcattgatctcccaagaaaatagtttttatatggagatacttcattattcatgggtaacttaattacttggaacttattatctggcaaggatattatgcattaaaacaatataaatcatgaaaccattgaaaaaaaatataaagaaagaagagcaagcaatggtaattaagcacacttgtgtttggaaccccatgttcccaatccctccctatcgtttttcgtgcgcacgcttttcaagctgctattcgaaagttgcttaaaaaatcaaattaatctattttttttaaaaatagctagcacttaattaatcatgcgctaatggattactccgttttccatgaggagggaataggttcccatcccctagatatctgtctggcaaagtacaaaagaatgatgaactcgtacctcatgacaaaatctgtctggcaaagtacataaagtgctccctgccagtagactccattgtaacgatcatatagatattctgttaccatgtcggcaattgtaccggcagcatcaccttcccgtgcaaattaaccatctctcttcccattgcccagtcctcgatgagaacacctgcagtaggctttgtgatggtggccatggcatgctcttaaccagaggatatagctcgtaggatttactacggatccgtgggatttggaagatctcgtagtgtggtgatacggtggggtcgaacacgagatagttgtcaaaccggtacaaatctatccagatgtgctgaagttgaggtagatgccggcgagcgagagagggaggaggtcggcgcggagcaggcggcgggtgtcgacgatggcgcgccatgccttgcagacgcagtgggacgcggcgatcgagccagcgcggcgcgaggcgcgcgaggacgtccgcgagcacgtcgtcggataggagctgcgtcacgtcgtcgtggtgctcctccatcgaatctctctctgctcaaactgctgctcggtttttagatgtcgtctcgtcgggtaatacttgcaggcggtctgttaatctatggacgagaattcagtggcggagccagaaattatacaagactagggctaaggtagggctggactaatggagtttcagttttctgaaaaatttacatggtgaatcaacaaaatttaagcaagtttttggagacaggcctagggctcaagtcctagctgccctaggcttgtctccgcccctggacgagatggcatccgattccgcgttggttttgcattccgagagaagtgaagcgcgcgctctgttccgattctagaaagaaacgggtggagtgggagttttgcctgatacacagagttttgttactccctccatttcacaatgtaagtcattctaacatttctcacattcatattgatgttaatgaatctagacatatatatatctatatagattcattaacctcaatatgaatttgaaaaatgctataatgacttacattgtgaaacggaaggagtacatgttttgatgtcatagttgttaaaagaaaaagaaaagaaaagaaaatacatttcaaatcgattatcaattattactaccttttatcttcagtgattggaggtaattctacgagattgaaaatatacgattttcttaatttagttgggaaagtctaatttgttgctagtattggtatgagaaagaaaggacaaaagaaaccatctaaacaaaagatcctatccacatttgaaatttatgaactagagtgaaatttatgaactagagtgcatcggcaagcaattttttttccgaggcaatcctgattatttgacaaagtaagtaaatgatatatactccctccgtatcaaaatataagcatctttagactctgacatggtctccaaccaataatatctataaaataagatgttttaaataaaaaagagttgcatattagtataatagtttgtttaatgataaatctaataacatcagttatacatgattgatcttttttacttttttgctattaatagtcaaagttaaaaatgtatgacttgtcactattctaaaaatatttatattttgaaacggatggaatactatgttctggtattataataaaaataagtcctttgcaaatacatgcgccattttctatcaggcacgctccagtcaaacatcaactttggtcggtaccatatatgcttcacaaataaaacctatacatgtatacataatgtcatgtacaattaatcgagataattgtctcttaacatctcatctgaagatagcatatttatttaggtcgccacacaacttacaccaccaacacatgctaaattgtaagacaatctcctaattacatgctttcatagttctcccctagatccaacacggtgtatatataaaagatgaatacatgccttgaatatacaaatcatcataaggttttgggaacgtactacctaaattttgaactttcgagctattaaaatgataggcaagtcctctttccctcttttggttcagaaaaataacttctttataaggatggaatcccaaaattgaaagatatccatggcattctccttcgtttggatttgcagtgtcaagaatgtcatcgttgtcggagtcccactcaaaattatttactcgtactaccacatatttcttgatatcttcgcagtgatttttgtaccagacactctcatattcatagtgatatttcctaacaatgtgtttcttgtaagcttcataatagttgtccatgtcattttgtctgggatatccaaagtagttgtggtattgcaaagtccacggaccatcattttgtgtacagatttcctgacaccttagaaggaaactaagatcattgtcatgcttcagttcccatgtcatctgaatcatataactcattgaggaaccaaacccgtagtcggtgctcattatcgattaatgcatagtgcacacccctcattgatcttccgagaaaatggtttttatattgacatacttcagtattcattggtaacttaattacttggtacttgttatcagacaaggatattctgcattagaaaaaaaaacaatatatgggttataaaaccattgaaaaaaataaagaaagaagatagagcaatttaagcacattaaaagaatgatgacctcgtacctcatgacaaaatctgcctggcaacgtacataaagtgccccatgccaatagactccattataatgatcaaatggaaaagccaatgccatgtcagtaactgtgccggcagccacaccgtctcgtacaaacaatctctccccattgcctagtccttgatgagaacacttgcaacacgcacagtgagggtggccattgcaagctcttaagcataggatctagcacgcgaaatcctgtactaggaactcgtgggattttgaagatctcatagtgtgtcgatatggtagggtcgaacacgagatagctgtcgaaccggtagaagtctctcatccagacgggctgaggtggggcaggaggagaaggcacccactgtcgggtagcagggttagccacgccggactttagcagaaggagtccgttgcaatgatcctcgactaggttgtcgttgggcgtgtagtcggtgaacatgccagagatggcggggcgtgtggagctgggacgggataggaacaccgaacggtgcatctcgtggaagttgatgtagatgccggcgagcgagagagggaggaggtcggctcgcagcaggcggcgggtgtcgatacggcgcgccatgccttgcagacgcagcgggacgcggcgggcgaggacgcccgcgagcacgtcgtccggaggagctgcgtcacgtcgtggtgctcctccatggaatctctctctctgttcaattaattcgttgctcgaaaggttttcgggtgcgtgtacgtacgtacgcgtacctcctacctgtgggcggtctgttaatctatggacgagagatggcatccgattccgtgttaattggttttccacgcactccgagtaaagcgagcgctgggcgctggagtgggagttttcctgatacatacggagtcgatcgagggattcttatcggttggacttggggcgcgaatccgttctgctcccagactcgggcacaagaccactgcaatactaacacccagcgtgaacaagccaacaaaagattggacgcgccgtcgataccaatggacgagccatgagcaggcggccaccgcgacaggttcggtgttggcgcgcgagctcaattccgagcaggagctcgtacgtgcgcttcatggcgcgccggctgcatgctcgggaggatcgacgagccgcggcgagagcgtacgtggttttggagtcggagcgcgcacagggcggtttgcactgcgccaatggatcgaatgtctggatggatgcattatattgcatttctagttttttttttccctttgggtggggggattactgatggtatactgtggagtagttgttaagaacaaaaagacgaaaaactcgtcacactcccaccacccgggcacccgccatctgcgccacaccgctgggccgtcgtactatacgcctttcgctgagagagagatgtgtgtctctgcggccacaaaggctgcccctcctgtgccgatcctgcctcctatcatgcacagctgctcggcaacccgtcctgaaaactagctgctgcttaattattttcacttgttcgtgaatcgtgaccaatgcaacagctaagagaatgaactagctcgttctcgtccctactctacaattatctatgtgactgtgtaggaggaaacgggcgatggagaaaccggattcctggatgccaaccagacaattagacaaacatgccgctgctgcacgagatatggatcgaggcatcgagctgctaaacgcatgcccctgccgagtgaccagctagggtttctcctgagagtcgttctggcttcgttacacggtacgttagaggcaactgttttgatcgtgcagttttcttgagccacttaatggcttccccgaattaaatggtttaactatatattttcaccacattccgcaaaagacactgcctgaaacacaaaagtccgttgtattgcaaacattgcagatagagacagacaaagatatgatggccgccgcctcgccggccaccgcttctaggtctctagacccctccctccgtgcccgtttgtcttgttgatcctttgcaagattgtgtctttgttagttgaaaagcatgctttttgcttcttctttttttttttgctgtttaaaccacttgtttactaaaattagattgtgttgcctcgtctttccctcccccagcacagggtgaggattacccggaggatcagacttgtgaagcaaacaagctggcatcacagttaattgattcttgcgggaatgggtcttctcctgatgttaggtgctgcgagacgattgtagtggtagttgatctacccaattgtctttgcctggtgtctctgcgccccaagattaaggagtcccagttttctgcttttactttgatcacctcttaccgagcatgttgaggtctccgtgccgtcaaacagaaggatgcagccctgtgctatggcttcaatggttagaatgtttctgtggttctctaatcaataaaatttcaaatgatgcgttcttttgcatgctagctagtactaaattggtactgtttttcgtgtgcagaaacagaggatgagcagccaaatcttccgcctccggctggaaatggcgttggcacagccacagtgaagcagcctaagatgatacttgatcccggggacaacttcagcaactgggatcggtacattatggcaatcttggaggtggcgactggagttcagatcatttacgcgctttttcgagagatagtaaatcgcttgccgaccatccttgcacggaataatattcctcgtcaagtgtaaggggtcaatggtcgatccatgtatctctcaattgtagctgttgcctgatgcatctgagttaatcgtaggtagcagctacatatgtatccctgtttatgtatcttggatccctggatccctgaacttgaatctggtacttattcgttgaatgactgtattaagcaatacgaagagcgtgatattgttccttttcttctctgccattcgctgttcagatggcaccaccttacatctttgcagtactcagctgtccacacaaacgattacttgattactatgcgtcgaaggtggtggcctatgaagccagctagagttggaaggtgttgactactacaagtctctaccactgatttcaagg

SEQ ID NO: 67799 - DNA, 5298 bp, Oryza sativa
  unsure (1)..(5298): unsure at all n locations
tgagggtccctttgaatcacaggaattaaaaaatagaggaataggaaaaacataggattctgacaggaatgtaagtgtaaaacaggattgcaaaacataggaaaaacgtaggaatgaccgtttgattggaccacaggaaaaacacaggaatttgaggagagataaagactcaaatgattttttccatgaggttctacctcttgctaaaattcctccaaaacttgtatgggaagaggcattccataggaatttcataggattccataaggtccattcctttgattcaaagggctttgtaggaaaaattcctatagaaatgaaatcctctgaaattcctttgaatcaaagggggcctcaatcttatctgtccatgacaaactattcgagctcaccccttgtaagatgaggacacaaatgatggggatcgatgccaagtaatggcacgattattttcgatgaattttctgcactaagtaagaaatgtcaaagtcagtattacacatcaataagtgataataccatatgctaataatgcattgcaaataaaaatgatatcaatgaatagctataacagaactgaaagaataaattcatgatacaaatcatcaagcatacgcctttagccttttgcagcccgaaaagaatccttttggccatcaactattatcaagcacaccatatagcagcatcaaaagggataaaaaattagaccaacgaaatggctgcaaagtggaaaaggggataacaaattaaaatatgctttttttaatctccaaaggcacaggtggtcctaaacgaagaacaacaccatctaaatttcatgataccctaagtataaaaaggtatctaagttataaccttacaattttcacgaacagcaaaagtgatttggccttccattcctggaagtacaatgtgtgcaacattgatcgagtaactggcaataaggaagagagagaaatcaaagcaagaaaaatctttgttactgccttactggtaaggaatattttctgctggcagtcgtgcagaattgtagtgctgattttatgtaccgatgagactctcttttttttctgagttgctaaataaacatgttttcatctagaccagcatggttcgtgctagcatattataagggatatgtttctcaagttgcagttgttatgtaccatgcaaaattaatttcacttaatcaaacaaccctaagggacactgatttgattaaggtaatgaacaaccaaaaatgtgcgtggattggagaagaggatgatcgattttaattaccttagggctggaagaatctgagagcgaacttgctgtgctccaagaccggcttctggtcatcgatgagcggccagtccaccatgagtgtgtcagtggcatgcaagcgcagtcaaatgagataaagtacataaacttcttttttcagaaccaaattcgcattcttgaatgcaagaaggcgctgctggaagaacaggaatcgttcatcgtacaggttgtcatgacaaaccatcagaacatatatcaaggaagtttaccaattaaaaattatattcagaagcctagcagggaagacagacattatattcatggacattattcatcgtgataacaatatctgatcagctaaaatattcaaaattgacaaaaaaaaactattttcttgtcttccctaacctgatcattagtttttggcaaatgaaattgacaacataaatattcctactcaaaggagcctttatatttctatgcatgtgtgttttattgttgtggagtgtggatgaatataaagagctgttaagtttcttagaactggcatttggaaaaaaaaacatatcctagctatatgtttagtatgacaccaagaaaatggaaaacaaaaacaaagcattatggtcatgatctatggtagcagctaagaaccctggatgtcatgttatctgaccttaatatgctctatggtttgccaggtgatggtaaaaagtatgtcttttaaaactaatgacaatacaatgcatgtcattgatatactcatgtctcgtgttaagtgatagtatcttgaacggacgggttaaataaattgataggctaattggcaacttggcatgaaatgaagtaatgaactggagagaaatgtaagcaacataaagaagaggtaagtttatatataatagccaccggtgctacagtacaaaatcatccgttgtggcatgttatttttagatatcctaacaatgccatgatattcagcaagagggatagctatttttgttcagagcttggctttaggattcatcacgacaattgatttttgctctacctaacccgaatatgcaatctgtaaccatgttatttgggaatggtagagacaagttaaattctaattgtgctcacacaaaaaaaaaatgcagtgcggcacatctaaagagggggaaatgatagaactgaaaagcatttcagaatattcagggcattcgccatcatcgggtaaaatccatcaaacaaaaacaacaacacagtgtttagcctgcacatctcaagtctcaaccatctaattggaagcaaaacaaacgcagtgtacgattcaaggtgacctcaggcgtgcagatcgttcggtctgggcctccatggaaaccagctcctgttgctctgttgctgttgcctgttggcgctctttctggtgcggccgggtctgcagggtgaagttgggcttcgcgttgagcctgatgccgagaatgacgacggtgaggaaggaggtgaggtagcagggaagctcccagtccacccacttgcagaactcccctgctgacggcgacggccgcttgaagagagccagggggtcaaccacccgacccatgccccttgtcgtgcctgctgcagatgcgcgccgcgccgcacaaccgagctcgcaatatccatgctccttcgccggcgcaggcgcgttcgcagatgaagtgaagagggaggttctgtgggctagggtttttagggatgggaattggcgaggtgcagcggtggccaacgtcggaggcggttcgcgaatcgccggagaacgggcgagagaaggggagaatttccctagaatgaatgctaacattttcactaaacacccttggaagatcaaattttgcagttacgtcctttgaaccatctctaccgttgattcataatccaacagatgcgggtgcgaaccgagccttggaatagcacgcggccacgtggcgcgtttcaaagatatgtaaactttgctcactacaaaaaaaaatcgatttttcatggtgtttacctatttttttctctggcggctataagcaaaaaccgctagggaaaatttgacgagagatgaggtgctaagaaccgccagcaaaaaaccattttcactggcggctgggttaagaggaccnnttgcaaaaatngangtnttctacaagcggtcctcttaagtgatcgccagcgaaagtttttcactatactaaaacaccaagtgcgcacggactcttcttatccactcactccatcttaccctattctcctcaccccacctccatcttatccactcacgcccacgcctcccctgttcttggctgccatggcgaagaagacggcggacaaggcaactgcagcgacggcggacaaggcgactgcggagacggcgacgatcggccttctcctctccttggcggcgttcgccacgcggcgagctcggggccggatccaccgccgccaacgaccggggaggccggatctgccgccgccaacgacgggtgaggccggatccaccgccgccaccgctgactagagatggcaacgggtgcatacccatcgggttctcttgccccatacccatacccacgatgtctaaatactcccacttaaatatccacacccatcacgggtacaaaattgtccccatacccacacctatgagggtaacaggtatccaacgggtacccatacccatataattgacttgtaatatttatagttttgtactataattagccatattagagttgtaaaccatcaatattttctctagcagcaatgctattaatattagtgttcaaaggcgagtaaaaaatttatacaaccacattacatactcaagagatcaaataataatttcatataactagactaagcaatgattaagatgtgaaaggagttttatgctatgatttagtagtcgttgagagttataatgctcatagttttagactcaatcaacgggttttttctacccacgggttggtgggtacgggtgggtaaagaacggacccatacccacgtacccaatgggtaagagttttcgcccgttagtagacccatgggtataagagttagaacacgattggctcctaatagagtaaaaacccgtcgggtctcgggttatgggtacccattgcatctctaccgctgacgggagtggtcggatccgctgccgacgccgacgggggtggccggatctgccaccacgaggccttggcagctagggctggatgaaaagctcgtggctcgtgagtagcttggctcgactcgactcggctcgttacattttcttaatgagccgagctggcatctcagctcgttacacataacgagccagctcgagctagctcatgagctcaaacgagctgatggaaagtaacaggccagtggcccaaccagccggtgcagtccattttccaccaagccgtctcaaaatattaaccctagatgacacccaatcctcctctcaccctcccagccacacaagcggcggcggcggagacgaatctggtgcgcccatccccttttgttccttccttgctctctaccgccgtagcaaaccggcagcaaatccactctgtattctgtggtatctattctatggtgcgtcgtggctgcacgactatgctggcactcgtgaaatccgtttggagaatgcgccatggcatcgtttgcggagtccgcgacggacaggaaggcaaagcccaggcatcagagcctcgaagcagcacctggatggatggttcacaagtaaaaatcgtcttcctaatcaccgagagattggttctcagtgagttagtgttcttcatgtgtttgctttgttttgtggctgctctaaattccgccagcgaaaacctaaaatggccgcgtcacgaaaaatggtttacgtagtagtggctttgaggtttagccatgtggcccaatgagatggtagtgtttgcaccctgaaatcggtattctagatgttggattttgaatcgcgtccctaaaccgcaataccaaatattacacatttctcaaattacaata

SEQ ID NO: 67800 - DNA, 16376 bp, Oryza sativa
caagggccccgccatgacatgcatggacaaccgccgaagctctgccaaggacaaaccggccatttgacggtccgcgtccaccattgccactatctctatatgtcgatcgtccctagaaagtggactagtaagcttcgacaatggctatggtggcgagggggcgtggtgagtggagaagaaaggcatcgcccttgagactaggaagagagggagaaggggaaagaggaagaggaacgctgggaagggagagatgggaggagaaaagctgacatgtgtggggctcacgtaagtcccacgctaactcaggcgccacgtcaaccaaaactgaggactatactttctaggaccttgggaacaccagtattatgagttgagggacgttaaagatgaggaatgtaaagtgaacttattcggatgcaatttatttttttttgtaagggttggttcatttatattccaaacatccctttttgagctcaacaagattaatcctttcggcctgtatattccaccggttttggggaaaagccagccattcgtagcggggccgccgatgcttatgcctatgatccaggtcagcgcaaaggttttggtggcataggttgaaactaaaaggaataagtctattatgcttccttcaactcttgcacctagttgaatcacatccctcaatcgcaaaaccaggtatagatagccaaaaggtccacccggcacggcccggcccaggcacggcaaggcacggcccaccagccatcgggccggcacggtctgatcggcacttcgtgccgggctgtgccggcccatcagctccacctttggcccaggcacggctagggatggcaacggggctacccccgtcgggtttagccaccccgtccccacccccgatgtgagaaaaatctcccgtcaccattcccatccccgcacacgggggaggtttttaccccgtccccgtccccatgcgggtacggcgcacccgccaggtccccacacccgacaatcgaaagaaattcatccagcagaccaacagtgcagcggtaagccatgaggcactaatccacaagcaattcaccaaatcaccataatccagcagcaacaataaattgataatggttgaatcagtgaacaatctgataattcatcattagtcattactcattacataatgtaaggtagcaactagcttgttcatcacagatgtgttagaggcggccacgtggaatgggcgacggaggcgatgctactgtgtgcgcgtggtggcgacggcaactacggcgtggagtgggctgtggctagaagacgggaagaaggcggcaagatgcgccgccgctcaccgagcccggcgcggcggctccctggcgacgtcgaccccccccccccccccccgccgattggatctaagggtgagataggggagcagaggagtgggagagagacacggtgagatgagaagacctagggttttcttgggtttatataccaacacctccgaattgggcagggcttttactttcatgtgggctaaggcctgcatatatgcctacgtcggggtcccatagggatacggggccagggagctagcgcccgcccccatactcggcccacccgacgggtgaggaaaaaggccgataacagccccacggatagtatttctctcccaactagagaccctaatagagtttttccccaccgggatcgggttacggggctccattgccatccctaggcatggcccaccagtagtcgggccgtgcagggccggctcgaaggcatgggtggcccatcatgctttttttaaataagtctattttccctcccttctctttgggaggatatatatatctacttctacttctactattttctatttaaaaagtttaaaaaatttccgtcgtccgtatatacataaaaaaaagcgaaaagaaaagatacggcaaaaaaaagtccgattgtgcaacggtaaaaaggaaagttccgtccataataaaaagcccgtaaaaagggccaaaaaaaacaaaaaggcgcggccaaaagaaacatgaaaagggtgaaaataacaaagaaaagaaaaaaaaagattttcgattctaaacgtcgccagtaaaaaaagctgaaaaggaaaaaaaaccgccatccctaataaaacggcgaaaaaaaggtaaaaaaaaaagcaaaacgccgtaagaaagatttgaccgcatatatgtctaaacgatccctcaataattttagagatcaagaaagattcaaagatttggccgcatatatatctaatcgatccctcaataattttagagattaagaaagattcgaccccatttgacggagaggattgactctgttgtcatgcgggcatggtactatgcgagctcgaccgaattaccggatttgatgggaggatcggctccgtcatggtacaggaacgagtttgttcgagctgggtctatagctccacttgtgggctgagccggtagaccgggcacgggtctgttcgagttgggcctacagttccacgtgtgtgctgagccgaagagaggtagactgagcaaatagaggtagcagactaggctaagactagaactgaaaagggaggaatgaatgaacgttcgcttcaaaaccaagcaagcattaaaatatatatagctaaataagtctattttacgtctctattctttcgactttggcataaaataagtctatttttactccctattgtttgtgtgtcgggcctggcttgcggccccatcgtgccatgccgggccggcccaacgtgccggtggaggggcccaagcacggcccggtggtcaggctgggccggtacgggcccaacccacatcggccgtgccgtgcttgggccgggccaaaatgccgtgccgtgggatgggccgtcgggcctcaggccttttggccatctataaaaccgaggggactacctatacatttgtcgacaaatttttccccaaaaatttgacagatgtaattatagtacaatcgtagtgtaattacactgtaacttatatgtaattacactgtaacttgcatgtaactacactataacttatatgtaagtttaacataattttgaatcgttagatctattacacgatttgttttggttaggaagaaaacaaatcatagcacacacatatgtgaaagaatttgtttccacgacctccattttaccgaaataacatgttacggagagatttttgaaagttacatacaagttacatacaagttacagtgtaattacactacgattgtactgtaattacatctgtcaaatttttggggaaaaatttgtcgacaaatatatagcaaaatcgaaaccgagtataacacctcccttatttgtaaaaaccggtataaatcgcctccttaagtgatttgaaaggtggttttatctaacgtggcagctttgaccctattgactagctgactcagcttgtggaccccacccatcaaggaccacttcatcttcttcctcgcctctcccgtctctcgttcctcttcctcctccatcacctctcacagcagaacgcggggcagagctcgtcagccgaccacgacgcgcgcgtgggaaggagcttgccggccgtgtcgtgcgcgggccgcgggggagggaggtgtttccggccgggaggagctcgtcagaagcggcgcacacgggtggaggggtcgccggcgcggtgcgcacgcaggaaggaactcgccataagcggcgcgcgcgtggggagcggtcgcgggccagtcgcacgctcattaggagctcgccggccgcggcgagcccgcggggaggagcttgctggcctcgacgccagtcgatcgcgcgcgcgggagggctcaccggctggtcgcacacgcgaggagggctagccggccggtcgcacacgtgggtagggcttgccagtgttagctgctatttcagagtttttcaaagttttagagaatcacgagagagaaggaatttgtgggacaattttctaggttctttcattcaactgaattgaaaaacttacaaatggaaattttagctactgctacttatactctaataacagaaaaaacgaatccaagcctacaatcgcgccatcccacgatccggaactcctggatccaatgccgtgcaaaactcacgcccacaacgcacgcctgacgcggtcgtctactcctgcagctcgccacatctctcgtgcatgcataacaaactcaaaactgaattattcatccagccgttgcaactgccatcgcctggatcaccttggggccatagctgaaataacagtcaacaaactcccccttaattctgctacagcccaaaatcacgaacacctagcaggtgccgtgctgtcgccaatctcgctgctggcaacccttttgttaacgcatccgcccgctgctcctcaatccggacgaattcaatctgaatcttcccactttcaacacactcacgaataaaatgataccgggtatcgatgtgcttacttctcccatgaaacacagggttcttcatgagtgcaattgctgatttattatcaacatacagcttcaccggcctggcttctgcaccaatcatctcaatcaacaatcccctgagccacaaagcgtgacacgctgctgcagtggctgccatgaactcagcctcacaggacgaaagtgccactgttttctgcttttgtgaactccacgagaccaaactgccgttgaagtaaaacgccatgccgctagtactccgacgatcatcactgtcgccggccagatcactatctgtgaaaccagtaatctccactgcaccattgcctccagaaaacatgagtccacagttgattgtccccttgagatatctgagaatttgcttcaccgccttgaaatgcatcactgtcggtcgttccatgaatctgctcgccacgcctactgcgtaggacaaatccggccgagtatgcaacaagtaacgaagacaacctatcactcgcctatactccgtgggatcaactgtgcttccttgagcatctttgtgcaactgtgaacgatgttcaataggaattgaggtagaattgcaatctagcatcccaaactaggtcagaatcttccttgcataagcagcctgcttgatggcgatcccgtcagtgccttgcaacacttcaattcccaagtaataggtgagcagtccaagatcgctcatctcaaactcccccatcatctgttgtttgaatgcagtgatgtcgcttgggctttctcctgtcacgatcagatcatcaacatatactccaacaattatcccggtactccctgtacctctagtgtagactgcttgttcttgtgcacaccggctgaaaccaagctccttcatgctccgatcaagccgtgtattccacgcccgtggcgcctgtctcagcccgtagagagctttgctcagtttgtacacaagatgttcctttcccttctcaacaaaaccttctggctgagagacatatacttcttcctcaagatcaccattaaggaatgccgacttgacgtcaaggtgatgcacctgccaccttcgatcaactgcaacaggaagtatagctcgcaccgtgtccaaccttgcaaccggcgcaaacacttcatcaaaatccacaccttgccgctggacgtaccccttcgccaccagccgcgccttgtgtttgatcacctcaccggcagtgtttttctttagcttgaacacccacttgagccctattgccttgtgactggctggcagcatgcacagcgaccacgtcttgttcttctcaatagcctccagttccttgttcattgcgttcacccacgccggctcgccggctgcttcacgataggatgtcggctcctccatctctacgagcagcgcttctgtgtcgtcatcatcctccaccaggtccacccgaggtgcttcaatcatgatctccgccaagcttctgtaccgcaccggctcgtcgtcactgccggccgtgcgcggtgacgcctgcacctcggcagagtgcgttgaggatgagccgagtgtaggcgtgctaggcaaggttggtgagaacctcgccgggcttgccggaggcgttccccgctgttctgccacttctggctccttgccggctcgccttcctgccggcggcgcccggtaccacggtaccgagcctgcctgctctgctggcgccggctgctctgcgccaacgggttcttctacctcgaactcagtggaagtcacctctcctgcagcagcactccactgccaaggtgtgttttcatcaaaaacaacgtcacgacttacaatgatttgccgacgacgcggatcaaacagccgatgggccttgctcccttcttcaacccccaggtacacgaccggattgctccggtcgtccagcttcttcaagtgcggtgcagtcaccttcgcgtgcgccgtacacccgaacacccgcaggtggcccaggtgaggtttcttccccgtccatgcctcgaacggagtgcgatttcccatcgccttggtcggcagccgatttaggaggaatacggcgtgacgaactgcctcgccccacatcctgccgggcacggacatccccttgaggagagaccgcgccattgccatcaccgtcctattgcgacgctccacgacgccattctgctgcggtgaatacggtaccgtcaggtggcgctcgatgccggctgcatcgcagacgcgcgcgaactcgccggacaagaactcgccaccgcggtctgtccggagtgtcttgatcgttcgtcctgccgtgttctccgccaacggcttgaacttctcgaaggccgcgagcgcttggtccttcgacttgatcacaaacacccacatccaatgagaaaaatcatcaacgatcaacataaagtatcgattaccggtgaacgtcgatggagtgatcggcccacacagatccatgtggagcagctcgagcggcgcctctgctagatagtttgccattcctgggaacggctgccggacttgtttcgccaccagacatgcttgacacagctggtttgggtggtggactgcgggcactcctgccgccatctccttgtccaccaatagcttcaacgcatggaaattcacgtgtccgagccgggcatgccacagccacgccgggtcatcgagactagccaacaggcacaccggtgacgccagctgcagctcgatgcggtacagccgatttgaggatcgccgcaccttcatcaccaatcgccaaggatttttgtcgaacacctcgaggtcatctccatccatcacgacacggtggccagtttcagttagctgccccaaactcaccatgttgcagtagaggctggggatgtagtagacatcgtcgagcaaccactggtcaccgttcttgcatgagaaaaggatggatcccttccccattatctgcactgacgaggcgtcgccgaacctgacctgccctgtcacggtctcgtccagttcccggaatttccgatgatctcctgacatatgattgctggcaccattgtccaggtaccacagatcaccagcagctgctcccttctctgccagcatcaggcgaggccacacacgctcctcgtgcacgaccagcccgcagagcgcatcctggcgcgacgcgttctgcaccgcctctgtcacagcgagcaacaaagttgggccagcatcctccgtttgcgcaagatgagcttcagccttcttcttcttggggtgtggacactgcgtggagtagtggccaaactcctcacagttgaaacattttatgtggctcttgtcgcggccaccgctgccaccaccagagccgccaccgctgctctgcgtcccaccgcgtccgcgacccctgccacgaccacgcccggcctggccgcggttcgccccctcaccagagggcttgttcttctgtggcgacgaggtttctcccccgcctttcttgaagcgcgcctcccactcggcctgagtgaggagaacttgcccgtcagcggtcactcctccggtggtcgccttcttcttccgcatccgctcttcatacgccttgaggcgacctaccgcttcttcgaacggcatggtgtcgacgtcgtaaaattgctcgatccctgcgacgaggctgatgaacttctccgggacagtgtcgaacagcctcttcaccatggcggcatcgttcaacgtcgcgccaagagcagagtaccggacccccatcgtggtgatccggccggcgtactggtccagcgtctccccggcctccatcaccatgttggtgaactcttccttgagtgtctgcaggcgcgcatcgcgcacccgatccgccccgatgaatctcgtcttgaggcaatcccaaacctcctttgccgagcgtttctttgcaacctgcatcaagagatcctccggcagcgactggagaagatgagactttgccttcttgtccttcctcgggtcaacggccgccctagccgccggctcgattgcttctcatacgccttgatcctccatcatagcctgcacacgtattacccaactagtgtagttggttgacgtgagctgtgggtaaaggaaagcacttcctgagctccccctcgccgggtccgccgtcgccggaaccaacgccatagtgctagatccgccctcaacctgagaagctctgataccacttgttagctgctaatcacccgatcgaacactttgtgcgcacactgcacatgtccggcacggcaacagacaaaaaaaaactgaagaacataggaagaaattcagaacatagaagcagagtatttcagagtttcagagaatcacgagagagaaggaatttgtgggacaattttctgggttctttcattcaactgaattgaaaaacttacaaatggaaattttagctactgctacttatactctaataacagaaaaaacgaatccaagcctacaatcgcgccatcccacgatccggaactcctggatccaatgccgtgcaaaactcacgcccacaacgcacgcctgacgcagtcgtctactcctgcagctcgccacatctctcgtgcatgcataacaaactcaaaactgaattattcatccagccgttgcaactgccatcgcctggatcaccttggggccatagctgaaataacagtcaacagccagccggtcgcacacgcgggaggggtcgccggccgcggtgcacccactaggagggcaagctggccagtcacgcacgcggggaggagctcgctggtctcgatgccggccggttgcacgcgcgggagggctcgccggccgcgccgcgcacgcgggaaggagctcgctggcctcgacgccggcaggtcgcgcgccctggaggtctcgctagccggtcgcgagggcggggagggctcgccggccacggcgcgcgcgggaggagcggtcgctggccggccgcgacgcgtgcgcggggaggaactcggtttgtcctccagaacctcgcgagaactccgcggtgccaccgccgtgtccgcgaactctcagtattccttcctccttcaccttccgcaccgaggcctagtcgccaccacgcatcgcctcttcgcgcgtgtcagctcgccgggacgacgccgcatctggcgctgcgtgaacggcacgcgtgtagggcggagagatgcgcgaactcagccgccaatgccggattgctgagaggtggtcggccctacatccttttttccatgctccctgacatttgggaccactgtatatggttttccacatctcattgacatgtgggccctagatgcaaaaaccacttttgaaaccaccaaggagtctatatttaccggttttggaagacagaggatgcgctatacccgatctcgtgaatgagggatgtgattcaatcagtaacaagatatgagggaggcaaaatagtcttattccaaactaaaaacatgggtcttaacataaaacaaattagttacaaaccttaaatccatctagaatcagtatttatatgatttttgatagatataatatcttaaattttcttcctatatttctggatgaaaagttattgaccatggtatcaataccaatatcatccaacaatttcttcttcattgccccatttttattctctcaatttattcacttgtccttttttttttttgctgcttttctctcaacaaaaatgatgtcaaggatatgcaaaaaattgaaaaagaatatttaacatctgaactcatatttttacctattataaaaattgaagatgattccatactcaccataattgtataaaattttcgtccgtcctagttgttgggatacttttatttgactgtttgactagcaactgaaccagtcaaaccgctcaacctgtgaattgaatttggtgtataactataataattgaatttggtgtataacttgtaatttttttctaggaaaaaaaatccaagcaaattcttagaatgagtttcaccttaactaaacagtataataataataagattaaaatagtcttcaccaattgcaacgcacggatattttttctagcataaatataaagtacaaacataactagaaaagcaccagatttattcaaacaaatctaaatctcactgatttgttgatcgcgggtgtgcaaggcaacacgcacgacggctgcttcgtccaagctgagaacctcccacaaggaatataaataaacttgattaagccaaatgtgtatgtcactcacaacatatgtcaatggtcatttggcaacgagctgttgctgctcctggttacctcctagatatttcacaggccgatgagcagatcggcgagtagtcaacgtgtcttgcagttgcggagccgcggcggctgttctgacgaagcggcctgccggccggggaacagtggtcggtgctagcgtcgacggttgattatagacgcaaatcgctagtcgcctagtactcgtctcggcggaggaagggttgcgtcgtcgtcaatgtgctctctgctctcctttctgtctgagaaccatagaaagaggcgcttaagtcttaactccgtgtcgcctactactccgactctccggtatatgattcgtggttttttttcttttttcttttttttgaagttggttgcctcttccgcttcgcggcaacgcaagagaacagccgcactctcctactcggggtcggagttgagaacacagacggaatcggatgccatatcctctataaaattaatcacggaacacaccgaacaccaccaaagaacagatcaggaacggccggagcagagagagatggaaaagcaggacgacgcaacgcagctcctaccagacgacctgctcgccgaaatcctcggccgcctcgcgccgcgttggctcgccgcgtcccgctgtgtctgcaaggcatggcaagccatcatcgacagccgtcgccttctccgcgcggatctcctcccgctctcgctcagcggcatctacttcaacttccatgatgaacggcattcggtgttcttctcccacccctcgacgcgccccatcatctccggcatgttcaccgactacacgcccaatgcggaccgcgtggaggatcactgcaacggccttgttctactctggggtggcgtagctaaccccaccacccgacaatgggcgcctttccctgagcccccacctccatgcaccgagattaagggcgtctgccagcttagtaactatctcatgtatgaccctaccatatcatcgcactacgaaattttccaaatcccacgtgcgcttgatagatatcacgacgagcttgatcctatggatgacacctcgcaatggccaccgtcaccaagcgtgttgaatgtgttttcgtcaaggaccggagaatgggaaaagagatcgtacgtacgggagggtgaggctgccggtacagttgccgacatggcattgtcttttccatacgatcatttcaatggagtctattggcagggagcactttatgtacattgtgaagcagattttgtcatgaggtaagtggctatccactcttagcattataattgctttctttctccatttaaagattgcttggtgatctgatggtgtccacaacgtcgctttttacttttgcagaatatccttatctgacaagacatatcaggtcattatgctgcctataactacggaagtatctgaatataaatcgcattttttcgggagatcgaagaatggggtgcactatgcattaatggatagggaccaacgactacgaatttggtttctcaacgagtcatgtggtcagaaaatgtgggaattgaagcatgacaagaacattagctttctactgaaaaggcatgacaaatatggacaaaatgatggaccctggacactgcactattttgactattgtgaaaattatgaccagaatgacattgatgcccattatgaaggttacataaatgaagattataacgaagagtacatcgccgcccaagattgcaagcattttgaagctgcctcctatgaagatcgtaatggaaatagcatcagaaacgtgatagtaccaataaataaatttgagtgggactctgacaatgatagcattcttgacattgaaaatatgaatgacgaacatcgcgatacatttttttcaatccttggatttcatccctacaaagaggttatatttctgaaccgacaaatggagagaggattggcttatcatttcaatagctcaaagattcaatacttgggaaaaacgttcccagaatgttatcattcggaagttcatgagatgtatgcgtcttttgtgtacactccctgctggataggggagctttctgaaagcacataatttatgatatcatcttacagctctccaaagaaccgaataaattgatgttacagctaggatgcatatcctcttcttctgttacaacaaagagacactgttacagcagtgtcttgactcaactgcagtagcttgctgtggttcactgtacaaacaataaccttgcgtgtacggtaggttagacagggtactatatcacattttactatagaagccgatcctggaggcgcacgacaatgtttgtttggatttaataggtgcaaggtaacgcatgcataggaacgataataattggttactcatgtactcccttcgtttctaaatatttgataccgttgactttttagcacatgtttgaccgttcgctttattaaaaaacttttgtgaaatatgtaaaattatatgtatacatataagtatatatttaataatgaatcaaattataggaaaagaattaataataataacttaaaatttttaaataagacgaacggtcaaacgtatttaaaaaaatcaacagcgtcaaatatttagaaacggagggagtatatattactagatgaatacccgtcacgttgctgcggaaaattaagttgcataatatgtacgaataagatgcaatttgaataacaaaactaaaacaatttattacaattttaagtcaaaaaataattgagattgcgtgtttttaagagagaagaaagaagagacaatttggaccatagatctatcatccaaaggctagaaataattgaggtgatgtggcttaataagagaagagagaaataacattaactacgtttagtggggatgaactatataagtatataggatgtacgaataagatgcaatttgaataacaaaactaaaacaatttaatacaattttaagtctaaaaataattgagattgcatgtttttaagagagaagaaagaggagacaatttggaccacagatctatcatccaaaggctagaaataattgaggtgatgtgacttaataagagaagagagaaatatataacattaactatatttagtggggatgaactatataagtatataggagcttgaaatcacataagtgaaaaatgaatatcaaaagaaccgatttcttccataaatagaaacaatacatttttaaatctacaatataatattacagttacaatataaatagaagctgttatatcatccgaccacaaaagaagaaacaaatatagcttgttcagtcatacaaagaagaaataaatgtatccgcattaatccttgtagcttgtcagcagcatcacatggatcaaggtatcttctcctcaacaaaatgtaggaaaaaaattagtgatatcatttagggttgaacaatcgagtatatgaaataacaaatagtaggacacaccagaattcaaactggctaaatgttgggcaaacaatttctttctgcacagtgtataaatatccaaagtttagtagctgcctagctggttatatgaaatatgtgaaataagctactgaacagtaaagacagattttcctctcccctaattgtcatttcatataatgcactataaaaaataaaacaaaaaaaaaacaaatgacgatgtagtgagtatagttattagaaccggaccggaccggcagtccgacggtgtcatggttatggataccacatacctaatagtagttgattaagctcgatagggcctaccatataccgtgtcttatatggaatcatatctcgtgtatagaaggggttccggataagtaatgataagtagagttctatgtcatggcggcctcccggctcacgcactcactttgacttccattctatgccccgacgccgacgcctgcggccacggcatcgtcttcttcgtcgccagccagtacatcggcctcttcaacgacatcagcaacggcgacgccacgaaccacctcgtcggcgttgagctcgacattgactagaacaacaagttccgcgacatcgatggcaaccatgtcggcgtcgacatcaccagcgccggctactacgacgatagcggcaactccggcgaccatggcttccataacctgacactggcgagccacggcaaggctatgcaagtatgggtcgattacaacggcacggccaagcagatcactgtcgccatggctcccctcaagatggccaagccttccatgccatattgccattgctatcttctacctacgacctctcccgggagggagaaacgggacatgccgtcgatacggcgtcgtcatcctcgatggctcgatctccccttcctctgccgcctctcccggaccgcctcgacggcagccatcggtgacgccaccgccgccgcatcggccctcggccctcggcacattgctgttcatgatgtagtgggagagtgttggtatttcttaacgacattactataaataaaattcccagcaagggtgcaaaaatactcctgatatattatggttacagagttcatccacaagcgcacggatatatcattgagcatttcacccgagagtattccaagggtatcgtatttatttaatcccgtgagaagatcatagtagagagaaccggactaataatttatatgttacttgtaataatcatagtctaagcagggattaagataaatcaaagggtagagtgacacacaagcagggagcttctcattctcatactaaaatatctaagctaagtggaaagaaaatagaaagagaatctattcctatatttctagtatacataatatatatatatatatatatatatatatatatatatatatatatatatatatatatatatatatatatatatatatatatatatatattatagttatctgattaactagctaataccctctatgcgatgccctctggtacttcgagaagccacccctaactgccgagttccttacaacaggccgtcatgaccatacaaccgaggctaaatacggaggagtaccttactcaggaaattcacttaggactatatacacgcgtggaggaatacccatactgagctgtcaccatcagcggcacacctctcatccgcagcatataaccccaaataacaatatcccgtaatctagacaccacgcctaaactaccagatactactctaatgtcattgtcatgacatatagtaattgcataagcaaacattatacccataccaatgcatctaccagataagctagcagtatgatcaatataacatgaacataatgtaaagttggcattcatatactcgaaaagtatttcaatatcataaatgtataaagaagagtattctaataaaagtacaaagcttacaaaagaggaaaggagagctactagagccatacccgaactcttccgaatgtttccggactccgatttctactatattcctactccactagcttaagaacactaaactaaacttgagagaatataagagagctttgcttgaggtgtgtgttgaaatggagagagtgaggggtttatgtagcctcctagtgacggttggaatggtcggaaataccctccaaccgtcattgggagctaatccacatcgtccagccgcaaccctgcatccaacagcgctag

SEQ ID NO: 67801 - DNA, 5909 bp, Oryza sativa
ccgaaccatgggttgggccatcccgacccatcttcggctgacggcctcttggacttctcttctccgcagacttgtgaattttggctcaattggtcgtgtcatttctgagttcttggcccattcatacataagtctaattctcgacatcgtccgattgatttatcgtctggtttgatatatgtcgattctcctccactttatggttattctctgcaaaaggttagtaaacctaatactagtataatattattattctaacataaatatgtattgcaagcataactagctctcctctattttggtaatattgacggtcgaaactgatcgctaacgaccgtcaacagggagaatgcgcacgggcgggcgacgccagcgctggcgttagcgtggggccgtgacgcgatcccgtgcccgccgtccgctgccgtcgacccgctccccgcccgacggagctctgcctccagtacctcaccatggacatctcgccgccgccttgctcccctgcgcccgcgtcgtctccgccgccaccgccgccacgttgccgaccgccggaccttctctcccacctcgcaccgtcggtctcctccccacccgtcggccggcggcgccgacctgcctagagccccagagagaagagtgagagagagaaagagaagggagagaagaggggaaagaaagagaggctaactggacaggctgacatgtgggggcccacgtcggtcccacactgactcagcagacacgaaagataaaaccgggatcaaaaccaccgagggatctattgtgaccggttttatatagttaagggaccctgtatatctggttttgtagttcgaggatgttttgtatcccgatgacaagttgagggaccttcggtgtactttttcctttcgtggactgccgccatgggcttggcagtgtctgtttgtgcaacactttatggaactgcctattcatttgtccggtgatttctaacaaaaaaaaatcatctagattttttctaccgttcgatttacatccaacggactaaaaaaaataacaaatacatatttacttacgatatttttatcaaaattacagtgcacttacatgtcatatcaattgaatttacaaatgtaattttagttatatatggctgtaattttatattttttaaaaaataacaaatacatatttacttacaaaatatttttactaaaattacagtgcacttatatgtcatatcaactgaatttaataatgtaattttagttatatagaactataatttcctgcactaatcttggtgcatgcctctacggccaaaaaaacatcaaatatcagagaaaaaaaatcacgtttagcaaaatcgacaccttacacctaaccaaaccgagctgcacaacatgggaaccagatcctctaacgtagcgctggctacgtcagagggacgtccaacggctctcgtccgttcattcggcatcggacggagtcgagcgagcatagcgattagactcagcccatatgttgcagaaaaatcggcccacgcgacctacagccaatcagccatcgacgccgcctccgagccacaaccgccggcgccgctaggaagcaagtcgtcgccgtcggcgtcaccgccgcagcctgcgcctcccagcgaggtcccttcattgccaccctcctcttccccatccccgtcccccacccgcctccgtgtcctccctcgagcggaagcctccgctgcgtccggcgtcccgtcgtggaggtcgcggaccgtgcgcgtcgacgaaaccatgactcctggttggaggtcaacatgtcatggaagatacagcaggaaagaagcaacttgtccaaagcaacaatgcattgttgtgagatttattgttaagagcatcttgagtgctgcaatttctgttggagttaatttatttctagaacataccagcctactctctaactctctctactactccctccgtcccaagaaaagacaaacactgatttccgtgccaaacgtttgaccgtccgtcttatttgaaaaaaatatgaaaaaaattaaaaagacaagtcacgtataaaatataaataatgttttatcatctaacaacaattaaaatacgaattataaaaaaaattcatataagacggacagttaaaattagacacgaaaacccaagatttattattatttttttttacggagggagtactcatgaaacacaaaagtcaagcagcaagtcgtgtagacacataagactcgccacgtgcaccgacctgtctgcatttccgctcacccgcgtcgtctcactcgacagcgacttctgtatcagtgtcactggtccgctgcatagggtggcgctgttgttccacagcgccatgcccccggcccccgctgccttgccaaattctgactgccacgcgccctcgctgcaacggggtggcggacgcagtttaaaatatataggtgagatgaagaacgaagatattcgctcaactagagcaatcaaaatataacctactttgtatttatagtttaatcgtataactaccatacctcgatcatagtttgtgttatgcgtgcgttttgcagagacgtattaatctgttggtcattctcacaccttaatttatctaattttgttgacccatgactactataatgggtaagagatcttaaggggtgggacggcacgggtcgtaacggagtcggtcgacccaccctgcccccggtaccgtaaatcaatattgtatataaatatgctttacgtcgtaaatatagtaaactattgattcgaaaaatacaataagcatatataaaatactacatacccgccgaatatgtgtacgaaattatagtagattaattcaaataaactaatatactaactatcttaatcagctgtgctagcaggctcggattgtgctccagatatatctgaggaaaaagtacaccgaaggtccctcaacttgtcatcgagttacaaaatcgtccctaaactacaaaaccagatatctggcgtcccttaactaatcaaaaccagtcacagcaggtccttcggtggttttggccccgattttgtcctacgtggcagctgagtcagcgtgggacccacatggacccatgtcccggtgtccacgtcaccaccctctctcttaatctctttcccctcttctgcccaggaccgccgcgcctccctcccggtgctcggcgctcctcctcaacttccgcgtcctcgccgccgtcgcagggtcccacttctcccccgcggtctcccgcctcgcggcccgcctccgcctctccccgtccatggccgccgtcacgctcctcgcgctcggcaacgacgcgcccgacgtcgcgggcgaacgacgacgcgggagggacggcgaacggcacggcgatgagcgcgacggccccgacgacgaacgcggagatgaacgggcgtcggcggccagcgacgggcgatgcggcggcggagacggcggcgaccagcgggtcgggaggaggtcggcgtggcgaggagggagaggagaaggtccggcggctactcgccccgccgccgctccgctccactccgcctgccgccgcgcgctcgcgggcctgctccggccgttcgcttgccgccgctccgctccgctggcagcgcgctcgtctgccgccgccggtgctccgctccgccggccgcgcgctctctgcacgctcgtcgctgccaatactggctcagcatcgtccacaaccacaagaacaggctcttctacctgctacgctgttagcacacaagaaaacactcttagaccgagacgtactcacacctggtgaatacacatgcaggagagtaggcaaagaacacaaggtatttgtgctgcacaaccgcaaccttttctggcactgcacaccgcagtgttttttttcaatgcacataatcaacctcaaagtacatgcttaaatagaccagctagcagcccaagttatgcatacataagaaaacatgcaaaagcaaaatactaagtctagattatttctaacatacgctattgcggctccatcttctcacctcaccgccgatggcggcggcggcgtcgtcgtcgtcgtcgtctccgtctccggtagcgcgaaccatcttgcgctcgccgccgcatgcagccgcagccgcatcactcctctcctctgatcccaaacccacacagtacctcgccgtcacgccgcgcagcgagctcctgcgtgtgacacggcggtggcacgagacgacgatcatcactccagcggacgcatccaacaacagggcgcacctgaagcacgtcgtcttcacgacgagcgttaaggtcgaggaggcttcttcgccttcgcgaggcccgagagcaaaaccaggtcgagtgttgctatcgcgtcctcctctgccaccaacgccgccgcggcttacacgtcttcttcgccgccgccgccgccgaccgccgtcgtggcgccgccctcctctcccgcctcgcctcgccccgccccgccgacaggtctacaggcagagagagagagagacgaggaatcgaggaagagaaggggagagatactcagcctaacatgtggggcccacgtgggtcccacgctgacttagccgccacgtaggataaaaccggggtcaaaaccaccgaaggacctattgtgaccggttttgattagttaaaggacgccggatatctgttttgcggtttggggatgattttgtaactcaatgacaaatcgagggaccttcgatgtactttttcctatatctgatcagcgtgcatatatagcccatagatatgtgtgtgcatatgtacttatagataacttaactatgtgtacgtgtactatcgtgtataggtttcggtgcataccgatgcatatgatgtacgcttagatacaatagattaattttaaaaaaattaatccattagctacataactaattaaaaggctctcatgcgaagattgtggttgggccgacaacatacgaaaatggtgatctttaaataccttttcgtacaggcgggtgacataatcgcatacgaatatcggttttaagcttttggcaacctgcaaaaaccatttattagtagtatacattagctcataggtttgatgaagagttcttttttttaaaaaaagaaatagagggcaaaagttttgtgtagtatgtattgatatagtagggggtttgatgaagaacttttaccaccgataattataacaatatgttaccaactaattaccaaaatcctctatattcatatgtttcttacattcaacctactcattaccaactaattaccaaaatcctctatattaatttgtttttttacattcaaactactcaataccaactaattattcaaactactcactaccaactaattaacaatatctaattattaccaactaattagctaaatcaccaggtaaagactatataagatgagctagttattagtgttaattgcacaaaccatgtctacctctactgtcattacagcggtgtttctgttataccttgttttccccgtgcaatcagtagagttcttcaagaggtacgtcggaatgtataagaattatgttgtttgcattctactccctccatccataaaagttacacctattttacatttaagattttctaaataagttgtttctatttatagtctttatgcattcaaaacttaaatgaggagataaattaaatgtttaattagaacccagggagtcatctaaatactcattggttacatccttgcattcacttcttgattttgtaacatccaagatagtttaatttctccttatcttggtggcaaaagtaataggtgtaacttttgtggatgaagggagtaatataattcttatgtcttagctccatttgtttttttttctgatttcttttctccttttcagtgttgggtgg

SEQ ID NO: 67802 - DNA, 4934 bp, Oryza sativa
  unsure (1)..(4934): unsure at all n locations
ttttttaaacatataccgccttcatatattgtatactgaagtgattatatacaattaattctggtcaagatttattgtgccaaaacaatatcatattactgtactttgtgtgtattttatatgaaatatatttgatatacaatatgaattgaattagagctcaattgtagatataatagaaaaatattatttttgctaacattaaattttaaaagttattaaaaataaatagaatagcaccatagtgtttagcagcatatttctagtttttatggttgttttgatatggtcttggcaattgttttgtagcggtgattggtgatgaaaataagaatgaggggtactgttttagatgtcttttaatcattggatttgtccctgtagaggttgtcgttctgaatcaacatatggatagaagatttgcttatcattttaatagctcaaatgttcaaatacttgggcaatacgttcctaaaattttatagtggattgcatgttcaaggcaagtatgcatctattaagaaaagttggtgagatttagcaagttgtttataattggttgagaaaagatgatagataaggaattactatggtgtgtttgattggatgaaaatagaatattggtagaaaagttattgtatttttggattaatttaaaaggttaaaggttgtcatattttagaacagatagagtatttaaaattaagtttgaaatatgtataacagtgtgacatgtaggaccgtgcatgcctcgacctgatggatctgtacgcacgtagaagtcatggcacttgcgccatgctgctttgcctgcttgctgtcgagtctcgcacgaaatcgctaaaaacagtctcgcagccctccgcgacgccgcgcccacgccaggtctcggtttgtcgaagaggtcaggtccccggaaaactagcgcgcgggttggcggcgagcgttttcagatagtttagcctaactaagtgaagttattagtagataataatggtaattaagatatgattatttttcgaaagatttttttttgtaccttaaccgattgaaaactttcaagtttgatttgaaaatctttgaagtcaaattttaaaaaatttcaaaactcaatttgaaaattttcagctcaaaatttaaatgtgtaagacaaatttagaaaactttcaactcagatttaaaaacttttatctcgagatttaaaaactttaaagtacagatttaaaatttttaagttaagatttgacaaaatatgaaaactttcgactcagatttaaaaactttcaactcaagatttgaaaacattcgactccgattcgaaaacttttgactcaagattcgaaaaatttcaactcgatatttgaatactttcaaatcagattaaaaaaatttcaagttaagatttaaaaactttgaaaaaaatattttgaaaaatataagtgtgctaaagactaaaaaaaagtaataaaaaaactaaaaaaaagaaaaaaatcgcaaaagaaaccacgaaaaaacaaatcgcgaaaaaaaaaagagcttatgggcttttctgagccagaagcagctggcgcgcggcaactagtaacgccctcgagtctcggcggcatgggcatggcacgcccatcacttattcgcagcgaccattcgctactgatcgccgcgcacgcaccgcgcgagcggacggacgacaggtcgaggctataatggatcggaatatgggaggctctggcatggagcccaacgaaaaagaaagcaaggcccatagcaccgcaccgtaaacttgaccgagagaacctggacgaaacccaaaggaaacccaaatcccggtaaactgatttgagctttctggatgaaataagttcatctgaggtcttttaacttgtcaacgaatccgatttttatccttcaaccaaaaaaatcagatacaacgtatccctcaactgtcaaaaccagtgcaatataggtcccatgacggtttggacggcggttttcgctgacgtgacgcccacgtgactattttgactcggtcttcacatgacgtggcaatgacatggcgcttacgtgacaatttgatttggaaaatattaaaaattgcagatccacatgttagtttacacaaaaaaaatagattaaaaatggtgggttctcaccctcctcttcttcctcctctctacccaactcccctgtattcactctctctcccctctcctctgtcctctccgacggccgaagagagatgcggcgcgcggcagccgggcgaggaggggcggggccattctgctgggcatcgtgggcggagcggcgggcggctgaacaacccctaccaggacctcaatatcccctacaagcagctctatgacctccccacctccctggagttcctcttccaggagtcgctcgcccagcgctgctcatggggtgagaacctcacctactacaccagcataggctaactctcgggcgccgccgtcgacctccgcgacgccgcccgcaacgccgagcccgggacaccgctaagatccgggtgaaccgcatcctcaactcatgcggcagggccactgcatggggaacacgctcagggtcatcggcctgctctatgccgggagcccgggatcgagagtggcatggtcaccgtgcgcgaccgtgacgactggatcaacagcgtcaccgtggggctcagcactggcgcgctcttccgcgccgccgacgggtcacgctccgccgccatcactagtgccatcggtggggtcctcaccggtgccgccatgtcaggcaagcaggcggcgaagagatatgtgcccgccctctgattcgtctgcacagtattctctctgcccctcctcgcccggccgccgcccctcctcacccggcggagaggacagaggaaaggggagagagagagagtgaatacatgggagatgggtagataggaggaacaagaagagggtgagaatgacatgtgggacccatgtgggtcccatcatttttatcttttttttttgtaaactgacatgtgggtccacaatttttagtattttctaaataaaattgccacgtaagcgccacatcatttccacgtcatgtgaagaccgagtcaacatagccacatgggcgccacgttagcgaaaaccgccgtccaaacagccatggaacctatatttagacagttgagggaccggttgtatctggttttttggttgaaggacgaaaatcggattcgttcacaagttaagggacctcagatgaacttattactttctagattgggcgaggatcccatgtgaattgggccttcggggattgagcgaggatggagaaagtctattttgctccgttaactatgacgcagtaaaatcagatatgtagtcccctcaactattaaaccggatcaatttgtctatcggacggtttttattgtggttttgccgatgggtcccacctaccattaagtgttccattatctttatctttatctttgcatgtagcctagtagttgcaatgacctgagtagcaccctaagctcctgagttcatatctctatagcagcgaatttcagatttggttgtttgaggggctaagttccaaaattaagaaggttgcatacattcggttggatgtagatgttgggtaaaaaaaatccttctctaaaaaatatctttgttctctctccctcggctggacacaatcacgcaaagatgggtggcatcggagcctcgttccgaggctagtggctaacgaagaccatcggagccgagcagtgagggcatcatcaaaggggataagaacatcacgaagtagcccccaactccaaacctacggctggtgttgctttttttttcatctggcaacggctgtactttcctcttctcatcatggcggccatggacattgtacctgtggacggccccaaggtggtgcagattttgagcggcgtggtgtcgagtgtgttgtgcaccaactagaggagtggcgatggtggtgagggtaggcgcggtgtgcaacgacgagatcaggggcaggtgcgtcgcgccaacaggaggagtggcggtagggtcggtgcaggcgtcggtgctgtcgtggtcattggacggggagaggtcaaggttggagctacgatcaggtgatggttgggccgaggtagaggcagagccagtctccgaccccatcactccttccctttcctccactcttccgcaggaggggaatgacctctgctgctcttgccaatgacgaggaaccaaggaggaggatggaggggacgtcggccggcgcacatccaccactacctaggcatcttctctgttggcggcaacctctcctcaatgttgtcgttgcttgtagtaccaccgccctgcacagtgctatcgtccgtgcaatttgggagagtggaagaaggggatggctttcactgacttgtggtcctagtcaaggctatgtggcgccacgtcaaaggaaaccagtgtcaaaatcactcgggaggtagattgactggttttttttttttttgaggggcacgaatcaaactcaacctatagttgatggtggtaaattggacttaatccaaagagatcgatcccatacgaattgggcctttggaattgccacttgagctttcactgcggtatgtgggcccactgacaacaacgttgcttaaggccgttgataactttacaagaatacatcgaaggagagtggagaggaaaacaacgagctcatcagtgaccagagagcagaggtccagagcagaagataaagcgcacagctgacaacacacagatgccaaatccggcagcacgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 67803 - DNA, 5811 bp, Oryza sativa
caagctatatgcgcggaaagcaaatcaaatgatacatgcttttaaccattttgccatgaagtacgccaagctcactttttttttctttgttgttgtttcttggaatacctctgtaatagtctctaactgggcattaggcgttcttcactagaggagttagcaactggttagtagctactgggactgaaaatcagtccttcgagctgtatatagaaggagatagattcatacagttaacagtataatgcaggatgtaaaagggataagggacatttctttctttcttttattttcattaaaattggtttagttacgttgggaataaagaaacaatgtgtatcctgcttggttgaaataaaatgtgatatgacgggggctatccagctatgttgttcgttcttttgtttcggtattttaattatattttatttgcacaaatgttgtagccttgttttgtgagatcaattgacttatagagcgatatcttgaggttaaaattaacacttgcaagacgattttgagacctaggaaacaatggaagataatttagggacttgtttatccctgttttgctaatatgtatgagtagaaacgagtcaacacacaagactactgaatcaaacgggaaaaaacaataaatgcaacaggggatgattgcacagcaaaatttgaaatcaatttattgccgtcaccacatgctgtttgcatttgcagcgaaatatgctgaaaaacaagatcatccccatggttatgtgatcgcgagttcaagttcagaacccaagcatggaatggaaaagtggccatcaagaattataatagaacgagcatgcaaagcaacagtcagaagaccattccaagtacaatcgacaaaaccaatgttgcgctgtcaatcctataagaacatcaagagcgatagcaataaacgtgcaaaatatgatgatcgaaccaaccatcattatcgcaaaattatccaaaacaggcacgaaaacttcatcaccatgatggtttatgcaacgccttgatacagatcaaagtcatggagtgagaggggaaaagagtttgtgtagtccaacatgaaggtggggaattattgccttgctcttagcatcacagtagaacaaagttttgacagcaaacaaaaagcacacatgaattttatcggagtggctaatgctgagctgaaacagcaggagctccctcagccttctcctttgccgcctcctccctacgacgaatagcagctcttaacttacgttgctcctccttgtagattctgttcctgcgctggaactgcattggagagaatcatacatttccgcatcaggtcatcttggttgttagaatcgctaatagaatgaaatggaaatctagaacaatataattcagagtactgttgcatcctgattcatttctcccactgactggaagctatgcactagcatgaatccataaattttattttgctgtaaggaatcagggcaagcatatatccctttaaaacacaagaaacaattcagaatatgatgatatcatgcatgccaagaagtaataagaacttgttaaatagtattacgacttgtgtgcctttatgctaatgaataattctattctagtcacattctggaaccaaccagggattttctgaactagttatccaagcaacaacagacactccgaaatattcagagatcacttggaaatgggaaattgggctatcctaagagacaaggagagaccaataatactattaacaaccttgtctactccctccggttctatattaattgacgttttgaacaagattgatgtcaaacttttataactttgaccatcaataactttaaaaatatttagtttaaaggaactagaacaacatatatagatttgtcttttaaagcactataataaaagtaaacatgcatttatttattatatatattataatagaaaaataagatcaaagatatatcttgtagaccgtgtcattgtccaaaacgtcaattaaaatgaaaccagagggagtacaacagaatggaaatgaaagcatatggaatcccaacctccaacaatcatatcatactagaatggattcgaaatacgattactactccaatcaaatgcagtgcccccaattagcgggtgatgttaatcccaagaacaatccatatccaccccttcaagaaaactgtaaatggtagatctaggtggttggcgaggcgggcatatccatcaaaaataaaccgagaagggcgggtgggagatggattgaggagtgaggagagaggagagaggaggattacctccttggagtggtggaggcactcgaggtagtcctcccggaggaggccgcagtcggtgggctggcggcagcggctcatacactcgctgaagtccagccagaagtcgtagcaccgccccttgttcccgttgatgccccacccggacgccatcgcaacctaccttctcctcccctctcgccgctcgccgccgatctcctccctcctcgctgcccgcctcttcttcctcctctcgtctccctactctcttcctcccgatcccccaactccctaaccctatacccgtccgtttcactgacgatgtggccccaccccacctctgagtgcttgtgggatttcgataatatgaggtaaatggaggggctgggtggaaatgtacccgttaaaccgtacttagcctcgatctcaaccgcacgtgctagatcgggcggtcagaacagacgggaattctgatcgctgccattggtagcgctatcctggttttttggtgggggaaaagaaaagggcaatgtatgtccctctcgattcaaattcagattacaaattgtgtaagaaatttgcgtttaagcatgtactatattattgattcttggcacaataaacacattgcaatgtcaggcacaaggttgatcatatcaagaccagatctttgcataaaaaaacataaagatttactccttccattttatcttataagacgtttttgtttctctgtccctcgtcaagattcattaacatttatatgaattttatcttataagacgtttttgtttctctgtccctcgtcaagatttattaacatttatatgaatttcaacatatatatgaagcacatatatggattcatgcatgaatctattcaaaaccaaaaccttcttataatgtgaaacagataaagtatatcgacacaattagcattagatacgtcagtacgttcccccaatgttcattcaaacgctacacgcgttctgtcagcatttctatttcgtactgcacaagaagaagccattcgtatcaaaatttggcacaatgctatacatcatcacagcccctcgctgcctgcactacaatctacaaaatgagtttctttccctttctcaaagaagaggggtggagttggtaagtcaaaactgagatttgccgagcagaaaaaaggcgctcgccattcttgttctgcgccaatgaacataacgtaattgtacctggattcaaagagggggaaacatcaaggttcattgaaatgctcaacaaattcatatctcatggattcttaagaaccatgaagacaacagatcgaagaggtggccttacttgtccaatgcagagagactcaagccagcgtgaccttttttcctttagattcccttgcctgcaaagaaatatttcagtagctgtccaagaatcttattgcaagaaacatcaaacaccgacagaagggagcatcaataagatgcggtattggaattttcagttgaaaaacgcattgtttatatgccaaaaaatggagcatgaaccgcaccttcgttgaaacagacttcctagacgatacaaattgaccgaagtccatgtcatactgcattttttgttctgctgatgtcgaaggtctagcctccctagcagtagatattaggagttctttgctgatacatggctgtgtgtctgagataccattatttctgtcctccagaactttatgcactgctgccagcttagcatctcttagaatagctgcaagatctgcacctgtaaatccttcagtcaaagaagcaacctcttccagactggcatcacttgccagtgaaacctgtgaccaacagaagatattaaaaatgaaaatgcatcatcaataacaatgagaatgttaagatatcaataatttaaggagttcacagatggcaaaacccgtgattaaaaatatcaacaaaagacaaaatggcaaatgagaactcacctctctagagtgaactttcagaatttccaaacgctcatgccatccaggaaaatcacataagatcaaacggtcaaatcttccgggccgcaagagtgcagcatcaattgattgtggcttactgcacataaggaaaaagatgaaaccattaaaaattaaaggaaaacaatcaagctattttagttccaatcttattctcatcagtaaaatttcagtcttcatagcatttcattccatgctgactaattcttgatgttttgcgactggtcattgcagtccatttaaaattgattggcatgctgcaccaactacatcttcttatgctttgagagctaaccttgttgcagcaaatacaaatactccagtcaagctttctacaccatctagttctgtcaagaactgcagacaaaccatatataaatatgatcttgattataacaagaaaaaataatgctcttttggaactatagaccgatccaaaacttatattcagtaatggtaaaggcaacttacttgattaacaacacgatcagaaactcctgcactctgtgttcctcgctggggtgcaatggattcaaactcatcaaagaacagtaggcaaggtgctgcagcagctgcctttgcaaagaagtcacgaacctggaatcagattattaaaatcagaaccatgaccatgtaaaagaagaatatcagaaccatattaatctcaatggtcttctatgtcctctataactacagctacacagataagataagatattaagacaggtctgagtaatacaaggtgcaggaaatgtcacagttactagcccttcaaatgtctctgaaactagaaaaaggcataagacaaagaatggtacatcacagcgataaaaaataaaagagtccttacagattgctcagaagaaccgatgtacttattcaatagctctggacctttgactgatatgaatcgcagagaacaagcggcagctgcagctcccacaatatgtgtttttccacatccagatggtccatagaggagaatgtttgatcgcaaccttacaggtgccttggtaaagatattcgggtattttgatggcaattcaagagtctataacaagaaaaacaaatgtgagtaggaaagtaagaatatatattacacaggtaatgaaatgaaggtttgtagacaatagttagttgtccatgagtatatcaatgaggaagcaagctccttgttcgtcaaaccttaaaatatttaacttgaaaccatatcacagtatccctctcaataaattgcaatagccaatagtcacttctattctcattcccgtaagcataggtaaataccccttcctaattcccatgtggaggcaatatggatggaaacatgtatatttctagaaaatatattttccacatggaggcaatattcatatctgttattatgtaccctcagttacatacattcagtccttctagaggctgttaaccactcccaacagatcttaaaacttggattagaaacaggacaaacatgttttgtcgctagctaatgaaatttctaagatagataaatttagtgct

SEQ ID NO: 67804 - DNA, 3732 bp, Oryza sativa
  unsure (1)..(3732): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnntggttatattcagtaaagcctctgcagcgaactatgtgaaggacctcgaccaccttctcttcccatgtcagcttccactcctgtttcttcttatcaaccgtatccctcatctcgcacttgtcctccccattcttgtcactttctgccatagcttgcttgtgttgtgtgctctccgacctggcagccagcaacttgtaaaaaaaaaacatggaaggtttggggttctcatgtgtccaatccaacaaacaaaacaaaaaaaaacatggaaaatttgtgattcttatgtgcccaatccaacaaacaaaacaaagatatgatggattgatcaattgcgaagtatgtgttgttttaacttttacatgaatgaatgatagattgtttaactgcggagtgtgggttggcactcccaatctcagtaatctttctctcaagtctatgacttcatctatgaggcggcgacaatagggcttgttgttgtacatcggccatgatttaattttggattatcgtaatggccggccggtgatcgggcacatgtacaggcgccgtgatgaggccggtgagattaagggttggtttgtatacatggatgggccataaacaacgatatcggagtgtaccgtagatgtggtcgccgtgccctaaatcctaatcgccgccgcggaaagaggaatcgccccaacttaattagctggtggtatacatatttaacgacagtttctacagaaaaaaaaaatatactccattaatcttaataaataaaaaagcacttacagtgttgatatgtccggggcagccggcggtcgatccccttgcgcggctcttcttctccgtcgccggctcaatacgagagctctcacggccagcttgcgactgcccctcgagagtgagagtgaggtcgccgtgaggtgacgattgcaggtcgtcgccggcgaccagatcgccgccgggcgccggttaattcgtcggaatgccgccgcttccgacgacgtcgtctgtacgatagggacgagaacgtagaggactgatttacaaaatactcaatcagcccgaaaataagttgggagcttgttctgccaaattttctaaatttaccgtgggctgttcaagttgatgtcatttctaaccataccattatttagcaaagttgttaaagatgtgactatattttttttcaaactttgataaacacgtaacaaatcttgccaaaatgttagtaatattgtcaacttaccaaaattttgacaataccaaatttagtaaggtttattttgaacacaatctgaatagcctcctaaaattttacacagtaatatttatcgggtcctaatcgagaatccattccgctgcgacaggtgcaaggtgttagggttagtgtttggtgacggatgataggaggggaggggcctcacccatagtgaaagaagaagaaaaagggatgtcatgtgctccgaatacaccctaaatgaggaaggcaccaacctatgaagactgagaagtcattctatgaactgtgaagggccaaagggcagggtgtggctaggacttctttcctctccaatctcttctcccatgcatttctttgattgatggtgaatcaaccttaccggtgattaggaatataacattttaatatcagaggctttgttcgatctgtgtgatgtgttgatcgcattctcatcaccttgattggtaaaactcctatagttgagttagtgattctctcaatttcgtgctcgatcggtttatactagacaccatggctccaacaaaggagggcatacaagttcgagaagtgctagctatgataaatttcatggaggagcgactaatggcggtgatggaacagttagacacgaaggttaatgagatggaaataattggcaaacaagtgtatatgattgcatcaaagcttgaacaacaagggagcggttggacaagttgcataccaaggtggatctatcgatgacatccctatgacaggtgtagcaaaagcatacgcaaataacgccttaaggtgcttaaggcagcaatcactccactatcaacaccacaagtattatagtgtgctctaagttattcgtatgtagatagaatgatatagatagttatgcaaatatcaatgttttgtttttgaaaaaaaaatgaaggttgatatttgttatcaatccaatggttataaaacattaatattattcaagtgactttcattgttcacatttcaatattttatttgctacatagtttaaaactcgataaggcaaattcacgtcaccttgggcactatctcagcgccaatgatgatggagttgagacactataggcttgtttggtatagctccaactcctaaatttagctcccgaagttaggtctggagtgcagttgtgcacaactctagtttattttatgatagagttccacccagctccactcccagttttggtggagctaaaactgtttggctgagctccagctccaggaggggtggagctggagctgtgccaaacagaccctatatcttagtgtcatcaggttagcgctgagatcatagtttatgttataaagagtaaatttcactttggtcaacctttatttaccaaattttcacattggactagagttagacttatattttcacttaacaccatatatagttaccatcatttgcactttggaccgggtttcacaaattacacatagtataatgattgtagatctgatttcatttattttttgtgttagaaaacttagaattcaacaatctgtactaacactacagttgggtatcgtaaaacatgtaatatcttttctagaaaaatagttcttaaactcaatatttctccaattttgtctctagtataagggttgtgaatgttcatatgtagtagtaatgaagtcccattaatctgataggatatcttataacatgttacaatcaatgttcttgcgctaagcatatttgcatggcaaaaaattccatatcattgtttcttgtaaaatgctaagcaccaagacaacaactcatgtgatggtaactataaccaggtccaaagtgcaaacaatggtaactatacatggtgttaagtgaaaacatgagcctagctcttgcccaatgtgaaattttggtcaataaagatggtccaaagtgaaatttactttttataaattagtttctgtgataggttattttttaaatgggtttttataaagagcgttgctctggtccagcagaaagtggcgcggggtactggtaccgtgaggtaccaaagcgaactccatcggtgggcagaatcggaagtggtgaaagttttgatgcgcgctggtggggccgtgggggtgaaaatgcggacttctcgccacagaaagcgcatcgctgtgccgcgagtgtcctcgccacaaagtcctctccttcgtggcgccgccggcgccttctccttcttcgctgcgtcgccggcgtcctctccttgttcgctctgccgtggctcgtctgccccttcggccttcgctgcgccacgccaccctagtgcgacctttctccgcggcactgttgtctccccctttgccgcgccaccgttgcctttccccatctccgcgcagagcgtccgtcgtctcccccttcggtgccccttcgctgcgccgccccac

SEQ ID NO: 67805 - DNA, 12265 bp, Oryza sativa
attgattacgatgcttttggtgatgttgttgtttttgatagcacatatagggtaaataaatacaatttacctttcataccgtttgtcggtgttaaccatcatgggtccaccatcatttttgcttgtgctattgttgcggatgagaagattgcaacatatgaatgggtacttaagcgctttttggattgcatgtgtcagaaacatcctaaagggttgattacagatagtgataattccatgagaagagcaattgcaactgtcatgcccaactcggaacataggttgtgcacttggcatattgaacaaaatatggcaaggcatctccgtccgaaaatgatttcagactttagagttctagttcatgcaacttattctgctgaggagtttgaggaaaaatgggtggagttcaagctgaaacgcaaagtggcagaagataaccaatggctcgggaggatgtacaacttaagaagaaatgggcggctgcatatactaaaggtatgtatttccttggtatgaaaagcaatcaacgtagtgaaagcctcaactctaaacttcatagacacttggatcgtaaaatgagcttagttcttttggttgagcactatgagcactgcttgtcgcgtatgagacatagggaggcagagcttgattcgaaagcttcacagtcagttccattcacagccaacgatgctagtctaattgaaaaggatgctgcccgtatattcacaccatcagtttttaagaagttgaaaatggatattattaaatcgaaagattgtgaggtgatagactgtatagatgaggaaaatattattaagtacatcatttgcatgaaaggaaaaattgacaagataacaatcttgacttgttcatatgttgaatcatcattgaagaatatgagctgtacatgcaagaaaatggagtgtgaaagccttccatgtcagcatatgttcacaattatggactatttgaaccttcaagccattccagatgtgtgtgtagtgcctaggtggacagttaaagccaaaattgcatttccttcagataggtatggtgaggtttatacctggtctgatcagatggaaagatatcgtagaatgcgtgcaattggatctgaggttttattgaagtgctcgatgtcagaggaatatactttgaaggtgatggagatgtttgaaaaactggacttagagacaaatgcaattgagggggatgaatttgatgtaacattgtgcggtcacgttgtagctcaaagtttacgctctgacattgctagtgtacagaaggttcatgatcctatggaggtagtacctaaaggtgcaccaactaaaaggttgagaggttttttggagaagggtaaccggcgttgtggttattgccgtgttcgtggacacacggttcgttcttgtgccatttacctaaggtaaggttctaatatattttgggtaatgcttttttttgtgttgtttttttgtaattggtgacaactgacaaggactagttttgttgttatttcagaaaagttgcagtagatgtatgaagtgcaaagtggaagcaatcaagctccatgtcttatccagtgggctattttgtgctatttgaattctgtaaatcatgagtcgtggcaggactcgtttgttgtgtttgaaaactgtattggagctgtgcttggtctattatgtttgctattttgtactcgtctgttgtgtctgaaaactgtactggagctgtacttgttttgttcaattattcatgactttggtttgctaatcgatcacgaactgtcctcctatctcactgtattggagctgctatagttaatccattattcaagtgtgctatacatgctcaatctgggaacgtgtgtgcttttcagtggtgaaaatcatatgtgcgggaggagatggcatatatacattttgagatatcatgatcgagtaccaaagtttaacaagggccaagggccaagagatagcatgcgaaatataatttcattcatagttgtggtccaaatacttcatttagcacaaaaggcaacttgcaacaagcagcactcatacatgcaattcacgaatagcacgtgtgctcacatatagcagacactacacaactgacggacagcagacatgctcacatatagcagacagtagactatagtaaggttgcagttgataatctccttcagagcaaatcaagacagtaactagaagggtcagtagacacttgtacgtcggacctgatatatgtcatagaccacacttgtgcatagcccagattaacccggcacggggtttgtcgtagagtgcacgtgtgctacgacacttgtacatcacacttgtgcacatgggtggacctaccatgattcccgggtatgtgcgaacggtgtgacatcgcgtgttgtgacatcgcgtgcaagtgttgtgacatcgcgtgcaacgtgttgtgacatcgcgtgaaacatttgcgtacaagtatgtgcgaacggtgcccttcgtcaggtccatcacagctcataagcagtgcagaaatgtgctttggaacttgttgtggtctgactcatgacaggcaatagtaatggggactttaaatttgttagacaacggtagtgcatgcagtcctgacttaattcctcgctacacttaccgatgagaactgtacagtcgcctattcaaaagcatgtagttatcgaacagacaagtcattaaattaatcaagttagccataatacaactgctaatacatgcttactaaaaatacagactgagatagagtcagataattttgtttcgtgctctagtatctccgtggcgccaaccatggcggatcaagacggcaacgcacgtgatgaaggcccacctcaggtgccacagcaagctcatgtgtcgtttgcccttaaggtatgtctaaaatcattcaaatcatgcttttgtcatatccattcaaatcgttttcctatccactgatttcatgctcctgtcctctaaatcttttacctggaaaataacagatgagctccatgactattgcttgttctattccaaaatttgtttcactcgttcaaaatttcgattcgtgtcaaaaagaagctattgaaagaatcggttttggtggtttattgcaaatgcctgatattacacttcaaaggataacgtgtgggcacatcgctgaccagttcgatgtaactacagaatgcgttgagattgaaggtatccagattccaataacaacatttgatgttcagtgcataatgggtttaccagctggagaattgttgattacccctaggccagtttccgatgatgaagactacaagtactactcggtgtacaaggacccaaaaaaaaagaatatcagtctagctatcttgcgggaagaactcttaaaagcaaaagtagccgacgaacatttcttgagaagatttgtcttgtttgaaataggatacattctatgtccgacaactaaaccatttgtcagctcaaattaccttgctttggtgaaggacatcaaccaaataaaacacatcaattgggctgctctcactagagattttctgatccgttctctcaaggagcttaagggcggaaggactaatctggaaggaaatctaccactcctacaggtaacgtaactactccatacttttagttcaacacagatcaatattattttttacagcttactagacacgtgttaacatttctgttcctactgctactactttccaattctggttatgggaacatgtgcaggtccaagattctaagtacaagatgacatatggtgataggacacctcctctcatgtcgtattggaatgagatgaaggtcaattcatggcttaagtacgacagcaaacatggcatatctggactagtaaggttcttatgtagtactaacacgaccagaacttctccttacatgttgttcaaatacaggttgtccaagagatcactcttcccttgcaaaaatgcgatccaatagttcaacatgacaatgaagagcatgccgaacaagcagcggacaataaagataacaacattccagttacagaccacggcccccacttgggaagacagaatcaatcaagaaattcacacactttccagatcagatacagaccatggccaaacatatgaatccccacaataccaaaattatgctacaagtcctgaaagcagccagcaacccaaggtattatttgtttcatttcaaacaaagtagcttgaaattgcagtttcttacttcgctctctacagaattcagccaatatggatattgtactgggccagctactgcaacttcaacaaagcatccagttccttgacaataaaatgacaaacaagttgatatcaattgaaggcatatgcaatcaaaatagaaaagatatccaggtaatacttttaagggtcacatctcacatttttgtgatagagcaatgcttatatctaacttataataggagattaaaaaaaggttgagatcagcattccatgtaacaagcgcaaagcacccaaaggtcgagatcatccatgagcagttcaacattacaaatcaagaggaagtaaggactgcacaagctgacgacacaaagaatacccaaacagagagcgtgaaaactacgcgaagtgacaaggtgaaacacacacaatctgacagcatgatggaatcaaaggtgaaaactgaagacatcaaagagacaagccaaactcctctagttatcctaagcgacgatgacaacagcaatggaaacacagaggtcctctaattcttgcacttacagtcatatttaataatctaatattgtattgtataattgttaatgttataccatccttgcaagctgaacccaaatacaaagatcctaatattttaggaaaaagggtcatcaaaccagcacacaaagcataagatgacttcgtgtactacaagaagaaattcacagttactgcatcgtccacaaaacaaccaaagatagacgatgttgatgccataacgattaattatatttccaattgcaaagacaacatattactttcagctatcaatggagtcaaactttattcccagtttcttagagcacttgttgtccctcaagaagcacctccaacatccaagtggttaaatggcagtgtaagcattcttcacaatactaccaatgtttttatttaaatttcaatcctgagtattattcatcttccatcatagatcatagacgcatacattgagctcatcaaagacgagcaagccgacacaccaagaggaaatgggatggcattactagaatctgaagcacattgccagcaatggaaatctgatggtgcaaaaaaaggaactttcagcaaaacataccgtcaaagaagagccacagttgcatccaaatacctcaaccatgatatggtataactaaatcctaatgtatccatccatactaccagtaaatcaaaacatttatttttcattcattccatgcagatcttcctaccgctaaatagaaataaggaccactggtatgttgttgtactcaatgctggaaaacaaaaaatacagatactagactcaatacgtatggataggaacacatatgaggctaacaaagacctcaacgatacggtatgttacattctaccgtatcatctgcgtgtttatacaatgcattcactttgtacattcatatatacaatcagcgattgtgttttgaaaacacagattaaaggtattgacaagttcatcgcatatgcaaccgaggacaaaagcattaccacaagatgaaaaaatacaaatgtgaccgattggcctttgtgcccaatgcaagttccacaacaaagggacggttggtcctgtggtttacatatgttgaggttcatagaacactggactggaaaagagctatcacctcaattccatggaatggtatgtttcctcaatcaaaacataaatatacaacctacttcattgctctaaatatttctaattcatctttcaggacacatgcactacatttagagcgaagctggcatccaccctaataaactctttcatgaatgaggtcatcaacatacaagaagacatcagacgcatacaaactgagcaaatgcaacaaaagaaggacgagtgactagactcttttgcaaatttcgttccatgcagttagaaaattgttttgtatctttctgaacttcttgtcgctcatacatttgttaccaaggcagtgggcaaaaaaaattcagaaaaattgcaatgtaatgtcacatttccacccaacatttctatctttctgaacttcatgtgcctcaaacatttcttcccaaagcagctagcacaacaatacatgcaattttatgccacaaaactatagttcccaacgcatttccacccaacgtaactgtagcgacgaacttaccgctgcggcgccgttgcagtctgttccgaccaccatatcgccccttgaccacgacggcaaacctctctcgtggctggcgacaacgagcggaccagggctgtaccgacgagaagcgaaccggcgtcaatcagccctggacttcacagtaagaactccgcgggagcgccgcccttcactcctcttgcctttgccctggagtccgcggaagcgccgcccttcactcctcttgcctccgccctggagtccgtggaagcaccgccctggagtccgcggaagcgccaccctggagtccgcggagatcggatggggaatcagatcaggaagcgccgctggcaccattcacttctggcgacggatggggaatcatatcgggaagtgccgctggggaatcagatcgagaaagaatttgcatccctagggttcctccagcttcaaagcgaaagatgctctaatgatatgcgaagttacgcatatgcccttccacccttaaacccactcgcgatacagctcaaattcatccacagtacctcgcggtacccctgttttcagtccgttcgatccgctccaacggacggcccagatttcgtaccgcgaggtaccgtacctacctgctagactgtagaaaacctcttttataaaaggccaaaagggtcaatatgccaaaggttcggtacggtttggaaaaggaacagcaacacagcattccgccgcgccgccgaaatcgccatggctcctcccgcctcccgcccgccgacgccgacgccgacgccgacggcgaatgcggcggcctcctcgtcgcggatagagtcgccgtcgctcagggcggccctcgccatggctctcatccactacaaccgcctcccctctcgagcagcagcagccgctgccccctctccccaggctctcctcaactggaagcgcaaggtaggtcgcattccccattccacaaccccgccgtcgaaccctaactctcattctctcctctgatcccgtgcgtgcaggccaaggaccggaagcgcgagatcctccgcctccgcgaggagctcaagctcctccaaggtacgtatccgccgcgccgcgttcgtttactcgatttccagtccccaattcgtgtatgggtgtgatcagacggggcgcgcggggaggagatggagccgccggtcgcgtcgtgccgatgccacttcttcgacgggtgcggggaccttccaccgccgacggacggcgatgctggggagcactgggtcgacgacgtgctgcggaggagattcgtcagattgggtacggtttttggcttcgatacactggttttttttttgaatttttgttgcttctagtagaattttttttttttgaaacctaaggcggaactttgttccacttttatatttagaagaagagaattgacccagtttataaggaaaaccgggcccgaaaaccacacaattgcacggttaattataggagcttctagtagaattttacatgtataagctctattgcaacagtgcggtggaaggataagcgcaggagactggacagatcactgcccacgagtagtttgatgggtgggtatcgctgcaaacatatgttcttctcactcactactcggatttcagattactgtagaatagtttttaactgctcaaatcttagtttcaattgttcgattgtgcagaatataacactgaggatgaggtacaacagcttagcttgtcgattgatttcctggtggagttatcagatggcttgtttgccaaagtaaaattctgttgtcttattatatctaagaatgtaagatatcccattttttgtgtttctaaaattagatttgtttgtgcagagagaagctggctcctcatttactacattttctcaccaggcagtagacttcattctgggtaagtgagagttgcacagttatgccacgactgaacatttaataaattatatctgttaattgtgccccacatatgcttcaagcggtatgagttctcgtcactgataataacgttcaacatatttgatttttctgtggttatttacatggcaagttgatactggaacctgaatgcatcgtcttgtagttagcaaaggaattatgaatttacttccagccttacctttcagttttcacatattttgttgattgtttaatggtagccgtataagatggctctagaaactattttcagtttttctattgcacttgccacacattttattttgtggggttaagagcacacttgccacacaaatcgtcaatatgttgcatatgaagttatctatttttgttttctgtttattccatgttagattgatgcagccatgtgtgataatcaatggtttcagcttcactgaagaacattctctcgtcagaaagggaaaaggagataatcgaggagataatcaatggtttggttgcacgtttgatgaaaaggatgtgcaccactcctgaaaatgctggtacttcaagttcagatgatctttaattgatccatttcagaccattcctagagcattttggatatatgtttttctttcagaaattacatccatagtgatgaatcatgaaatggtgccattagttgcacattagcagtgttttagctagtagcaccattactattccttaacaatggacttgactttcttttcgcttggtttgttttttgggaacatttatctatgttatgacatcttatagttttgcttatttttatcacttgagtgttaactgaatttattttcagaatgtgctctgctattgtcaccaattctatatttatttgtgctcctttcattttgttcgtatattgcaggatcagttgactgttcagatgcccaattctccctgcagcacttattccgtaagttaggaaatgaggagtttgttggtcagaggataatccttgcaatttctcaaaagatctcaaatgtatcagaaaaattacttctggcagatccatttgatgatggtttccctgaaatgcatagcaatatgtttattatgtaagttgattttcaactccttcagatagattataacagaggaatttctgcacaatttgtcataagataatgtccgactctgagcaatatggtctgcatacagtttttttctcctcttttctgataatttactgtactgtcagttgagatgcagtcatgttttcagaacatatttgtcataattttttgcccaacacaatctatactctgagattgccagttgggcagttacaacaacttgaagatattagacatgacatatctcatcagaagaagaatttatgatctccagttccatcatacttggggcatgctttgtgttgttgcatacttagcaaatatttaatttgattttctttactccctgtttcctataaggattatttcttttgtgccttactttgtttttatgttgcaggatacaattaatcgagttcctaatatctgacagcttcaacaattggctatgccgtgatcattttgacagaagttagtcctctgttgccctgatggcgctgttttatatttgttaattgttattcaatgtgaattgtgctgcatccaacatgataacatgaaaacaataaactatatccacatatatgttttttcttcattcaattcttctggttgcagttaaatatctttggtttctacattgttctttggaattgcactttatcatctcatactaattatttgagtcgagtcacagcttataaattgtataattctatccctgaatctgaatagctaaatattgaaagatacatgctgataatggtgcaaacataactcatcattgcatctactatctctttttggcatttcatcacatgagcttgatcaaatctaaatacaacatttattcagaactttttgaagaatgggtcagatctattctcaaggcacgaaaggacttggaagtcctagatgggagaaacggactgtatgtggtatacattgagcgagtgattggaagattggcaagggaggtagctcctgctgctcatcaggggaagctggacctagaagtcctctccaaactcctttactgagaacatgctgcctctgactcgccaatgtattcacccacatgtcatttggatggcaattctcatgaattattagaggcttgtactctacaaacttggaaactacatatcacattttgtatatcaatttcagattttcaggatgactagctaagggaagatgatgtagcaagaaggtgttttgttctcctttgaatggctgggaaaccaactaccgaagcatgctcaaaagtatgtttcattaaccccatgtgttaatgagtagttatcacaaaccagtctgctataatttgaaattgtatttcttcaccaagacccttacatgcctacattatggtctataacacagaccttagaatctattaggggatccaatattgtgataggcattgtttggtatgtttagctaattgttttactctttactccaatttacttatgtcatatttatatatgcatgttttatgtctgctctaaaaaaggaagggagtttttcttaaatacttaagaggcaataatgcatcagccccttttgtcatgtgtgtgtgccgtgcaaagggcagttttgtctattatgctttcatgtactgtcgttttcttcatttctagatggtgatgtttaaattacggtgtgaactctcaataacaagaaaataactaagcgtgttctggggtggtgactttactcaacaagtcagttgctttacaaatttgatctcgtaagtgcccccttgggctatatgatgacgttctggaattaggattgcaaataaactgcctaaaactttgtgtagctgagataatatagtacacagcctctctgtatgtattctatacgtgatattctcaaatgtttacacaatgtaagtttatgaaacaatttttaattgagaaacgttaagaaatcaagtattctctgctatttcagagacatatgttaggtccttattctgaagggttatctagattagaaattgttaacagggtgttggctttaattatatctcagcaacatggtgcagacaacatgcaccatggaagattagggatgagtttaaagtcttaatagccaaagaatattagtgttctttcactctcgttttggcaaagaatgagcttgcactcttcaccctaagaaaagagatagcccttcctagctctagttaccaaatcagtgtttgagtagttacatcaccttttagtcagcagctagcttagctccgttctcaactggtataacaacaactctcatgagccatgaggggagatagtagttaaccaatcccaggatcttccgagtttttatcttggttaagctcaactgatctcttcatcccattgacaagacctgtatgcttgatcaatgcaaggtccttttcaggtaggccaataccatccagcatctggcatctgctccaatcaacaagtgacgtgcaccgccgtttcagagcctaaatccggccttcttcctcaacggtgaaatatctgaaatctgaatcccagatctgatgtattatatccttcttaccattttaacatgaacgattaaaacgacaggtgcacgttactggaaaggttaactcgttgtcatgtcaggctaatagaggatgggtgaaagcataaccagtttcaagaatcaatatcagctttcatttcaagtactccctggagttacagaggtggtttctatgagccctaaagtaagaccatcttcagaatttatggacttccgtggcaatcggtgagttctgataaaacgtcaattgaaatcgtaccatgtatagtagcagggctgcaggaat

SEQ ID NO: 67806 - DNA, 5833 bp, Oryza sativa
agacataaagctttatttacttgagctccagttcataaacttacactcagaggcagctgatgtaatttcaattcaagttaaccatgccttagctggtacttgaaccccaagaaatataaactaatggtatatgcaccaaaatatgtactcaagacatgaaaatctttcctttcttgtttgggtgggaggggtcaccagtactggactactggttataactatcaattatacgtgataataacgcgtacatgtcatgataagctgatatgatggtgacaagccccatttgtccatttgcctcataggacggcagcaccatgtggtccatgagatatctgaggccccatgaagccatagagcttgcaacaagcacagatagcccttgcattcttgtgatcggaggatgtttgcctctgtttgtgtcacctacaaagaaggagaaaaaggaggctctggagtgaactccacttgcctacaaaagacttttgcttctgaattctggtattagttggggagtggtgtttagcacttgcacgtcaggatgtgaacatgcattgagagggggtagatgctgctgctgtgagcattgatgaagctttgctaattggcgacaaagaaccaattatcgactggacttttgtccaaagtggtttgctttagttagtagcgaatgcatgcattgccctgccattgtgtttcgtcagctacatgctaggaatattcaacgagacagagggggatggttagccagctttgaaatgaggactagaggaataggctctcaaatcaggtctcctgatctggtttggtgtgcttcgcgtccaaatgcaagaagctctttggcttatacaatattattatatatctattgtcgaattggtagcatgcttaattccatgctgtgtgattattggcacaaaagtatctgacagacagatggaatccaccaagtgaaaaaaaatcacaataattagtaattagctaactgcaccaaagaaactatagctagctactgaatgtctgcatgccctgacgcacgggcggatggacccatgaactgaaagctacaagattaactaaacaagatcgtgtagacctcgacaggtaagtgattggtaatcacatggagtgtcctaataagttgcagatgcccaaaggacaaggacaggagaatgtagagtactccaatagttttttggaatcaatggtgtgccttggaaaagtatataggacaaacagtgagatatagtctgatagatcactcgagttcatgacatgaatccttgagcatgcagaactacagaagtgtgatcaacttgtttttgcatgttcaaatataatgccatgcataacagtagtgtctgacatgtttgctttctgtcatcttgttttcctattatatacgttcgatatgagccctgttactgtcgtgtggctagaattaattctgttagatgcatgattcgcgcgtggctagaaatgacatttgtgtatacatcatcgtttctttatcataatttcttgccatcgtgccatggcaaattaactgcttgttaccaaaccatgcattacacagctcgacagcgagatgctttgcctcactgttagcttgatcgggatcgattcacctcacaggtacgttgattaattttgcttaaaataagcatatgctgggttatcagtgtgaactttttttctctgtttttttctgggatttgaaagcacgacgtatgaaattactaaattagactatatagtgcatgatagttgaatgatatcaaatgctgtttaggttagaattgttttcttctcttatcaccaagcgcataatttgaaaatgcaatccgaattttttacagttagcgttaataattaattgtacgtacataggagtacccattaaggtgtgattgaggtgcgtctctatacacacactactaaaatcatatacagtatatcacacaaacaaaattaattaaaccagctgtgagagcgagcacacatttcacaaatcgattgaattggaagttgaaacacaagatatgcattgcatacacacaaattgcctgtcgatttggctagcttttttgtgtcaaacggacacaagtaacattaaagcactagcaagctggtgatagtgtggactagtggtagtagtggcagtaaccatgcacacgcatgacaagcgtgtggacgcgacaccggctagcagtatagcttacaacttgagagaaaggtcgatgtcctcggcgtcgccgccggctgccgcggcgtgcacgcggtacccgtagcggcgcccgccgtcggcgatccagctgacgacggccgcggcggcgccgccctgcggcgggtagggccagccgagctcaggatgcggcggcggcggcgccgccgccgtcgtgacgccggcggagagctcgcggctgcgcttggcgaggctgcgctcgagcttgtgcgcgttctggtggccgcccagcgcctgcgagctgtagaacctgcgccggcagtaggtgcacgagaaggcgcggtcgtcgccggcggcggcgagaggcggcgccgggttcctggtggccgcggtgtgctgcctgccggccgccgtggagtggaccagccgcaggtcgaggttgacgtcgccggcggcggcggtggtcgtcgtcgtcgtcgtcgacctcgcgctgatgatctccttctccatcaattagtttctagcttggtatggatgtgcaaaatgtaattgtcggggtgggtaagaaagatagtgtggtgcgagctcgatcgaggcggccgtatataaaaggaggaaagtccaattaagcctggaggactagctaggcgatcgactagctaagcttagcttgtatggggattattgtcatgtcggccctctagtgcttacggccacacggcgctgttgttttggttgggcactagcaattaatcattaatgtcaataatggaaatatattccatgattattcatttttgaataataatcgatgttacatttgagctacatattatatgtacacggctgcgggaactcacctcccacgcacgcaaaacagagtgatgtattttcttatgattaattaggtatgtactaattttttttaaaaaatggattaatatgatttttttaagcaaccttcgtagaattttttttgcaaaaatataccgtttaacaattttttgtaaaaaaaatactatttaacagtttgaaaagcgtgcgtgtgaagacgaaggaggtgagttgggaactgagatcacttaattcgacactcgaaaacagtaacagtattaccaatctttctgccaatgatatttttttttaataatagattaagagacttaacctctacaccaacaaaatgtacacagctaatccatggggactttaatcaacagatatctcccaactggtactactagctagctagctagacacaaaaccaggatattatccaagatgatacccaacgtttccctagctagtccaagacaagttggtaagatatcgtaagcaaattttgaagttcttataaaaattgttacgtgtaaataactatgtccatcttgactctgcaattaaaggcatgctctccaagactaagcatgcattacatggtatcacatggataatgggtaataattaaggagattttttttccttttgctaccgattagagcacactacatcctcacttttgccatagcaaaaaacctcctcttaatctatgcgcgccattattctatacaagtaatgttttatttttgctgttgccgcactttgaccgatgtctaatataatgtctttcaccagtccataacaccttgtatgttgcttgtacggaacaataatggaagagtacgtcattactctgattgtgataaaagcggcaatatgtagctaacccattgtagagacaaaattgtctgaattaagctaacaaatggactacatattggcaatcaatcgatggaagctctttgccatcatactagctagctactactccttcacacacacacacacacacacacaaatctagaattgaatttggcataatctagctcctaagctcttgtacatccagattcgttgtattagattgtatcaaatctaattctagatcggtttttcgtgggacagagggagtgggtgttatattcactcagtaactaattaaacgtgacatttgcatatctccgtgagtatctggctagtacattgtaagtacctacgtgtcgtaatttgctctgcgttgatggcatgcatgacgtatgcactccagtcgtctcttgcacgggacgtgccagattattacttttcatattttactaatgtacggtatatttatatttataatatgctcagatatccatatatctgtactactatataatctttgagattctttaattacatacgtacctatgtacggaacgagtacggcatatctgcttgtatatatgtgtacagcaagatctattccatttgacctttatatacggtatatatacatgtatggtacatttagttatgtatgtagtactcctatgtgcagtcacgtccactgttctatatatggttgatacatgtaataagtcgtttgcttatatacatttgcagtaaggcccatgctgatcagcttgcatgcatgatcgacccattgtttgcatgcattgcccttgattagctaggacaataaagtagctctaggtagctagctagcttcatccatgcttacttacaactacctccatcacattataagtgcaaccatgagtttttatgcctaactttgttcttttgtcttatttgaaatttttttataattagtatttttattgttatgagatgataaaacatgagtagcactttacacgtgacttatgttttaaatttttttattttttttaaataaggcggacgatcaaagttgtgcacggaaaatcatggctgcacttaaaatgggactgaggaagtattaattagaaaaaatgttctatactccagttttgagcatgtgaaacgatggtcatggagagcagtactccctccatcctacaataaatttatatttataagatattaagataactttagtaagaaggaaaaatgacttaggtgttgagaaacaatattgataaatggtacttctcaatttacaaagtgagcaaggatatatagggtgatagaaactaattacccctgacccgtttcaaaatatagcaatctaatactagattggatactgacatattgtatatcctaacactacgaatttgaagaatgaagaatgaattacctatccagattcgtagtatcgtagggttctagctactagcgctactagctagtatctagctgcaagggctacgtcatgcagattcatgcatgcatggctgaaacttgaaagccaaatgaaaacaaaactagctagagactaggcaaagatcccctctaagatgctgatcttactacacggctattatccagatgtattattatgctcgaccggatggaagctgtgggtgtgcatgcctctgacagtgacataggttcagtcttcagatcagcaagtacattaacatgacttggactgcagcatgcaactatgcatttttaacaaatcaggctctaggctcctctatagcttggcccattcctgactgcccgggcctttgcctgaaacccaagtacccaacaagtataataatttctggatcccatcgattatattttgggataaatttaaataataaaatctcttatattatatgatggaaggaatatgtttgctcggagtacattgcatttagatgctgtatt

SEQ ID NO: 67807 - DNA, 28326 bp, Oryza sativa
  unsure (1)..(28326): unsure at all n locations
gtatcaagatcgctgcacagcttgaacttgcaggcacagtatgcacaaacagtaagcttgctgcctgtgtgagtagtgagtacaaacagtagcaaaaggatgcaaatagtccggtttccagttctttccagttcgtgggctgcatttcaccgcagaaatgacatgcaaatctatagtatatttaaagccagtactgagtagtagtactatgtcaatatcaaatgttgctaataatgctaccactataaatcagaatcaaactccagctgcactgacactgtgtatgccatgccagggttgtaccgggcatggaggagtggttcatactggacagcattgtgcagatagatttgaggagtagtaggagtatgcaagaggaatcttgagacctactcctacatgcagctcagctctctggatgtactcctacacagtgagaagcaagctgatcaatgtgtggacaaacagtgtgtaagtgcatgcaaaattcaatggatgctgctgtggtagtagctaagatgagatggtggtgatcttagcaatgcaatctgacagagatttggtcggcagggaggcatgctgcatgggtccggatgagatctgcatcgatcgacaacttcgaggccgatagatagcaaaaactatctcaagatattagccttctaaactcttcgcgatcgattctcatcatcagtctccaccaaactagctggtactctcctccatcttgtttttcaattgaaaagcctgcatcctctacatgaatattattgccagctacatgttgttgacttgttttttcttctctctcgaccggatatatatacaatctaagaactcgtgtatattttgactgtgtatatcgtttataaatatagagaccggattaatgaaaatccattgtctaaaaatatgtaaagtgactgaacaaaagtcaggcagtcagcaaatgaaaaattaactaatacactaaatgtgtcctctggctaattgtttttcgttcgatttttctgtatgaaatatgggtctcaagtgaagaaatgaatttgtatttggcccacgcgtcgaatttctagcatgcatggtaagctcaccaaatgatgtagcacgtttgagaaatgtctagaggtcttttggctagcttcacaaggtggtgggctagccggcctgggttcaaatcctcactcctacttatttctcactcctacttatttgatattaggtcattttctaatatttacgtttttttatgtagcccatttgatttaggttattggatggattgtagttaccaatggtttatctacttgattatagagatagattaaatatttttctttaaaaaatcaaacttataaaggaatttaaaacaagtgatttaaacaatgcaatagaaggattttttttttaggaaaaatatttcttgggtttcttcccttgcccggattgtgggcaatagcccgtttgatttaggttattggatggattgtagttaccaatggtttatctacttgattatagagatagattaaatatttttctttaaaaaatcaaacttataaaggaatttaaaacaagtgatttaaacaatgcaatagaaggattttttttttaggaaaacatatttcttgggtttcttcccttgcccggattgtgggcaagagggtcattttggtttgaaactatagtatacacatgcctcaaccctataaatgtggtaaaacttggctccaatccaaattgctactaagaactactgaaaactactaccgttggtcttctgggttggacacggatattaagtagatgaaattaaaaatattatgattggttgtaaagggttaagaataaaagataggtgaaagggtttatattttaggataatttttaaatgctatattttgaaacagggatagtaccaaatactcaattagcaatttagcatcagatcaaagtggcccaaaatcacctactagatgatgcacagggggcgaaggcagtggactgggggaggcagggtatgtgtgggccgccaaccccctgcctcctatgggccgtcacagttggggctgaacgggacgaccagaatggaattgtgactgacaggagggccagaccagaacataattgtgatttttttttatagatgggcaataaataatatttcttccgtttcacaatgtaagtcattctagcatttcccacattaatattaatgttaatgaatatagaatatgaatgtaaatgtgaaattcattaacatcaaaacggagggagtattgtccagttagacacactatgcaacccatgcaggatgtttctaccatttctatacctgcctggtatctcatgtctcggaagtaagatagtacaagggttacaaaatttgtaagcactggaagcaagcaaatcatcactgaaaataaccagtctccagaacagacacagatcacataagcgaccaccacaaggtcacactctctttattattaacaagttgttattgttaccatcaccaggtcacccaaacagatgttatgttgttttccagacacaccttgttcagtataagacaagtagattaaagaggattttactggaggaggcaaaaggccttattcatcttgagatcgattgaactgggaaatttacagaggcttgcacaaaaactgcagctctccttaaggctagccactaaggaatcgatcatcatataaacgcaacgaaaaatattaccaacaggaaaagataaggaacaaaagaaaggtaaaaaaagaaactatttaaggagctaggcttccatcctatcctagtgtacaatgcttcaccagacagaagcgctggacattgtcttcgcccatttcttagtatttcaaagaggaagagcatggatcagagaattttcagtatgaaccaatcaccctggggctttatgctaagccggcctctttaacttccaaaggctttgcagcgacagatgaatccccactggcacctttgtcagctgaattagggctcacattcttggcctcaccaagccgaactgcctgcgcaaagctcttagttatatgaccaactagatcagtggccacagtcaagggcttcttgggctcaaccacagtagagctgggcagctgatgttgctgatgcagccgcgccttattgtccagcagggctctctcacgctcctcgtagaagtcaaagtcatcgagtatcgatgcatcctcctcatgatccttgaagattttcagcatctccataccttgttcgagttttacctaatataatataatgcagacatctatttgtgtcagattaaatggttgaaaccattacattgtaatatcaacatgcatatcaaagtaaaaggggaaaacaagaattattatcgttattatgtacctcttgtgtgtcccggctgttggtcacaggtttattatcattgttttcaagaattatatggcggaaaagattatttggaacatccttcacaatgtgccacttaacagggaactggccagtccacttatcttgctgccaatagtcaacactcttctcaaaatccactggcccaatcatctctgcaacaccacagaattgtgcactagcattcacctgtacatagcattcaaactgttaactctgaagagaaacaacaaattcaaagtaacaaaaccactaacaaaaaaatgaaggcagtaaaggaacaataagaaagtaggtcacagctttaattaccgaaaacagcagaaaaattgggcaatgctcttctttctcctttgcttcacggtaggctgagtctagtttcttgttcccgtttgtggtgctagcccaaacaccatatttgatgctcttgtgcacattgtcttcgctgtatgattttatgatgaaaaatctggcattcttgtactctgtaacaaagtcaggcctgttgtacaactcgcaatcaacgcctgcagaaggcttctcatccttgccgccatcctctggttgcttcttaggcctagtggcacgtgggcctcggctttgctcattgaggaagtcaagtgaaccattgcagctgcaaagaagagcattgccccttcctctcgtgcggcctttttccatcggaatagaactcgtaccattcaggccaaagctagggaaagggcccccataattagtggcctgtgggaaatatccaccatgagagaacactcttccgtaagagtcacttggtgtcccaaaaccatagaagggcctgtgctgaggagattgctgaaattagaggggaaaaaaggaagagtgtcagaagatagatcatacaagtaaatatgcctgtgtcattgtaaatatccgacaagtaaacagtgtccttatcagacaagtgatagtagtcattttgagatagtaaacagtgtccttatcaggaaaagcaattcataattctaagtaaatttctgtgaaattcactggcaagaagaaaaccaaagcttaaggttgcatttgaactagaggcaacttggccatatcgggaatcaggaccattcattataagaatttacagaattctaaccaggcattcttgccattacatgtctagtcagaagatattatatccaaattcaagaatgaccatgtttatggtaactgaattatggcctaaaagatcacacgaaaacagaataggagagaatatgcggccatctatttcaatcagaaaaggcactgcagattgcatagcattttttattagtctactaagcttattgttatgtgaattaaacttaggcaagattgtttggaaactgaatggattaatccccagacacctatgacaattagtagctcgcaacagggtgaaccactatttcatttgacaaaagaaatagacaagagatggcatgtgcatagaataccattccagaagccatagggaagttgctttgtccaaagggccctgaaacgccaccagcaggttgaggtgaagccgcaggtgatggaaacgacccatttccttcagacgatcggaaccattctgaaattatcatcatgagataaaaggttaaaatcatgcctaaaaagtgaaacctgaattaggagtatcagctgaacaaggcataagatagataataaccaggtcttggtccgaaaaggaagctgttaggactcagagtttcggcgataaaagccccttgtgttgggtcaatcggcaccattgcctcaccctgtgatattggagtaggagagcttaaatatggcatgccaggtggtactgattgctggtagtaaggagccgagaaggagaactgctgaggagagtagagctgaccatctccactaacagcagccggtacaggcgttgagataggagaataatgagcataagggtcatagccatagccaccatggtacatcaattgaggatcatcattgtatacaaccttcaataaaagccaacaattttagaaaaggtgcttgacgaaaaacttctggcaaccaaaaaaacagattgcttaccgctggacctgcttccaagccttcaacactcacataaggaggatatccatcccattcatttgaagggttatcatatcctggacctgctcataaaagacaaattatcaattatgtcaaggactcaacaataacattcatcaattagagaatagtgtgcctgagaagaacatatggtttgtgatctgaccttggtaatagaatggctgtgcctgagaagaatacatggtttgaggatatgcagcattgtgtcccccacctatattggaagtgccagcttgggcttgtccttcacttggtagattgataccatttgaatcgtgtgaaatggtgggttcaaggaccttctcatctttgctaggaatggtctaaggtcataaaaagcaatttcagcaaacaaaaaaaaactacaacaatcagcacaaaaaaggcaattatgacaatcagaagattgtatagaacatctctaaatgatatcataaagtaatgacctgctcttcagggttatcagaaagaacaggtttttgttcagcatcaactcttggctcctgcgaatccattgagcctgtgggagggagattgaacagatcaaatcaaacattcaaggaacatagatttactccaattaaatgtagagaaaattcctcgcaaaaaacacaaaagtaagagaaaattgtattgcaaagtaatttttaaggatcatgctgtattaggcacttctttgttaggcgaattaataagtaatacattttataccctgccacttcgaaacaaaaaggtgaggcacactaatcaacaaaggtaagcatcgtaaatggcctgaagtaccaaataaagacagctacgtgcctaagtccccattgtacttacttagatgtaccatagaaccatatcattcagttcatgaacaaagccacacttctaaacaatcacatacatgggctgatgggcactagtattccaaattactgaaattagtgtactttagtaccacatacttcctccgtcccaaaataagtattaatttctggctacgaatctagacattaggaatcaacttatttcgggggagtacttctccaccacatagtagccaatagcatatgcagccgtgcacaataaaggcatcaattttccatcattcactgccgtcctatcaactagtcaaaaccatactaaaaaccacaattgtggcctctacaggcaattgtcgatactgacaggcatcctaccactactaccttctcccttcgtgcagctactatccctgcgccagctgctgctgctgctcacaggagacacactagaggcattggttgcgtccgtatctttttcaggtatactggctcgccggaattttagtgcaggttgctgcctgtacaaaccatgaacacgtgatgcgatttccatctgaaagcggcatcttacccaaccgacaaaatcgcacattgctaaacctgcacgcgaaccaacaatagtccacaccacctgccattattcacggacgcgaagaggagaaaagaagacggcaatgtcgatgcttgagcaggtcttcgctgcccgaatccctgaaatctaatcttaataatccactaattcactcaataattccaacggcaccactatgagtctatgacatggatggcatcagggaaaaattaatcacgtatactatctatgaattgtcataattaagcgacgcagacagcttgcgccaagatccgacgcacttggcagcaagatctagcaaggggaacatcccgaacccagcaagaatcaaccaaaaaacaatcgcaccgatgcaaccccagatcgaagagcaaccccaaacccaaccatccagccaaaaatcgaaacagagacgaaaaaaaaaatccccgcgctaacctgggcgatccgatccgccgtgcgccgattccatcagggatccgtccgtcggaaggcagagggatcggtatggctcaactcgcgccaaatcccgcgagccttgggttgaatcgttcagctcggatccctcctcctctcgatcggatcggcccgaggggccctcctcctcctcgactggattcgattcgatccctcttctctctctcccctctgcgattgcgattgcgtggctcgtgatctgatgttgtcgtccctctcaacctgatcaattgaagaagaagaggagagaggtgcgcttcgcttcgatcttcttttattatatattaataaaaaaaaagagtaagaattcgctatttattatttatagggtgagggttggatttgtaaacgtggggaagttggaggggtgttcgtgcaagatttgatttggggtttgctctagaaagagccgatgcccacgccggaatacgtgttggaatccgacgtggctctgacgtggcagctgcaggtgcgagtcaagtcaagatcgatccgtacaaagccaaaaaaccaaaaaaacaaaaagagggtagtgtattaaccttatctcatgttggtctcgctttgatctcggattggatctaacatggccggtaagtttattactacctctgtcccagaataagtacagctatggatatccgtgcccaacatttgaccgtccgttttatttaaaaaaaattatgattactatttttattgctattaaatgataaaacatgaatattactttatgtgtgactaaatattttcaattttttcacaaaatttttaaataagacgaatgatcaaacgttgaacgtgaatagtgcaaaattgcacttgttttgagacggatggagtattattttgatttatatttaaataagtttgtgattaattcaagagatggacttggatcctgtctggattccgatgggaactccttgcgctttggtgtgattggttgattagctagatttagatttgtccacttgtctgtgtcatggttaattccactcgtttagatgcgcaagacgaaacgattaggcgccagatctgttgctgctcctcacatcatgattgcgtgtagctatctgcatttgcagataagattcctctttaaaatacacaataatctgcatctgcagatagtgtagtattagtgtattacttcgtattggagtagcaagacatagatctggagcaattgtgtcttttatgtgggactggacatgcttttggctctgtacatcttatttctataatataaaaggttataaaatggtacctatatatccaagacatgatccgttgtagtctagctggttaggatactcggctctcacccgagagacccgggttcgagtcccggcaacggaattttgtattttttaaaactttctttgttttgctgccgtccaatggctctaggcccgccaaaattcagcccgtttgaactatggaccgtctttgttttggtccttcaagttgtcactaagtttgaaattcacccctaaaacgaaataccagatataatgggtctcaatttacaaaaccagatcacccgaggtcctaaccagtattatgcccagttttagttgatgtgacaagttgagtcagcgtgggacccacatgtcagtggctatcactttcttcctctcctcaatctcctcttatccgctacttcttctctcttcctgatcccctccaaggtgaggtgagacggagcgtgagcatcaacaacgcgctgacgtggcaccggggggggggggttagcagttgcaacaattcatgctagtcaccttgagtgatcgaggtacctgacggcctctgttagagtttgtgtcgaatatgtgtacgtagtcggttacaatttagaacttggagttgtaataggtgttagggggtggagttagagtcaaactctgtaacccggcatctctcttaaatagagagaggggcaccacaatgtaaccatagcgactacaatatagcgtagatacgcgggagatgatggcgacgtggccatggactcgtagcggctagaagctatgttggttggggaggagtgcctataatcagagccccggggatgtaggcttcggttgaacctcgttatcaaatatcgtgtgttactatgtcgtcatctggcatgtcttgggtgattaatgattgaaccgatcgggaaggttagtcgtcgttccgctatatcgactaacttttataacaacttcgttgaggacgttggtggcgtcttgctccgacgtgccacctcaccaccattcattatgaggttttcccttatgtggagtgaaacctcatattggtgctgcactccgtctctagtcatgaagatcaacgtgttgtgatctctggtctctgcaagactacaaccgcaaatccaaacaactgttttagatcttggcacgaccttggatgccatcctcacacggccattgcatgactccatctgccaccgagctctgccgggctactgctgtgcttgcgcatgagagagagagaagagaaaagagggcagagagaagagagaagaagaaagggagagaaaggggaaagatagtggcgatgatgtgggtaccactatatttttttaattgaacactcattgacatgtgggtcccatatttttttaactttaagtggaaccgctttgagaccttatttgcactggttttggaagttgagggacgcggtataactggtattacagttcagggatgaattttaaactcggcgacaacttgggagacctcaattgaacttactcctttgaatatggaccataaaccaaaggtaggaatccaaactttaaaattcagcccgtttgaaatatggaccgtaaccgatggtggaggtaaaaaaccttacgtgggcccccagaaaaataatgtgggctgacatcgcgacggcccaaggtatgggcggccacgtcagctgcctcctcggtcctcgcagttcacacccccaacaaatctgtttgtctctgtctgcaacaactccaccaccaccaccaaccggaggcgcctccgcctccacggccactataagagcgcggcggcggcggcggcgggggcggggggccatggcggggaagaaggaggaggaggaggctgttgtgtacaggggcgacaagctgatcctgcgggggctgcggttccatggcacccacggggtgaagccagaggagaagaagctgggccagaagttcgtcatcgacgtcgacgcctggatggatctcgccgccgccggggactccgacgacatctccgacaccgtcagctacaccgaaatctacaggtcgctcattttaaagctctcttctcctctctatcccaaattcagaattaattaattaatcccgcttgctggtttctgccattggccgtcctacctcccttatcgaatcccccacaacatccagaatctagagagttcaatctcgcttgctactgatatgctccctgaatgaagttgctactgggattcgttattttcaagttgcaattacagatgtggttcacagtgcacttcgttccaaggctaagatgagtttagcggctactgacatgctgtaacgagattttaactcgtcagcacagtgcatgagttcagaatcatataaaaaagttcagcatatgttttgccgatccttttcatgattcagaattgctactagtaccactcaataaagaatgttcatattcttttattttttgtatcgtataggatagccaagaatgtagtcgaaggcccgtcgcacaatctgttggaatcggtggctcagtcgattgcaaactcaaccctgctcaagttccctcagatttctgcagttcgagtgaaggttgagaaacctcatgttgctgttcagggagtcctcgactatttgggcgtggagatattcaggcagagaaaagcatgaacaacacctatacttgttcagaacctcattcgaacagatacgtacttagtgtacttgtcttatctttattgctcgttatcataccaatattattcactcagtatccatgtcaagaactagaaaattccctgtttaatttgcacgaagaggaatatatatgtaacgtagattgttgtggtactattaattaatactccctccgtttcaaaatgtttgatgccgttgactttttagcacatgtttgaccattcgtcttatttaaaaaaaattgtgaaatatgtaaaactatatgtgtacatgaaaggttatttaacaatgaatcaaatgagatgaaaagaataaataattacttaaattttttgaataagacgaatggttaaacacgtgctaaaaagtcaacggtgtcaaatattttgaaacggagggagtactagcatgcttgtgaagtgtcatccgtccgtcctgtcctaacgattttattctgatgcagttggtcgatctaatcttccctttcaataattaaatctacaatataatagtatccattattgtcagtcacagaagtatcttcagtcagcattcagagcaaaaatgttgaccaccattctgtcttctgaggcgacaggaaagttttactaccttatttcattgataaaagaagaggaaaaacaccatgttgtactgcatatatactgtaggtccagaagaccataggcagagtataagtaaatattaatactacattattattgaccaccgttcgcatagtctgcagataattaagcatccctgttgcatgatgtgtgaatgacagacttcagaaatccgcgctgacgcctctggaggcgaatagctcgtcgatgtagctgatgatcccgttggctgcatcgatgtacttttgcatctctgcagccgcagattcatctgccgcagttcacaattacaatagttgcaaattgaggataaattaatcataaaaaagcatgcatatgaacaattatatagctgcaaattgagaaattaatcatcaagaagcatgcgtataatcatcttaaaaaaagaggaaatgttacatgacggtatcccattcagatgggatgatatctctaaggtatcgtctgatacccactacaattaagagtagttgggactcaacaatgcattattgatttcatttgcatttgaccaagtttatgagaaaatttagtaatatctataacacgaaattagtttcattcaaattaacatttaatatatattgataatatgtttttttttcgaaaatattgctaaacttttctataaatttggtcagatttaaaaaagtttgactagaaaaaacgtcaaaacgacttataatataacacgaagggagtatatattagtaccattttcgtttcaaaatatattacacagttgactgttgaatatgacttatatttattcattttattagcattattttctttcaaaataatacgaatgatcaaatctaatacctaaaagtgcggaaaagctaacgcgcgcgagcgtgttggcggtgagcgtttccgaatagtttagcctaactaactaagttattagtagataatgacagtaattaagatatgatttcctttttttcggaagatttttttccactaaccgattgaaaacttttgaagtcaaattttaaaaacttttaaaactcaaattaaaaattttcaactcgaaatttaaatgtgtaagataaattttgaaaactttccagtacagatttgaaaatttttaagttaagatttgaaaaaatataaaaactttcgactcagatttaaaaactttcaactcgagatttgaaaactttcaactccgattcgaaaaccttcgactcatattcgaaaactttcgactcagattcgaaaactttcgactcgagatttgaaaactttcaactcaaatttgaaaactttcaactcggattcgaaaactttcaactcgagatttgaatactttcaaatcagatttaaaaattttcaagttaagatttaaaaactttcaactcaaaacattttaaaaaaaagtgtgctgaagattaaaaaaaagtaatcaggaaaaaaaaggaaaaaaagtgaaaaaaatcgcaaaaggaaaacgataaaacaaatcgcgaaaaaaaagaaaaaatggctgatgggctgatgagccgggagcagctggcgcgcgcgccaactagcaacgcccctaaaagtgaacaacatcgtgtatttaaaatcaaatgcggtataaggagaaaatggatatagatggccaaatgggccacacgaccgggcctgagctgaggttagtcgagccagcatggcccgacctccacgtcgggctgtgccgtgccaacccatgggctgcacacacggcccaagcatggcccaataagacttggaccgtgccatgccggcccggcccatcgtgctcttccatgtaataagtctattttttttcctttaactcttcgagctttgtcttatatggctggaaattaagtctatcatctttctttgggccttgccttacatggttaattaagtttattttggatcctctgctatgtttttaaacagtgtcgtgccaggctggcccaccgtgcgaaggcatcggcctaggcatggcccaactatcgggccatgccagcacgggtccgacatcagtcgggccgtggtgtgcttgggccggccatcaggcttcgggccttatggccatctatagagggggatcctagtgcgcgcttacgtgccagcaaaattgctagcgcgcacgtcagctgggccgtctccacgcgccctttttgattttttctttttttcgcacttttttccgattccttttttgttttttcttttttcgcactttcttcctgattttgactcctccaacactttttttttctgtttctttccaatttttttcaatattttgcatatctatttacaaatgtagaattgaaagttttttttattttgacttgaaatttttaaaatttgagttgaaagttttcaaattttgagttgaaagctttcaaatttgacttgaaagttttcaaatctgggttgaaagtttttaaatttggattgaaagttttaaatctaagttgaaagtttttaaattttgatttgaaagttttcaagattcgaatcgaaagttttcaaattcaagttgaaagttttcaagattcgggtcgaatgttttcaaattcaagttgaaagttttcaaattcgagttgaaagtttttaaaattcgggatgaaagttttcaaaatttgaactgaaaaatgttcaaatttcacgtaaggatttttaaaatcttagtacaagaaacaacctataaaaaagaaaaataaaaataattagcacgataattagaacgatgattattagaaactaattacgttaccgtgtggtgcacgcgtatgtctgtgtcgtttcctacggaaagaaaacaaaagtgggctggaaggcccgaaacagttgccgtgggccgaaatgcgcgcgagttagctagctagcgtgtctgcgctaattagcaaacctgatctatagatggatgatggatggaacagtaccggtctcattgatggtggcgaagaagtcggaaatggacttgacggggatggcgcagatggagtcggcgacggtgctctgcacgttcttgtcgtggtaccgggcgaacacggcggcgtacgccatggacaccaccccgtcgaaggagactcctcctcctcctggtcgctgctgctgcagctgcgcgagcatgagctggaagagcgcccgcttgagctcgatgccgcgcttgacgcggacgaggttgttggagtgggtgccggtggccctgacgcggccggcggcgacgtcgcggtcgacgagctcctccgcgctgtccatggcctccgccgcgcgctccagcgccaccagccgctccgcgtattccgtcttccagaacccggcctccacgccgaggaggtcgaacaaggccagcgcgtggtggcacgcccgcaccagcgccttcagccgcagcggcggcgccgcccgcacgctcaagctcaccgcctccagctccgccgcgtactccgccagcggccgccgccgccgccgttcgcctccttctacctcatctacctgcacctccgccattatatataggactctatcactattcactaggcgctagctagctctagctctgtagtacgtcgtctgtatgatgcatgcctgtatttatagatgtacatatgcacttatgcctgcagtacatatgcacttatgttggcctcttaattagggaggttttaagccgctgcagcttctccataatcaaaaacttttcaaacaatatcaatcttcatcaaattctaagaaaaccggtagttacatacagaaaataaatttaaaatcataaactggtttggtttttttagcttctccagctattaactaaatgcctatcataatttaaaacttttccaaacagaacatatgtattttagtatgtacctatcagaaagtaagtttatgcttatgttcaattgcacgaaaataaatgtgtttaacttgaatagttgcaaaaaaaatttaatgaaattttacaagatagattatgatggtataaaccaataaacaaacatgcaaatctaaatttaaactgtagaaaaaaaagaaatgcttttcaccatgttgcacacatactattcgctgcttgattttttctttttcccctctatttgtagatttaacctgtatgcttgtgtataggcttatgctatcctaattaatcaatgttaccaaatttatttatttatttttcctataggtatttgactacaatccatgtttccatgacatcatccatgcatatatgtttataagtacaaacagggtcgtggttgacctgcaagttgatttagtttgaattatcatgtctgttggtcataacgcgttcttgaaattaattcgatctatccctttcctaccttcatggttgactgcaggtcagattaaataatgttgaagaacacatatgtaagtcatatatagctacatgtattgtttttgaaggttatacggtttgaatttgttgggtttcacaaatatatcttctaagtaagagactatagtccataggtgtggcttcacttgacagtgtcgtccaaaccgatatcgctggttttccctagccaatcgatctcaactaacctagctagtatagctattagcatattaaattcctagaaattaccaggagtacaagatcgaccaggtcaagtccaagcatgcactaattcttggcaggagtagacttaattagttaagtgagtgctcgatcagttgacttgctgtaaatgtatcgcatttcaatcttcacgtccaggaaattatcactgaattttcaaattacaatggttattatctaatcagtgaatcggggtcgagctaactaattgaattgaacggcaggcataatcttcgtaaccccgttgcggcctggccacattccggtccaacaatcccattccgacccaacaaaaaatacataagtgtaaatttcatcccctgcaaccttaattaccatggtttatgaaattactaatatttttgttgtttaataaatcctatatacttatatagttaatcctcactaagtgtagttattgttatttccctcttctcttaataagccacatcacctcaattatttctagccattagatgatagatctatggttcaaattgtctcttctttcttctctaataacaccatgcaatctcaattatttataggctcaaaattcataagtagtaatttgttttagttttaataatcatatttcatcatatttgtacatattatataatttattttttcgcagcaacgcggcgggacattcatctagttaataataatagcttggccttgcctctggtccacgaggagagtgcccattgccagtgtggcccggcccaacacggcccattataaacgtagcactacatactctctccattttctaacatttattaacgtccttataatatcttactataaagttatcctccactaactcattaagcttaacatgcaaagatgtcacatcatcatccactaattaataagatgccacattatcatccactaacaatcatcacatttaaacatcatgcaaacatgctatatctttatagtttttataatttaagagcttttcaaatacaaacatgttaaattatcatccaacataattcacataatgttttaatgtatatctttattatgttttataatatcatatatacttatataattcatcctcacttagttagtgcttaaatgattaatctatagtccaaattatctttctctttttttcctctaattaagtcatattacatcaattgttttagcctttagatgattaatctaggtctaaactatctccctactttttttcttccataaagtcataccaccttactttttacgtttgaatcactattctacatactatttaaatttaaattatcataaaccacattaatttacttaacctgatgttatctagctatcttacacgttattttttttattgttatcatactaaattcccgcagcaatgcgcggggtttcacctagcaacttattatagacatacatatgattattcgtcctatttagagaagtgtacgtaattaaaatttatatatttttaaataagttactttgagtatgacttatatttttatttttttaaaaaagacgagtagtcaaatatatatttaaaatttaacgtcatcggacatttaaaaaaacagagagaatactacatatacttaaatagatgtacttaagattgagaatgaggaatatgtacaaatatacaaggtttccgacttcaaccagaagttatcgaagtaaatggaagttgccacaaaagcaacctcccaaaagaaaataaattacattgagaaattactatcctatatttatgaaaacccagcttccttctaaatcgctacttaaatagatgtcactggcttgattatcccctataatgaaacaattatagtttttgagataataaggaataatcatgctagtatcgggtagttaacaatgccacaatgccacaatgcaatccagcttctctcgaaagctaataataaaaataaaatcaacgaagaaactaggaaatgatgatgatggaccatctcatcatccatccatggaggagaaaacaaaggccacattggatttggatctggaaagcacctacagggagaagagaggacaattctaaggcaattagcaaacaattgggagtagttgggactcaacagtgcattattgattgcatttacatttgccctctccaatcattttcaccagcattcattcatgcatccatctgtactgtaccctaaactaaactgcactctgctaagtacttgccgcactacattctccgattaaattcttattgattcctgctaaggaaaggagatgatgagggccatttcttaatcctaaagaatgtctactaactcattggatacgggattttttcattctattttatttgccaaatagttattggctagagctggcttggactctggagagcatgattcctgcatgctttctggtcaagcaacactattatcatagcattatcaatcagatgatttgattagattaggttaggtttgttattcacctaaatcaaggcatgagcacttgggcatacaatcaggagagtaggagtagtaggtaaagggagtaatgtacagcgtacactgctggggtctacaccctaatattagtatacatacggctacctgcctatctgtatcacaccacaaatgtatacaacagcaaagcgtaccagctgattgatggtgtcactcaccaaatgttctttgtttttcagttacaagaaaaaaatcgatggaataacaaatacggagcactgaagttgcatactttggccaaacatagatggaaattttataattcgtaatcgtcacttgtcctttaacctatgtaataatgaaatgaattctattattgagaaaactattcctgaacttgtaccggtatacggcccttcaagtacacggttaagtaattttcagcagatgcatttattccgaaagcgaaaattctgaaaaaggccaaaagaagagagagagagagagagagagagagagagagagagagagagagagagagtggcaggcagctagtccacattcaattcagtattttcagcgcagtgtgagtataaaaagtggcagagtctgaatctgtcaactcgatcttcccttctttctctgcagccctgcactgcatttccaaggctggagattgatcccacccaacgaaccagcgacaaaagggcgacggtagaaaattattttcaccaggaaatgaggaagagagcaaggggtttttataaaatctccagcttttttctgttcctctggtcttgattcttgaactgccctcaagaaagcaggggaaaggaaaggactcccctttccactgggagagagaaaaggagagagagacctggagaaggggggaaagggaggaggaagaagaggggagagaggccatggtgcggaagaatgggtggcagctcccagcacacaccttccaggtgcaatttctttcgatcagttcttcttcttcttgttgtttttccgtctatcttggcttcttgcggttgttatcgggcgcggtatccaccggaaattccgccggaagaattccttgtctttcaggcctgaagaacatctcgatcttcccgaactgaaagaaaattttcagcctttgtttgtttctctttttgtggatcagtttggcagaattcagttgctagtgatcttgcttatccactcccttatatctcaacttccactttacgtgtgtgtgtgtggattggaggagataaatgcgtgatgaaatgttgtagacttacgaagtagagttcagtttctagagtgcactgctcaggaatgatcactgtaattttcgctagtgtttttaggaatgcctggctctgaacctgtttaggctttgggcgaattctcctaggtagccttttttttttgttcctgattcctgcattttagtggagtggtttttagtcgtgcggtggatattcccttttgctactaactacaaaatctcatcttttggcatgatcctggttctaccatgatggagtgcggaattgttcaaaaaattaaataaataaacagagagatggagacatggagtgaaagattatgctctccatgacttggcactgaaatgggtgcaaaaagggacaaacttgtttgggttcacacatacagttttactaacaaaataaacaagtaagaacactggtagcttgagcttctgaagggatagcttggtgccttggtcatgtattgctgcttggcgacttattggacactccatggttattaaacaatgtgattttcatggactggtgaaattaagtagtaacttccaatcttccagttgctatcttccagttgcccttgtagcatcaataagattattgtttttctttcattatgctattactgaaaaattgaaaagtcagtttaagcatactaaggcagtgtttgagggagagaggattgggaagatacgcaaaacgaggtgagtcattagcgcatgattaattgagtattaactattttaaacttcaaaaatggattaatatgattttttaaagcaacttttctatagaaaatttttacaaaaaaacgcaccatttagtggtttgaaaagcgtatgcgcggaaaacgagtaacaacctcccctatctcctatgaacgaacgcagcctaaaatgctataagaggacaaagaactgtgaacttgccgtgttgtcctatgcctataataccctccaaaagcatttattgacagttcttcatataaaaagggtaatgcatatacatccaattgttgggacatttttttttaatttgatgtcaatcagcaaaaaatacgatttcgtattttctgttcacaacttttggttcatgatacacgctgtagtttgtaatacttgccgattaccggacttttgaacagtggatgactaagttgaatctcttgtcaaacagattattgcaattaccgttttcttccttctggtggttgccttttatgccttctttgcaccattcctgggaaagcaagtccttgaatatatcgcattcggcatctatactcctgtggtaagcctaccaaatgacacctgcagcatatcatgtgaggacagttatttgagatgtacacttactgtttctcctccacgtggtaaaattttcaggcatttgttgtcttcatcctttatatccggtgcactagcataaatcctgcagatcccgggatcatgtcaaagtttcaaaatggcttccgtaatgcaccaacaagtggcaccggcttacaggacacaaatttgccaggaaggggtgatgttgctactggaacgaattccccaacatctacttttaagagctctctagatggacgttctaaccatgctggtttagctgctggagatggaaataatttgagctcacaaccaccaaggagttcaagttgctccttagtcggaggacttatttgtgctctgtttgttgaggaggattgcaggacgcttgttgattcagagcatcaagctgatggagaagatgccttgttttgcacattatgtaatgctgaggtaagcttgtatatgtgctcaacgttggaactgcataatgatttttgtctcagtttcaggcaaaatatatcatttattttcctctgtaataactttgtaaaagcgaaaacttctgttgtcagatgttgctaattacaaaggcaaaattttcaggttcgcaaattcagtaaacattgcagaagttgtgataaatgtgtggatggttttgatcatcactgtcgggtattttcttatacaaacctatgtttgtcttcaaattttattcgcacgtctgatttttgcatccattgcagtggctaaataattgcgttgggcgcaagaactatttcacatttcttgctctgatgattaccagcctcctctgggtctgtaaagtggccttacttaatctctattccgaatacatgtttaacacagtactaaaagattctttgcatttttcattaattagttcagctgattggcattttaaatctattcttaatctgtgatctggcagcttgccattgaaatcggggtcggcattgctgttcttgttgtatgcttcgtcaacaagaattcagaaagtattattcaagacaagcttgcaaatggtttaactcgtccaccctttgcaactatagtagtaagttgcactagcagaaatcatcatactttagttgcaagacattttctctagttgactgaatgcaaacttcttgtgcaggccatatttactcttctttctataatcgcttgtatacccctaggtgaactcttcttcttccacatgatactgatcagaaaggtttgtatcgcaattctcaccgaatcaaatgtaatatctaaatgacatgtcagatgcatagaaatgtaatgtcatttgcttgaaattcccctacattgctttcatttgaactgaatcaggggatcacaacttacgaatatgttgtcgcaatgagagctatgagtgaagcacctcaagaggaggaagaagaggatggggtgaacattgtttattccccaacaaattcagcaactactggattcagcggtggaagctcacttggtcttccctacaagggttcatggtgcacacctccaaggattttcgttgatcaggtaactgcaaacgatgacccgtctcttctgagacaatctctcctgataaataaagaatcagatattgtatcatctgaatgaatatcagtatgaatcttcaagctgcaaatagcattacaaagaacatatttatctgaattcttgcaaacaacattgctaaataatctctccgttttaggttataagacgttttgactttgctaaaagtcaaactatttcaagtttgactaagtttatagatgaatacagtaatatttataatactaaattagtttcatcaaatcaataattgaatacatttccataataaattagtcttgggttgaaaatgttactaatttttttacaaactttatcaaacttaaaacagtttgactttgattaaagcaaagacgtcttctaaaatgaaacggagggagtagcgctgtactatttctcttctgaatgattgcaatgcaggatgaagtgatcccacacctggaggctgggatggtgccatcaaccatcgaccctgacacggctggaaatgctgagagagcaaacagagccaagaagcaagtgaagatcagcgcgtggaagctcgccaagcttgacaccaacgaggccatgaaagcggcggcgagagctcgggcgtcctcctccgtcctccggccggtggacgctcgccaccgcggcggccacgacgccggcgacctgagctccagcggcaacggcagcgtcaggagcagcgtgagcgccgccgccaaggagcagaggaggagggcgtcctctctcccgagctcgtgcgcgcagagcgtggcgagccaggacgagtacgagcagagcggcagcagcgtgatgagcagcccggtgcgcctccacaagctcgcgccgccgccattgccggcggcgcacaacgtgccgcctcggccgccgccgccggtgaacgctgctccggaggcggcaatacctcggccgccgccgcctgttcctccggcgacgaggatatccaacccgatgttccagtcggccacgtcgtacgtccgggagaaccggagggcgtcggtcgtgtgggaccaggaggccggccggtacgtgtcggtggcgccggcgccggcaacggcgaggccaggaggaggcggcggtggcgccgagcagccggcggcgagggcgccgcctttcttggcgaacccaggtggcgagcgcgagccattgagtgccgcccgtagccgcaataatcccgccgcgcccgcgcccacgaacgccgccccttcgtcgtcgtcgacgctgccgtcggagaggctgacgtactccggccagtcgatattcttcggcgggccactgctgggcggcgccgccgccgccggcgaacctcgaagggacgagccggcggggacgagggcccgcggcggcgagtccttcccggtgtttgctcccggaacattccagaagaagccgccaccgttccgtaggtgaaatctgcaactgatgaccggcaatggcgatatcatcgccggacaatgctaatctccggcgaggtgacactggaagcagaatctgcaagaacaagtgatcagcatatgctgtcgaagcattaaaaggaaggaagattaattaatgtggagttttacatctgatgaagtgaagataattacataaccttgtctgattcaggaagagagagaaatcgggagcaaagagatgtggtgggagcaaagagttttgtcatgtacagcattcttttctcggtaattaattccgaacgaaatcatataaaactccgggagttagtatttgactgtgatttgtacaatagtaatgaataattaattgaattttggacgcaatacgctcaaaaaaaacagatttgctagaaatatggcgccactttttctgtaaaaaaatagtcgatttttagaccctaggatctatatcaaaattcgtgctaatgctttccgagaaaaattaaggtgcggtgcggtggcggggagtcgatcccgtgatcgacgagttacaggcatacagcaccaggcttttgaccaactgagcacaagatgctattcgttctatcctcaaagtaaatcgtagttaatgaaaattacaatatagtgataatttatgcaattatatgccacttacattgtaattacatactaaatacatatataattttgggacttacatatgtaattttgaaacttatagtgaaaatacattataattacatatgtaattttaggacacttacatatgtaattttagaacttacagtgaaagaaaatacattaaaattacatatgtaattttagaacttacagtgaaaatacattaaaattacatatgtgattttaaatttatttaagtgtaacttttgtgattgttagttttctatcgtaaatttaatttatattgtgtattataataaagttacttatttgttatattgccaaggctcattaatggtcaactttgtgtttgaaatggtgttaatcagtgtgaagtccaatccgactgttttggactaaattttgtggcgccatatatatagatggaccccaaaaaaaacttgcataaagaatggacaaaaacgacagtccccgggttatccaagataaatactaccttcgtactaaaatatagtaacttttggcttgtccagattcatatctaaaaatacttatattttaggacggagggagtagcattcaccatgtctctagaaattacaagattaccatattctctaataaacaaacggtttattagaaaataaaaatattttatagatattttttttatatttattcatagcaattaaaagtcaatactacaaagaaattacattaaaaatattttacaatcatctttaaatttaagtttgaaaatttaaattttagcttttagtttgacttactctctccgacctaataatacttgtcgttttagacaatgttaagatcaaactttagaatctttgattataatttttttaaaaatatttttctttcaattatttttaaagtattatgttaaccgaagagaggatccaacgtgcatgagtacaagtgcgatttcttcttcatggagctctatataagcttctccaaaaataaaataatttaaaagaaaatccaaaaccccttgactttttttgaccggatacaagagaggaggtggagtcgtcgtttttcgacggcgaggagaggagaggggagctgaactgcggaggaggaggaggaggaggcgatgaccgccggcggcgggatgaaggtggaggtgcgggtggtgggcggcgcccggagctgtttcgccgcgctcccgctccacctgatccacgccctgtcccgcacctccgtttccggcgacctcccgccggtcctcgcgctccacctccgcgccgccgccaccgccaccgccgcccgctggtccctcgcctggtccggcgccgcgtcccggtccagcgccatngaggtcccccccccccccccccccgactcccgtattattcccatcctagaattgtatttacttttagcatctgtgatggatgattgctcgctttatcctggtcaaaattatccggggttttgctgcttttcggtcaatctggcttctgcgagtagaattttcgatgattgtgatgaccctgtatatgcttgtattcgttgctactatgtaaacactgtgcagtaggctgtggattatttccagcgtgaaatctttgatcaaatgttggggtttgcaggttgctcaagagctggcagaatgcatctcgttgcctgatggaacagttgcacagttgagtgtagctcgctccctggccaaagctgattcagtctgtatagaacctttcagcgaggatgattgggagatactggagagccgtgctgatttggctgaagaaacaatcttgactcaggtactattctgttatatacattgtttgcttgattagccaagtgataatcatctctaatgtgtaaagatttactatttaaattctcttcttcaaactaggttggcgttgtttacgagggtatgaaattcccattgtggttggacggccataatattgtgaagtttgttgtgacctcatcttctccaaagaaatcactgggtatggctccttttcttatctgaattatcctcgtgttacatccagtgcattattttatctaaaccatagttccattcgaatgaactttctaaggaatgttccgctcatgcgcactttgtatctagtgacctagctgtttcatccaaactacttcaaattgtatgtaccttcttatatccaggatgttacgctagtatgaaatcatgttatcaacaaaagcatggagatgagcttgataagttcgtacatattttgtccaagcctctataaataatttcttacaatggtatcagctttttttttttttgccgggtcggccgaaggaacggcgaccaaatttcattaagatgggggaaatggtatcagctgttgtatactgctattagattgtagcttttgcgtacactggtagtccatccgactgtaccttaacctaatttagcaccttctgacaaaaccccaatgattattgttctaacgcatcatgaattttgcttgctgcactgtgttacagtatgtcatgctgcttttagtttctcataaaaaatgccttcagtatttgaggtcatgtaccttctgtatttatttctaatgtttgtcatgcttttaattcttttagttcaacttgttccgggaactgaagttgctgtggcacccaaaaaacgtagagaaaactccagccaggatgtgcaaaagcaaagtgcactgaaggaagaagctcaaacaaaggctctcctgcgtgttcaagcagcagataggaagtatgtgcataaattcaaatataaaggtgttgaactgggggtgattctcagctatgctgtgctggtacatccagatacagctgcaagagcttcaatttccaatcttcagttggtcactgtttcatccaaatcatcaccaaagagacttgctcaaaaaggcaaagaagttactcaaaagaagggtattttactgcctaaagaaagggtccgagaagtggtagtctatatcttattctcagattcagtttcca

SEQ ID NO: 67808 - DNA, 999 bp, Oryza sativa
agacccctgcaactaatgtttcaatttacctaagcatgtcactctagtcagaaaagaacttccattattttggacagatgaaaacatgagcatgtccgcatgtctttatttgattgcttcctctactcgttcacttatattcactcaatcacaaaatatacatatgaaagtagctgcaatgagatatctagattaaatacctattgcacaagaagttcccaaagcggcatgacaacacacaatccataaagtcaacaaggaatttctgcagtgaaaagcagttcaggttataaaaattcatgaagagacctagtttcagcagagtaatgcagctgcaaaagaggagacgacttacagatgagaactcaaatgcagatggatacaaacgtaacaactgagaaatacaatccagccactgaaaaataagatatgagtgttctgaggtgggttaatacaagttttgagtgatacagaaacaattgatatcttaatcacaagatattcactgcgagaattgccaaatggataatggttcgcattgttcataaggaagattattaaaaagccagaatgcagtcacttgaatgtagtagtcactatagcaccgcctgttattaactaataatttcaatataaaaatggaaaccatctgccatgcatgatttgcgagggcgtgcaacttaatcctaaatgctgagcggtcttcagactcttcagtgctcagtttgtacaatacaactccagaagagtattagcttatgcttaccctcacaaaagagtataacatctgccatacaggcaataaggaaaccaattacagaatcagaaaaggttgattgtgtatgagaaaataaaagaagaaaaaacattattcatttagctcactgttggcagttgctgatgcttgtttatgaattgaggtacattgggagaactgagactcagttacatcaaataaatttgactggaaaagtactgttttaacacaggggctgcagg

SEQ ID NO: 67809 - DNA, 7656 bp, Oryza sativa
acttccgaaaattcatcatcaatcctgccaatggctgagatgaccttgccagaacagctccagacctgtaacacaaacacactcaagttttatgcatgtcgtataaagggaactgaaaccaacatgatactttatattaatgatgttacagtgttacccccaaaatctgaaagtagcggaacaattatgaactatataaatataaaaggaatggcaatgaggtcataattcataagaccattcaccaacagtcatcagcctttccaaaatatagggagcataagactgcagagaataatgatgaaatttattggcaaaacgtaagcatgcataccagggtcacaccacgaaataacaggcaagcgtctgccggatcggaaagaagaagcttgcaataaatcttcatcactaacagataataaaaaaaatgttggtgctgagcatgtgtaagagaataaaattaccacaagatattatgaatggtataaaagtaccttatgctccttggcacaatcaatgcagatgggtacgtcgaacatagtgagtaggtggaatttactttacttaccctccaccattcattacgcaagtctttttcgaactcggatccactatgcgggaaccatttcctaaaaaggcgatggtattccttcaagagccgcatctttggatcagatttctgataaacagtggagggatcacaagaaaatgcatatagatcccacagatgagtaggtttgctatatcttctcaaagcatcaaacacttcgtttttctgaaaagataagtaacagaaatgaaacacaaaagattaaaatacatgacataacaaagtatgagaccatatgaggttttaacgatgcatcacccaacaaatggagaatagaacaaaatataatacaaaagaatattagaatgaaacaggatttctacctgcttggttttaggaagaaaatcgaacacaatgaccctcatgtctttacctggatgaaaaaaagatcaagttaaaggtaaggtcaaaacaagatacatttgcaaactactttagatgtcaggtaaaattattaacacatacatagactgaaaaatcaccaataaaaatggcgatactatggtaaaagaacaaggaaaatggcattatcgcacagaaatcacagaatggttcaagaagataattattgtttttaattcatatcccaccaacgaaagatggattcaattacaagaggacatgtaatagaggtctctggcagtattaatactatgtcaacatagatcctttcaggcacaccatgaataccttctcaagacagattatttacaaatttctgccaagatctactcagtcatgattaagtaggactgtaaatatatgaattgtgttcaaagctgacttacaaagtaaaaaaagaaaaaaatatattaccgatgacttgaagaagttcacggggctgcttcttatcatgctggcggggcaagggttgaagctttacgtcctgccacagaatcaatattttctaaggacttatagaatgaattaaagaaaatggaatagtggccatgaacccaaaagaagacttgaaaacatgaacttcccaatgaaggaaattatagacttacatcatttatcttctcaattgcagttagtgggatggtacccaactctataacgccttttgtggcttggctctgtaaaaggggtagcatttataaaagaagaacaagagtaatatgaaaaggaaaggactgagggagcagtctgtccatcattagaatgcttagttcaagccaaaaaaaaaaacaggggtcataatatactaaattcccactcaaaaagcaaacaagacattattcatatttcaaatcgatggaaaaaaattgagagaacatataaggaacaaacggagaatgttgtatagtagaatgaacttgtatagacatgcaggaggcatccaaatcacgtcgaattgtttctaataattgtgataaaactaataatatgattgcttaccacaaagagaagtcggaaatttgtcactgaaagaatgccagcctcatctgtgtttagtagaacaacaccatgaccctaaataaggagatataagagggaccaaattagagatgtaaaagagcaaaagtcagaagcagctgtttctgtctgtgtaaggcttttggtttcagtctgaaacacattggttgattacaaactcatggagtataattgtccctaggattttataagaaccaaaaggctcaaaaacaactatccaagattaaatacccttgaaaaggtgatgatctggaagccgacaggctccgcaaaaatgtatcaaaatttgaaagtgggaaatcatgatcactagattacgcacagaaaattggtgtgccttagtaggtgaaaatgtgcaaaaatcgttagtgttacgtaaaagtttccctgataaaatgtacatccagactaggtacattattgcttccattaactccactgtaagcggcctagaacccgttcggtgtactacttaaacttgtaccaccgcagttcaaccatagcactaaaattgtgctacccattgtgacagattatcctgccccggttgtgtcattcagaattgtgaatggcctacagattatgagtgataggcaattggtgtactacttgtactgctgcagttgaacaatagcactagaaatgcgctgcccattgtgacagattctgctgccccggttgtgttattgagaggagaattgtcaattgtgaatggcctacttattatcagtgaacagggaatggatgggtgcattgcaatcaggatagtccggcgaatcattctaggcagtaatgaatgaatttgatgagttaatccaaagggcaatcgacaaagcatattgcaaggttagtaaagcaccacgtcacgcaactgattcggagatttccgtccgaaatgaagcttgcacatcgaaactggaggaattcagtcacagatgtgggggaaaaggaggcgattacctgggcgtaaacctcctcatcctcgaggaggaagtcctccatgccccgggacgaactccgcggcggcctcggctcctagaaagcggagagaacaaaatcatcaatagaaacaaaacgtgaaatcggagatcacccccaaaacagcaaccgaaccctatctccaaatcaaaaccgccccccgcaacgactcgcgcacttatcgggagaggagaggagagaagatgaagcctctccgcgcggcaggcggtggccccgcgcccgcgcatgaggatcccaaacccacaggccagctcccctcccgcaagcgcagtcgtcgcagacagccacacccgcgaagacgcaggcaggagagcgaggagagaaatcgatggagaggcaggaggaagggagggatgaagcgcaccaccgaggaaggaaggaagcaaactgaccttgatttggttccagtctatggcgtcccagctgccggagccgtccatctccggcggcggcggcggcggcggcggtggcgcccgcggcttcgcggcgtcgcgggcgacagagagggagggagcgctccgtctcgtccggctcgtgtttggtttgggttgggtttgcttgtcgtgagagggaggcgacgcgaacaacacatgcgatcgcttttgttgtatgtagcatgtggcgtgcctgatgctacgacaagttaacgcgaccaaatgaaatgatcacttgctacaagttttcctcctcctcctgctctgctctgcttccctgtctttgactgggattttatgtatgatcgtactaccgtctaatgacgcacatggctattattaatatatttgacatttaagataagataaaaaatgtattagattaaatttataaaatctacaataagtttgtgatattgtactaatatgagtagaggagtattactcttcgagcaaaattttacgtatatgatttcttttatctttttgaactaattgtttgagacattattgagattaccatagttttaaaagtttgatcagtcctagacgttaaatatttatactgcttatagtttcttagtcatatactcatttgctgataagacgtggaaaaatatgaatcatgctatttttttttatggataaaaaacttatatttttgtttttggcgattcaaaagctaataaaaacaaactttggtttaaaaaattgaaaactaaactttaatttttaaaaattttggtagcggttgatgagccaaaagataaatgatgaaagactaaaattgtttacaactgctctggtaaatcaggattattttttttcgaatacctggcacagaaggataattactctatttgatgatggagatgtgtggttggtacatgaatgagattatgaaatgttatctaatgatgatgttttttttctatgagttgagagattcatgtggtcaggagggattcaatccaaccggttgaccatctatttttttttatgaagaccttctaatttcaaaataatcaacataaacgtgatctttttcacggtgctacctgatttaccgctttatttattttcagatagatgcggtgacggattaggattatctcgtaaggagcagcttgtataataaaaactaggtgaaaccccgcgcattgctgcgggaatttagtatgaagatatacatcgaaacattatgtgaattatgttgtatgataatttaacatgtttgtgtttgaaaaactcttaaattataaaaactataaagatataacatgtttgcatgatgtttaaatgtgatgattgttagtggatgatgatgtggcatctttgcatgaatatatacattgaaacattatgtgaattatattggatgataatttaacatgtttgtatttgaaaaactcttaaattataaaaactataaagatatagcatgtttgcatgatgtttaaatgcgatgattgttagtggatgatgatgtgacatcttgttaattagtgaatgatgatgtggcatcttgttagtggatgatgatatggcatctttgtatgttaagcttaagaagttagtgggggataactttataataagataggataaggcattcgttgatggcgtctgcttaatcatctcgtttacataaaaatatctatattttacatcatacatattgtaaatgctatatcatgggattataacattaaatatctattataatagaccgtattcagctgcacgttgcgctacaacgtactcctaccataactgcactgacaaaaaatacataatccttttgtattttaatatatgacaccgtttattttttttactaacgtttaaccattctcttattaaaaaaatataatgattatttattttatataattataataaatgccctttagacatgacataaatatttttatatttaaatattttaattgtattatacattaaaatacgaagggactattttgcaccgtagctaaagtagtggagccgcaacacgtcctttagacgatgtttgtgctgcttagggagcttatattatataaaatggagtaaggaataaaacacacgtgaacacaattgggatatactcataatgtacgacgcaacgaaataaattagtttggaaaaaagaaatactagtacagaaatacggaggagttggaaagttcaaaaaggttaaaaaaaaacacgaccacgatgggactcgaacccacaatctcccgctccggaggcgagcgccttatccattaggccacgcggtcttttctgcttgtgcaggtatttatatctctctaaaatgttactattttcttttaatctgctacctaaccgtgatctttgacaaaattggtcgtgttgggcctttaaaacacgtaagataagattgttaagactataggccgagagagaagagaaataaactatcttcggcccaatcaccatccatattcctagcccagggcccataccagtgggctgtagaatctgaactggtagaaacagtcagcccgtccatcttactatacttcctaactattatggtggcccgcgcagattcgcggctagcatcattatattttctctcatgtaatagtatatatattttctcattatattattcaaatatattaaaatgacaacataattttaaattttgcaataactttactaaactactaatgtgtaatatgcatattgtattttatatatgtgttagttattaattatttttaatatcaaatttttgttatttgtaaattatatatattcctatatggactctagactcgtcttttaatatttctttttttaaattctgaatttttattatttctaattgtatttctatgtggtctctaaactcatctttcaatattctttaatttttaattttaaatttcagttacttctaaattgtattcctatattgactttaaactattcttcccatgtttttcttaatttcgaattttagttatttgtaaattgtatttttatatgatctctaaacactacttttaattttattatgtttattccgaattttagttagatttaaattcctatatggactataaactctacttctaatattccttattttttaattccgaatttctattttttttcttaattgtatttctatatggactctatactctacttctaatatttcttacttttaattccgaatttttattattttctaattgtatttctatttggactctatactctacttctaatttttcttatttttaattccaaatttcagttatttcctaattgtatttctatatggactctagtctcctcttctaatatttcttatttttaattccgaatttcaactatttctaaattgtatttctatatggactctagtctcctcttctaatattccttattttttaattccgaatttcagctatttcaaaattatatatctatatggactctgccttttctttttcttcgattaatgtgagaatttctaggccatgagagcgaacgtggatgctcctttttatttcgaattttagttagttttaaattcctatatggactctatactctacttctacttccagtattccttattttttaattccgaatttctatttttttttcttaattgtatttctatatggactctatactctacttctaatattccttatttttaattccgaattacagttacttcctaattgtatttctatatggactctagtctcctcttctaatattccttattttttaattccgaatttcagctatttctaaattgtatttctatatggactctgtcttttttctttttctccgattaatgtgagaatttctaggccatgagagcgaacgtggagactcctttttctattcttttaataatataatagatttaaatccccatgttaaacaggcaaacagcgacatgagcctttccgatatctaacaggttcgattaggaaatcaagccaagcatatactccctctgtttctgaatagatgatattgttaatttttgaatacatatttaaccattcattttattcaaataatttatacaaatgtttgtataaattatgcttaaaatactttaagggataaaataactcgcaacaaaataaattataattacgtaatttt

SEQ ID NO: 67810 - DNA, 15172 bp, Oryza sativa
ttcgccatcctcgctaagtttgctcagtaatgactgtacatagatgattaaatctgatcagtttgcaggctcaatatacagcctcgatgctttctttttttcctgtctctctctctttccaaaggccaccagatacttgcagaatgtcgctgcctcgctgatgatgttgcttgttcatcctgctcagtctgggaaccgatcgaaacgtagcctgaataatgggtttcgtgccactcgaagcgatccatgtgagaaagcagagctaggaaagccagccattctcatttgcccccagattttcagtgacaacgatgaatgcagaattttgtttccccaagctatagatcttatgcttccaatctttctattgcttcaggattttatcttgctaatgctagctctttatgtcaaaaacaaaaaatcgtaattcactttcttgtgcataatgcagtactggtagtagacagtagttagttagaagctgcatgtaccagcgtggctgatgaaatctgaatctgaaaggaagctcaattaatcaatcaatacagttgtgccgatccaacacaaacacacgaacggacctgatgataaatgagattcatgcgtaaagattggcatttcggtattaattagtcgattccgatctcctgatcattattcagcacagagagaaagacattaagacatgcagagccacatatgcatccaacattccaactgttgatggaaatgctttaatttccatgtcgccatcagctgttgatggaaccagtcctggaggaaatcaacacgcttgcttgcttcctttccttccttccttcttcgacttcgatcaggttacttgttgaagaaatctcacgccacaatcaaggaacattaggattgacctaaattgactggctaagctggggcattacaatactctaatttttaatcttttcagttttgtttctgctacttgctttgcttgacgagcgatccaaaattttcccagatatctggccctgaaattcagctctgcatatttatatctgtaaattaacatagcttagttcaggttcagttattaagtggtgacagaattagaatctgagttaattttcgagtaagtggattggtgatcgatagtgtcgcacaagcttgatctgtatatttacatggccgtcgcgtaaacgcctcgctaattctttatttgtgcgtttcccgcataatctacaccccccttaattcgcagcatcgcaggtagtactagttagtactgcgaaactaacagaaacacttggtttatacgactaatcaatcggctgctttatcaattaactactgcagttaagcttaattctatctgtcgatgaattaaaaaacgagcatgtccaagtacctacgtgtattcagtgttaaattcatcttcagtagtcagtacctggccaccaacaactgctattccgtccaattaagtaaagggtgtgttttctgaaaaaagttggaagtttgaagaaagttgggagtttggaaaaaaaagttgaaagtttatgtgtgtagaaaagtttttgatgtgatagaaagttgagaatatggaggaaactaaacacggccaaagttacaataaatagggaaattcaaatcatcccttaagaggatatcccctcatttttacatgtcatttaaaaagtcatcaaaattttttaaaaaaattagtatgattgatcaatatgtgatatgtcatttcacaaacatgcaaattcaatttcaatttatacaagtagaaacaaataacaaatttgactatgaatagaatgcgtaattcacggtcaaatttattttttttaattatataagtcgaattttaactcgcatgtttaaaaaaaatatatcatatattgatctatcttgataaatttttttaatttttttgataactttttaatgacatgcacaaaacgagataatgtacactcgaaagacaaaaatccacttcccaataattactgcactggtattagtgccatatcaacatattctatgctactctatgctagtatctttctgttcgagttaatcacatgacctctctgctggtgattaaaccctgaggatggtataatcaactgcataatcacatcacatccaccaattgattgggcactgctgcaagccttctagattctgaaaactgcacatacaacaataagcattggtgcacaagtataatccaaaattagctatatcactgtgtgtcactcacgagagcaatcaaccattacaagtgtagtacctgacctcttaattatgatgactaaactgttgccggcaagcaacgccttgattcgatcggctctagcctctaccttgcacatatgcagccagcaatccagcatcatatcctcctctatataagaagcccctgacctccatggctaccaccaccacctcacaagctaattcaacctactaagctagctagctagtgacaattaagtgatcacaagtgttgttgcgatgggtagagtagtggtcgtcgtggcggcggcggcggtagccgtggccgtcgtcgtgctgctgggcgcgcggcgccggcggcgagcgcgatggagttcggcgacaaggacgtggcgtcggaggaggcgctggtggagctgtacgagcggtggcgcgggcagcaccgggtggcgcgggacctcggcgagaaggcgcggcggttcaacgtgttcaaggacaacgtccgcctcatccacgagttcaaccgccgcgacgagccctacaagctccgcctcaaccgcttcggcgacatgaccgccgacgagttccgccgcgcctacgcctcctcccgcgtctcccaccaccgcatgttccgcggccgcgcgagaggcgcagcggcttcatgtacgccggcgcccgcgacctgccggcggcggtggactggcgcgagaagggcgccgtcggggcggtcaaggaccagggccagtgcggcagctgctgggcgttctcgaccatcgccgccgtggaagggatcaacgccatccgcaccagcaacctcaccgcgctgtcggagcagcagctcgtcgactgcgacaccaagaccggcaacgccggctgcgacggcggcctcatggacaacgcgttccagtacatcgccaagcacggcggcgtcgccgcctcctccgcctacccgtaccgcgcccgccagagctcctgcaagagctccgcggcgtcgtcccccgccgtcaccatcgacggctacgaggacgtgccggcgaactcggagtcggcgctgaagaaggcggtggcgaaccagccggtgtcggtggcgatcgaggcggggggctcgcacttccagttctactcggagggggtgttcgccgggaaatgcgggacggagctcgaccatggcgtggcggcggtgggctacggcacgacggtggacggcaccaagtactggatcgtcaggaactcgtggggcgcagactggggtgagaagggctacatccggatgaagcgcgacgtgtccgccaaggagggactctgcggcatcgccatggaagcatcctaccccatcaagacctcgccgaacccggcgcccaagaagatcaagaaggtcaccgacgacgacgaagatgatgatgacgaggagcaccgccaccacgacgaactctaagctcatttaattgtgtgttttacaacagtaactggctaccgtttggaggcgattgatcgacgtcgtaacaaaataagcagttcgttaatttaatcacctgtagttgatttgattgcatgctcgtattttttgcaatctagctcgattatgtttacgctgtgtaatgattattgattattaatttgaaaaagattgttaagtatgaattttgtccgatattttctaattttcaattttcatttgcacacacttctgtgtagcacataaggtcctaagtttaaatctccataggagtgaatttcaaactaagtttctactccctccgtttcaaaatgtttgacatcattgactttttagcacatatttgaccgttcgtcttattcaaaaacttttataaaatatgtaaaattatatgtctataaaaatatatttaacaatgaatcaaatgataggaaaaaaattaataattacttaaattttttgaataagacaaacggtcaaacatgtgccaaaaaatcaatggcgtcaaacatttcgaaacggagggagtattttttttaaaaaaaatgctgcatatatccagttggatatagaggccgagtaaaaaaatacccttctcttagaaaaaattgcacacgcttcttaaatttataaatggtgtccttcatacataacaattttcttagagtgctggtctaaagattcatttgttcgtacttcgtacccttagactgtaatgattttttttaaaaaaatctatcaattttagttttctcaaacaaaactcttgcgtttttttaccggaacaaagactattgtgttgggaagaaacggcgccggtttcaggtttggcatgacgagcggccacatggaggcctagcccatgggaacgctcttccggcccatggattaggcccataaaatcggcccacaagctacctacacctctctctcgctaggtggtttgagaagaatccatctctctctctctctcccaatcccccaccaccaccgccagccaccagccactgccgcggcgggaatccggttcccgcggcgacatcccccacgtctccgccgctgcaccggcaaaggcagctgcaccgcgacccacccgcgcgctcccaatcggccccaagattaagattaaaccaggagagaccacccgatcgagtgttctctcactttcgccatggaggtactccgctacatcttttcctgcttctcctcctcctcctccaaatcatcctcagcatctgcgggctccgtgagtatcttctttaattgctagtacgtaattgtgattttactgtgcttaattgttgatccagtcctaataaggctatattactcgctagtctgagttcttgtggtactagtaattagcgaaattatggggagagttctccataatttaggctaaaaccttgtcagttattgttaattctaatcaccaccggcagcctgattccaacatttgattatggacttacaacgaattgaattagaattttatgccgactgttaattgttactagttcctttgtacctttgggatatttgatgatgatcttgattcacataagataagataatctacaacaaatttcagtgtatgtgccaaccatagttgtcgagtgccatttagagcgttgaaggggattgatttcaatctcatatgcctcatctctcatgttgctgtttttctctgggaagaaccgtttcatgttgctcctggtgctgatactgttgcagcaccgactgtggtcaagcggggctagcgacaagaacaaggcaatggttgagcagctccagaggtacgggattatcaagtcgagcaaggtcgcgcaggtgatggagaccatcgacagggggctgtttgtgcctcctggtgcttctccctatttcgacagcccgatgcccatcggttacaacgccaccatttctgcgcctcacatgcacgcctcttgcttggagctcctggagaagcaccttcagcctggcatgcgtgctctggatgttggatcaggtctcccgtatctcatatattcagtttcgctcaatcacttcaacgttttatctatgctcctaaaatatcatttcaattatgtatcatcacaacagaaacacttttgagttttgatgttctcattcacaaaactatgttatgaatcttaagtgccaaaatatagaattgcttttgtttttgagttacaacttcaactataggtttatcattacccaagatctgtcagtggagtagtatcttatctaatagatgtacttatcactgcacactttaggctttgaaatgcagaaatgtttgccaacatatgtggaaaaaacaatatttagcttcatctcacagcttttccgtgagggtatgtattcatgtggtctatgatgggctggcccctaccctataccacaaagattcagtagtaatgttggtttctttcatctttttttctgtcatactgatttatggaattaaatattgattcaggactgccgacctgtttaatatttcctagctgaaatgctcaacagatagcaaatttctatacatgtttgtcaactcgcattgcttatttacgtatctttgataacttcaacaggcacagggtacctaacagcttgcttcgcgattatggttggaccagaagggcgagcagttggtgttgaacatatcccagagttggttacttcgtctattgaaaacatcaagaaaagtgcagcggctccacagttaactgatggatccctcagtatacatattaccggtaagtagcgcaagtttgcagcttttaattgttcactttcctctccactagtagtaatgacaaacatgctgaagtgccaaggtctgaactgaattgcagcgtagagtacaattttgtagacaagggcttagttgcaagggttaaatgatactttaaataaacatgttgaacttctgtaatttgttttaaagggttacttttgtcgggtctaacgtggtaacaagttgttttaggtttcaaagagaatctttttatccataccaaacagtgagtggttcttcatctgtgatacttatgctttctagacacagacttggagcaactttgcccatccatctcataaacttatattgtgcatccgggttggcttcagcagtacttcatattccaaaacattatttacctaacaataatcgatctctgtaactgatacagatggcagagaaggttggccagagctcgcaccctatgatgccatccatgtcggagctgctgcaccgcagattccacaggcgttgattgagcagctaaagcccggtggcagaatggtgatcccagttgggactatgttccaggagctgaaagtggtggacaagaaccaggatggcaaggtcagcataagagatgagacggctgtgcgctatgtgcccctcacaagcaaggatgcgcagctgcaggctaactgaatgcactaccataatattctgctgaatgtaaaaccttcaatgcgtgatcccagttacatcaagatgttattattgtacataaattggtcctaccgtatgtgtgaatcgcttggtgcttgtcaacaatgttggatgttggttcgtcatgaagcatggaagtatgtgcttgtgttgatctcttttgcctctaatggtgtttccactacaatgtgcatgacatatttgttatcttcacaacacggttggcttagatgtaacgtatcctgcagacttgatcagctttgtgacattaaagggattggagtgtccatgactattgtggtttcctgtgcattatatgaacaatagtttatcaaagtatttggttcttgcaaatccagagaacaacatttctgaaagagaaaaaataagcataatgcataggggtaagcactggctgctgccatgcatttgctccttttctcagatatatggtcgacaagtgaacttttggattatcacggaaaaaaaatactaaggacatcatcattataaatatcctacttggaaagttgaactcatatttttgagaataatttaacataacatcagcttggaagacacataaaaaggacgggaggactcaaaatcaggaagctaacgcgcgctctgtaaatgacaaccatcagcttccgccttaacgcataacactttagcattcttgttcaaacgtgcagacatgctccccaacgccatatggaatcaaaagcctcgctgtggtcgctcagctgccacattcactcgaagtgggcggccatccaattcctgtaatccatcatgaacaattgagcataataaaagaagcataaaagaaacggtattagcttatagagcctccatatttgccatactcgttataatggtgatattcaagtgtatgcttaatgtagatggtgccgtcctcacctgtccatcaagggcagaaatagcatcatcgagctcctccttggaggccatggaaacaaaaccaaatccccgagaacgcccagattctctatcgtagacaaccgaagcgttaaccacctctccatgctcgctgaacaattgcagcagcctagagtcatccacttgccatggcaggttgccaacataagccctgaaagcaggagcaaactgccttggaggtctctccacacgagagccccttggagccgccctgtttacgttcagaagccttccgttgatatcctgtaaaacataaatttatcagccagcagctgagaacactgtgcaacttatacaatttcttctgtactatcattttatcactatgacagaaatatcttcgagctcagttttactgaacgcagttcatcgggtatgggaacatttcacaatggttaacctaaatgagatgtaccaacagtataattttaccctttgatcagataatataaattgtttcagttatcaaggtacttccaattttatgtgtaacggcagcatgtgcgaatggtgaaaattgtgaaaataaaatacttcaatggattaagaaacgactattcagaaatgcactcacatagcggttaagcatctcaatggccttgtcggcttcctcaatcgtactcatggtaacgaacccaaatccacggctctgccctgtctttttgttgtaaatgacctaaataaaaacaataattgggtaattggaaatactgagccttgagaatttatgcaattggcaatagtatcttgcaattcttctgttaaaaagaagaagggggaaattgattgtgggctggcgcgcgagtaggctcacctcggcgacctcgacgacgccggcctgctcgaagagctgggcgaggccctcgctgtcgacgtcgtacggcaggttaccgacgtacaccttggcctcctcggggggctccgccgcgaactcctcctccaccgcttcctcctcctcctcctccacggaggccaccacctcctcctccgcctccgcctgctcctcgaccacctcctcctcctcctcctcctgggaaccctcatcggcctcctccgtctcgctccattcgacgccggcctcggcggcggcggcggcgtcggaggaggcgacgaggggcgcgagggggaggcggcgggaggcgcggaggaggggcggcgcgcgggagaagaggaggtggtggaaggggagggcggagagcttgtgcggggcctgggtggcgtcggcggaggcggccgcggccatggccatcgcgagcgaggtgacggaggtggtggccatggccatgggcgagcgaggaggaggaggatgaggggggggagtaggaggggataagctagcgctactgttggagcttgaggcgctcgtcgccctccccctctttatccgccgcgcaacgtagggtgggctccttactgggcccaattgattttgggccttccacgtccaactgtccgttccggcccatttcttggaaaggaaatgagccaaccgccgtatgatgtgtggatgggatcaccaatacatttgttcacaaattttcgaaagttttaaaaatttaaaaaagatactctgtcctattcaaaaaaaattagaattattatttattttctttgtgacatactctctccatttcacaatgtaagtcattctagtatttcctacatttatattgatgttaatgtgtatatatatacacacacacacatgggagtatgtacacctgctatcatccaccgttgatctgtgattagcttcgatggatcctgatatcggattaacgagcggacccgtttaactttttgacaagaaaaaaattacgtaccccttaatttagccacggaaaccggaatgacctgagtacaattcctcgttccaccagtgcatcggatccgaaaatcaggtcactaggagagaccgcgatataatagaactcggagaaggcggcggcgattcatcgtcgattccgcaacagcagcgagattcatcgtcgatccatggctgcgttgcaggtgacggcgtgatcccggcgcggcggcctgcacgcgcggcgcggcggcggtgtagaccgatcggcaacatcgtgtggcggaaatgcaggtcatcgtcctccaaggcaacggcgcgacgggacgggactagtcgacggtgcgatgcagcaatagttgaactaacccaggcggcatcaatcactcgtcgatctcgcgcaaagccttttcgatggcgacaatgcattcggcgatagccatacgagatcgatcagatcctgtgtacaatctgagacaccagaatacatgtggttagtactacttaattatttcttatgtcgtgtatatcatatcaatcttatcttcttctttgcccaggcagtcgcatggtgcatatgcacacctcggagaggctagtgatgctagtcgtcgctagagtccgcagtacggtgtgcttgcgcatatatatatatatatatatatacacacacacacacacacatatacacacacactttattatccaaagtactttaagcacaaattttcgttttttatatttgcacaaatttttttgaataagacgagcggtcaaacattgtaagtaaaaacttaaaatctcttgtattatgggacggagggagtataattttagtgcaattgtgatgtaatgacactgtaacttgcatgtaactacaatatacttcctccgtttcacaatgtaagtcattatagtattttccacattcatattgatatattcattaacatcaatatgaatgtgggaaatactagaatgacttacattgtgaaacggagggacttttagaactctctccgtaatatattatttcggtgaaacggaggtcgtagagacgaatcatctcacatgtatacacgccgtgacttttaattcctcacttgcactgttgcacaaatcttgaaacaaatataacggttcaaaattatatgaaagttatatataagttacattatagttacatgcaatttacaatatttattatttttttagagaaaaattattgataaatatatagcaaaattacacgtggataaattggactggtcaacaccgcatccccctctatgccgaaccgggcccacgctgcctctcgtcttcctcctcggaacgactttgatttctaaccgcgcgacatggacgacgacgagacatcaattggacactagattatttttttttagggatgcatgaaacgtgctgtcaatcacattgccactattacaacagttgcattagcacaatggcggcagcagagaggatttagcttagctagctgagctcagtcactggggagtggagctggagccgcatgtctgtgctgcccatcctgccggcgccgacgagcgtcaggccgtcggggtacacgtcgacgcggccgaaggcgtcggtgccgggcgggcactccagcgccgcctccagggtgcggtggtggacgccgcgggcgtcgacgccgtagccgcccctgtggtcgtggccggcgaggcacgccgcgacgcagccgtgccggtgcaccacgcgcatcacctcctcgtagttccacatcagccccgacggcgacgccgcgccggggtgcagcggcaggtggctgcacaccaccgccgcctcccgccgccgcgccgccccgcgcagcacgccgtccagccaccgcagctgcgcctcgccgacggcgccgttgaacatcacgaaccgccggtccacgccggcgaggccgctcgggctgttcttgtccgcgttcgggttcctctcgtccaagaacctcctcgccgccgccgccaccgggtggccgcgcggccatcccacggcgctgaagtcgtacgcgtcgaggacgacgaacctgtagcccgggaacggcgagaagtcgtagtaggcgcgccccgacggcatcctgagcagcgacacgagcttgctccggggaaggttgtagaggcagtggttgccgagcatgtggtaggccgggccatgaaaacggtcgaactcggcgacgacggcctggacggcagccagcgacctgtccttggggcagaagccgtcgacgatgtcgccgaagttgacacagaagcggacgccgccgccggcgacgggatgcttgtggttgtgggcgttccaggagcggacggctctctgcaggatggtgaggctgtggcggtagtagcgggggacgccgaggaaggagcggccgtcggggatgtcggcgtactgcacgtcggcgatgacgccgaacgagaagaggggctccttgcccgccgccgtcgcccggaccgccacggcgttcggcggctgaaccagcatcggtcgtcgttgccgaatgattgccaatcggccggcgaccaccacaagcttgtcttcctctccggcgagctgtgaccactggccagtgacctgaccaggagaggggaggaggaagaagagtatccgccgcgtccaccggccgctcgtttccggggatggccggcgaggcaacgacaaagcaagtgcaagtgggcggtggtccggccatcacgtggcacaatcgatggctagtaatatttagaaaaaaaaaattgtactagtaataataatgttcagctagaaattttatttcaataaaaaagatcaaccagaaaaaattgaaatagtatctgcatctgcttaggcgttagaatcactgcagtggcttcattcctcctataaataagtaaactttaggtccctcgtcttgatgtcgagtttaaatcatatccttaaaccatatgacgtatcccttattttttaaaatcggtacaaatatagtcatgagacaatattgaaggtggttttggataacgtggcacaataagcaaaaataaataaataaccacatgggacccatatgtaagtgaaacagctcgatgatcgtgcttcggcttgagcatcaccgtcaccagccatgtcaacatccacactgcccgtatggtttgcctcgtcgtccacgcggctccgccgccgccacctgacggagtgagaaaggggataaaaaaaaaagatcgttgtttcacttacatgtggggtttcgtgttatcttttattttcttcttgtgccacatcagcgccatgtcactcaaaaccgctttcaatattatcttaggactatattttgtattggttttgaaaaatgatggatgtgttgtacctagttttacggtttagggatgtgattcaacctcgacatcaacatgagggactaatggtgaacttattccttcctcctacattcctatttccattttcacagcgtcggcccatcataatacggtccacatatttgttagttttattttgggaaaagtctgttttgagtcctctccgggagagctgccagagagagatggagtcatgtagtgaagagaggggagagggagaggatgtatacatgtggccctatgaagatgggaagtactccctccgtcccaaaaaaaagataaactctgggtttccgtgttcaactttgactgtccgtcttatatgaaatttttttataattcgtattttcattgttgttagataataaaacatgattaatattttatgcgtgacttgtttttttaatttttttcataatttttttaaataagacggacggtcaaatgttaggcacggaaaccagggtttgtctttttttgggacggatagaatagtcacttacacgaggagggctcacgtctactccctccgtcctaaaatataagtatttttacctatgaatctagacaactatgtgtccagattcatagccaatagttgttatattctagaacggaggtagtactttttattttttttgattgggcatcacatcaaccaaaaccaatctcaaaatagccgagtgagtcattctaaactgattttagtatcagaggagacggtgatatacctagttttacgacggttcagacttgagagatacaaatcagattcaaccaatagcaagggaggcaaaattgacttattttttctttcgtttttatcgtgcgagggttattaatattctttttcatcattgatgccataacccttatttaaaaagaaaaacagcaaaatttcattaaaccggattttgtgaagaaccaaacataaccaacttcctgggggtcttcatcagcataaaaaagtgttagaacaagactaggaaagattattgcacggatgcagaatcatgatgtgccgaagcgatggtaggcaggaacacgctgtcagcatagttgggttacagggattattgcaagaaatcatcatgcatgcttactctgtccatcaccacttgattaggagggatctaaatggtgatcccgctgtagcaatcttcaaacagtgcaatatatctcaatggaatatactaattaaattgcatggttaggggttagggtgtcaagagcatcaggtcggtctcagaatatatgatacgatcgtcctgtcacttgcccataatcgaactggaccttgatatacagctagcgattgcgtgttgattaaaaatttccgtgaaagcatgtcctcccaactgatgtaagcatcagcatgtcaaggttaacacctcactatctcatgtgatctcgtgtggtaagatacaagagaaaaactggaagtagcagtgccaccaatggcatgaggattatcaatcagatggccaaagcagctagcattgggtgtgtacagtttgtccaaatcaccaaccaaccatacatctataggagatgatgagatccatccttaaatcgaccagacctgcagatattggttgccgctggccattgacgtgcatactttaatcgactaatcaattcctcggatgccacctctctctgcaagctcaccacacgaccatgccaatataaacaagaaggaagaaattcgcaacaaatttatattcatcgactttggcatcacaagtagagtagcagatcaaaacgcaacgcgtctcgaatcaaatccatcttcttttttggtctcttcttcttcttcttcttcttcccctcgcatacgtgcgcaatacatagtgcattccattttattgcagcag

SEQ ID NO: 67811 - DNA, 9847 bp, Oryza sativa
gttcgtcccccgagcccaccggcgactactacctcgccgtcgtcgccgacgccgagctcgcgctgctcctcggcgagggcggcgcggcgcgggacctctcccgccggttcggcgacgacggcggtggcgccgtcgtcctcagccggcgagagcagctgcgcggcgcggcgacggcgcacaccacgcggtgcaggttccgggagggcggggcggagcacgaggtggcggtgcacgcgacccgcggcggcggcggcggcggtgagggggaggtgcgggtcagcatcgacgggaagagggtggctgaggtgaggagggtggggtgggggttccgcggcaaccgcgccgccgtgctcgccgacggcgaggtggtggacgtgatgtgggacgtgcacgactggtggttcggccgtggcggcggcggcggcggagctggagctggcgcgcagttcatggtgagggcgagggcggagaaggaggggaggctgtggatggccgaccagccgccggcgaggggtggcttcttcctgcacgtgcaatgctaccgccggtgacgtgacgtcactggacagtatgtatgtgcaatgtgttactaacaaaactagtccgtgccaatcagcttctctaattcgagttggtgattttattacagtgtaaatcatggtgtacatgaaagatataagtatatgtctccagcctgacattgtatgaacatgggtacatgcatgctgatgtgagtgtttctggttatctgaatcgcaatcaaatggcatagatagattctgatcatggttacatagaaaaaatgatgcttacattgcctccagatagcttcattgagatcaagcagaaacgcttgcattctctgccacgatgctgtcaagtaatgactcgcatgcgtcttccagcagatccagcacctgaaaaacattgtgcaaagataggttactactggagaatgtacatcacgcatatctttctcatgtaaaatcttgtcctcgtataatcggcacaacagacaacatcatcgttgcttgcacgtaaggaactatgagtacacttaatggttttgaggaagaaccatattaagtcaaatgcatgaaagaatattaatcaggcattcagcaacagtcttatttgaaggaaatgaaggaacattggcaaaaacttaaataaatccgactttcatttttgctgataatattacttagctactaatactaccccattgggattactttgaacaatgccttaaacccaggagttcatctatatatctaaaaaaggatcacttcaaaatttcttcacggatcacactctatgttattctgtttatgatcttgatagtcaaaggtgaaaattttagagcaattaattattgtgcaaaggactaagtaaggctcaaagttgtctacgatttgacactatgttttagaagccttgctgaagaattttcatcaacttcttctatgcttctcaagcatgctagtgagggcaccaaccaaacaggcccaaagactttgggcagagctaatgaagatcataggtcagtactggaggtacactttcatgcataaaatactatgcttgaacagaaaacattattttattgtttcatgctgtcatgcacacatggatgctcatgttcatccccactgggtcaaacaatgaaacatatctaacttcagtcagaaaaatggaacatatctaacatgtaatttgcagacttcaaaacaatcgtgcacttcatcatctcaccttttcaaatccttgagggcctccataatacggatctgggacttctgactcagtatgacgcttgcaataggaacacatcaacttaacctagtaaaggtaaaaagaacatttcatgtgttagttttcaagcatgaataccaacatcagcttaactgcttaaccatatggcatgttggttcttatccattcttagccttgccaaatttttggcaatgtcaggaataggtattgtcaaaattttggaaaaattgggcttttgtttcgcttgcctacccatgttgcattttggcaatgtactcaattcaaccaagccagatattttggcaatgcccatttattggccacaaaccaaatgggtgactaatttttggattgccattttttttttttggtttggttgagtttgggcttaactggacttccagattgcagtatgagataactaactactgtaaagttgtataagggtgtcagaaagagaataaacgctaggccagacactatccattatcaagcagctatgtggtcacccctctaccagaaataagagagtatctgcctatctggtaaaagaaatctaactcgtagatatggtgaatcagtcaagttgctagaacaaagtagccatcatcagctggagcaagagcaatgcaagagactactttgtagaaattgatgattcagcatttgcccgaaacaaacttagaaagtgcacttcactgtaagtgaaacatgctaaggaatgttggagaaaatcaagtaggggaataaataataattgcagtatattaattcttcaccttccatgtcatattgaaagacaaagggcatggtcaattggtcatatcaccgattattttaggggaaaacatgtattaggagaaagcaaatgtggatacttcagattgtgcatataacggcatataacatgctgtttgggttcccatagatgcctaaactctgtaagacctcaggttctggggttaagacaacaaaattaaaaatagaaatgatcaaacaagtatatgcaggatgaacattaatggaatgtttgcaatacaggaattttgtggaaaattaattggactcagcaaattcacacagaacttggggaaataatctcatgttataaatgagtcaagaactcttataacatattaacattctaaccttcttgggtccactgtctgggaggggttccctgtgtctccatctctcaaatgaactgagtaggtcttctgcacattgctccaaataaaagcacataaggcagctgaacataataaaaaaaagaggtaccgaaacacagatgagaggagttgagagagtaccataattctgcctatccattgcaaggataagatcaaaatctcggaagtcggagggtttgacaggcctggatatggaggtcacctcaattcccctcttctttgaagctgatctcatccttgagtctgccttgttaccctgaatccaagcaacacctcatcaatgatgatgtcatcgctgaacagagcaatgtacaaacaagcatggtattacagaatacaacctcatggtaaccaattgtaccagcagagtctatgagaaacttggactcaagcccacgcttgctcacgaggttccggaacacagcctcagctgcagggctccgacagatgttgcctgtatacacaatttacatcaacacaggcaacaaacaccacacgtttcaggctgtaatacacataggtaagataaggcagtggggtgaatttatcctttttctgaaaaacagggggagacgcaccaatgcacgtgaaaacatgcaaacgtacacagacaaataaacatgtcaaagaaggtagcgcacaatcttatacgctgataaagcaaacactacattgcttgtacatggaaagatgtcgaaattcacatgtactaagcacctgacacaaaattatacagctcgtcctgataaaccaagcaactagaaatttgaagctgtgaagtctgagctatatatcactacacggaacagattgtcgtaatcaaatgatcagaataatgcaacaactgaaagcagatagtccctaaaccaaattgcaacttatacagtgcacacataacccttgagagaatgcattttggtattccaactgaccaaaatctccgaattgagctgaacaaaaactgtgagaacccatcctggtgcttactaatactagcacatgcgagcatatccgtaaaacttgataaccatatcacgtacagccagaaaaactcccacacttcccaatgtgcataatactatcacggacaaactccaatggagaaatcaggcaaacgcgatggggaaattggagagataaaatgccgtccccgaattagtgcacgcacggtgcggacacactagggctgatagtcgcagaagcacccaaaatcagcgggacgaagcaatcacaggcaacttcaatccacatggacaattatcaaatcgagtggcgctatcaagcggttccccaatcagttcatggcccatcgctgagacgataagaagctagggttggtgtgatttaccgagacagacgaagaggacggagaagggcttcgcctgcgccccctctgccgccgcggcgctcgcctccgcagccatctccccctccgccgccgccgccgcagccgcaaatcgaaggcgagggtttagaaacggatcgcgaggacgagcctggccgagacccgagctggagatggagattgtagtgggaaaaggtgaagcggtgcagtgacgactggctgccacaagtggaggccgcggcacgcgcctcctaaccgggtatcgcgttgtcgggttcggagccggagatgagcaggcggcggagctcgccgcggctgctccggccatggccgccggcgccacgagctcctccctctcgcgtgcgcgggggaagctgtgtggatgggggcaattcgagcgacgagtggctcgcgccgcggaagcggagatggttcggtgtactggagcttttgaatccgaaaactccctaataatcctcggaaaaaaaaaggagagaaaaatatcgataaggttgaggaattcgtctaactgggttgggcctactggaccgttttaatatgggccgtgggttacggcctgtgggctggctgttgtaaacatttgcgtaaaaaaccccaagagaagaatttacttttcatttgaatcccccgtgtcactgtgtccgtcagatcggccattggcggctagaatcgaggcggagagtagggacttgtttttctggaaaccccctattattagtttcgtaacacaaataattgctcctcgtcgccggagcagaaggtctcgaggagtcgagacttctctcccccaaatccccagaaccctagcggagctccacctcgagatggcgacggcgagcgatgcgccggcgagctccacgataacgaccgccacggacgacgccgaggtggagcgcgaccagggcaacggcaatggcgccgtgtcagccgcacccgccgccgtggggaaggaggcggcggctgaggaggaggagatgatcggcccggctcccgtgccgccgcggccgaggaagaagcgcccgctccagttcgagcaggccttcctcgacgccctgccctccgcggccatgtgagtgttctcctcgccgtttcaggttcggatttggtagggggtgcgtcggctgggaggctgacggccgtggcttggttttgcaggtacgagaagagctatatgcatcgggatgtcgtcacccacgtcgccgtctctcctgctgactacttcatcaccgggagcgcagatggtaatctctcgcgctcacgtctctgcatcgtaccgtattcagtgtgcgatactagtggtttgtgcctttgtggtagtttgttagcttgtggcagcatgtgttagatttcggatggtatcttgtggaaatgtcaagcccttctacataagggatagtccttcactgaaccataatcacgggcttgatagacttgcgtaatagtattggttgaaaaacttttagatctatggattgatcaaatcctgtggtatgattcaataataagctgattcattttcatgtaatgggagcttaattaccatccttttctcctctctacccaggacatttgaaattttggaagaagaaaccagctgggatcgaatttgctaaacattttcgatctcatctcagtcccattgaaggcctagctgtgagtgttcagattcttatattgacttccctaatccagggaaaacatttgcattcgcaatatatattagtctatttatcttgctagttgctactcttagtcacagctcctgcctatggaactatgaacaacctcaaattatagcgtgattcagtaatgcaggtgagtgttgatggcctactttgctgcacgatctccagcgattggtctgtcaagatatatgacgttgtgaattatgacatgatgttcatgatgcgtctcccattcgttccgggtgcaattgagtgggtttatcgacaaggagatgttaaaccaaaactcgctgttagtgatcgtaatacaccttttgttcacatatatgatactcattctggttcaaacgatcccatcatctccaaagaggtaatctgttgttgctttctgtgtgtcgatgtgtatttcttgtgaattaaagtaactaaatgattcttactgcatgagctgcctctttatgcagattcatgctggcccagtaaaggttatgaaatataaccatgttcacgatgttgtgatatctgctgatgccaaaggactcttggaatactggtctccgtctaccctcaaatttccagaagacgcgtatgttgtttctctcttggagttattttcaacgtttgtgtagcttgtggttttgtcttcccaaaacattgcactgaaccaccaagtacttgagccatgattacacctaccatttccttttctgttaagtctgcagctggaacaatcctaggtgctaattaatcaacgaaccagctttttttaaaaaaagttaggtactattatgtttggtgaagatgcacttaacttaaaatcttttctgattcacttttgtttcttataataacatattatcctactttagtatttatggattgttttttcatttcacctgtcactctggcagtgtataagctctgggttggttccttttgtaatggctatatttatatgtgctaacagctgttctgtccctcttggtgaatgcatcaatccatcatcttatcaatgcatattgcttttgttttttgtgcagggtgaactttcgtttaaaaacagacacaaatctatttgaaatcgcaaaatgcaagactagcgtgtctgctattgaggtacttcttctatttgattctcaagttatttgcatttgttgcttcattattgatagagctacaggattactctgataaacgagcttgtgttgtccagatgagcaatgacggcactcaatttgttgttacatcccctgatcgtaggatacgggtattttggttcaaaactgggaaactaagacgtgtatatgatgagtcccttgaggtaagaaattccatctgtacaatgcatggtacagataaatatgttctgttataatccccaactgaatgctgtcaattataggtggcacaagatctgcagaaaagtgatatcccgatgtatcgtcttgatgctattgattttgggcgaagaatggctgttgagaaggaaatagaaaagaccgaaaatgttccacagcctaatgctgtatttgatgagagcagcaattttcttatttatgctacccttttgggcataaaggtatgctatttttttactgcacatcttttcttttatgtagtatgtgtttgatatcattatatgtacttcagttatttatataattattttttatgttcggaatgataaatgttgctcaagaaaatatttgtccttgtggaattccatcttatggatcagctgctagttaaacagcatgttttgtattagctttctagcagcttgttttgtattcattatgctcctatctagctgttgagttcatgtaaatatctggcatgttgctattgttgaacatatttctgtatgattaattctgatttcccataaatatgcagattataaatttgcacacaaataaggtttcaagaatcctggggaaggtagaaaacaatgaacgttttctgaggattgctctataccaaggtgataaagggaataagaaggttagaaaaattccttcagtagctgccaatgtcaatgacagcaaggagcctttatctgacccaacgctgctatgctgtgccttcaagaagcatcgaatatatctctttaggtacatcaattcaatgatctttggataggtcgtattggctgattccgcatgctgcttctgtagactcctttctctccagatggtttttcttaaattttaatatcccgcttctcaatcctcttttttcattatacagtcgtagagaacctgaggagcctgaaaacgcaaccaaaggtagggatgttttcaatgaaaaacccccaccggaagagcttttggctgtatcaaatttagggaaaactgctacaacatcactccctgataatttggtatgttttctcaatcatttctaaaaatggtaatttgctactattgattttatggaaattcgatatcctggtgggatagtctttgaacatttttcctttttaggtcgcatttatttacatgagtatttcctatttcaggtgatgcatacttctatgggtgatattcacttgagattatatccagaagagtgtccaaaaactgtggagaatttcactacccattgccggaatggttattatgataatctcatatttcatcgtgtgattaaaggctttatgattcagactggagaccctttgggggatggcactggtgggcaatcaatctggggaagggagttcgaagatgaatttcacaaaaggtatataagttgtatgccttttcctgtttttcttttctcatttgcagaaaacaatgcagtttttcatcttatgtaccgtttagatgacagatgtctatgcaaggtccaggaaagatatctgtatagtcatgtaaattttgcatgcactgtgcttattgttgttgaagagaacacaatccatatgaataatcctatttgaatatgcttatagtgacaactgacagctatggcggctatcttgcagcttgagacatgataggccttttactctttcaatggccaatgctggaccaaataccaatgggtcccaattctttatcacaactgtggcaactccatggctagacaacaaacacacagtgtttggtagagttgtgaaagggatggatgttgttcaggtaccagcctttttgaccaacttagtgactgtgtgtgaattttcatatcttttattgtgcttcctaatatgttttgttttaaacttaaaagcaaatcgagaaggtcaagaccgacaagaatgacaaaccatatcaggatgtgaagatcttgaacgttacagttccaaagacataagctcaaacaattggtcagtttttctgctcttgataccataatctaacctcataattcattttgttttggggattgtcttgaacaagtgactttgcttggtgttttcctacaaaatacatacaatgcaaactaatccttaactggcacagatgtcttgtgaacattaatttttttaaattgttcccttttctaaagttacctactacctccatccacaaatataagcatttgtagcatttgaaatttgtacatttctggagtactactttcccaatccaaccaccgctgcatttattgctcacttagttgtatttctaggcatggtattttccctatcaagtagagtcccaggggcatcaaattaatttcacctaaaccttattttctgttaaaatcctagaagtgatatatttgtggatggaaagaatatagtacatacattaagataatactgccagttgcaacaacattaagaatatagcctgctttacttatgtgggggctgcaggaat

SEQ ID NO: 67812 - DNA, 15279 bp, Oryza sativa
ttgtatcaccagtgctctcatgtggtcatttcgtgtgccttctgcaggtttgacattgtacgcatgaggttcttccaccctttgcaagcctgtgaaagacaaatgttctgaactttatgtgctgctgtggtgcatcgagttggtccttcaaacctcaacccagaggcagcaccatattattagaaagcactgcctttgatgaggtatgtgttccgagttttaactagctttcccatccataacccaagggcaatgggactgtaacatttttgctgtacacgggattggtattgcaatttaacaatggaaaaaatgtaacgagccagttagatgaggatacatggacgatttttccatgcatgggtgtaagggcgtaagttttattttgactagccactgaatgctgataccaattagactgagctgagtaaccgtcatttagctgccgtgtagaacgatggcttttcgcgggcgtcatgttttggcgccggctaactttttttcggtagtcttgattaaccgatgagtcggtcgacgttgtgatgttgacatggtgatgatgcccgtgtaaacagacaaggaagggggaatcccaatcccgtgtttgtttggccggcggtgcgtgctggaattgggttaaagaattgttgctgcagtggtggggcatgtgcatcgtgaacctggacacggagaggaggttaggcatcctgagcatctactaggtgttcccatctgacgctgtctgtccactgaggttaagatcgtactacaattattgtaatagtgttgcacaaggaggttagtgttggctgtgacgttgcgttagaaaatgaaaggagtagagtagcgttggttgtccccgtggtgttgaaagcgaaaggaggactagtaattagcaagcataaatgttaacctttgataacttttgggatagtttgtaatatttactccttccgttctaaaatgaaacaacctaagactaaatacaccactacttaagatcacgaatctgaatgtacttatgttcacattcatagtttcagattgtgttttatcttactatagtattttgcaatgaaggagtattaataattgatcaatcgtgctctaattaacgggcgtcagcaatggcgtgtgcgcattcgttgttgcccttttttcccgggtgggggtgagaacggtcaactgggtcgtagatccggtatgtactatgcgactaggccggcgagactagccgccctcgcccctctcgctgtttgacgaacaagagcgcgccgcgtgggcgccaaaattagttggtttggtgggggaaacgaacggagagagaggaaacgagacggaagcagcaaacctttccttcctccgatcgatcgagctaatgcctcgtcactccatcgtcggttcggtcgtataaaaagcaagcgagcgagagagccgggcctccgccgcgcgctttcctcccttgctcccaccaccacacctgtcctccttcccctccatcgtcgtctccctcctcttgtcccactccgactccgacatggcggccgcgaagcacttcacctacgtcatcctcggcggaggcgtcgccgcggtaacatcgccaccctcctcctctactctcttcaatacgcgcttgccttctcatggccatcacatcatctcactcacacgatcgatgaactcattttcattttgatttgtgcagggatacgctgcgcgggagttcgccaagcagggcgtcaagcccggggaactcgccatcatctccaaggaatcggtaaaccatccatccatccatccatccatcgattccttcctgaatgaatactggactagtaattcctaattattttttttcctcttcgtgtttctgctgcaggtggctccctacgagcgtcctgctctcagcaagggatacctctttcctcagagtacgtcacgccctcccctcccctcccctgccctgcatatttattttattttctcaacatactactaattactctcttccatttcttgctgctgattcattccgatccatctttctctctacagatgcagccagacttccgggattccacacctgcgtcgggagcggcggagagaggctcttgcctgaatggtattccgagaaaggtacaattactgcttttttttctcttttcttttccatataatttgcaatctgcagttgctgttcgatcttcatgccagagtactttgttgattgcaaattgaaatggttatccatgagttcttctggtcacttcacaaacccgttgccgtacattaattcacaggctttcagtgccagactgccagtagtactaacttggaagctaaccaaaccttcaaaaaacttgaaaagtaccagtagtagtattttataactcaagtgtcgtttcattaattctatcctctgatctctgatccttttcgagtaaacaaaggaatgccagctaatttaaatggccaaaaatattcctctataaataaaattgctaaaagtcaccattttctgaataccgcagtctttctgacagattgatggcaaactgaatgagagagtatacggtgtttccatttgtaatgttgcaggtatcgagctgatcctgagcaccgaaattgtcaaggctgatcttgcctccaagacattgaccagttcagctgatgcaacctttacctatgacactttgctcattgccactggctcctcggtgagttctcaactgtacctttaagctttaacccacaaagaaaagaggaatggtgttctttttagtaaattttggttgtgaacttgtaatgtttgtttattcatatcggtttttccagagctatgttgctcatgtcatttttttgggaatacgcgagacgcgcatttttgtattaagatgttgctcatgtcatgaacatctgtctgcttgatcaggtcataaagctcactgactttggtgttcaaggagcagaggccaacgacatattgtacctgagggatattgaggacgctgacaagttggtcgcggctatgcaagccaagaaggatggaaaggctgtgattgtcggaggtggctacataggacttgagcttagcgcagccttgaagaccaacaattttgatgtcactatggtgtaccctgaaccttggtgcagtaagtctccttattctttgcatccagaaagatttactactataaattgtgttttctgaatactcaacagcaaggaaacaaatacctctcatctttatagttgtaacgtatttggccaatgaaatctcatattggagatgccatctgttgtagtgccccgtctcttcacttctggccttgctgctttctacgagggatactacgctaacaaaggaatccatatcataaagggaaccgtggctgttggttttgatgctgatgccaatggagatgtgagcactctgtagttaccacttagtccagtatcatcttgctgtgaaggcaaatgttcaccttgttaattttttttttctgttggcaggttactgcggtgaagctaaagaatggaaacgtgctggaagctgacattgttattgtcggtgtcggtggcaggccactgactcatctcttcaagggtcaagttgcagaggagaagggtggaatcaaggtttgtccggtttctgttcatctttcagattctgctctatctgctacatttgttgcgtgatgattgtatttcaggctattgtccatttgagtcaccctaattagcaactgaaccttctttcgagcttgttcttgcttataccttcgaattagctgaacatttcaaatctgcatgtgtcttccagactgatgcattcttcgaaacgagcgttcctggtgtatacgccattgccgacgtggccgccttcccgatgaagctatacaatgagattaggagagtagagcatgttgaccatgctcgcaaatcagccgagcaggccgtgaaggtgagccatccgttcgttcttgattcttcatcctcgttgccgccattgatcaggattcagaagttctttgtgataaccaaattcactggcttcaatgaacttgcaggcgatcaaggcgaaggaggccggcgagtcggtgccggagtacgactacctgccctacttctactcccggtcgttcgacctctcgtggcagttctacggcgacaacgtcggcgaggatgtgctgttcggcgacaacgaccccacggcggccaagcccaagttcggctcgtactggatcaaggacggcaaggtcgtcggcgtcttcctcgagggcggctcggcggaggagaatcaggtcattgccaaggtcgccagagctcagccgccggtggccgacgtcgaggctctcaagaaggaaggactcgacttcgctgccaaagtctgaacctctctatgcacacgcatttcattttgtggacgctgtgatgctgccatcttttcgattctgagcttcgtagtgattttgttagctccgatcctatatatggaggatttgttttgttctcattgtgaatttgtgatgtagtcactgtggcgaggtcccaataatgtctgtactctgtagcttctgtgattggttgttttctttttaaaaaaacctgtgtatcgtctgtgtttcttttttttttatcacggattaggctgttctttgctagttacttaagaagatttgacaaatgaaatcagaacagttttaggccatcttctttttagctactcaattagagcatgtttggtagggactctaactcttaaatttaacttcaagagccgtgtttggagtggagttgtggagcagtctaaatctagctccacctccctagttcatccagctccattctcatttttggtgaagctgaaactgtttggtcgggcttctgcttcagaatagtgtgagagctaaagctctatcaataaacccttattatggattatttgctccatacttcaaaaatatttgattcataatttgtatagataatccactacaataattttggttaataacctattttacactgggccttaatttggtgagtttgagttagtacgaaacgaattcattttaacttgaacactctaaaattctacatatctatcgcggtgtgttgctatcgggatttataatttttgtaggaacttataattgtcatagacaaaatattaatatatgggattgtacagcccctttggcataacatttacgttgttgggatattattggattttactaacagcaacagatagttaaacctacgagcttgctaattatcagtactcgcttcttctcttttgttattgatttgcaataatgcactaaaccgcaaaacatatatggagttatggattattactagtaagtttgaatatttatagttacgttattgctagaatttacaattcagggtagcacgcataagaatatctaggattgtacgacccgtggacattgcatttgcaatcataggatattgttagattctggtaaaataattggtactcacatgatgttatagttccttaactaattggtatagtatccaccaactagattgctgcttcaacatcactcatgtttgctcttcgattcactaaactgcagtgcacatgatgttatacagttccttaattggcacccctcctaaaacttctacaatttaaaatttgtgctaaggcatagcaactttttttcacctcaaccagacacaatcatctatcactttttttcacctattttacttatctcaaccagtgacaacaatcccttatttaattttactatctctttaatatccgtaaaaatctcaagtatttatgtttttgagactgacagagtagtctactatttttcttgcaatttgtaaagtctactatttttcttgttatttgtaattacataaattatacgaattgtaaagatttggcacattttttcaagtgaaaatgccacttgttactttttaattatgcaataaaacctccaagctgttgcttgagatgaactaaagtcaactaaaaaggcagctttgggtgtcttgttacttgtagtagttttttaatatcaccttaatttacttcatacacatagctgtgtgatcgcagtaatgaacagatatacacgaattataccggcattaaacatgaaataaatatacacatttaatcattcctataccaagggctcattcctttataggaaagggctggggaaataaaatctaaccaaatttatgcgattattgttccaactccagctcatgctcatcaattcaaattaagtagaaattaaaattaaattccaagagcagctcacaacagcacaaaagaaaattaaaacttgcctttgggaatccaatgcccactcctccccatataaatcacacccgtcgcatcgctccgattcccaatccccacgcttccattccatccatctctctcgctctctcgcttgctcgccccgccgattcccgatcggagtgaggagctcgccgctgctgcttgccatggcggccgccgcgctgaccagccagctcaacgccctcgtcaacaacatgttcgccatggtgagtgaggcgcttcacacgctctttttacgaattttttgcgccatttttggcggaattccgggtgtggatgacgagatttttttggggttccatgtgtgatgttattgttggattgtgtgtattggggagttagggtttgctggacgaccagttccagcagctgcagatgctgcaggactccaccgcgccggacttcgtctccgaggtcgtcacgctcttctgcgacgacggcgagcggatcatctgcgagctctccaggcagctgtgcgtgtaactgtttcgcttgcttttgatcggatcgttcgtgttcgtgttggggattggcttgattttggtttgggagatttgattgctgcgtgtgtgtgtgtgtgtgtgtgtgtgtgtgtgtgtgtgtgtgtgtgtgtgtgtgtgtgtgtgtgcagggagaagccaaatgtggattttgacagggtggactcgtatgtgcatcagctcaaggggagcagcgcaaggtgagcttttcccctgtccttttctggatatggaaatttatgttgttatggataattattgctgttattgtcacttggcgcacgaaattgggtatgagatccctttcgaatgggagaatttaaagcgttgtgcgaagcatgtagtcaactttgggaggattgtcatatgtttgattattgcatcttttatggcgtagaatctgacaaaaatggtccattccacccaaagtgattggacagttcgaagagcagcggttcacattgttctatcatatgaattgcccttctgagcaatttgggatgggttgtcgtccgtttgatagctgtatcattctatcatgtagatatgacaaattcagtcccgctcccatgttgatcagacggttcaaatagtagcattcatattctcctgttccttgtggtgctccagatctattcaaggaggattgtcatatgcttcattgttccagcattccttgacatagatctgaaaacatgcttctgttccatcacacttattgaatggttcgaagaactttcctccattccaaaatgacttggtttacacgtgagagtcctatagtttgaaatgcttcatatttacgaatattgtatctaattttacttagaattctattttttgttatttttcaaacccggagtgttatcacattttagattagttggtcattaaaaggtagactgctagagaatatatcatagattagtgagagaagggtctaatggtattcctaagtgtatagaccataaactacttcaccatggatggtccttcagagcttctatgcaccatatgcacaaacagtagtaggatgacacagcatgtaaaattcctgtttaaatgccttttttttttttccttttggtgtagtcatggttttgtacctttacaccttccttcctcgagatccctaatttccctatacccgaagatatcttcctgatggctacaaaagaaaaatgtttccatttgagatttgtttactgaattttggagatctccttacttggtcatatctgcaggtgctatcaaattttcttcttgctccagatcttaatagtacctagaatttaatcctgctctttatcagtatatcctcagaatgatgttttaaggtacattttgtaagggtacactgaacctattcaaacaggttgtctggagtttatccagattagattttttttcttgaaacagaaatttaaataagaaattgacaaacaaatcctttcgcctattcaatttgggttcaggtatatttatgtactggagtgttattctacagaatcaaattatgtatgaaaataactcaccatggttcttcatgttagatctccttatatatttagaactggaactaccaattggcattcatacacatcactacaaatattaaatcttgttgatagtaggcaactcacaagccagacggaaatgatcaataaaaacatgcaaatctgatagtaatatcatcgtcccagaatttctagtaggtcaatgataatattgcattgttgaagatataatcaaatttgttgctcgtctttccattaaagcatttgaggagccttcctgactgtatatccttgcatgtttgcagtgttggtgctcagaaagtgaagaacacttgcattcagttccgtgagttttgccaacagaggagcagagatgggttagtacctattaatacagtattcccatttttttatcatattattgcacatatcgttatatgcatatcttaacgatgatctagtgcactcttttcttacattttcctattgttagtgttttctgtggtataatgttgacgtaatttcttgcattattttttctattgtaacatatcttcatggaaagcaacaactggctgattctactctgcctgttgacttaggattgtaattgctccactccaatttccaagataatagaatcactttaaaaggtgtgactaatgtaaactctatggcaggcatgccttgatttgaaatgaaatagtttgattcttatacagaactggtagatttttcagtatttttttcttttttgaagaaagggcaaaagctttgccacttatgtattaataaagcagaagggccatgacaaaaaacatttacaaaagggaaagggaaaaacaggggatgtgatgctcgcgcaccagcccaaaaacactacactctgctagtcgattattcccaggcgttttatctccttaagcttgaccgcacctgcctttacccaggctgaggcttcttctttgatttttgctagtagggtcattggggtggttgcaacatgacggataactcttgcgttttgcaggttgtccaatatgcccccaaatattttagcatgcatatttgtagtggaaccaagttgttccatcctctctgtatgttgtgcagctattcagtaaagtagggtcattttggtttgaaatcctaccaaaatatttgtagtgccaattcttgggcaagttttggcactacaatttttttggtagggtagatttatctcaactccatagatttagcaaaagttggttccaatccaaatggctaccaagtactactattcaaggctaccaaatacttggtagggcaggaattggcctcaaaccaaaacggccctaaatctacattatattgatctttatatcttcatttatgtaatagcctaaaataaaatatgttatttttgtgacaattgtccccttctttgtgttgggccttttccattatcaggtgcctcaagactttggatttggtgaggactgaattctatgatcttcgtaacaagtttcaggctatgcttcaggtattaccttgcgttcccaaattacatcctatactccctgttgtgttgcactgagttggagtggacatcttaaaagtaagtgattttgtgtaaggtttggaagtgatttgtaaggtttgctttatgattggaacattaaattgtagagatggttggatatgatggaattaatactgttactttccgtgcaacacacaaaaacaatcaacaatgattagtctgtttgctgaatgaatagcattagtcttttcatgacacatatatgaggtagtacagtggtatagttgctgtgaagcattaaatagcatgcgagataatggcagttggcagaagatgaacatggtatatttatttctttacaaagttggttttttttctttgtcatttccagtgctacatttgtacttaagcctttacgtggtaccacttggtgtggtaataattatgacttacagatatcgcactcaaaaaccttgtttgtcttataactattttattttatcccatccttgcgtgtggatatatctatgggataattccaagaggcctagagttgtttggtccccaacttgtatttttcttctcataatatgggtagacctgatcttttacctccccagtttggccctttctcatttctgaatggaaaatggtcatttaattctggcttgcatttttcgatttcttgggctgtcaaatcttactagtcttatgacctgacgatgcaaatttaccttaaccatttatagaactgatctgttattttgctttccaatgcagctggagcagcaaatccaagcttgttaccctaaacattaaactggcgcgacagtggagctgcatgtttacacaactactgtgcctttggagttgtagaacatgctcgtttagcttttatcttggagtcatttgtttctgggatgtctgtagctgtttagcaacaagctgatctagctttggcaccttcattactgagtagtcgctctcagtttctgtgatggggacaaccgtttccagcaatttgtagtatctgttgttatctggtgtctcagctatagtttttttcggtcgtttagaaatgcaacagctgtgcaatttcgcgaaaattgcattttgctggttgattagggcggcttgtggtatgttgttgagaacaaagcgatacttaatatcgatataattgctgtttgaaaccatgtgttgtgggatgaatgtgaaccgtgccttgtttatcatcttgctcaggtcaagttgaattatttttggattgacatgcaccagaacagtcaagaacacatctacaatccagcctttccatcatctggtatgattttccatatcctatatctcttgtggttgatgcaagctactccagaaatttatcctgaaacactgcatgcaaatttgcaactggttctggggagtttaggtgaaaaatgggtgagttgtgtccgttgttatgaacccaaatgaacggaacctgtaggtttggtagcatttctgcattagctggccaacatcaacatgttactccctgcaatgtacaacagattcaggtttagctgcacacaacactgaatttattttaaggcaattgctgcactgctgaggcattgagaacagcaataaatcaaggtcacatgcattgtgccacttgaacagttggaactggcccttgttgatggctatacctaagcttaggtggactcgttcatcatacatgtactataatactactagacttaggaaaagtggtcctaaatactcgtacattgttcctacttaggagaataaatgtataatagcgttgggctagctactgtcatggaataaatcatttcatttattattattatacgtctaaatttggaggcgattacaacaaattgtttcccttcttggacctcagattttttttttgtctttacatttaccgtcggaatttgcacgtgattccttcaaattcttgtgttccaaacagggtcccggtaagtggaattatgttatttttctcctccctttgacctgaaaaagattatattttcagtcatcctaagaaaattactagtaagggggaaataccatagtctctctggtaagtaagaggtattgaagggataaaacttcgattaaggatagatataagatgataggaatcgattgtcttttggataaattttgaacctgaaatcaagtgttttttttaatggaggggagtaggtaggaagaaaagcagagagaggtgaaaactgacagccaatggcaccccttgaatcgcaatgctatatacatgtctcgagaaagaaaaaaagatggtactgtaatgttgaagctaaaggagcgcaagttggatgcacattgttggcaggcggttgttatttttcaggaaatctgtttcccctgccggcctaataatgccaataaatgcaaggcacgccgagtaggtctagcagcatttgcatctcatgccgtcttacttgctgctgctgctgcttcactggcaccacacactggggcttgctacaacagtatcttcagaattgcactggtagtatcaatctaacatactcattcaatctttttgatgatgtgatccatgcagacatccaacatgcatgaaatgcagttggtggctaaagtttcttgatggtactgatggaactatcagtctccagtgctgaaatcaagaaaaagggtctgctgttgtaaccaatctgcctcttgttgttagctaatccagctgctgctcgcaagtgtcgacatgcttggtttcgtgcaatcactcattgacaacaacaccctttgtcatacattctctgtcttcttcttttgcagccttgttgagtagcagtacaacttaaactctactactcaccaaatgcaaatagaattatgccaagcagccaacagatagatagaacggtggtgatcgtgctggtaagatgatgaacaagattattacaggaccgatggataaagcagtgtaaagatcaattatcagtagtataaaaaggacatagcaatagtaagttgtgaattcagtgatgaggagtggaagaatggcaagggcaacaacaagaggcattcaaagagctgcaccttcttcctcttgtactttaccaaccctagcagtagctttcgatgtgcactcctcaagatccgttatactatctgaaatttcatgatcccagggatacattcctgatttcctgcctgccttgtgacaggaaataccaggaacatagcaagagggaaatgcagttttgcatgattggccatgttcagttaagatcaactctgaactctgtttttcataatgcatggcccaactctgaactgaagctccaaataaaaagatgattttggtttacctagctcattgtgcagaaatgcatatgctacacccataactgattgttacatatggatcaattaactatagatattccacactgaaggttgaacagctatatgttgatttgccattatttgttggtcgggtaaagtttttcagtaccagccctgttcagtttagtgttcacttctcctttagggtgctgaatgctggacaattttatgagcctcccaagtatggtaaataattaatgtagaacatatcacaacaccaatctacccaatggcattgcccatggatatacttggtttttaatttatgctgcttaccgatcaatccagcccaactttgttactgtggcatgcatgccagcaaccagcagcagggtgaatagcatattagcatgtgtcaaataattttgcttatcatataagcaagacatagtagggagtaatcacgctgctgttcattgatcactacatgcattcttaccacttactgttctgtgtcctaatagggagtactacatgcagatactgaattccgaatccatttttgggtgtgtttagttcacgccaaaattgagagttttcactggacaaaaaaagttttcgctgggcccaaaattgaaagtttgattgaaattgaaacgatgtgacataaaagttgaaagtttgtgtgtgtgggaaagttctgatgtgatgaaaaagttggaagttggaagaaaaagttgggaactaaaccaggcttttgttagctagtatagctcaaactagagaagcaaacagagcggatagtttccgttcgcttcaaagaaaaagaaaccacggatacagttcgaagcggataatccggatatacggatacggaacttcaaactagtcaaatgaacaagttctagaattacatttgtttgattaggtaggtgtaacagataccttttgtttgtcgttattttgttcttctgattattagtggggacaaaaatcagataataacacagtggtcaattaatccattgccttgaaggaagaatgcagcacgtacaataagattaaatgatccttcccgaaagtgctcgagttaagtcgaacacagtgtggttggactgaagtcaactgcagattaaggcaggcagctgagagatcagaatcaatggaaagcaccattatgtatgaactggtcagttggcccatactccttttgttaaattgaagacgttgtgattaatttgtttgctgcagtggttaagatttgatcatttcgttgcaactacatacatacagcattgcaaattgcagcagcagcaggaggaggcaagactgcagtgctcatgtgaatgtggtcctctggcggcattcatggtttcatcttattgcaaaacagtgattttcctgaccaatcagaaattcacaaccaatagaaagaagatacacacaaacaacatattttagataacaaagatatacacaaacatcttgattacttggatgatttggaaggagagaaatggcaggatatttgaaggagtcagtcagaccgtcgccgaggtctcctagtgcatttctgaagaatggtgggcatggtaagctgctggctttggaggcatcacgattgaagagatataaaatccatgtatacatgtagttaggcgtttgccggcaaaaacctttccttgttctaggattgggatgtgttcacaacaaacatgttggttgttttatgtaacatctcctcattttcttaatataattggtcggggttttcctacgccgccgaccggcgaaaaaaaaaataacaaaggcctggtttagttcctaattttttctttaaactttaaacttttttatcatattaaaacttttctacacacacaaacttctaacttttccgtcacatcgttcctatttcaatcaaacttccaattttgacgtgagctaaacacacccaaagatacctccgtctaaaaataaagtcgtttctagctataaatatagaaatagtcatttttattt

SEQ ID NO: 67813 - DNA, 2263 bp, Oryza sativa
tctttcttgtccgacaaggacttgtatcaacccatggatatgaatatgtacacccaaggtctatgtaatctatctccacgatcaatacaattcggcgtatcgccaccttttacattttctactttattttatcgtccggcgggacttggcacttgacgcggggctgcatcggtgttcgatcttcggcgaagggataagtccaatgttccgtcggtctaggcaattgtatcgtctacgtcggcgtcgttcaagactgcatcagtacattcgacctctgaattactctggtttggataatatatttgcctggctatttatcatatgtctatgttaatctagtcctagcatctcaatttagctctatcggctgtctctcgttttagggtttctgccggtatcggctaaatcgccttgctatattagattagcctagacatctaccaccctgaaaatcagtcaacggcttgattgtctagatattgtgtttcttttcatacttagtgctgcatcagttaagtttgatctactaagtcatgcttagaaccataatctctagcttgctttttgactgccaataagggtttcatcggggtttcagccgatgagttatctggacgttgcatcggctcataaggattgcatatacatataagttagatttagccgatcgcaacatagatttcattgtttaatctaatattgtggatttaatgacatcggacctccagccgatgtatgctttaaccttcagatcagtgcttattatatattgtttctagccgattggtttctatcggattatattattgttattttattacatcctcatcagccgattgctttcatatcattatctacgttggacatatagccgattgcttaaaccctatcgctatcggctggtatcggcatcggctattatcggctatcggctagaactactccatcggcttgtcaaccgatcggctgttttgatctactatttgcatatcttgtcagttgcaggatcaaactgactggcacgctcgcatctaatcaagatttggacctgcacaggagataagcagatctcccaggctggtgtgttcgattttctcgtcaacaccatcacatcaaaactttcctacatacacaaacttccaacttttccgtcacatcgttccaatttcaatcaaattttcaattttaacgtgaactaaacacacccaaagatacctccgtccaaaaataaagtcgtttctagctataaatctagagatactcatttttatttataaatatagacaggaacttatccaagtttataacgccgtgattagtttcaaaataattcttcaaactttcaacttttccatcacatcaaaattttcgtacacacagatttccaacttttccgtcacattattccaattttaaccaaactttcaattttagtgtgaactaaacacagcctaactagaaaaagtttcattttaggacaacggtagtatttatcaaactcataccggtgaattttggtatatatgatggatactgaagtaattaagtaaccattttttttctcaaattaaaaattgatattagttatctatgtgatgtaatttagcagtggagcgaaagtacttgtaatctagcggttaaaatgcttaaatatcatccctagatcctcgatgcactcctcgcgggagcaaatttcagacctaagttaaaaaataaagttacttgttgactcccgtaaaaatatatgttaagaatcgatctatgggtaggttcttatctatgggtaggttcttgttctatggggcaggggtcttaaagaacgggttaaaaaccgatccatagaagctactccgcatgtgaaagaccaaccattttattgaggcttttttctttttaatgaaaaaaagagagtcgtatttcaggagtgtgtactgatgaaccatttaactctcccttcggctgcagctgtgcatatggacagcgctatctccctcctgctgcattaactcttcagtaattccgggcacacatgcacagatgatccagtaatactctgacacgcctagcaggatgttaggtgatcgtctgatcaagcactagtgatcgataatcctgctccttttttattacttattttttgaccgaattggtccagcttatattggaagcaacaagagatcgatttgcctatctaattgcctatatatatctgcacatgagcctccctcttgcgtgcctcactcacagtcacaggtgcttgctt

SEQ ID NO: 67814 - DNA, 3827 bp, Oryza sativa
tgtgcatatatatagtagctagctagctagctagatcttgttcttgttcttgttcttgttcttgttcttgcaaggactggatatgaatgctcattgctgatggagctcattgctgctgctgctgcatatgagtgcagttcttgtggagaagatactgagggtgcagcctgatgtcaagaagatctacctgctcgttcgcgccatcgaccaagcatctgcaaaccaacgcgtccaatctgaggttgattcatctcatccatccatgcatctcttcctatttttttatacgtacttaatcaatttcgtattatcttcgttttttaatatatgatacggctgactttttcctcaaacttcgactaacaatactattcatttatttagtcaattaaagtgaaaagagtaccactgtatctgtcatcaaaagtattttaagtatacataatatctatttgtataaatattaattgtagaatggaccaatagtcaaataaacttaaaaatggtcaactgtgtcatctgttgaaaataaatggaggtagaatttaaaaggagacgtatatcacctagtattaaaatacgtacatggctgcagttgattggctagttggtgctgtcaatttttttcttgctccatcagtttctgtaagtaaaataatatgtgttggttggcctgttactgtatttttcgccggtctgccaagaaaccaacttgtctgcatggtcttcttatcttgtactcctcgacacatccaatcactatcacttacaagcagtaggtaataagctcacctactgcgttgcaaatctactaattttactgttaaaatgttagaaaaatagaaagtcatcacgcactcgctctgatcaagtagtccgctgaacttacaagttactacaacggtatatataattcatactatagttgtgttgatatgactaatcttttgaacataaataaacatgtattagtactagtacatatatagctgaaattcagctcgttattagcaatatatagatgcatggaaaccgtgtagctttctcatgcctactgattgattcgatatgtgactatgtgagaggtgacagccatgtccttttacgctgaataggttgatgattcgtgataatatcattcgatggtaaaaataaattaattaaatattataaaattgcaaatcaaatttaaattcatttataacaaagtttacactaccatttagaagctcgggaagcgtatatttactaagtcatttcattccttgaaataaatataatttagaaaatacaatttaaaagcttggaaaacataaataaatataattgaattttaaaaatcattatagttatcctgttattttattcctcgaaaaataacagtgtcgggtatagttgtgacagagtgcaaggatgggaatgttgataatttaccgcaatgaaaaacagttcgacgtgtgtatcagtgtagagctaccaagcagagcatcatatcccagtgacatacggtgaagtcttaaaaaaattaacttctgactagtacgaatcttaggttggtctaagtttgtctgatctgagccatccgtagaagggatcgatggttcagatggagcagaatgtaggcattattagttggaagctagcatatgatgaggcgtgggcgtccaaacgaataaaaatcttttaaaattaatttattgagtatggtcagaatactgctaaaatgaacattttcaaatttttgctatgctaaaaaattttgagtaagttgacagcatatattgcctttttaataggatagactaaatgtggtgttgccggaattctctaggtaataaactaaataccatatatttatcaattttatcaaacaatgatacagtttaaaataacatcaatctaaacaggttcgttatttaagtactacttactttttatgctaaatataactatactagttatgttcataaagacaatattgtaattctttaaaaaaatgatagtcaaaaatgaattcacaccaattaacagtgtcaagcagtaaggtatgcagtagtaataatgaggtgatggcccatgcggcaggtttgctgttgcagctgttgcctcatctcttcgatcccacgatttttttttcctctcgatcgaaacattgtttagtccttaatttttttttcaaaaacatcacgtcaaatcattggacacatacatatgtagagtattaaatatagataaaaaaattatttacacagtttacatgaaatcgtgagacgaatcttttgagcctaattagactatgattaactataattgctgcagtaacctatatgtactaatgacggattaattatgtttaataaatttgtctcacggtttccaggtgagttataaaattagtttttttatttatgtcagaaaacctcttccgatatccagtcaaacgttcaatatcacacctaaaaattttcttttcgtgaactaaaaattaatccacgcccaagactgtgatatgtaatctacctatagctgcacatagtacatgcatatgcatatgctgttctgatcgatatatatccatgcatggttggttattgcttgttgcctgcagtcgaattcattccttgcttaaataatttcactgcagcatgtgcgtactatcctgctgcaacctgcaccgtgcataataatgcacattactagtatactgtatttttcatgtgtatggtccaatatatccagctatccatccattacacagcaacactttactcaaatactcaatgcagagctagctgtactctgcatatgcagacatataaggccccacttgcggtgtgcattcaccttgtaatgcacatgcccgaagctgctcattatcttaaaaaaaatacggctctatcgttttacttattcgggaaaaagccaaacagcatatttataaaaaaaataatttatgaataatattttttttatatgttcttattggtctaaaagtaaaggctgaaaaataaactttaataaaaaatacaaaataaacttaaaaattaaaaatttaaattttaactaataaatataactataagcgaaaagacgagtccgatatctgtcgccggaaattagtactccactactgccagtaacatttactgacaaggcccggtacattatagtaaaaagaaatgaaaaatatcgtgtgtttgttgccatgagtacaggcatgaggcctgcatgcatgttgacactgacaacatgtttaacaggaggaggcatgcacagatgcactgtgtattagctctacgatactatacttacgtcctagaaagaatagttaattagtactaccataactgcacacttgtactactggttacagctagtagctgcgaaactacatgccgcagattaacttatagacgcactaggaaattaattaaaatgatgcgattaataaattaattaatgtgaaaaaggaaaacatatgcgtgctgtgcaggtgacggagacggagctgttcagcgtggtgaaggagaagcacggcaagggattctcgcgattcatcgaggagaaggtggtcgccctcgccggcgacatcatctacgacgacctgggcctcgatcccccgttgcttcaacacctcgccgacaacctcgacgtcatcgtcaatggcgctgccaccaccaacttctacggcaggtcggtcggtactatcgattcaaatatagtacaaatccattcaattcagttatatattaattgatgaaatggaatggaatggaattgccttgcaaatgatgaaatgatcatgcaggtatgatgtgtcgctggat

SEQ ID NO: 67815 - DNA, 15080 bp, Oryza sativa
atcagctgattaattaagctcgatcgatatatatatagatgcagttagtaattaaattgaagttaattgcatgcagcttacgcgggcggcgagcaggaggggctaatccaggagagggcgttcgaggaggggtgggcgctgcgagaggggatgcacctggacgtggacgcggagcttcggctggtggccgacgtgcgtcgggaggttgaagacgacgacgacaaggcgcggaggaaggcgatgaaggagctggggctcgccagggcgcgccacttcgggtggtccaacacctacgtcttcaccaaggccatgggcgagatggtgctgtccaggatgctgctgcaaagctcgtcgccggcgccggcgatcaccggcgccggcggcgtggtggtggtgcggccgagcatcatcacgagcatccagcgggacccggtgccggggtggatgcaggggacgcggacgatcgacacgctcatcatcgggtacgcgaagcagaacctgtcgtgcttcctgggcgacctggacctggtgatggacgtcatcccgggggacatggtggtgaacgcgatgatggcggcggcggtggcgcactccggcgaggccgggcaggagcggccggcggtgtaccacgtgagctcgtcgctgcggaacccggcggcgtactcggtgctgtacgaggccgggcggcggcacttcacggagaagccgagggttgggaagcgcggcgaggtcatccccaccaaggagatgcacttcttcaagaccatcgccagcttccaggttaattaatttactcttcttttttttttattttttaataatgaaagtttgttactgaattcagtctattacgacaagatgatatataattaaaatgcacattaccaaacacacagatcgatccaaaagaattacaaggttattttttaatggtatttctcttctatagattataagtcgctttggcctttttcttagttaatttttgttagtttgattaagtttatcggaaaatagcaatatctacgataccaaattagttcgattaaatgtaaacattgattatattatcataatatatttgttttgtgtgaggaatactactacatgtttctctgtaaatttagttaaagttaaaaaaaatttgaataaaaaaaatcaaaggatatgaaactgacggagtagaagcttttcattgaagtgtgttgtcaagatgatacaattacgataaacattttaatgtctgtataattacgatgcacacgatcaaacagatccaaaagatagaaaagaattacaagttggtattgatttttgcaggtgtacatgctggtgaagtacaggctgccattggagatcctccacctggtgaacctcctcctttgtggcctcttctcccgcctctactctaacctcgcccgccagtaccgctacgtcatgcacctcgtcgacgtctacggccccttcgccttcttcaaaggatggtacgtactacctacgtatttctctacttttatacacgtatatacaaatacctgtacattactactaacaagtaatcattactgcatgcttggattatatatgaagcttcgacgacataaacttggagaggctgaggcagaggatggggaagagcaggaaccctcaagacgatgaaatgttcaacttcgacccaaagaccatcgattgggaggactacttctacaggatccatatacccggtgtgctcaagtacatcctcaagtaaaacacacatggatgatgatggattatatcatcatgtataacagctggatgaagaagacttaagtattgtactctggctctgctcctccctgttacaaatgccagcaatctacctaagtatgctgatactagcttgtatgggaatatgcatgcttgctcaaagaattaatctttaatatatgtcaactactagactaagtaatgcttgtatcggagaagaatcaccatatcttaatcaataataatacactgtgtgcttgtgcttgtgtcatgtactaccagctttacttgtccttgcttgtgctctgggtttcatctgcaatctgacgatgaaaattatttttaccagtatgctatctctctcaccatgtagtgaaatcaagtcaaaaagttactctactcaagcgtggtgctgctatactttttagcttcaagcaattactgagcaaacgcaaccaacaaccgagagagttgtgacacaattagcacacagtaacacggcgagtggcaaactgatttccgaatttgaaatgtatatctgtggcacaaatgtctgaaacagtttgtaataatgctgtctttcgtatgcagaatttcaatttactacatatattttgcttgtagctaggaagcaaacttctaatcctcctattacatataataagataacagattgttttggtcctcaggtctgatgcctactagcccagaacaaaccagtccttattctgttcttaggtggaaccaggttgttttgagccaccagacttgaactcaagaaatcaaaacaacatatcttcttattcataggggaatagaaagcttccggtttccaggatctaatcacaactctgtatttgtcaaatttgcttgtgtatccaaaagcacaagaaataggcgtaaaatcgctcatggagccatgaggagttccttcacgaatgcgagaacatttggcacatcaactgtccatgcaactgagattggcttgtagccagaccatggattctctgaattccacctgcgtcatagttggaacaagcaatcagtaacaattacagtagccatatatcagtgatagatgtgcttgtcaaaatgtcatgacgctagaaaggtaaatatgttgtgattaacttagaaataagtacaatatcatactttttcaatccttggtccattaaagtgtgaccagtgcaaatgccctgggtttctactctcacaacacccttcttgaacgtgaagtactcagggtgaactagggcagtgaagctcacaggatcatggaggaaaattcctgaacacatagaaataatcagctaaagtatatttcagtttgaatggtaactagcagaataataccaaaacgagaggatttcgatataccatgaaagccatcggattcggcatgccagtctctatagaactggcacatgtcacataagaactgtgcatgcttcccttttgagtttcttagctccaggagatcctcatctgaaagaaacagattttacttgatgaatataattgaccccacagctggactcgaaccatgcaaatgacactatcaaggaacaaacctgtaaaacagacttgagttgttatgttaatgccaaccacgtcaacatctgctcctgaggtaaaaactatgtcagctgcttctggatctccatatatctgcagagttatgcagcgaaaacttaatacttgtgtcaatgtattttttctgtccatgtacaagcactagtctaatatgcaataatgacattacatttgcttcagcagctgggctgacatttccagccgcaaagaaagcaccacccagtacaactattttcttcaccttacttgcaaaggaagggtcccttttgatggcctaagaaagaacacagacagacttatcctctgtcacggcatataaagcaacatgctaaacaggtttatcctgtaaatggaagcataccagcgccacgtttgtcaggggtcccaatgcgagtatagaaacttctccaggaaattgagagaccttattaaccatgaactcagcagcattttcatcaaccttcttactagtgggtgcaggaagaaacaaattccccaggccatcagacccatgaacaaagtcagcaacacgtggctctcctccctaaagtacaagagcacatcattaacaagctcatccagataagcatggggcgttgactggaattgaataggaaatgtagtatgatcggaagtctgcggtcttaattgaatcggtggcatataaaatgttgatgcttatgcaaataaaagtaaactgttcaatctatattataaatagaaaaatgaatattatattaagccttaactcccacgggcaaaaaaaaaagaaggttgtgccctgtacatccaataaactaggaagactgtttcgtcttatttttaagatgtcacattagctacacatttatgattgacgctaatcaagtcagcactcaagagccatttaaaattgatatttgacaatgtaagcaagcataaacgaaggaaaagccatcaaatttgaaagcagccatgaagatcggtttgtgcgggagaacatgtatcaagattcatgttgctcgtcgtacacgctaagtcttacattgttacatataactgtataagcatatcgtgaaccagcgtaccttgagaggctctgcgctgccctctgctactggaacctcaggatgtcctgctctctcacactgtcattttcaatacatgccgctgttaacaagaggccaagagcaagaaacataacaaaggatattcaaccatctcaaatctcaccagcaagagcgcattctgagtcgcattctttgtggtggtgttgccaaatatggttgtgagccctatgatctccacagttggagctctgaacgccataaggattgtcatgctatcatctggaaccagtttgtaaggaaaagaattagcaagaagtagtttcctagaaggttgaaattcagatgtattttctgaagacatagaaatcagaaagcacatagtttgaggcaatagattcacaacaaaatcttcttcaaattatctgtctagtatttgtgccgtatcggtctctctctctctcaagaagtggatgtagttttgcaacaggagtgaaactatctctcttttaaccttgaattgttttgcgtccaatttaaatagaacatttagaatttgaacataagaaggtcaattggaattggctagcacaagcatcagatgtcatgcatttctattgcacgatcaggaaaaggtgaatgtatgtgaaaggggaatctgtaacttctcaatttacactaaaatgttgaaagtgtgacacacacacactcgtaaagctgctcttttttaaccatcaactaggcaaaaatcaggaaacaaaacggttcttcactgtagttaaagtatgaagaggtggcccccacgaacgacacctaggtgagacttgagaggaatcatggcgtagtgttgacacttgtcggccgcattagcacacagtcctggcactaactaggtgctttaccattagactgaagatgctaataagatataattacgacaatagtcatgaactatcagcagcagctcttcaatttaccagtttctagcgcatcgctaagcacaaaaccacaaaccagtcgcttaagccaaaaaaaaaaaagaaaagaaaaaaagattgcaacttttccctaaaggattgcaactttttggtgcttgtgcatgcaggatccatccatcgttttcatggacaaggccggatagtggggatccgtccaaacggcggattgagaaggaggaaccccaccacaccacatgagtggtgtgagagagagtttcagttggttgtccttcctctcttctcctttcttggaggagtaggtgaggtgaggaggaggggatcaggaggggaagataccaaaaagagattgagattttttcgctctcctcatcttatccatctatctatctatctatggcctctcgtttctatccccatgactccattgttgtcgttgggagaggagatgtttccacacaagaattgaaatcaaatcaggaagaaactagtatgagcgcaatgagatgaggaagaggaagaggaagggactcaccgatgccgggatccgtgtcgatgatgagcttgtcccggtggatctgctcgttcgaccccatcacaaatccacccaaaactaactctctctctctctctctctctctctctctctctctctctctctctcctcaagagaggaagatcgaggaggaagaagtagcagtaggacgcaacctctactactctcccttccaagtagttccaactcagacttgggctttctttctggcagcaccaaacgacaccgatctcctcgcctcgcctcgcctccatatatagaccgcgccgatggcgatgacgatggccacgaggaggaggagaggcaagatgacgtcggtcgaacacgatgcacgtggattgattagcgatgacaaacatggtttggtttggtttgatttggttaatttagggagggggaaagggtgtcatcgtctgagcttggtggcgggacagccgtccgatatcgtgccggaggaaggagagccgtcggatgaagggatagtggcacgacacgtggatgaggcggatgcggagtcggcgcccacgtgtttggatctctgccgcttgttgtttttgttttgcccttcggatggggctgtttttttaaaaaaaatatatatacattacaacgcagagactcacaacacacgcacactcacccctataaacacacgtacgtaaactctacccctatgagcatcttcgcaagttcagatcaagtagtgactattcaaaattgaccgatacctataattcagaaggaaaacatggtgcatgcagtgcagtatttgttgagaattgaagattcggtgggtgttcatccatcgcatttgcatgcatgcatggcctctctctttcatttctattttagcgcccgacaggcagcagtagtattgctattacctgatgctcgacgcggcaacgacgacacaggatcgtacgtgcatatactccctccgtttcaaaatatttggcactgttgactttttagcacatatttaaccgttcgtcttattaaaaaattatgaaatatgtaaaactatttgtgtacatgaaagtatatttaacaatgaatcaaatgatatgtaaagaataaataattacttaaattttttaaataagatgaatggttaaacatgtacttaaaaagtcaatgatgtcaaacattttaaaacggagggagtatataattacggcttctatatacacgttgagaataatagtatatatcctactagcgatcgatcgatcaaattaaattgctctgtgtcttctgctatggacgacaaggaactaatatatgctacgtgtcgtgcagatacttgccaacttcatatgaagatttataaatagaattcaataaatatttatctattttgtgttggtattattagttcttgtctagtgcttcgatgtttttttatactctccattcgctgaattacgtataataagtggccgtagcgatggcttgtctagtgtttggtggggaaatagctacatgtcttttgatttcaaatcttgtaagagatgatttaattcctgagtaatctatttccttttccccgaaaaaaaaagaattatgtaataagtggttgcaacttgtttgtagccaaagaccgaaaatctttccaatatctaaagaaaatggacgaattatggagatgcatgcatgtggcgcaattaaaattctgctattgagttcagtttgagataacgaaataatattataatgcatgctgaaaatgcatgatctgctttgttctacgtacgtctcggtttcagttttgctcgtgcgtgctggatagatagatgtactagtgtatactcgctccgttaaaaaaaaataatctaatactaaaatataatacatcgtaatacaaatctagacgtagaatataaaattagaatgtgtcccatcctaatacaatgttatttttttaaggtacggagagaatacttgtcaacctagctacctaccgaattaccgatgagcttctccgtcaccgttctcatcctcatcctcatcctgcaacaaccgtattatatataggaccatccatgcatgcattcatgcagtttaattaattttcttcctaattttttacactatattgtcttgtcattagtagtttgagatcaggaattaagtgatcagaatgatcatcgatcatgtgatcgcttcaatcgatgggcatcgccaccacatagacataggattataggaatattacgatgatatataattggacggaagcagcgatcatgcttaacacatgcctctgtctgtgtttccaagggaactagtacatgtactatattgcaaatcatcaatgatggatccaaggtgtctgtcaggcatattactattctaaatattcttctaataatgcatgtgatatgtacatatagcgattagtaagtggattggatctaactaagcttgctactcataattaatccagacagcaactcatatgacagtgatcttccattccactttctatctaagacaaagtccaaactacaaagcgatgtaaactaaagctacccacgtctatcctgcaccttcaactcaaaaaaacaaattaaacttgcatttctcattttttgcagttacatttctgatttcttcaaaaaaaaatgctgaagagagcagacgaaacagtagtcctggttagaattcagaggtacggcagccaaaggccgaattaactcaagttgaagcccatactaaacatgggccacagttaagcatgtgcctagatagttttccggcccaaaaggcccagtagcgagatccaacggctcaggacatcgccacgtggcgtctaatccgaaagctctaggcgataaaagcagagacgccatttctgcctcgtcccctcttcgcctctcctccgccggcgccgcccctgcccaaaccctaggtgaggtctctctctccgtctccggccgcctccctcctcgatccgcaacctcacctcttccgattgtttgattgtattgtctttacgcgctgtacctcgcttcttctcactagttttttttttctgattttattctactgcagagtgttgttgagttatcggccgcaaacatgaggtactctactcctcccaacttgcttactgattagttgttttcgttgatttagtctggtagtagcattgctttgggggatactggtgtcatagatcgtttcttgttagacagttgaatgcttttatttttcaaaaaaaataaatctaagatagaccttagagggatccagtagttttataatttggaggaaaaggtctttagtttatgccgaatttcatacatagaccttcagagtggcatcaagagccaaagagggatccagtagttgtatatagttatcaacaaaggtgactacttgatatatcttttttgtagcattgcttatgtaactaagcactgggttgcatcataaagaatgttttatttgcctagtaaacagtagagatggctgatttctagattataccagagtatggtgcactgattgatgagtatcagaaatgttctttcttttccataacaaattctgaatgtgagcttgtgcgatcaattgcagtaagttacaaaccgaggctctcaaggaagccatctcccaggttgttgctgattgcaaggaaaagaacaggaagttcaccgagaccgttgagcttcaaattggtctcaagaactatgacccacaaaaggacaagcgtttcagcggctccgttaagctgccccatatcccccgccccaagatgaaggtctgcatgcttggtgatgcccagcatgtcgaggaggtaagatatgatgttgtagccattttgtttaattcagactttacaggttacattattgtagtattttctcaatttgaacacatgtagtgttactgaattaccatttcttaaaatgtggttgtttgtttccctggtgcttatttctttacatgtcaacatatgttatactcaatttcgttagcatctaatgtgtttggttgtatgcaatttggatttttctctctgtaatatctgtctttattctgtctaatggtactgtttctccctaattttcttcctactaacatgctgcaccatggcatttaaacaggctgagaagattgggctcgactacatggatgttgaggcccttaagaagatgaacaagaacaagaagcttgtgaagaagcttgccaagaagtaccatgctttcttagcatcagaggccatcatcaagcagatcccccgtctccttggtcctggtctaaacaaggcaggcaagtcttccattttctgacatgcttgctcttcttttcatgatctttgttttgaatacctgttttttcatgtacttgtatgcacatttcaattttttgggctcccggcaatggaattgatcaaattattgtgcatgtgttgcaaggaccactatctttatatgttaagtaaatttttcggctgctgtttggctttctgaacacaccatagtacatacattaagctggtatcttgtttaaagtactgttagtgttgtgtgctcttgattatgcacacttttgccatgtatggtctactagcaccgctctgctaactgggtcatgtcgttggctctgcaggcaagttccctacattggttactcaccaggagtctcttgaatccaaggtcaatgagacgaaagctacagtcaagttccagctgaagaaggttctgtgcatgggtgttgctgtgggtaacttgtcgatggaggagaagcagatccagcaaaacatccaaatgagcgtcaacttcctcgtgtcccttttgaagaagaactggcagaatgtgagttctgttctcaacttcatggcatcagtagtttacatttctgatgtttacatgtaatgaaatttatatagtgtaagcccaacaagcaaacacaatcagtctaacttgttatggtttgtgctttgcaggtgaggtgcctgtacatcaaaagcacaatggggaaaccgtacagggtgttctaagctggtttgctccacattgaagctgataagatgctgggcggttgaactgagcttgtccttacattagatctgcttgcactgatatcagttttgtgcttacccaagagaacatcgagatatgttatcatattttgtagtagtttattcagtgcacttcggatttatgcaaatgaggcttgtgttatttatgaatagtttcgttcatggggagaattggtgtgccaactaccgttcgttctggtttgaccttgaatcgatagcaaatgttccgctgctcgcaagaatcgtgcagcatcgaaatcatgatgcggcgccgtttgaccccatttttgaagatacagaaacagtataattcaagtagacttttaagaacttgactgaacatagatgctgagtttactctcccatattatctgttagcatcaaaaggcaattacatttgaggataactaagatcaaagcatgtcagaaccgagacgcaatcacaggtaacagtcgatataggctatagggaaaacaaaatggtactaagtacacagtacggcacagagtcaataaaatcaccaaggcctatttgcacaaacaaatccaactaggaagcagaaacatagctgaaaagctgtacaaattcaaagctctttgggtcttgagacacccgaagaagtcaagggacaatgaagggaatgaccattgacaagaacccgtcatatgaaagagttgccgagccgctgtagcgtgtatccttctctttgaatttttcagttaaaccctacgcggaaccaaaaaataaataaataaaaaaatcagtcattaggttctttgctgcttctttgcatgatccaatcataattggagggctgcaaatggaagagaagtggcataccttaacaatcattccacacctgcagaattaaaattacagaggcatacgaaacaatagtcagattccttcattcagaaaataaactgactgatgagttcgttttgtgtgagaaatatacttactccacaaagttgtcaaagtccaacgcgccacggctggagactccattgttgtagttcgcgataagaagctcaaggacagaaggtggaaccgcatatccaagactgcgtagagcttctctcaactcatctttctcaatttttccactcccgtccctatcgtatctgtcgaaaatgccctggatgttgccaccaagaacagaaattagcccaataggtaacactaaatgaaagaacagaagaataggcaacatgacacctattgattaattgagcaccatataatcttgcaaagtcttgcttagataagttaacagacaataattataatatcaaagacataattgcaaccagctcttccagacagaaacaggttgctgggtctccactccagtagcattgttatttcctctctctgtttttcttttgttaaaaaaaatacaaacataaaaacctccacttgcattattaagcagatttcttaacagcgagagacaggttggatgggctgtactgctgtctacaatttagtgtccagttgaagcaatgatgaaaacacaatgaaaggcaccaaaaactaaatgctttacaataataagaatgtaatttgtctgttgtgttcgtagataaaactatagaaatactgttggcactcacccgccattgcccaaggcaattccacagtgacacgaactctgctggacctgcaaattcaggtggcaatgagaaatcagtcagttttgtagtaacttattttgacaactaaaatggcagagctgcattgacgaaactaatgcacgaatgcttgtaagcaatcctgatatagaatttcaatagttgaagcggtaacactcataaaaggtgaatatccaatctaagagcaaggggccatgggcacagaagagaatgatctacggtagaagcttttacagaaagaaacagacattcccaatttcccatgtagtagaaggagaggaaagcttcaaaaggaattgtacttgcatgattctatctttcagttgtactagcaataaaagtatagttataaaggttgtgtaaactgtaaactggtaataatagcagtaataagtgctctatcgtttcagattcgatgcagcgagcagtatgatacgagtaagttgcaacaaattgctcccaggaacatccaatctatcactgaaggaattggaaattccagccaaacatagaccttatgttggaattcaatgctcacatgagaacagcaaacaaagaaaatgaaaatttcattttctgggcgtgattgaagcgatgaagagaggatatatgatttggcgcacagggaagaagagtagcaggtttacccatgcgagagggggaatgggaggcaggtttgttgaagaggaagaggaggaggcggacggtgcggatgctgaagcggtggtaggcggaggagagcgcgtcctgcagctcccgctcgtcgatggagccgctgccgtcgcggtccacggccctgaaggcgcgctccacgtccgggtgcgtccccggcgggaacaccaggaagccccccatccccatgggatacgcctgcgacgacgacggcggcggcggtgggtaggtggaggacgggtaaccgccgccgccatgtccgtagccgtaggacgaggaggaggaggccggtggggcggagggcgtggtggtgtagccgtaggaggaggcgggtggcgctgacggggtggagccgtagccgccgtagccgtagcggttgtagtccgccatggcttcttgcttgctctcgtcgaaggaggaagaagaagaaacgaagagataactgacgaggcaaaggcgtggccttttctttatacctgtgcagtgagaactgcaaaggtgcggcctttggcaagaaatttttggatgatctcgatcggggaaggaggaggagaggagtgaaggagctattaactggaagcttccaaagctgcaggtgtacggcaacagggaggaaattgatggttatactattagtattaggagtcgtaagcaattgttccctcgtttctaaatatttgacaccgttgattttttacacatatttaactgttcgtcttatttaaaaacttttatgaaatatgtaaaactatatgtatacatataagtatatttaacaataaatcaaatgatagaaaaaaattaataattacttaaattttttgaataagacgaacggtcaaacatatttaaaaaaatcaatggtgttaaatatttagaaaacggagggagtaatcaagaagagattgttgtaactcgtagttgcttcattgctaagcgagcggtttcaccagcagcacaaacagaaagggagaagagaacaacaacaacaactaactcaggacaagacaaattagcattagtagagtggtgaagcagctagagagataaggaaggaacaagtcgtgagcgagcagcctaagtaagctcctcctttcaaatctgctttgcgttgcgtttcgtttcttggcaattgcaaattgtgaaggcgcgtatgtatcaaatactcctaatatgtacgtgtgctggtttgatgatggaagtttacatggacacaaccaagaacaagtctgtcttgtcttgtgttgttgctcatccaaattcaattccgcggcggctcactgcgcatcgcccggccgaccatggatatttctacgtgtcgcgtcgcatcgcgttagtttcacgcggctcggaattcggaatatgaatgctggtcaacgctgcgaatctaaccaccagttatacaaaaacagatctaagcaatttctttactaatgcggagtatgcctaatacaagtatacaacaccgcaatcaaggattggagaacgatgaaaagattccgaagaatcactggtaagaatcaaggattggagttttgttaggctgtgcttttaagttttaactaaggttcacaacctgtgctactgtgtttttcacgtgcacacttctcaaactactaaatgttatgttttttttgaaaaagtttctatagaaaaattaatgtaaaaaaatcatataatccatttttaattaatcatgcgttaatttgtcactctattttacatgcagaggggaagtattcccaacacctaaaaaaacacggccttaaatatattatttttaaaccatacatcgttat

SEQ ID NO: 67816 - DNA, 3475 bp, Oryza sativa
atgcgatgtacccatcaacaataatgtgtccgtatcgacttcgtcaatctcaagatatgtcgggtccagccttttaaaggtgctcacaaggatatgatgtgcgtgtattgaatattaccggagggctttctgctactcggaagctagctcgatatcccggtgatcgaaggttgtgattgcctaacgccaccaacaccaagccatcaagaatcccactttatcatgttattgcttagatcaatgcccaccgatgcacttgtgggtccacactccattaaatgttacttctctaggcctcccacatccaattatcttcgatcaaacttcatcaaattgtcatctagttcaatacactccaacgtcttttcggggaaggaagccccaaaggaggaagggctattgaagtaggatgtagacgaacaggaaactagacaaaaaaaggaggaagagctgttgaaggaagatgtagacaaacaagaagcgtgataaactccaacgcccttttgggaaaaggagccccacaagaggaagagttgttgaaggaggatgtaaactagcagggagctagacaaaaaggagggagggctattgaagaaagatgtagaagaacacggatctggacaaaaggatataaatggagatcacactgatagaagaaaggcacaactcgctagtcaccacaaccaccggaagagcctagagccctagacctcaaccaacatggagacccaagctattaaacatggagcatgctaaattgagcagatccaaaggaggggacaaggctaaagtgattggacacactcctagacaatggggcagagctaaattggttgaagcaacggtaaaaacaatggctctagggactccaaccatggaggcatgccagtattggcacaaagtttacacaaaaaaggatgaaagggaagagtgaagcggactttctaggggccaatggcacgagaaatgcattgaccatagttccacgaccgtaatagaaaaaacgaagaggaaaggagttggcaaatgaagaaggtatgtggagatgtcatcggggaggcaaacggatctagggttaaaagaggataagagaggaggcacataggaaaggtagccgctggcaacggcagccataggtggacattgttggttgggggtggaaaacatcctgaagaagaagaagccacgtccaccaacctttcacatgagggagtcaaaccgaccgaaacgggtgccaggccaactagatgcaccactagccatgtggttgtcattgttcaccaagccctcatacacaccactgcccatcgtgtcttggagatgcagcctacacaatttggcgcacatctagccccatagttcatcgggtctctccagtgtctgtcgtagccatccccaatgccatcacattcatcatcacaacccgataattaatgtcaacttgttcactatatgtaaacctctagatttggtaggaggggagggggcgttatgagtgttagggaaaagaataagggtgacgagattgtaaacgagaaggggcccgatggttagccactaaagaggggcacggaagtttcatcctcagaccttcaagtgagtactctaccgaggatagtatggtttcagagtggcagcactcaaagctgaccattagggatccaactcttgtgactttagggctaaagacataggagaacaataaagcatgtcttgtgctacagtacgaaacagtaatctgcagtggtttaccgtagcaacagtgataagcaggaaaatatgatgtacaaaggtactgtttgcgtgttactatattgtactgtagcgatcgatctcatccattcgctgcaaatcggacggctgagaataccctaaagaggatctcaatccgaccatcagaggctgaagaccctctgccacatttattttaataaggaaatcagaaatactagtctctcaacacataataattgttgacaacaccaaagaacttcacacagggtgcacatacatgcgctactaacaaaaaacaaaacactctgaagcctgaaccaaacaagtgacattatattggccactccattatgattgtactaaacaatgtgacagaaatatagaatgtccatttctttttcatctgtcgtctgcttacgttaagcccaagtgccaatcactgtcaagcctcatacagagagagaaagagaccttgtacagtgcctgtctgtctgtacttatctcccggaccggtgatccaaaataatcccacgtgtggtatcgtatcgtatcagcattcagcagcacaaaatatttccggctgcagtgaagtgagccaccgattttcttttcttttcttttcttttgttgcgtcgtcttcgattcctcctgtgctgtgcgcaccatggcggccaccgcgctccacctcccgccactcctcctcgcgcgccgcctccgcttctcctccgccgccgcttccacgtctacctcgcgcaggaccacgcgcctctccgcgcagctcgacgacaccgccgctgcttccacctccacctccacctctgataagcccgccgccgcctcctccttcgcgccgcctcccgacttcaagcctccggagcccaagaccttcgaggtgaagcccggccagtccgacgacatcgtcaccgcctccctcgccattcccttccgcctcggcaccggcgtcttcgcccttgggtactttattttctatttctactgaatttattcgatccaatacctactgaattttgtttctaaatcttattgttactcgattcatatattcatggccttggattcatttgatgtgcagatattcggtatcgctggtttctcctgacgaggtggcaccagatgaatatgctttggatttccaaggtacaatctttttattttattttcccaaagcaaataccaacgatgaacgcacacacaaggtcgtcattttgcaccatacaacgacctagtttattctcaattgcttcgtaaaacagacactatattgttactgtattaccagcccaactgctgagatcagacttcaaaccagtacatagtaacacatgtatatgtgtcatttcttattctaggtcggaaggttaaggagtcatcaaagatagggcagtgtcctcgaccagaaaagcctatcgagatttacgagtttgaagggtatatatgcttcatcttttctctctttccataaaagacatgtattgttcagacccaataatcttcttctgggtattctctcatgctatagctaacttaatttgtaccgtccattcaattgttgctgtattaattctgcctcaacttcagctgcccattctgccgaaaggttagtatttttagccttcgacatctgcatcttgcactttaccttctgtcatgtatgacaatttttttaaaatttgcaggtcaccgagatggtggccgtcttggactttgatgttttgtttta

SEQ ID NO: 67817 - DNA, 1793 bp, Oryza sativa
  unsure (1)..(1793): unsure at all n locations
tttatttgtcgtatggatttactttgctacagcgatgtgtctgttttccacttttcccttcacttaggatatttgggtgttctttctgtctggaagaagtagtgtgaaatcagtttgtttttatcatcatctaaggtactcttatgctgcaggtggatccaaacacaggggttgccatgtatgaatctgatgccatcataaaatacctggccgacaaatatggtgcctatttcatctctcatctgtacatctccctgtccctggggcctcctactaacctcctgcatttgcccttgcttttcaggtgatggaacagttccaattatgctatcacttggtatattaacagtaagttatgatctggttctgtccttttacctttgttgaaataacgtctaatcgattattatttgatatatggttcttgaatttcacacctactcagcaacctttatttggccagttaacagtcagttgtgcagtttaaataaccttatgctctttctttcctagactataacagcagggctcgcaatgagtggacgtagtgggaaggtacatattgaacaagccatatagtcttgttttgcatgaaccgtatccagggctgaccagtgttgtttacagggttctaagtatactcctgcaaagcttccacccgagccaatagaactatgggcatatgaggtctgaatgctatgcatatcgatacctaagcatcagacgtaacgtgtggcttactgccagatccaaaaactgaccggcgcatgctgtatcatgacggatctcctttgtgtaaaatagtacaagagacccttgatgaattagagttggcacactagctacacaggtactcaataacgctacaccaatgacaaaattgctggatatgctgttagctatcatcagtgttttttcctgctgtaaaatcacacccgtgtatcacaaagacttgcaattgcaagcactacactcttggagtaactggtagctgaaaatttctgcagctgtgcacgcggcagccccaggagacaggaatttttgaagaaatacggcattttccaggttggcaaccatcaaatgttatgccttaaattgtaaaatttcttctttgcgcttgacatgaattactgctgtggcaggctccttatatcgaagatcctaacacaggggtcaagatgttcgagagcgctgatatcatagactacctgagggccacatatgcggcttgagaatcccttctacttctcatatctcaagtgtcaatatgcagtatatactacactgataacctgacatatctcaagtgttaatatgcattctctctattcttatgttgtagattctctctattctttacaaggaatcggcgaattcataatgcagtacatgcacatacacataacactgctcattttattgtacacgaatttttattgaaacgattattgtaaaagaatttatactccctgtttacttgttttatagtgaatgacactgaaatgaggctgtagaagaggtgcagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 67818 - DNA, 778 bp, Oryza sativa
cgcagtagtcgcagacagccacacctgtgaacacgcaggcagtagtagcgagcagagaaatcgatggatagtcaggagtaaggaagggatgaagcgcgccaccgaggaaggaaggaagcaaactgaccttgatttggttccagtatatggcgtcccagctgccggagccgtccatctccgccgacgacgtcggcggcgacggtggcgcccacggcttcgcggcgtcgcgggcgacagagagggagggagcgctccgtctcgtccggctcgtgtttggtttcggttgggtttgcttgtcgtgagagggaggcgacgcgaacaacacacgcgatcgcttttgttgtatgtagcatgtgcagcgcatgatggtactacaagttagcgtgaccgaatgaaatgatctcttgctacaagttttcctcctcctcgtgatgtgctatgcttccgtgtctttgacttgggttatatgtatgatcgaagaaccgttaatcacgcacatggctattattcatatatctgtcatttaagatagcgatacaaaatgtattagattcagcttatactatctactataagtttgggatattgtactaatacgagtagaggaggaaactcttcgagcgcactattgtacgctagtatgatctctttatatcttgttggctcaattgcctgagacattactgagattaccatacttttaaaagattgatcagtcccagtcgttaaatattgaccctgcttacagtttcttagtcacatactcatttgcagataa

SEQ ID NO: 67819 - DNA, 1029 bp, Oryza sativa
ccggcgggagactaaatctagctattgcaaccggcctcttcgatcgagctcctgaccctccgccagcatagcccgagtttagttctaaagtttgaacccctggaaacatcacaacatcaaacttttttacacacacaaactttcaattttttcatcacacatcattttaattttaattgaacttttaattttaaggtgaaactaaacacacccctactcaaagcacgtgtggaattaagtttgttgtggccgacggctgggcaggagctcaacaaaatcgtgacccgccactagcctcctcaagctcctagcgggcggcccaatcattgtaaactgatcttgattcaggccaagtttagttctagaatttttcttcaaacttccaacttttccatcacatcaaagctttcctacacataaacttccaacttttctgtcacatcgttccgatttcaaccaaacttttaattttagcgtgaactaaacacaccgtgagctcttgcttcgtcaagctcctgtcccgctgctggccacaacgaacttccacgtgcgctggtcgccgcttcatgagctcccgtacaccggtgcacgtacgccttggcctcatcctgctcccaacaagcagttggccttgccgaactagaggaagggttgaggttaaagatgtgtcgacccagtcccactaatattatcctatatgagttagggataatattggtttacaaaaaatacgatatgcaaaaaaaattgatctaattgtgtccaaggcataaataataccacggtttaattttaagaaaaaagtaaatagcacttagccgattttataaataacagtgatgtttttataattggatagagttacaatggatggttcacgttaacccatgcatctatctatgtgagcagaccgatcacatgctctactcgtagacaagctgcagctgctgacttgctaccagtacaatttaccgtactactatgtagttactctctctataaaaaaaccaatctagattaagatactat

SEQ ID NO: 67820 - DNA, 3673 bp, Oryza sativa
  unsure (1)..(3673): unsure at all n locations
ttaccgagtgcagggtagtcattaatggtgcagaacaatagaactcttagcttgaagttctcctgaccatatgcatcccaagtttccacaccttctttccaaagaatctccagatcgtcgataacaggctccaggaatacatcgatatcattgccgggttgccttggaccttggattaacaagcacaacataatatatttccgtttaaagcataaccatcgtgggaggttatagttcgcaataagaactggccaagtgctgtgagtactactcatgtcattgaaaggattcatgccatccgtacaaagacatatcctcatgtttctagggtcggcagcaaagtctttgtgttttcgatctatagtcctccattcaatcgaatccgctgggtgtctaagcataccatcattccttctttccgtggcgtgccaacgtactaacttcgcttcgttcgggttggcaaagattctcttgaaatgatcaataataggtagataccacacaacctttgcaggaccacccctctttgacttatttccttcgtcagcacttttctttcgcttgtaacgagaagccttgcagacaggacaagcatccaagtccgcatattgcttgtggtacaatatgcagtcgttgggacaagcgtgaattctacgaacctctaaccccagtggacacagaacctgctttgcttcgtatgtcgtctcgggcaatgtgttctcaacaggaagcatagccttcaaaattcctaaaagatctgtgaaactcttgtctgtccatccactacttgccttcagcttcattaggtccaaggtaactgacaacttagtgtgttttgctttgcatccagcgtacaaaggcgtctcggaatcacttaccaacctgctgaatttcattccatctctctcattttgggctaggtcctcaacgtcacgtaacatgtcttgtagtagatcgtgatccacatcaaccatttcaccgcccaatggagaaggtataaacatgtcatgctcattttcatcttcctaattatgcgcaccacttctgtctgctgctgctccacttctgattcttgctctccatgcttcacccaacatgtatagccctccatgaatcctcgttgtatcagatgaccgtgtacgtcctctccgctatcaaacatattctcgttcttgcaatctgcacatggacaacacatgtaatcactgtttcttcttatccgatcctcctccgcggcgttcataaaatttattacgccctttcggtactccgtagaatgacgtttcaaatttttggcatacatccaacttcgatcaattgctacaaaaaaaaacaaattagaggcacatattataagatcagtattgcaaaagtaagacgtgatgaaattgctcaattaatgatttatattactcacttgattgatccattttgatcacttttgggaatttaatttctgttttccttggaaaaaggacaaaaaatcgccccctacagcctcccaccaaaatagtgaacagtgggatacagttacactaggtggtggggggtatttatactgtgcaacaaatatctgtaacggccctaanacaatcaaccgtgacgggcatacaagttatctctatcgggccgtaataaaagaccgtcaaaaaagagtgtcatctgtgacgggcaataaacttatctcaatcgggcctctagttggagcccgtcacagatgaccctcatctggacgggcttcttttagggcccgattgagatatggaaccctcatctcaatcgggcctcaactatagcccgtcacagataagtgtcatccgtgacgggctttagttttgtgccgatataccatggctgtgcgaccatatctcaatcgggcgaaactttggcccgattgagattacttccttgtgacggcccgcaaattccagtcttgttatgggccgtcacagatggaaggatctgtattagtgactcctatatactactgttactatactaaacagtatatacctactgactaaataaaaaacggtacatacttcctaacctatcaatatattatatattagatacttgaaaaaacagtacataatccttaactaattgatttaatataatattggatacttgaaaattttagtatatactggattaaaaaatcagtatatactggaaaaacaatcagtacatgcatactccttataccagtatatataccattcttaagaaaaagtagtacatacttctacaagaaagtatatacttctaaaaaaagaaaaataataaaagtagtataaacttctacaagaaaaagtatatcattccctagctaaagatattatacatatagtggttacaaagcagtatttatacgtactactactatgtaaacacaactactggagtacgtagtatacaatgctactgctattaaaaaattagtacgtatacactagtactaatccacgtgtttggatcagttctgtgcatttaaaatttgtaatgcatgcactcgatcagttagttgtgcattaaaactaaagaaaagaaaatgcattgttttaaaacagatcagattcaccatggccctattagatgctattggatcatccattaacaaaggggagtatatacacttgggtgtacagaagagtcgtcctatatatatatatatatatatatatatatatatatatatatatatatatatataaaacacaactcttctctttccatctgtgtttccaactcttatcttcacaaacctccaccacttattatcaattatgccagaagtaccccccccaaaaaatgccagaagtacactattaccacttatcacccatacgttttgaaacaaccacaacgttaatcaaatagggatatgttaatgagacatctctgggggaacagggaatttaagatcaacatgggagcgtggagtaggttgggtccaaaagggggaactccaacatattcagcatggctttcaagggggacatgattagaaatccaaatacccaatagttgcaagtctgaaattgattgatactttattcaatggttcttatttctagtgtttgcacacgatagtatgcaacaccttattactagagtacatgtaaccaacgtttgatcaacaacaaccacaagaagagagttggaagttgacaggggccatgttgcacatgtatggcatctgcatcgccatgttcatcatcatctgctgctgcccgagtccagcacaaataacttgttgcatgctctgcatcatctggtaactggtgtcacagttgcactgaggcatcatgccttgcagctgcatgcaacattgctgctgcaggggagccattggctgtgatatgaacatggctgtggagctacccatgcccaacgtttgcatcatgtactgcctatacggatccgtggtgcccatggctaatgttgctgggaaatactgcatagtggtgattgcagtagtggcacttgcagaaagagcaattaaggcaaacagggcaaatatcttggtggtgtatgctgccattgctgattctacagtactagtgttaaacaagatcctagatggtgtagacaatattgttgagggtgatggaatgatggttgcctttgcctaggggcctatttatacatgctagtagctatagctgtg

SEQ ID NO: 67821 - DNA, 3036 bp, Oryza sativa
gattttcgcgtgcgggtgcatcgcccgcacgaaaaaaaatcagatttttgcagacactttggtgcagacaggcaggagatccgcatgcgaaaacccttttcgactgcacggaaaaattgttttcgtagtagtgaaaaattcaaccccactccgaagccatacaacaactcacaaattgcaatcgggttcaatgtggtctgccaatccagatgactagattgtgataaatctagggttaaggcttcatagaagatagaactgattcatatgctcaagtgaagtattgttcattgcttgagtagataaaagttccaaggacatgattttcagtgaactggatggagaaaactattgcacatgtaagatcaatatattgctgaaacagaaaagatctatcggacatgctggcaggtaccaatgtactatgaataaaccatcctagcgagtacttatcttgttaacatgttatatgtatactaatatatgtatagtgccagctcattgaactcaaatacaacaactatcgtttgacatttatcatgaataccttcaatgtgatcttccctcagctagaatgaagttttctttcgctctcatgaagttactctactaatgagatgtatatggttgacaacttggcatgcattttccagtttcacaacaatatgttcattatttaaggtccgcttgcaaccttataagggctctcgtatagaaaaaaagtcatttttatagtagtgtcataaccggggagaaatatatactactaacactataccaaaatataacaacttttagccgtgaatctatagataagtatttgtacggatttgtagctaagacttatttaattttagaatggagaaagtacctctgtatttaaatatacaatgtcctaggtattatttgtctttggcatacaattttaaccactacatgtattattagaacatggcgataatatccaacaaaactatatattatagaagtatttataaaaaaaattgaccaaaaatgacttatatgtttgcaagctaaagattttgagagctattgaaggtaaaaattgtaaaattttgaccaaataaagttaatagtgttatattttaaatatggaggggtactttcttttatatcgttaatttttcacaacgatgatcatgaactcttctattttgatctttggaccataaggaataattactccttccaatttggagatatttaaccatttgccatatttagatgtgacaattaactttttgccattggacccacatgtcatagacacatgtggatccacatgtcattgagataggggtggcaaatagttatttgctaaatctaaaagtggcaaatagttaaaagcccctctaatttgtcctctccagggattatatcagatcatgagagcctcttaacgtctgtttttttccctcaaacacacagtaaagttaagcttcatttcgttaagaaaataagagaaagtaaagaggaaaggtcaaactcaaagaaacctctaaaaaaacaaccataacacttctacaaacacgccagaccagtagaactagaccactatgatcagcacattaccaactagattagcatctagggcgagcgactgaagaaagagctcatgcagtacatcatgtacagaagctccagcccaataccataagctacactcataagagctcctccactgcaatgataacacaatcacacccatcaacaatttcttaaaaggtaaggcacacacataagaaaaagcatgaactagaacatgaaattaccttccagactaagggaggaagagaaaaccaacctaggatacaatgttaatgtggcacctctgcatttcttgatgtgtcccagtcctagtcctgtatgtctatcagttctctttctcattgcaagttaatccaatttttaggtatcacaaaaaataagcttggaaggtgcacactagctattaagccaacatatatatgcacaaaatttccatctcttccttccctcaagtaagctgatttcttttttttttctgaaatcctaagcaagcatctcctttcttcttccttataaagagtgagcactgaattaatttggttgcatctattaggcaagcagtagaaaagatgcagcacatggtttgtaattgagtgcagactacactgagccaagataagcatttagtgtcagaaaactccatatgaggtctacaacgatccaacattttgatcatactataaaccatttacatttgttaaattgtgacaacgaaaagggaaaaaaaagagaagaacgtggccatgcatgcacggtaacaaactgggaagcattatcggagaactgacacacatatgacttggtgagactattggtattagtttttattataaatcaacaccaatgagtgcgttagatgccgattcttaatttgatcccgtcaaaagggatcatctgtgtgagaaacctttcataggtgtcggttttaagtaaactggcacatatgagggcgttacagatgtggtgttcaggctatcacaatgcttgcacctatttcttgatgtgtcccactcccactcctacttctccatatttatctctactatatttgtactgcaaaataaaccaacatatatgtgccaggaatcacgactgttctattcatcaattacccaaagtggtaagttagacactgtcacattgcaaagttcacatgtaaaggtatggcttataagggagacgaggtgcttgctatggattccagagcttacatgagggaaggtagagatgggacagaatggcatatatgaacatgtgtaatcttaatatctagtgtgcacaagttaacctccaagttcattttgtgatcgctcaaaaaaatggtttattttgcaatgccaaagagaaccgatggagatggtattaggattgggacgcatcgagaaatgccgaggtgcaaatattaatattgtagtctaatgtggtttcctcttccttaatttgacaatctggaaggttatttttcct

SEQ ID NO: 67822 - DNA, 4120 bp, Oryza sativa
  unsure (1)..(4120): unsure at all n locations
aagaaaattctcaactgggggatctgccatgtgactatggaaaaggaggaggggagaggaaaagggaagatgagatacaatagctgatttcacatcatccggtctaattgagtaactgattttaaggagagggaagacttgaactcacaactttaaccacacaatcttgctcacctttgacaatccttagttccttacaaggactttgcaatcatcatatggtagtgatatagtactaagcattgcaagacttggaacatgaggtgttgctgtatttacaagggatcagggattcgaactcgagacctatagatacttttgcgagattttagacaatgcttgctgcttccaattgcctgcacattgtttcctcaaatttcagaattcgatgcgatgttttgttgcctgacgcgtcctcagtctgtcatgcaattgaacgaccgctcctgctgctctactgttaaataaaactcgtccaaggaccaaacccatgaatgaatctgaatacctgatgctaatcttttttatatcactatggtctttttcttttgtcgtcaccatttaacagatgtagtaatatatagtttccacagtacgattaaattaaatggagtcgctgtagacttcactatgaacttattctgatactaaatgtagatcttggctcagtgcacggtcaactgaattcccagctctttctaaggagaaaggagatgctaaggatttcagaggaaaaaaaaccagcttacttgagagaaggtaaagataggagggttcaaaattttggaccggaatttcagaaatttttgaaatttcagatctatcagacccacctgatacgaaattattttggccaatgttttgggttttctcaaacttttgtgaatttggcaaaagttagtcgaatttggacaaatcttgttaaaaaaatttaaattattttggatcgagatttctaaatttcggctatatcagtacctccgatagaactactgaattgaaaaattgaaccctgatgggacaaaatgacacatatgagtatatgttagcttaatatatatagccagtgggcacaaacttcccagtatattccgcacgaagaaaaacttccctgttcattttgtgatccctcgaaaattgggtttagttcttcaattcaaaagagaagagggacgtagaacgaataggattgggantgcatcgagaaantgcagagttgcaaanncatgtgacattgcggcatggaaatttcctgttctaattattgcatgttatttcttatgtgcgctagaagcaccatttcgcgaagtagatgacgcattactttggatgtctttgtgcttatgnnttgcagaaaaggtgctggtctggtctggttacaaagttctattataccagaaaaacgttcaggacaggaatgaagttcttcacttcagctttaccatgctgttttccagtatgatctttacatccattcatcaagcatactggttggacttttcatgtatcttttctcaaaattaagaagaattaacagtagacatgaaatctgagctgatgaataggctttgtagaagtaaacattttctcattccacctgaaaaatgttttaagatagcaaaaatgtgtaacccaaagaatcaatttaatgcattttcctaagcgatgcacatgataatttatgtttctccttcatccaattattctgtttattagcaatatgacacgattagattggctcattagtaagcaccatgctgttgcaaccaaaatacagttggtgactaatcaagtgaaacactacacttcttaatcgtgataactgaaggatactctctccatttcatatcatgtcgtttgatttttcttagtcaagtttgaccaaatttatagaaaaatatattagtattttcaacacaataaaatatattatcaaaaatatattcaatattagattttatgaaactagtttgatattttagatggtgctaaatttttccataaaattagtcaaacttgattagaaaaaagtcaaacgacttgtaatatgaaacagaggaggtattctttgagagatctccaaggactgaactcattggagggtaggtagacggaagacgaaaatatataccaatagttttattatagtatctgcgtaaataagttattccgtagcagctgattttaaggagaatgacatgaacccctaatatttaaacattatagtcttgcgcctctatggctatatgcctcccaaaactttgaaatcatcatacggtatagtgatggagcgatcgacgagccgacgagcattgcaaggttaggaacaggaggcgtttgggaacgtaccaaagcatgaaagtgaggatcttgaactggttgtgacaacacaagaggttctatcctgctagtccgtaatcatcatatgctagtttttgcttttcgatgtcccatttttcttcttttccacagtccctgcacatatttgatcctttgcgtgagttgtgaatgtgagaggcatccagtaaaacaacatctgccgaaaacacaagttctttcctctttttttttttaggaaattggagcggttgaaacacatttaaccattgtaatagcatattatgaacagatatctactggcccgtagataaaacccaatccaacactgaaatcaaccaaaatcttcatgctaatcacagttcccctgaacaccggaagtggggatttatgcacaatgctctggagcacatgaacaaaatattcagaattaagacatgaatgggaaaaaaaaagagatcaagatcatgatcatggacaattgtgctacatacatcatacatcatgttttgtttatcttagatggcctacaaaaatatgtaatacgattcctaggatattgccctgatttcacatactatgtgggatcagcttaagcaaacacatgctgtgatttctgtgcaactcttttagcatgctctctgaaaatatgaattctggtttttactgttggtggaagaattcagtaatcctatgaatgaatactatagtgagatacacatcatctaatcgcatcccgtaaattgattttttttttaaaaaaaagaaatttggaggctcaaaccggcccacaaaagtttgcacacaacaagagcccacactaggacagagagaaccacataaagtatggccgaagaaaaagttttaaacgtttcagaaaaaagaggtaagtttttaaggaaaagtatgaccaatagaattgatggaatttctcaatctgagtcctagatagattcatgtttaccaccaaaaagcacatggtggcaacatgttgcttttctctggggatgcagtttcatcattcaaatcataggccattgttttatttttctcgacgtaagaaaaattaataaaagaagaaacataatctccaaacaattgtgaaaggtactatatattcaaacaatataaatcatccaattgctctagacacagtgatcacaatagaagattaatattcttcccctactacaccactcttgacaatcttcctaccctattgcagaaacaagcatcctcgcattttgcacaaacaaattaaggggatggctacacacagatgaaaatgtactgcttttgagaaattaatatatttcgtggaataatcaacaattccacacaggatattaaaactggatcagatgcatgtatgttaatcttagaagatatcaatacagaagcatgtgcatctctatgaaaaacatttttttaataaaaggtaaataataaatatatgataaatcgacaaaataaatttctgggctagtcatgaattggcttagcccattactctctaatccacctataaaatggctttgcaatcgataaataacgtagccctcacgccgccgccatcgccggagtccgccgccgccgccgtacacttccgccggcggcaagggcaaccatgaagtttttgattccgccgccgctggttcggccgcctcctcctgacctctcctacatcaaccgatcgtaccgatctgtccgtcgacgagaagatcgagatgataatctaaggtgcgttaattcgttcattccttcgtttcaacgagatcgtact

SEQ ID NO: 67823 - DNA, 13105 bp, Oryza sativa
taactcttcagatattttccaagcaagagaagatctgactagtggagtagtaacaaacacagcagtgatgcttgccatcggaatatttttacatcatattaattactcccaaattcaggtcaaaacttgcaatgttttctcactgtcaagatcgtattaccgtaagcatgggcaacttaatcaataatatagtgagagtggattgcttaactgctattcattccattcacaaataatggttagttttggcatcaagtaaataaactttgattatttttagcgacatcgaactattacagcgagtatatttgaatgtaaaaagtattagttaactacttataattacaaatataatgattcaacttttatgctaaatagttagattatttaaaatatatatttgtagtcaaagtaggataacttaaaattaaactacacatttacccgtgaactgaaggagctgagggagtacttattatactacttatcccatatacacggaaaacaaaacggtggattactgcataaaaacttaaaattttttaaagcaacttttttgagaaaaagtttaaaaaaaatatcgtttaacagtttgagaagcgcaacagtcttactctgcttatgctgtcaccttctctgttttaactgaacagccctgcttgatcagcaaactcccctgaggtcaaacatctgacagggtctttgcctgtcagctaggacagtcatctcaggcatattacatgcatgcatgttggatcttgtcaaattgtttgacctaatctaatccaatctaatctgcatcaacatctgatcagcagcaagaaagttcatggaagctagctgtgtccctgctgctaaatactcttctcagtatcccactatatcagcatgaattcatgcatgcagtttcaggtttggtccattccaaaacttagttgctgcttccatgcaggcatgtttccacacgtgtttaatttaactgtggagtttggacttgatttgaagtttctcaatctgcacgagcttgaattcaacaactagtacgaaatatagaaggtccttgcaagtggcatgaagaataaaagagaagcttcttgagaaaatacttgtcaagaaacgttagtaatgcttgtattattagtgctttaaaaaattgcaatttggcaactaatccttgttttcttcttaagcttcagagggaagtactagtagaactataggtactcaaatagtggtgaaaggtaatccattaggaaaaatatataatctttttttttcaaggagcccattgaaacgtacgcctcccctggtttctgaccattgggaattctatggaaatgaagtgactcacctaccatgaatctggcaaaatttcttggtcataaatatagtttgatgctattttttggagatgggtttatagttatatactttgatgatgcactgatcgtacaagagctgatataatattaacactatttgtttttaaaaaatagacattagcaaaatcttaatcatggtgcttaagtactattgtttgactaggtatctatgctattcaaggaccaaaacatcacctccatttgattctttcttgatagatggaaaagttcagaaaggacttaggcccttcaaacttgcaaaaattctatcacatcaaatatttggacacatgcatggagcattaaatgtaaacgaaaaaaaaaccaattgcacagtttgcatgtaaattgcgagacaaatcttttgagcctaattacgccatgatttgataatgtgatgctatagtaaacatttgctaatgacaaattaattaggcttaataaattcgtctcgcagtttacaggcagaatctgtaatttgttttgttattagtctacgtttaatacttcaaatgtgtatccgtatagttgaaaaatttttggcacacgacctaaacacggccttatttcaagttggttgcatttagacatcagcaaccaactttaacaaataaaagcagcaggagaagggaaagaaaaataaaatgttaaagtcttaaagacatcagcaaacacttggtcataggacttgaactacagggacctggattctttggatattatagtagtagtacacacgtcatacattaatttaacatactaaagttccatttgaaatggaagaatcaattattccaccccaaaacaaaaggattcagtttattggagagcctgtcgatctgtcccattggttggattagcaaatataaaagcaacaaaaggaaatgttttctaaaactcagtagctacattatctagatgatatagtacacacgtcatgcaatatatattaattatgggccccatttgaaaaactagagaatttgttttttttgtgggggttcataatttggcatttcgctcttattggggcctaattttcaaatgagaattcctcataaacattactagtctaatttcgcgcttaattttcacaggaaaagatcagaaagaattaattggtcgtaatgtgtcaaagccagagacagtagcagcccggaaatggacaagttgatctatgggcatttggataaccacacatgtaatgcagcgtatgtgatgtatttaaactagaattgacaaaagcaattgggcttttcctatcgatggattgatcacttgatccctatcaagtaacagttccagttgacaaaataaattgcgtgcctgttttgaattaggccgtgtttagttccctcctattcccaactttccatcacatcatatcatatcaaaaacttttctatacacataaacttttaacttttttaaactcccaactttctttaaactttcaacttttttcaggaactaaacacacccttaatagtgaaactggtgagaaaaacaatttaattaattaaagctatctgtcctagctagctagctaggcatgcaattgccaagaggatatatatttgcatgtagttgtcgacatgtccacgttagagacggttagaattaacgatagatgtttatctgacatggacaataatctctgaatttagccaggccaatcttgatcgtaattaactgtcctactgtagcatatctggatatgtacaatatattgtgctgtgatgtgtgttctcgtgttatgtaattaattatgtgatggccatggcaaagctatttatatgccaaactatcactactacacaaacgattttcctgtaaaaggagctatttagattacagacggacgcggaacataactggttacgtctgcaaaaatcatcctcctatttatatgtgcagacccttaagaggactacacgaaaaaaatcgatttttgcaggcgggcctattaagggtccgcacacaaaaataaggctagttttgtaggtgaacccctcttaaggggtcgcatacgaaaattgattttcacatgcgggtctcttaagacgtccacacgtgaaaatactctccctcctcagacatcttttccctctcaaccacttcaaaaatttcatcttatcctctctctccatctctcttacctcctcatgcttattctcatttctccctgtcactcactctctcgtctctcgtctttcactcacgggtggcggcagcgcggcctcgtgcttccccggcggcgggcggcggcagcccggcctcaccctccccggctgcggcgcccctcgctcacctggatctggaggtggcgcccctctcccgcctagatcctgctgtgggtggcggcaacacgactgggagcgatggcgggctcgggagccggccgcggcgaaggcaggctcaagagcggcggcagcgggagcggcgatgatgaccacgaggagcacggcataagcacccgcacgaaaaaatcggatttttacataccctacggtgcagacatatgagagatccgcaagcgaaaaccccttttcgaccgcacggaaaaatcattttctagtactgtatattaacattatagctttgttcaatgaacagaatataatcaatccaatttactttcacctttaaattttaatataaaccaggatatgtttgttttgtattaaaaaatcaagctattttacctataattttgtgataagatcacttttagtttactgaggttttatattaatgtttctatatgttacttattatgcggttgccagttagtaataaattttaaatcaattaatattgttatatgtgtttttcgccattgatgtgatgcaaatgatgaagcacatattaagacaattttttcttgtgtttttttttctggtagtagaattataatcttctttttttctcatatctagtggaccttgtcaatttgtattactacctcactcaactatagataatagaattaaggaggttaattgttcttactggtaggagaaatcataaactagtggcatagatcatatttattggcgataacactggtagtaaaatactactactccgtttcatattataagtcgcttttatttttttctaatcaaacttctttagttttaaccaaatttatagaaaaattagcaacatctaccaaaccaattaaattagtatgattaaatataacattaaatatatattgaaagtatatttattttgtgttgaaaatattactatatttttctgtaaaattggtcaaactaaaaaatattactatattttatactaatataaaatagatgcagtaacagtaacgggcgccataaaggacacgttaaaaattatctggagtacagcttttcactctatattgttcatttgttttgacaaaacttgaatttgttaagtggacctattgttatatatgctggaggtgtacgtacgtacgtaccaaattaaaactagccgcatgcatgtacaattattgtactagctagccatccaattatttcaagagacaggtgatactttctcttgtcaactttcgaagaaaaaaaagtaatcgagctgtccaattattgtgtataacgagccagtacaacgacatctaaaacacgcattagtagctgcaacaatataattaacagcagcaacgatgacgacggcatacaagaattcatgaaatcttataggtagataatatatagttgcctacttaacaaaagaacatatatggcttatactaaatctcacaatttaaattagacgcatgcatgatattaatatattacaatataattgacattttggatatcaaattaacagcaaatattgtacgttcttccttgagccatcctcgatctcccttgcgtgtaagcatggtggtgcatattgccacaaagccgtcgacatcggaattgcgaggaaaatttgtatcgactttatccatgtcaaagagaaagttggtcaaaaacatgtagatttggagtgttgcgccagtcttcaaactggatgatttgtatatatatggatggcctcatgttaaatctagaaaaggttaatcacggttagttaattaattgccttgattaatatttaaagtatatattgaacgattgatggattcctggattggtatgctacgactcctgacttgttttctttcataaagaaaaaataaaactagcttgctactcaacggaaaccgaatatgttgacctccaacaggcaaagattagctatacctatatatatatatatatatatatagtcaagtagtaagaatcaagcacgtcgaataataattgttgtgtataaaaatggttatttatttttaatagacggatctatcgaatattaattagttgctgctaatggagctatgatatatcatacaattaattcatgcatgagtttactttcagtccacaaatcaatcggtgatggtcgtttcccatttatatatgcatatatatatacacgaatcaaggaatcaaagttcagaattcgtttaatgtcgtcgtaccagaacgacgactcatattaattccaactcaactatgggaatcgaagcgtgaatttcggtgcgacagcaacgagcttcatgttgcgatgatctcattatcactagtacgataacgatttttccgtgcagccgaaagcgattttcaggtgtggatcttccacccgtctgaaacaaagtgtctgagaaaatccaatttttttcgtgcagttgacacacccgcacacgaaaatcacgtgcacgagaaaataaaaaatcaaaaaaaagaaaatcaaaagacgccctggaaggctggaaccctaatccaactaccgccgccgttgccagccagcacgaggcccgccgccgtcatccccgcagtcgcccacgacggatccaaacgcccgaggctgggagaccactgctgccaccgccgtcgtcatcgccgccctgcctgaggcccgcgccatcgtccccacggtcgccagcgacagatctgcccttcccgcggcgcggtgaccggtgacggatccgcccttcccgtagtggcaggcgacggacctgccctccccgcggtggccggtgacagatccgccctccccacggtggcagacgacggatccgctccgccgccaccaccctagccgatgccgccaccatcaatgccgccaccgctctcaccgatgctgccgccaccgccgccctagccgaggctgccaccatcgccgggagtgggtagagggagagggaggagggagagggctggagagtgagagggagatgggaggagtaggaggagagatgggaggatgagagggagagggagagggagtgggagtggccgagtgggaggatgggaggagatctagtggcatcaggagctaaaaaggtgggtgggctatttttgcatgctgatcacttaacaggtccgcacgcgaaaataggctctgttaagaggctcgtctgcgaaaattgatttttctgtgtggtcattttaaagagtcgcatgcgaaaatagagcacgatttttacagatgtgaccacttatagttcgtctgcaatctaatgtgggtcccgtacaggaaaatcattttttactagtgtgtgatctaaacaaattaaatatcatcatgatcaatctatccttaatttacttaatgtagtcactaatacttggctttgagtttttagattgaatacacaaaagttcgtccagttattattatattacaacggaataaaaacaaacctacatgtgcttagtctcttgagggctccaaattttgcacatggtactctgagaagaaaaagatcttcattttttttttactgtggttttggttaaagttgtaacggtatataatggctcgaaatatatattagagctgttacatttgtatgagaaatgttcttatttatatctatgtaaatcgaacatttcaagaaactcgagttattcagaaaaataaacagtgcatatgtttggccttccatccaaatggaccaaatcatgacggtttagactaaaagaagagttacacaatttataatatactaattgtttttttaaaaaaaaattgcagctgaattataagaaatcataagagtagctaggttgatgggtacagcttaatattttttactatttaatttcagaattattacaactttcatttattaatgttgaatttaaaaaatatccatacctctattaattgaaaaagaaataatagataattaacaaatacaacaatccatctaccgggactccatgcatgcccttttatcatgtacttcattggattattgtaaccgattattttcccctcatctataaaaatagtatgttttctcataaaatatttcgggtcccttgttctaaactatttgtttagtttatttattcatgtatttaatttattcttataatcgtgtagataatctattacaataatgtagttaataatctgttttaaagtgtcctgaattgtagtggtttataacatctagaagaagcatgcacgtcatctgttattctctgtagctcatatttataatatgcaaagctatagataactacacaaattaaggtcaattgagatgacttattggtgtgtcgtcccctacaaggatatgatcttcatctctagctaaaccttgcgtgtgaaaaagcttgactagccatcgagcttaatttcattaatcaactagctagggctgactaatgagatgattgattatccatccatcctaaaatataagtgattttagatgatgtaatgtaacacatcctagtagtactatgaatctgtacaggagtctgtccagattcattaagtactaagacgtgttcctgtctaaatttataggactagtacatgttacatccacctaaaatatgtctagtacatgttacatccacctaaaatatatcacctaaaatatatctattatattttggtacagagggagtatacacctggaaatgagcccgtcacttcattatctcactatcgtacggctgcaggattgagattagctactaattccaaaagaagtccacaagcttgctagcctagcttgattttctctttgggagtatactagtaattaactactacaaatttcaccatttcacactgctatccggttaatttgacgcacgtttcgcacgtgtcgtcaacggtctctcagctgactagcgtttcgtacgtacggtcgttaattaggtaaagcgggtagagattagtttaaggggttaattacgcatcgggaacagtgccaatgatacttttgtcaataatagagcaagtttaatagtatagcctactactagctttaattcatctatagtcaatctaaaagccaattcatataataattgcttactatactattagtatatggtcccacatatcatacacacattacgtcttagagtttgtggtacagctggctacagatctgttgcccgctactcatctctctcatcttttatctcattaaaatatgcttatagctgactaatatagtctgctactgtacctgctctaagcagggtaagtggcacatgtattgatagcttacttaatcattgttgggtcagtggtcacttaattacttactccatccaaaaagaaagttacaccttcgtcccaaaataaatttatttttcacacattctatacatgtcaatataaaataaaaggattagaataccctcactttatcaaatccaaatacaattattctctcctttatatactcttaatgtatttatctcctacttttactgtgaaatcattgtcatgattaatatttgtgatgaacaattggctatgcaaatgatttaatcaaagaattggtttgagagtttgtgtgaatgttggtgtgagtgcgtgtgactaatgtgggtcaggttgtgatatctgtgcccagaaacggttgttttgtctaattgtgtgcaggtgacttgaggtcagccttggtcaatggtgaagaccgggactatgctcagggaggagcagaggtctattgcggtctggataccatgtgagaaggtgagtagagtctggattcttggaggtcaagttcggtcaacggtggggatcgggactaaactcaggaaggagttgaggtccagacggtaaagtataccgggtgacgaagttggatacaagatggcatacggtggatggacatcgtgtgggagagatctttgcaacgggcttcacgaggtgtgcgtgcaagtgccagtgtttgcgaagggaattgtaaagttggagtagtatatggtgctacagtacacgaggtactgtagcgtgcaggtatgcatacatgtacgttgctgtacatgtatgtgtgatcgatacatgcatggtgaagcatgtatgtgtgcatgattggttggccgagcagcaggagagcgcctcggtgggcttcggtggctgttggcggcatgccaagtcggcccaggagaagcaagggcccagctggcagcgagtcggagacggtcacgcgtggacgtcagcttgggagcgaatccgttttggatttctggtgcggccggttgtttgctgcacgtttggaaattgtaaaacgtatggaaactgaaggatggagtcctattgtgtataagagttctacacctattttgagtaggggtttttgtggtataaatagagagggagcgtgaggcttcctgtatcgctttagagagcaatagagttgagttttggtttagggtttcgagtttagtcgaaatttttgtaaggagtgctgttgttgcactttgtaaacacagagagaagtaataaagtcgtcatccactttaagagttcttcgatttgtgtttcaccgggtttcggcggtctaaccggcaactcaccggtggtcagaccggcggcattgcggcggtcagaccggcgggagcgaggcggtcagaccggctgcagcggcaggtgcggcaggcgacttcggcaatcagaccggagattcaacaccggtcagaccggcggcatccactcggtcagaccggcagatcaatctcggtcagaccgacttccgtcgatttcgagggtaacttttatttccgctaaaagttttcggtttttgggtataggtttttgggtataccaaccattcacccccctctggttggcttagttcttgtaattcgatcctacatttaccaactacaatacaatgattactcaaaattgaacttgttttaggacgaataagagaagctaaaaatgaacttattccacattctgtagaagtatatattgtctagcaaatattaaggtttggaaaaaattaataataccctaactaaatttgaattactactaactataaggtagatagagataccttctttccttaaaaaaaactttaatcactttcgtcaaaaaaaaatcacctttctatgatacacttaattaatcacatgatcaatccatttagaaaaataaaactgatagctgctcaccagttaattagtgcttgctggtagccagtcgttattcttgttttaaggggaaactaaatgggatgcccaaacgatctcggacgtcgattctcccctaatctcaatcttggttgcgtccatttcaccatttcaaccaattagtcggtttccttacccgagagaaaacactaaattagattataattaattaagtattaaccttaataaacttaaaaataaacttatttaaacttttgaaggaacttttatatatatagctttttttcataaaaatcatcccgattagtggcttgggaaacgtccccgtggcgtcaattttgatgccttatataagatacttggttcaatcttttgagagatttatagaggtcactgagaatggaagctacgtacctttcttcttctctatctttttgttaggaacaagtaactgcgatttaattatgttcagaatattaattaaatttggtcctacgtcgttttgaggctaattctatcgagctgatcgttgcagtaactcattatttctttgcagctggagctgggtcggatcagtgagatgttgagctcttttgttttatatacatgtcttttaactcatctacttgctccttgttaattaactgatcaaatagaggattatgtcaatgtcattagtcatcacctgcctgattaggacattatacagtagttatatattgataacatacagatgttacaaagctagatatgcaccttttgatcgcctgcccattattctgtcaacttgttcatcatggtgtgttctatgtgtagtgacagtataactgccaaattacagtaatctaacgaatcaaacaaggtatccagtaggtagaaataaacacatcaaaggcacctgtgtgtcgccttcctagattttgctttcgtcaaacatgtatgttagttttgtcactgacaaaatatatcataatatgcttaataaaactacaaatccattttggcaccggttgcaactgtatgatatgaatttacaagctctgattaaaataaatcaatacaccaaacttctttttttataataaggctggggcattggagattgaactttggaagtagtacggaagtttcagagatattgcatcataggacgacaaagagaagtggaaccttttgctttgcagaagttatttcacatatataagtcataacgaactttggctaaaaaaggaggaagaaacatgacgagatgtcaaaggtgtgatcatgtagttgtcaaattaaatgtgtatgtcaacattttgtttctttttgaagtggaaatgtatggatccacttgatgagaccacgaataattcgtggaaaatatataaagatccaggacggcaaaatttccgtgctaaaattattttggaaatgtgggtatggaaatggatggttctaattgtattcattagttccaagaggaatttcattttcattagttccaagaggaatttcattttcatgtcggtagattggacggttcagatcagaaacctcactttctaaaatattattcccacctttgggccttttcatggtcaaattcgttagaaagagatatttctctgttcaatttttgtcaatttgactatgataaacgtcaggacacgccagtatttcttccggtgttatatatgtccacaaagttattcattttcagaaatgttgaaaccagcaaattttttttaattggagagtaacaaacaaattattcatttgagtgtcattctattccattatctaaaaaaatttgagtgtcggttcttcacaaaaagaaattcaatgaaaatgatacaaacagaagtctgcatcaaattagatatgaacaaaaatatcaaaatcatcggatacatcatagcctacttttgtttattacagaaaatcccgaaaattgttgtaaaaactgctgccatattaggtctatgccaagcagagctttttcatgcctgcccactaagccactatatgtttcaaaagtttgagacaagaagattaaagaggagaagcttgacaagtgctatgttgcatcattcataggacgacaaactgaagtaagtctcctttcctctctgatttcttaagtaaaatttggggtaaattaagcagatatgggcaaacagatataatgcttcagctccaaatagatgcccgcattttcggcacagccttttatctttttcctga

SEQ ID NO: 67824 - DNA, 2447 bp, Oryza sativa
tatatcgtctttaaaaaactcagtgaaaatgatatcaacagttgatggtctacgtcatgcaagagcttagtttaatagacaggttgcatatgaaacaaattaaaagctttggaacagcagtaatggcagataatgatccaaggaacaaattggacatttgatatatatattttttaatttcgcacacctgtattgttttccaaatacaactaggctcttgatcaggcttgccagaatatataaaggataatgacaaagatcaccaaccgtctctgtcctgcactgtactatcctacaccctatatctagctagccaaacagaaataagttcattgtgttagctgagaaacacaaaaactaggtttaaaactaacatgctatcttaagtttttcaaattaacctagttatttgaacactaaacaaccaaaagaacggggtgtattaccggcactagagaagtaccaaaagataatttgtggtatctgctgtgccatttttaaaggcataaaaaggctaaaattaatattctctcaatcccaaaataaatacatttatagtttttccctaattaaaaccatcctaaatttaactaaaaagagaagattattaatatttatagtgcctaataagtagactataaaaataatttcataacagatttaatgatgctcatctgatatcaattatttttatttttccattggattggtcaaacttaagatggttgacttagcatagaaccagaaataaacttatttcaggatggacaaagccaacaagtagttgatgaaaccataattttttgtgtaacatctgaaccgtagtctataaatcacctgcacccaaattccaaatccaaaccacaaactctcttttgttgtgaaatactccctccattccaaattgatctacatatttcataggtacaccaagacaaaaaaaaactaataactctctcatactatatttattatagcaacaaactcgatacatgcaccattcccactatttcttagccaatagcaaatcaagatattgcatatgggttataaatacttgtgtgcatgcatcaatgtccatttactccaatgcacaaataacgaatagacttaatgaataaacacaaatatgtagatcatttaagaataaaaaaaaatatgtagatcaatttgaaatgaagggagtagtttttatgtgtccattcttcaaaccccccccccccccgggtcattctgcttaggacatctcccacaaatacagtaacagcatgtgtttgagatttcagttcaaaatttccgaaattttggacccaccggcacgaaactattgttcccgaaaatttcatgcttttgtggaatttagaaaagaaattattaaattcagtcaaaatttattcaattttcaaataatttcgttccgggaattcggtcgcctgataccaaagttgtaaaccctggtaacaacatcacaaaaggtcgctgacgtaacgctcgagtcaagaacacaacagcaatcacttgtacaaaaaccgcaagaggcaattgaattcacacgaaagagataagcatgctgtcactgacgacgatgctaacgtactgtaatctactgctgattttgctcgacagtaaaacagcttgatcgatcacagtttcagagaatacccacttgtcgcaaaccatgggcgcatacgatcgatcgtttgacgcctgtcgccaacacggctgacgaagcaaatttgttgatgtcgctgtcggattcagaggtcatgttttcagttatgcatcatcttcagtttgttcttcagcttattcgatcgatatctcatatctgtaaagtgtggtcggtgacctttattttttttctccccatatccgttccttctgaaatcagaagctttctccgtctgaattgcaacattcttctggattaatttgtgctgtaagaacatgttttggtgtctgaactctgaactctgaaacctgaagctttcaaagaggattcggcttagccgtcatctagtcgtaaacgcgtcccagcatgcttgtgaaaagacttgctggttgaaatgttttgtcccttgttgacatgataaggaaagatcaaaggtttgtcctgtatgttctgttcaaagtgtgctcccaacatgtttccaaagaagccaagccaactctaacagattgtctacaggactgtttccaattctttttctgtttttttccaaaaagaaaattttgtttcaagataacaccataggaaatggaagaagtcctagtttcctgtcttgagaattttcaagatgtataattcatgcagcaggagtgttataactatttacagtgccatagctcattgtcgttgtggaggataaaaatataaattctgcataattagttcccaattattttaccattcactgattcacaggtcatcttgtttccacatgaca

SEQ ID NO: 67825 - DNA, 4345 bp, Oryza sativa
ggtagtaaaattttccaactaggggttatgtttggtatgaagcatatactgaagagatagaatagtaggtgaatgattgatttgcaatgccccaatcaatttaccaaaccaattttgagttgatcaaactgatttggtagtagtacatgtgcacttatgcatggacaaatccacttcaaatttcaactggaggagagtttgaccaagaactgttgtttaacaagctagctactacaagtgtgatttctcaacaaagttctcaaggtacctaatacctgaaggtactaagttttatactaaaaaatatgatacctcctaataccttctcatgaatgttaaaattacctttttttccctagggttttgcttttgatagagatagtatataagaaaaagaaaagaaatgatgtttgaactcttgaaaagaatggtaattgaagttcagaaaatggaagaccaaatatgcagttggtccatgtgctattattgtaaccatccaaagtgcttctaaacgtataaaattaatgcaataatgaacactcgatgaaattgtttgtttgaattttgtaagttttcatcaatcacgtggtaaaattcaatcttggtaagatgcggcgatctgtacctaggcctaggagagcattagttattcacacacatgcctgacttgaacaatcttctaaaaacacacgcactatcactacgagtgttggttccagctggttcgtgacagcagcggagcagaagaagagagctttctccgtgttgcaggtcagaaattcagagatgttgcggctgtagaaggcaaagatttcaatcttggcagctttgattttctcctcttttcgctgcatatctttgcgtcctggcacaacgggttttcacctgtaagttctgacagctgatgcagagtttggtgaagttccactgatatttagtcttgtgacaagtggaaggcaaatcatgttcatgagatcacctgaaaatgccctgcagagctgcttctgctcaatttggaagttcttcagagaatgagaattcaaccaaatcttgcaactgaatgtttggtccaaaaagaaaagttttgcatgcataggataccagatgaagctactgatgaaatcatgaaacctgatctgaataatcatttccttgtattgttcaggtgaagtctcattgtcatagaaaccaaaaggcagatggctgtaagccctgcaagaatctttggttggctatcagatgcagcagcctaagtagttatcacacaaactaaacctaatataatcggatttatttcggttcttgtgaagaaaatgctcacgcatgcacctaccgaaaagggcgtgtgccacagtacttagacacaaaactaaactgaaagtctgaaaaccagtttagtttggtcatggccaacgacgactctgactctgacaaccgcttgcatacgcactctgaaaccgtgtgttttgtttatgcggcaaattgctgacctgaccaaatcctcttgtcgcatttgggagttctcactgatttggttatgcactagtggttaattagttcgctcaaatatgtatttccttttttttactgcttaaatgagtagcatgggatgttcagtgaagttaatttattagagaggttattcctgacaggttaattagattaaattgtgaaaattccatggaagacgttggccttgtggttgatgagaatcaaaatccaatctttgcccatctaacacctactacctgcttctttcattttctcgcctttgttaattagtgttcaccgaagataaacaactaggtatttggtgttgatagggcatatacacactactttttgcaagaatacattgtttaggagtttgaaaaacgtaaaaataaaaattcaaaatgaggaattagaaaagaacaaaaccttaataaaaaataaagaaatttgagttaggacacaactaaaacttgtaaactacttacaacaatgtggaacggagataatatattatgagtatggttacaattttacttatgacaaactcgatttgagaaaaagaactcggccattttacactctactagaagcaacgtcgtctacctaagaattgctcttgtgagttgggccattgtttggtaggtcaggcttaacactagctattctgtaacgggataacgagtataggcccagttgtttttgccagactatctaaccaggatttgggctttccagacatgcatgtacaacccaacttttgttagatggggcatgtacacacttaggccggcggaaggctaccgatcaaagtagccttccgccggggtaagtgtgcacgtgccacagctggtgtcgctgggccgggcgccgttccaccacggcgtcgaggcggtgggacacacgcacggggccgccgcgcgacgagttcgccccttccgtgacggatcagctcgccgaggcgcgggcgtccagttcgatcgacctcaccgcgacggccaggccagcctccaggccgaggcacgccggcgccgggaacgatcgaggtcgcggcgtccggttggcggccgacgtgggcctactctctcggcggcggatttaggaaagattgcttagttcgtgaccgacatagattcggtgtatgcgtgctccacgatttaaaagaaagaccaacacccggtgaaatcgcaccaacagaatccgagacacgaacacgatgaacgccaccgttgcatcaccgtcggagcccgccgccgccgtcaccgtcgcatcgctagacgagctccgcgaggtggccgaggatgatccccgcgcgtcggaggacggggggctgcgcgtggcggtcaccggcgtccccgtcagccaggcggaggagctgcacgcgctcgtccgcgaccacgtcgaggcgaagctctggagcgtcggcgtcggcgacgaggccgacgccgccatggcggcgctcaggtccgcggccgacggcgccgcccgcctcgtggggctgagccgcgcgctggacgccgtcgcggccggacacggaggacggagccccggcgccggccacggtgccccgcgtcacgctgctgagggagcaattgttgccattgacctcctcccatcggcgtcaatccactatcgcgcgaagccacgtcatcagcctccctcactcattctcctctatcgccaacgtgcacatgcagatctcaattgaacgtcttccttaccagcagccgtaattggaaaaaaaaatagaactgacacgtgggtcctacgtttataggtattttggtctatatgatgacgaaaaatataacgatgataatatgatttgtagatattcggatgacaagtgtacaaatagatgaattgtagtaacatttatctgaatcagcatatttgcaataacatggatccaattaaacaaaaattgggttacacattacgttacgatgaattggagtaatatctggcttcccaacttgagacctcgaggatgtggataacaatgggaggatcctcgaacgggatagtcatccccaacagggcagcgatccgtgccctcgtcttctccgccgtccgccggaagtaggccatcgagtactccagcgactccggcgacgtccatctgtcgccggagtaccgatagtagctcagcgcctccgcctgcctccctatgtccaccgcctcgacgacagcaacgacgtacttgcgcgggaggaacggcggcggccgttgggtggacacgtcgcgggccagctccgtcagcagcgtgatgcggggccccgtggccggcaccgggacgccgtcctccgtgtccctcacgacggcgtccagcgcgcggctcagctccacgaggcgggcggcgccgtcggcagcggacctgagcgccgccatggcgtcgacctcgccgacgacgctccagagcttcgcctcgacatggtcgcggacgagcgcgtgcagctcctccgcctggctgacggggacgccggtgaccgccacgcgcaggcccccgtcctcctccgacgcgcggggatcatgctcggccacctcgcggagctcgtccagcgatgcgacggtgacggtggcggctggctccgacggtgatgcaacggtggcgttcatcgtgttcgtgtctcggattctgttactgcgatttcacctggtgttggtctttcttttttaaatcgtggagcacactccgaatccgagtatatgtccctctttttcttttttttctttgacctaacaacaaaccgtctcggttcatccccgaaaaatcctgaaatatctcgccatcaaacgaaaccgtccgcgtcaagatggatctggaccaaccccagacgatgcccacctccgg

SEQ ID NO: 67826 - DNA, 1576 bp, Oryza sativa
ctccgccgccgccgcggcgcgagcgcggatcacgcagaccaggacaccgacgatgacgacgacgacgaagatgcgagccgcaaacggcggcggcggtggcggtcgaggtcgaggtcccccgtgcgatatgcgtccatcgaagatgccaatctgggtctgagtccaccgtatatgtatatcccgcgctcgccgttgctgtcgccgccgccgccgcgtcggagctgtagtccgcagggctgtgatgaggatgacgacgacgacgacgacgaagacgtcatctcctccgacgagaagtccacgaggggatacgactacaccccggcggtgcacgccgtcccgagcgggctcttctcctgcgcggcgctgcgctcgctgtcgctcggccactgcctgctcgcgccgccggcggccatcgccctgccgtccctcgagacgctgctcctcgcccgcgtctccgacgccgggagcgacgtgcagcgcctcatctccggctgcccgcgcctcgccgacctgacgctcgaggcctgcgccacggtgaccgcgctcaccaccgtcgccggcctccgcaggctggccctccgctgctgccacgccctgcgcaccgtcgccgtcgacgcctcgccggggccgccgcgcctccaagcgttcgagtacaggggctccgtgccggacgacaccttcctcaccatccacggcggcgcttcgctgacgaccgtcgcctactgcaagatagacatctgcggcgaggaggtcacgtcgtcgtcggagctcgccaagctcagcgcgttcctccgcctgttcgccggcgcgaagcacctccacccgagtccgcccgcctcggctccggcctcgacgacgccgccgcgttcgcgacgctcccgacctttcagccctctcccacctcgagctaagaggatacctccccaacgacgacgacgacgccatctacgccgcgctgaccatgatcctcgagcgcgccccgaacctggagacgctgtcgctcgtcttccacccggagcctctcgacggcggcgacgacgccatgctgcatatcacgtactacaaagaggaggagctctacgacaagcacctcctcagctacaaccggcacagcgtcctagccgcgccgacgagcggcggcggcgccatggcgccggcctgcctgaggaggcgggtgagggagatcaacctggtgcactaccagggcggcgcggcgcagaggacgctggccatgtacctgctccggagcgcggcggcgatcggtgagctcgggtgcgagctcgccatggggcccttgtggatccaggacgagctggcacgggagctcgagggctgggtgatgaacaaggcggccattgtcaacatcggttgatatgatgccgctttgcgcaaccatgcatcgattaatttgatcttgtccagtttgatttctttcttttgttcgaaagagggtttgtctttggctgttttcgtccttgtcgatgtaggccgaaattttaatccatgtttagaaaatatatgggtttgtctatttgctgccacaattcttatttagttgactattcttatttagggt

SEQ ID NO: 67827 - DNA, 1844 bp, Oryza sativa
gaggacggcagcgggccagtgtaacggggctggaggacggcagcgggccggtgtagacggcgggggcaaagcggaaagagtggtagttgaaggcggccggtggtggcgccctgccgccggcgacagggaagacgacggacagcttgccgccgtcggcttgaggcaaaggagaggagggggaggggggcctcatcggcgccgttgacacctttcggccagccggcgaggccgggcggcggcgcgctggggcagcggtggcggcggaggcgggggaagcgctaaggagcggcggcgtgaggaatcgggagaggagagaggatttttagggtttggttgtctacacgaatcttaaagcaatcgaatggtctaaaatttctaagatctgtgagggggttttctgtcaaatgatctatagacaggccctataaagtttggtctcaatactggatttgttttatgaggcttagagatgcaaatcactatttctttgattatggatttgacttattataaccttttgattctgtacgttaataaatttcccgaaaattaatatgccgtacagccatagtggtctcctctactgtttttgggtcaaacaagtgttatatgataaacttcttcatttgatttgctgcgggcaacacgtccataatgctataataataataatacaatatgttaacgccgattatgaagtctaattactgcaaaaggtaaaaagtatcgaatagaaaaaaggggcaagtaatgttaaatggtgtgaccttttctgattttatctagaaaaaatgtccgtgctttaagatgaaattttaaacggggcaagtaatgttaaacaggtgaaaactattttaatcttattattattatgtcgagttaagatgaaattcactgtgttaaattcgcttggatatatattttgttagaaaatcgtaagctgcaattaggtgtccgatcgtctcaagttagtatgtgagtttttaaagagatttcttatacaatttcttctgtatttctaaaagcgaacgaacttagaaactggctcaaatacagatttgtattttcaaaagcgaatggacttaaaaccgactcatacgcagatgccgtactaaaataccagcaaaaacatctttattttttataatagtagagaaagagatagagatagagagatatgtgtgcagtagcttgattgaatatttctctgattaggtttttgtatttctcttggcaaccgtgatcgatcggctactgttgctgatcgtcttgttgcacgtgtggattttcgatatgtgggtagtaatagatctcggctttgatatcctgatcttttttttaatctttctggaacacgtatacccggcagaccgtattggattgagtttctgatgaacacggtaggaattcttctcgatacagtgtatgcgtgtagagaaaaatcgacaatggtatgtcgtgctgctggccggcctcggcacacggcaacacaactgactgctgctggttggtgttgatataggtgcgtgacaacaggtcccaaaccgtgttgctgaacagatcgtatcggcaagatgacaacttcgcggtggcagttggttcgtgacaatgcacagcacgaaatacaatcggctgaagtcactgatccgaacaagcaaattttcttagggaaaatccaacgtttaaagctcatacatgtgggacacataaatagttaaattgacagtgataatgtgcgagacggatttggacacgacgacttaccaagccaccggcaaaaacatcttcaatttttataatagtagagatagagatagagatttgtattgctttgtaaacttcag

SEQ ID NO: 67828 - DNA, 2802 bp, Oryza sativa
tgagttgtccccaaacacttcatcttacttgttgaggaatcgtctgatgaggaatcatcgccagtaactttccattttcccctcgtgggggttgccaactgtcttggatttacattgccgatgtcctcaacttcctcaccgtctccttagccacctagacattgattctgcaattcttgcaggtatctaccttgtcggtcatcgcatccctttccactccttcccgactcctccaagtagacgtcactaggaccctccctaccctgagcatctacgtacgttgtgtcaattctgcctcctctacctaggccactaccaaagggacacatcggcctgacttctcctcttggatctatgttatacttccaccaccaccactctcaacaataaatagtatccttttgatgtagcccaacaatagtatccttttatgtagcatgagtgtctatcaagggctagataataataaatgattgcctttgaattgtatttcctgtagcatgggtgtctatctagtccaataaatgattgcctttgaattacatttcctcttacaactctcgtacggtgacttggaaaaaaactgcaaattaatgtacttttcttttacgaccaaattaaagaacttgaactagctacgtcgtcttaaaacccctggaaatcaaatttgtttggaataaggtcacctgacgtccctcaactttacgtcgagtttgtctgaggtccttaatccacaataccgaaaatctctacccctcaactatcataaaccgtgcacaaaaggtcccgaggcagtattgacctaatttttcccggtttcgctgatgtggcatacagtaggccctacatgtcattgtcctcccttctcttctcttctctctcttttcttcttctctttcctttcgtctccctgatctcttctctacttcagcgagactgcaggcgggcggggcggcgggcgaagcaggcaaggggcagcgcgcgcggagcagcggcggcggcgggcaagcacgcagtggataagtagagtagaatagtagaagatgaatgcatgccagctccctcacgctaattaagccaatcccaatcctaatcctaattcctacgtgccctgcactatttgtccataccttcatcattttgcttactaattggcccaaccaaatctttgctttgtttcccctacctaagctaataataatctagctaacgctccctcactctcaaagttagcctcatcaattagcagcgtgaggaggatacagatcaatacatggcggcgggagcagccgtgcacgtcgtcaggcggccgccgctacagatcagccggtggtgtacacggtgtggaagaggtccagcataggcttccagggcaccgatggcttctccgtctacgactccgccggcaagctcgcgttccgtgtcgacaaaactactaccaccgccgcaaagctttcgccggcgacctactgcttaaggatggccacggcccacggcacgcctcttctctccctcaagccacaggtcaatcatctttccattcacttcattaattcttttctagctactcgtatatcgctttagcagcagcctgtttactgatcgatcagatcatgagtttagtttactagtttggaatcatgtatcttaagatcagctcagcgtggaggagttcatcgcgcggtacatccagctagctgcacgcgccacacgtcagggacgccgtcgctgcactcgtgctcgacatgttcaccgcgcccatagtcgacgtggcgtgcgacctcggcgtgctgtcctacgtgttcatgtcgtccaccagcggccagcaccatgctcgcgctcatgctgcacctccccgtgctccacgagcgcgtcaccgtggagttcgacgaggtggacggggatgtggacgtgcctggcctgccgcgcctctgccgccagcgtccatgccgtgccgtgcccgatggtggacaagaagagccccaactacacgtggttcgtgcgcctcggcgaccgcttcatggacgccacgggcatcatcgcgaacaccgccgaggcgccgacgagctcgaaccgcgggtcccctcgccaccatcgcggacagtcggtgcgtgcaggggcgaaccgcatctccgatctccccgacgacctcatccagcgcatcctccacttcgcgccggcgagggaggccgcgtccaccggcctcctctcctcccgctggcgctcgctctggcgctccaccggcgccgcacctcgccgtcctcgtccgccgccgcgacgacttcttctccctccgcgacgcgttcgtccgctccgcccacgccgcgctcgccgccgccgccggcggccacgtcaggaggctcaccatgcacgtggagacggagcgcctccccgtgcagctgacggccgacgcgttcctgcaccgcgacgcggaggactgggggaggaggcacgacgtggtcgccggcgtcgtgtcccacccggcggcgcgccgcgtcgaggagctccgcgtcgccgccgtcaggtccgccgacgggccgtcgtccgacagggaggtcacggagatggaagaaggggagttccacctctccctcggcggcagcggcggcacccagccgtcgacggagacgctccgcgtgctcgacctcaccgggtgcggcggcgtctccctccccgccggcgcggcgctcccgcggctgacgacgctgcggctgcagctgtgcgtcgtgcaggtcgaggacctgcagggcgtcgtcgactgcgcgccggcgctcgccaccgtgcacctcgagtccgtcttcc

SEQ ID NO: 67829 - DNA, 4259 bp, Oryza sativa
caccactaccgcgacaccaccgccgtgctccgcgcgcgcttctggcgcttcctccacaacttccgcggcgtcaagtccctcaagctgaaggtgacctacctcaaggcgatcgccgtcaccggcaacggcaaaggcatcctcctcccgccgctccatggcgtcgagcgcctcgacgtcgccgcgctgcacgacccggcgagcgagacgtccacggtggccatcgccaacctgctccgctgctgccccaacctccgcgacctcgtgctccgcctcagcacggtgccgccggattccaccaagaacggcggctactgccgcgacgtcctgcggaggcgctggcaggcggacctcgacgagtcggtccaccgcctcgcccgccggcgaggctggccgaagccgccgccgccgccgccgccgacaaagatctcctgcatgaaccaaagcctggacgatgccggcggtgacatccatggattgagcggccgatccttcgcctgcttgcgaagctcgttgacaagggttgggatccagttccggaacgacgagcgcagctggcttggcgtctcgctgatcaagttcttcgcggagaacgccatttgcctcgaggagatgcgcgtcgatggagggaacgagaggatgcgcgatcacatcaatcgtagggttgagagatggatcgttgagagtggcatgcgatgctttagagtgttaccgcttgagcggcgatgaaattaggagagatggattattgcaaacttgcaagtgactgaaattaatcaaggtcttgataagttgtgtgttgcaaataaaatgcgggttttttttttctagcttgttatcttcagtgataaaagaatgtcgttttaaattggtgtagtacaaaatatagattttggatataccaaataatcaaaatgacatatatagccaaatttgttatgaagagagctttcataacattacgcttgtgtgtaattaactacattttagttcatgttaaagaattggtgagcattgttatttactgcctctatctcaaaatatagctactaaagtgtgttttgaaactaatgattagccgcacgtaaaactagaaacatgattaacatatgattattgagtactaattactaaaagctagcaaaataaatttatttgattttttaaaacaacttatgcatctacttactcatcccaacgagtcacaaacatcactcgattaatttgtttagatagtttctcatctcaaccaatcatacttatttctcacctcaaccttatttttttttaaaaaaaggtatatatatagggaccacatatacatttatagtataacttctacgtaactttgaaaaatccctctataacatagtagtttccgtgaaatggaggttgtgggaacaaatcctctcacatgtgtgtatgccttgactttttttccttctttacacgaatcttaaaacaaatctaaaggttcaaagttatatgaaagttacatagtacaagttacaatgtaattaaattacgattgcattataattacatatgttcaaattttgggagaaaaataatcgaaaaatatagaaaaaatgtaaatatatatttatattttatgatgaatgtattattgagtttgaagcacatggcacgtcctttcaaagtaactcagagacatatgcacgattcaaaacctagtgccatggtaactccttccgttaccttggtaatttctatattttaatttgtttagaatgtgatttgttaggttctaggggaacctaaaactacatattgctaagcctgaaactgcagtgctatgcaatttgcaattcagttcattgttgttactgcaattttgttgttatatatatatctgattttattgtctttttatataagtttgaatatttttctagagatttttatatatttttatgactcaaaagtctatttcatgtaattttgttggtttttgtaagtgagaatagtttattgtgcaatcattcaagagtgataagtaatatagtatgaattatctagtgatgagaaccgtatcagaaaaactactcaacatcagtattccgtaaacacgggataagtactaccagtaaatatctctcactccccacactttctattcaaccttatcctctcatctcttccccttccctcctctctctctctctctctctctctctaccaccctcatggagcacggaggcgacgaggtcttgtgggatggcgcatcgggcgtggaggaagctgacatcaccgccaccgccattgctgctggtggaggtgtgggcggagtagaggaggagatcgtgaagctgttagtgaggtaggtgcccaattagcacatgatggaggcggagctgcccatcacatttcaggaggtggccattgtcgacgaggtcactgtcatcaaggacaagagacctcttgtggtgtggatccgtacacccagatctaggctcgcgacctccaagctcctacgttatctagttctacatttgattttgggttctgcatgttctataggtgtttctacagctatgttggcttttttcctggaatatatttcctttattagtttttattcaactctctcttgataaacacatgatttttagttctttattacggtgacattttagtggtatcatcatactttggtacttgtaggtatcatggctgatacccaggtatcagacatggtaccagtaggtaccatgcttagtacctgtggtatcatggctggtacccataagtatcagacctggtaccgggcacctgtaaggtatcaggtagcatggctggctgcaaggtatcaagtatcaagcaccacacgtcttctctcctcttctcccttccctagccttgatccttgtctcctattgctatcacaaccaaagtcctctcctgctctggatgggggaagtcctgctcggagtagttgcaggcgtcgccggcgaggtatcgcgtgcggagtaaggttctggccagccggaggaaggagcactcctgctcgaagtagttgcggcggcgcggcgccgctggcgaagcgcaataccaagccgggttctgcttggggtggaatcgcgtggacagcgtgggcctcagtcagaaaaagatacatattaaatctgtcgggggatttagttatcccgtgactaccactttgcaatgaaatcctatacagtagctgccctcgaaccatatacattggattgtcatcggagggttgaaaaaacttactaaattttttgaaactttaggcgcctaaaatctacacactcactagaaatatacatgtttgtccatatgaaaattataccattagggttttatgtgaaaaaaccttttgtatttgaatatcaagatactcgtagaggccgtaacaattaaggaaatatataaggatacagaaggtagatgttaaatttgtaccctaagctagagaccgtgagaaataaacataattttcgtaggttgtccaatttgttttagaaattcgagtacaaactacaaagaggtgtacttcaattttcgtaaaacaagggcactcgtatattggtgagaaaggtcaccgtaaatcctagaagttcccaactcgtatcgagaaattaattaaggtaacgaagatctcgcgaccaaccccagatggccatcacctccgccgccggctgcggctgcggctgcggcggcgacggcgaccggctaagctcgctgagcgacggcgtgatcggccacatcctgtcgttcctcccggcgaaggaggcggcgcgcgcggcggtgctctcgtcgcggtggcgccacacgttcgccgccgtccacaccgtctccctcgtggagcccgacgcccccgtcgtcgaccacgacgagttcgccgggtacagccccgggtggggcccgccgccgaaccccaacccgccgccgccgccgttcgccagcgccgtcagcgccgccctcctcgcccgccaccgccgcgccgccgccgtccccctccgcgcgctccgcgtctccatggccggctacgcccacagggtctcccccgcggtggaccagtggatcgcctacgccgtcaaccagcccgcccccgacggcgtcgagctcgacctccgcctcggccgcccctcgctctgccaccgcgactactccctccgccgccgctccgccgccgcgatcgacgaagatgcgaggccgagacggtggaggacgatgccgcccgaggacattctcttcgagagccctagcagcgg

SEQ ID NO: 67830 - DNA, 8148 bp, Oryza sativa
  unsure (1)..(8148): unsure at all n locations
gcccgtgtacaggcggcggttcgagccgcaggagtacagcgtgccgagggggctcttcgcctgcgcggcgctgcgttcgctgtcgctcggctccgtccggctcgctctgccggcggcggccatcgcgctgccgtccctcgagacgctgctcctggccgacgtcaccgagtccgaccacgagaggagcatgcagcgcctcatctccggctgcccgcgcctcgccgacctgacgctcgaggcctgctacgcaaaggcccacgcgctctccgtggcggggctccggcgcctacgcaggctggctctccggtgctgccacggcctggacaccgtcgtcctcggcgacgacgacgcgtcgccaccgtcggagctccaggccttcgagtaccgtggcgaagtgccggacgacttcttcctcgtcaccaccacgaagcacgggcacggcgtctctctggagacggtcacggtcgcctactgcaagatcgacatctgcggcgacgaggtgacgtcgaggtcggagctcgccatgctcggcgcgttcctccgccgcttcgccggcgtcgagcacctccacctcgcgtccgctcgcctcggctccggcctccacgacgccgccgcgttcgcgactctcccggacctgtcgaccctccgccgcctcgagttaggaggatgcctccccgacgacgacgacgacgacggcaccatcttcgccgcactgatcaggctcctcgacctcgcgccaaacctggaggcgttgtcgctcgtcttccacccagagcctctcgacgacggcgacgacgacgacggctaccgcgcatactgttaccacaaggaggaggagctccatgacaagcacctcctcagatacaaccggcacagcgtcctcgccgcgccgacgagcggcgccgccatggtggcgccggcctgcctgaggaggcgggtgagggagatcaacctggtgcactaccagggcggcacggtgcagagggcgctggccatgtacctgctccggagcgcggcggtgatccgtgagctgaggtgcgagctcgccatggggcccttgtggatccaggacgagctggtgcgagagatcaagggctgggtgatgaacaaggcggcagttatcaacttcggatgatatgcttgcatgcgcaatcgtgcatgaaaataatcttaagtaatcatttttttagtggagtaccagtaccagtattagattgtgcgaaaaattagagcaagaataatattgagctctaagaaggctgaatactgaggtggatgagagagaagaggagagagatgagaagcaagccgtaagtttacagccggcttaggcacaatcaccaagaaaatttacgagatagataggtggaccatatgtttatagtgaagagctaactagtatataagtgagctgagagataggtataaagatctatacaaccagcagctggctatattattacccttgctcttatcaaacatatctagattgtattttgactgatctaaatggctgagttcttttttgaagtttccaactcaacctctctttttccgtgtactgctttccaaactaccctccatctcataatataagggattttgagtttttgtttgcactgtttgactactcgtcttattcaaaaaattttggaattattatttatttttttgacttactttattatccaaagtattttaagcacaacttttcttttttttatatttgcacaaattttttcaataagacgagaggtcaaacaatataagcaaaaaactcgaaatcccttatattataggacggagggagtactaaacattcatttttaaataaatatatatatatatatgagagttattttaaagaatcatattaatctattttctttgaaaaataactattacttgattaatcatgcgctaacaagtcgttcttttgcgcgatggagtagttcccaacacctaaaattcattaataggctgtgttctttttagatgttggaaacacttcccctttacacgtaaaacagagtgctggattaacgtatgattagttaagtattagctataaaaaccttaaaaactaggttaatatattttttaaaagcaacattccgatagaaacttttttttttcaaaagacgcactatttagtagtttaaaaaacatacacgcgaaaaacgatggatatgagttgtgaagttagtctaaagaacacattctactaatgaatctgaagtaataattactgttattgctcttatgaatcaaacaatttgatgtaatcatgacaccttaaaaaaacaatttgaagtaaccatgacatctaaaattgaaaattaaatggaagtggatttttatcacttgaaggaacgtcctctcattttgtacgcggcatttaaaagtcatcaaaaattttaaagaaaatgtcaagatagaccaatatgtgatatgtcttttcataattacataattcaaaacgaaaataataaatttaaccacgaattacgtgttctatttaaagttaaatttgatcattataagttaaaattgactatgcatatagtagatctattttttaaaaagattttgttgataatttttatgcgacacttaaaaatgagagatatattttttaaagatcccaaatcaaatcatgcaccacgagcatttgattatgaagagtctgtttggcacagctccatctcagctaaacagtttcagctccaccaaactaggagtgcagttggatggagctctctcacaaaatgtactactccaaactcaactcctggagttatatttaggagttaaagctgtaccaaacaggcccgaagtttgaggcccagctaacccggcccgtagggcttcagcactcggtccagcccgttcgctccgtctcgccgcatcctatccgtactaagtcgcatcacaacatctgaaatatcgatcgccttcttggttcttgctgataggatcggtcgatgccatcgccgccgccgacgccgacgatggccgccggcgccgccgtcgaccgtatctccgacctccccgacgaccttctccagcgcgtcctgcacttcgtcccggcgaaggaggccgcgtccaccagcctcctctcgtcgcggtggcgctccaccggcgccgtcaacctcgccgtccacgttcgccgcgaccaggagcgggaattcttctccgcccgcgacgcgttcgtccgctccgcccacgccgcgctcgccgccgccgccggccacgtcaggcggctcaccatgcacgtggagacggagcgcatgcgcatctgcatgcagctgacggccgacgcgttcctgcaccgcgacccggaggactgggagaggaagcacgacgtggtcgccggcgtggtgtcccacccggcggcgcgccgcgtcgaggagctccgcgtcgccgccgccgtcgtcgaagcgtactggccgtcgttcgacggggaggtcacgagcagcagcgaaggggagtccgcttgtgcctcgacgcgcagccgtcggagacgctccgcgtgcttgatctcgccgggtgcggcggcctctccgccgccgccgccgccgccggcgtcctggcgctcccgcggctcacgacgctgcggctgcggctatgcaatttgcagatcagtgacctacaggggatcatcgacgccgcgccggagctcgccaccgtgcacctcgagtcggtcttcctcgcggggacggcagaagaaggctgcgtccgcctccgcttccgcggccaccaccgcgctcgcgatgatcaactgcggcgcggactgctacgcgtgcggcggctgctacggcgccaccgagatcgacgcgccgaggcttcgatcgttcaagtacacgggcttcgcgcggcggttctccctcgtctcgccggcggcggcgccgccgccggatgacacggtggtggcgcgcgcggagctccacttcctcgaccacttccaccacaaggacgccgacgccgccgacacggtccgcgccaacttctggcttttcctccacaacttccgcggcgccaagtccctgaagctgaaggtgagccacctcaagcacatcgccgtcgcggggcgcgcggcggcgcgccgcgcgctcctcctcccgctccacggcgtcgagcgcctcgacctgaccgcgcgccacgccgacgcggcggcgagcggcggccggacgacgacgacgtccaccacggtggccatcgccaacctgctccgctgctgccccaacctccgcgacctcgcgatccgcctcacccgcatggtgccgcacggctccaccaagaacggcgtctacgcccacgacctcctgcgggagcggcggcgggcggacctcgacgagtccgcgcgccgcttcgctcgccgccgccggcgaggcagctcgacgaagaaggacttggacgatgtcagtggtgacatccatggattgagcggccgaatcttccattgcttgcggagctcgctgagaagagttggaatccagtttcatctggacgaacacaacgactgcatcggagtccggctgatcaagttcttcgcggagaacgccatttgcctcgaggagatgtgcatcgacggtggaaatcagaggatgcacgatcacatcaaccacatggttcagagatggatcgctggtcgtcgctgttcatcagcaaagagcgagaatggcacgggaagttcttcacaacctgatgttttggaaagcagcatgccgcgttttagagtgtcaccgcttcagaggcgatgaaattaaaggagatggtttacggttttggttgaaacttaattaaggtgttggaagattagtaagatgtgaatttatttttagcttagactcgactatagttggccataaggcccgaggcccgaaggcccggcccacggcacgcctttttggcccggcccaagcacggcacggcccgacttgggtcgggccatgccggcccggcccgaccgtcgggccgtgcctgggcctccccaccagcacgctgggctggcccggcacggtcgggccggcccggcacgatgggctggcaggccagacccggtacacaaagtatagggactaaaaatagacatataaatgtcaatgtctaaagaatagggaccttaaatagacttattttagctattaatataccacagcacaaagaagagggaggtaaaatagactttttttagctatacaatgtcacagcccaataggagggagaaaatttagacttattctgaggaaaagcacgatggcccatcgtgccttcgggccggcccggcacggcccgaggcgtgttgggccgtgcctgggctatgagtgcggcacgtgggctggcacggcacggcccggtgcgtcggtcgggccgtgccggcccgacaagcctcggcccaggcacggccgggcctgggccgtgccgtgccgggcggcccacatggccatctatagacttgacggattaaaaggacgaaaaataatataaaaagatatggataacgtagggaaccagattctccttttccaatccattgtaaaaatagggcacacttaggtcatgtttgcttcttaacctcactctgttgtttatcacgcggacgcttcccaaactactaaacggtatatttttataaaaaaaattctataaaaaagttgctgtaaaaatcatattaatcttattaagttttttaaactaatacttaattaaccatacgttaatctattgtcccattttgtatgcgaaggggaggggctttccaacccctccaaaaaaaaatacagccttacacctgttacagtggccaaagagttactgctacacaatgataggaccgacactactactaataaggccatccacaatgggtgccgtcgactcgtgccctcgcaaacggccgtttccctcccgtccccttttcagcgtgagtcgtctccccagctaggaacgcggcgccaagcagggggacacggctctttgcaaggagcaactgcttttcgcagagacacgaccctcgcccctgggaggagacccactgcaggctcccgtctcctcgccgctccccccaaatccccctcctaccctcgcctctctcccacagcgccgcctgctcgtcgatccgctccaccagacgccatcgcgacggcgaggagaagctcggcagccttgaagaggagggcgagccagttgtcggcgaggcgacccgtgaggcggcgctgggcgggggtgccgggggtgtcggagttgagggtggagttgtcagcgaggcgacccgtgaggcagcacggggtggcggagtccggggtcggcgacggcgacggcgacggctggagggagagaggggagcgggaggagggcgaccgggcgctgacctcgccggcaagccgccgccgtcgctgctcgaggccagatccggcaagccccactccgccgccactccgacggcgacgaccctcgacggcgacggcgacgaccccgcggcggagggaaggggatctggcaattgatgtcatcggccagcccgcgcgctcgtcgtcgtcggccaccgcgcacgtcgtcgccgtcggccacgccgcgcgcccgtcgccatcgtccacctcacgcggcgcttgccgttcgccaccgcgcctcattcgactgagagagagggggagagatcggaagagaaggagacagtgggcggaggagaagagaaaatgcgagaaagagaaaaggaagaggttgctgggctagtggtctgatgaggggtatgggtggaatttttgtactgggctaccttgagccaggacacccattgtgagatgtagtacccttatcgggttgtttcagattttgagaagcccatccagggataccctccattgcgagacaagttccccctacgagtgtcctcagttagtgaggacactctaggagtggctcacattgtggatgccctaagctgagcaatatgcattatgatcgccacttactaccatttgccgactaggcgactacactctctgtttctcttctcaatttccttctcttttcttccccatataacgcatgcaagtatttttttctgaaagaaaaaaaaatcaatctttctttttaaacnnnnnnnnnnnnnnnnnnnnnnnnnatccacgacgccctgcaaagcgtgtgctccgctgcctcgtgatacggatagcccatgctactaaacaacattcgtcctctccttaagagtgttgcaatacatacgacttacacgactagagatatgcaaccatagattaaaaaaaaacatgttaatatgcaaaatactccctccgtttcataaaaaacgaatctaataccggatgtgacatattatggtactacgaatatgtccagattcatagtattatgatgtgtcacatccggtaggttggttttttatgggacggagggagtagccatttacaaccgttattcagaccctgtttagatgggactaaaacttttaagtccctatcacatcggatgtttggaaattaattataaatattaaacgtagactattaataaaacccatccataatcttggactaattcgcgagacgaatctattgagcctaattaatccatgattagcctgtgtgatgttacagtaaacattctctaattatggattaattaggcttaaaaaaattgtctcgcgaattaactttcatttatgtaattagttttgtaagtagttatatttaatactctaaattagtatctaaatacagggactaaagttaagtccctggatccaaacaccacgtgagtcgacagttgggtcgtatgtatagccatttcctctccttaatgggctgggcttcctgcttaatgggccggccttgttagtcgatgggtcttctccctccccgtgactcgacgacggcgaagggaaacccaaccccatccatccctctccttgccgccgccgtcgacccgatctccatcgctggcgacggcgagcatcgcatcgcatcgcatcgcggcggtgcccaagcgaggcaatctccccgtccgtcttccctcccggcctcggatcccggaggaggtctctcctcctcgctaggagcggcggcgggtgccgtcgtcctgctgcttcccttccgcccccggtgagcgcgccctcgaactcgcctt

SEQ ID NO: 67831 - DNA, 2105 bp, Oryza sativa
tttcttcacaagtttagttttgcatcaagcactaataacaacattcagaatctgtatcagagaaggacctacttgcagctagctcaccagttcacttttacctaaactctatatatgagctgatttcctgtcaaagatcaggatagaaaagcacaactcactttaccattctggtacaggatcgcttaaagaaacttaaatcagaacatgggaaggtccagcttggaaacataactgttgatatggtatgattctgctatcgattatttatggataaatctattgctattgctttttaagggtgtccttaattgattgggctaaagtcttgaattgttttctccaggtccttggcgggatgagaggaatgattggaatgctttgggaaacatcattgcttgacccggaggaggtatacttgtaactatgtatggttctatgataccataatataaaagcagaagtgcttattttgtctatatatatcttgtaatgtgcaatagatgaaaaattaaacaaatgaatcaccatattttcatgatctccaaacaagtttctgtactaacagttgagcatgatctgttcaattcacagtaacaacgatgtaattattattcatatttgtcaatgtgaatcaagttccacaatcaactttagcacattgatttaaaggaggtacacggacaaaatagtctagatttctcatttctgaagtcactatatagtaatgtgcttcattgaaagagtgtgatgcttttatgatttatcgtttagaggtggcggttttgcttcatattttgagttagagttgtaacttagttggaatttgtgaaatttaaacgtgtatcactccatgttttgctgttggatgtaaatctctctcttttctatccagggtattcgtttcaggggtctctcgattccagagtgccagaaagtgctgccaacagcaattaaaggtggagaacctttgccggagggtctcctttggcttcttttgactggaaaggtttggcttttgcctttcttatagaatccttgttgaaatagtttgatgatctgccaataaagttccttccagaaacagggcttgttgattcagtaggagcttctttgtttacctgttatacttgtaatctcgattttcctattcttatttttgtcagcatttagctattagtgtggactgatgcgtatttgtttgtttcaggtgccaaccaaagagcaagtcgatgctctatcaaaggaattggttacccgttcgagtgttccaggtctgctattgtctctgttggtttattacattattgcttagatgagtttcacatcattatcatattttctgtttcttaaaagttcaaatatagacagataaatacagagattatggaggttttgttcctatgaagttttattctgaaagtacacataaacacaccaagtttcttataaattagtttgaaaacaattgaagctacttcattctgaatttcttatagtaatctgttagctttaaggttaaccttttcaatttccttaagattattgttgttaacttaagaacttcttacgtgtagttaaaattttaaaggcaactgtagaaagtatttttgggccagttccatttattttctctattttgactcttcatgccctctgctgatagatagagtaacttgaatttttttaacctttcctttgatattgtcataatgatatagcttatttatgtattcatctttgataagttgatttgagttcattgtgcattcaatccttagtggtagggagtactgcatataaatttggacatctataaacaccattcctttgatattgtcataatgatatagcttatttatgtattcatttttcataagttgattttgagtttattgtgcatttaatctttagtggtagggagtactgcatataaatttggacttctataaactgatagtatgttcaccacttggctactgggctcccatttgattgacatatgatatggatgcaggccatgtgtataaggcaattgatgctctccctgtaactgctcatccaatgacacagtttaccacaggggtgatggcacttcaagtaaa

SEQ ID NO: 67832 - DNA, 7123 bp, Oryza sativa
acataactaacagctgagattttcattagttgaactgttatcctgaaggacctagacccattgactgcccatggagtctttagtccttagaaatgcgtagtgagtacattttattgtctaatagcatcaaaactatgaaattgagactatcgatctatttctgctggacgagctattgtatggctagaaaaatcctggttgtttggggtgatcctgagagctgaatttctatatccaaggtagaagtggttgtggtgatagtataaggtagcatcataatttgccacagaaaaccttgcaatctcttagctttcaagtccgtatgtttataacttatgatatactttttttttacttttgttggccattgcctatctctcatgactcatctctgggcactaacctcttcatcccatacttgtgatattcaattacaggttggaagtgctctgtcagatccttatctttcttttgcagctgcactgaatggtttagctggaccattgcacggcctggctaatcaggtatatgctcagtttgttgcactggatcttgtttgccgcatcctgctaaaaaggactcattgcgctattcaacatatgctgcagatcatttttaaatcgatttttagtttgtgtgaactgaccatagtcaacatgtaatgcaggaagtgctgttgtggatcaaatctgtaataggtgagacaggtagtgatgttacaactgatcaactcaagagtatgtgtggaagacactaaaaagtggaaaggtagcttatctcactgttatatctatttgatgaggaagtgcatatatgatcgtgttttaactgcaaatttattttctcgggaagtttgaaatgaaaactcagctttctaagagttaattgctaagcattttgtgttatattggatctctaatgatctgcatacagttttaccttattttttgttgaacatgaattgagaatttagaattactaaggtcacagcgcattcatttgtaggttgttcctggcttcggtcatggagttctacgtaagaccgatccacgatatacatgtcagagggagtttgctttgaagtacttgcctgaggatccacttttccaactggttagtctaaaatgtctgtccaactgcatggctctcttgcagtccaactatctcattgggattcttatcgatctatatcctgtcaggtctccaagttgtatgaagttgtgcctccaatcctcactgagcttggcaaggtaatgccactagattgatcatgattgctaccgttttatgtccatcttattggctaaaaagtgacaacattgtccatatttccaggtcaaaaacccatggcctaatgttgatgctcacagtggagttctgctgaaccactttggattatctgaagctcggtatgtttacctgtcctggttaaataatttagtaaccaaatttaatcttgaacccatgatggaatagtaaatgtacttcagaacgagtacttaataaaagcggccatctaattacgcaggtattacaccgtccttttcggagtttcgaggagcataggcataggatcccaggtatatttcttcccttcaactgtctacctctttcttcagatcttgtatcaaccaattctgacttgtgatacattatgtatgacagctcatttgggaccgtgctcttggtctgccgctcgaaagaccgaagagtgtcaccatggagtggctggaaaaccactgcaagaaggctgctgcttgaagctacacacgcctacaccgctgctgttaattcttctaacaattatcatcttggatgttaataactgaggataaactcgaaacgttcagccacattttaatatttttttccaggccaataactagaggaagatgctctcgatcggctggtacatttttgtagccatcgctgttaggatgctcatatagttaatctgccattgggcaacaatgtgattagtttaagttgcttagagctttatcctttgatgaataactttttcgagccttctaagttagctcgagttaacataccagttgtggattatggcacatttcttcatttcctttctgttgttaaatttacaagtacgattcattttctttcgcctgcgccctacccactggttcatgtccagctatcagcattgtgatgtcctagtggtgcctagttggcttatgatttgctttgtgtcaaactaagtttactaagtgcaataatttacccatctttggctgagtgagtttgaatcagcttctatattttccgtagttttctcaatctactaggcgtaatatttcgcacaaaaaatttatatgtagaagtttttttagaaaagaaaataaatatatttttcaagtttgcaatggttaataatttattaatcactcaccaatgacctttaaatttatgaaacatagtgaaggcacattgaaacatgttgctatcacgtatgatacattgagtattaacgggctaaaatatatatttcttttcatcagaacataatcatgcgatattttgttgtgaagatttaattataacgaatacaacgtacgattagataaatagtttaggagaaaaattattttaaaggttattaaatccatgcatgagagaagagagagtaggagcaagtacgatcggatcgtaaatcggataagtagtttaggagaaaaaattatctgatcggatcgtaaatcggataagtagtttaggagaaaaattatttaaattgatactccccccgtcccaaaataagtacagttttacactattcacgtccaacgtttgaccgctcgtcttatttgaaatttttctatgattaacatttttgttgttagtagatgataaaacataaatagtactttatgtgtgactaactttttttaatatttttataaatttttcaaataagatggatagtcaaacctttaacacggattcctacgagaggattctcgtattgttgtggccctgcagacgaaccgggctttcggcccatcacagcctagtttgtttcgccatcaacaccgactttgactcgcaccacctgcaatgcatatccctcgcgttgcgccacggataaatttccaccgccttcgccttcgcgagatcggatcacggcggcgtcgaccgcatatcggcgctccccgacgacctcatccagcgcatcctccgcttcgcgccggccaacgaggccgcgtccaccgccctgctctcagcgcggtggcgctcgctctggcgctccaccggcgccgtcaacctcgccgtgcgcctccccgagcccgacgacgggcgccgccacggccaccgcgtcagccacgacgccgtctcctcctgccatgacgccttcgtccgctccgcgcaggcggcgctctccgccgccgccgccgcagccggaggccgaggccgccacgtcacgaggctcaccttggaccttcgggcggcgaccatggatgtgatcgacaggttcgtgcacacggagaggccgcttggtgcggacgcggcgcccgacacggacgtgtggctgcggctcagcgacgacgtcgagcgagaggcggacagatgggtgaagaggggagacgtggtccgcgacgtggtctcccacccggcggcgcgccgcgtggaggagctccgcatcagcgccagcgcgccggccgtcgacgacgacgacgacgacggcgaggtcgggcgtctcgtcggggtgttccacctggacctccgctacgtcccgtcggagaccctccgcgtgctggacctctcccggtgcagcggcctgcgcatgccgcccgccgtggaaaccccgcggctgacgacgctgcggctgcaggcctgcgccgtgaacgtgaacgacctgcagcgcgtcatcgacgccgcgccggcgctcgccaccgtgcacctcgactccgtctccttcgacgggatggagcacggctgctaccgcctccgcctcccggcggccaccaccgcgctcgtgctggcgaggtgcaggacggacgcggagccctaccgctaccggagaagcggccgcccactggggaccagctccgtcgagatcgacgcgccggggctccgatcgttcaggtacgcgggctacgcgcggcgcttctccctcgcctcgccgccggacatggcgcgtgccgacctccacttcttccacgacatgtacgcctccgcctccacgagccgcgacctcttctggcgcttcgtccgcagcttccgcggcatcaggtccctcaagctcaaggtgagcgacctcaagcacgtcgccgtcgccggcagggcgacgcgcgccgagctcctcgtcgcgttccccaacgtcgagcacctcgagctggaagggcaccacgaatccgcgagcgagacggccgccgcggtggccatcggcaacctgctccggtgctgccccgccgcgcgccacctcgcgctccacctcgccacggcgccgccgcgcgagcgcgactccgccatgaacggcaggtacggccgcgatctcctgcgagcgagacagcaagccgacctcgccgagtctctcgatcgcttcgctcgccgccgccgacgcaaacccaatcctccgccgccgccgccgccgccgacgccggtgaactccatggacgaacacctgagcatcgtaggattgagtggccgatccttcgcctgcttgaagaactcgctgagaagattcgtaatccagtttcggatggatcgacccaactgcattggcgtcaagctgatcaagttcttcgccgagaacgcgattcacctcgaagagatgcgcatcgacggtggaaatcagaggatgcacgatcacatcaaccacatggttgagggatggatctccgattcatcgtcagcgaaaaagagggcgaatcacgagagttcgcagggtatcgacgcgagtacgccacgctttagattattaccccttgagagacggtgaaattggattgtggtgttagcaagatgtggattgcaattcgataaactattgttaatttggattgtcgaatgttcttgaaattgtagatttggattgcaattcaataaaccattatttctttctaatttatctaagaaaaattataaattacccctgagctattggggtcgatcaaattacccctgagctattgtggtcgatcaaattaccccctaacccgaaaaccaaacattgttcaccttgaacttataatgcatgacaaattaccctggtttatcctaagtggcatacgcgtgaaatccagtcagcactttttttaaaaaaaaacaatgatgagacccacctatcatacctcatcttcccctcttcctctctctttctctctatctcttagggtgtgtttggttgctcgtatgtccctagcctggctcgtatccctcatccaaggtgccctcagcctggataggataatgcaattggctatgtttggttgtccgcatgggtttatcctggatgatatgagatgctgtttggttggttgtatgacaggatgttgtacaatagagatggtgtttggtttgttgattggaccttaggtctgggtgacctcttcttacatatggtaaagttacccccacgaagcacactaacaaaaattttctaagtctgactcttgtgggtgaccatggtgttactatttaagccaagttttcgaaaatctcgttaatttcatatatttgacaattttaaacaactagctgtcagtaatcatgtaattttttaacaagaaggaatcaatgtgaaaatcatgcatattttttaacaagaaggaatcaatgtgaaaatcatgcatgccggtaacctcagctacatatatacaagtattaaaacaaattgatccatctgtgttctctacctctgtacagccgtcgtcgatatcattagcatgtatatctgcgaatattctgaaaaaagtggtaaccatctagctatggaacataaaccataaatttagtcatccagattaaaaaacaaaatcaaagtgaccatctttcccaatctctaacatcaagggaaaaaaaagaacaagtgcagaccaaaaaatcatgcccaggcatgttaacaagttacatggatctgttaacattgatcacaaagagcagtcaagtgccaaacaaaaatctgttaacatggatcacaaagcgcacttaatatcagaattcacaatccatttgtacgcatcacaaatcatcacatttgttctaaatcagttgcacccttcacagcaagaaaaatggcaagtgcaaatagctagaccaagtttgtatctgtaagtcccagtggaggaacaaggataaaacaagtgcagaaggatgaaatttatcatgaagcatagatcatgcaacaataatatggtgatggatcctcctggtttcagtgaggatcaattggaccttgttctaactcatctgactaatgacaaggcagcaagccttgtgtacattcagaagaatgaggctcgccgtgctcgttgggttaagaagttcatagaacagcaccaccctgacagcatctaactatttagctaactattcaggagaggtgacaatggacaccatattttgtatgtaatgatgattaaggtggtagtggacaccatttgttcttttggtaggatagtactcactgcttaaggtggtagtgtgacaccaaattatttacattcggctatgtgatggttaaggtggtagtgggacatcaaattatgtatatttggctatgtggtggttaaggtggtagtggaggtccatcactgagttctccaaatcaggctgcacctccgtatgtgttgtagcgagtattgttgaagccacattgttcacagaatcagtcatgttggtgatgagagcaacttcaccttcagccaaagccggggttctcttcctcttcttatctggattagatcctccagtcggctcatcactagtaggcccaactccactagctcgagcagcagtcccaccaccttcaacaccaacaccacttggtccagcagcaatcacatccccaataatcccatcaagaggtccaagagcactgtcagccatgtctggagggttgccaagggcttcatttgagcccatggcaaatcttcctgtg

SEQ ID NO: 67833 - DNA, 1535 bp, Oryza sativa
ttcacaaaaatctttaaatattccgcccgtaaattgagtgccgttatccgtaatgatacgattcggtactccaaaccgatgtacaatattgatgaagaaatctctagctttgtctgcggtgatggtgacgaccggtttggttttaatccacttggaaaacttttccacagctacaaagagatgagtataacccccgactgcctttttgaatggaccgaccatatcaagcccccaaaccacgaacggccaagacaacgggatggtttgtaactcctgagctggtaagtgagtttgtcgggcaaagaattgacaaccttcacatgttcgcacaattttgtcggcgtcggaaacagctgtgggccagaaaaaaccctgccgataagccttgccaacaatggttcgtgcagcagcgtgattaccgcagatgcctgaatgaatgtcttttagcaattgtcttccctcttccaaagatacacagcgttgcaggattcctgatggacttttcttgtacaactcggtctcatgaatgacatagagtctgctgcgcctggagatctgcttggcttcatttttgtcttgagggagttcttgtttggttagaaattttatgagaggttctctccagtcggcttcaatcatgcttacgccttgagtatccatggcttcaattgtttcttttctgggcacggttggttcgtaaagatgttcgacgaacacatctgaaggagccgcttcctgttttgaaccaaaattggccagcctgtctgctgcctcattattatgtcggaggacatgggtgagcttgagtccgtcgaatttatcttccaacttgcgtacctcttgtcgataagcggtcatattgtcatctagacaggaccattctttcatgacttgattaacgaccaactgagaatctcctcggacgattagtcggcgaatgcctaaagagacggcaatccttaatccatggagaacgcctcgtattccaccacgttatgggacgcagaaaaatgtatccacaatacgtagctcaatctttctccagtcagggaaattaaaacaaccccagctccagtgcctgtaagcctcttcgacccatcaaaatgcatagtccaatattccatcttttcctctggcatgttttcttgacactcggtccactcggcgaggaagtcagctaaagcttatgacttgatcgaagttcgtggcttgaaagatatgtccaaagatgtcaattctaaggcccacttcgctatccgtccgtttgctttgtggttatgaagtatatccccgagtggaaacaatgtgaccaccggaccgagtgaccttgaaaatagtgagacaatttcctaacggtaattaagacgccatataataaattttgaacctgaggatatctcgtcttggagtcggccaaaacctcgctaacgaagtatattggtcattggactttttgaacatggccttcctcttcacgtttgacaaccaggaccgtgctcacaaccttagaggtcgccgacacgtataacagcagc

SEQ ID NO: 67834 - DNA, 3472 bp, Oryza sativa
acgaggtcttcaagtagtcggattctttcagtcggatctgatgatatcccgaatagcagtccaagaaactgagtagctcgtagccccggccattgagtcaaccacctggtcaatgcgaggtaacccgaaaggatctttagggcaagacttgttgaggtcggtgtaatcgacacacatgcgccattgcccagtcttcttccgaaccagaactgggttagccagccagtcgggatggaggacttctttaatgaagcctgctgctaacagtttggctaattcctctttgatcgcatccttcctatcttgtgcaaagcggcggagtcgttgtttgatgggtttggcgtcttccttgacatgtaaagagtgctcaatcacctctctgggaataccaggcatatcggatggtttccatgcaaaaatatctttattattttgaagaaaggtgatgagagcgctttcctatttacaatctaactcagcgcctattacaacagttttggatggatcagagggatctagtggaattttcttagttttgtcgtcgccttcttcggtctttgacagcttggtcgtaagcacctctccttcgcttgccgtagtggcagccaatcggatctcttcgcgagcgagagtgatctcgtgggtttgggctatttcgcaactttctttgtcacatgtgacggcttgcttgatgtcgctccgtagtgatatgactcctcgaggaccaggcatcttcatcatcatgtaggtgtaatgtgggacggccatgaatttggctagagccggtcgtccaagtatagcatggtacgttgtctcgaaatcggcaacttcaaaacaaacgttttctgtgcgaaagttttcccgagtgccgaaggtaaccggaagagtgatctggccgagtggtgtagcggataatcctaggatgacaccatggaagggtgcattactcggctttaattccgttcgaggaatctgcatatcgtccagagtcttggcgaaaaggatgttgagtgcactgctaccatcgatgagggttctttggagcttgacgttacgaaccactgggtatagtaccagggggtaccgccccgggtggaccactcggtcgggatgatccgagcggtcgaacttaattgctatctctgaccaccgaaggtattggggcgtgttaggctgaaccgcattgatctcccgttctgttagcttctgctttctcttagattcataagccaggggtccgccaaagatgtgaattagttctttgcgatgatcttgaaaaccaagtgggacatcgtcttcaccatctttcttctttgatgtgccttggtctccgtctgagggcttacgtgcgttcttgacgtattgctctacaaactgtttgtagacgaagcaatctttcgccacgtgattggagttgggatgatgcggacattgggagttcattatcttgtcgaaggtgttgacgcgggaacgttgtcgggaagatggagaggttgttgccacaagctcttcgggcttacgcttgcgatccttgtggttgttacttccactccctcctgcggtcggctgcatcggatcccatataagaagctcgctctttacccgatcattcaaacattttgtgggcggcgctcctgctctattgttgcgtagcaatacaagcctgctcatgctgcttcggcggcgctttttcgccttctcttcgctctggacaggagccctaatggacacggggagggagcaggcgaagcgtatcctttttggcttccaagtggtgcccgactgcttggacgccgtaatagcatcttcggctttggcatactcattggctttttcaaacatctgcttgaccgtcttgggaggtttgtgtccgaacttgccgactaggtcctcgtggcgaatgcctttagtaaaggcggcaatgatgacgtcatcggtgatgtcggagatcttgttgcgttgctcagagaagcgtcgaatgtaatctcgaagagattctccagacttctgaatgatgttgtagagatcgaagtgtgtaccaggccgttcaaaagtgccttggaagttggcgatgaagtggtcgcgtagctctgcccatgatccgatcgtgccgcggggtagcccgtgaagccatgaccgggcagaatccgctagggccacaggtagataattcgcatggctttgctgtctcctcctgctacgcggattgcgagaccatagacggtgagccaagactcagggttggtggtgccgtcatatttctcgattccggtcgacttaaagccagctggccaatccactcgacgcagatcgcttgtgaaggcagcaactccgtccacatcgtcgtcgtagcgatccggtgaatgatggcctcttgctgcgcggtgctggttgatggtgtcacgaagatcgatggggcgccttcgatgtggggagtgtggtcgttcaactcgacgctccctgtatcgttcgggaggcgaacgaacagaccgttcatcatgtcccctgctcctgcgactagatctggcgccgtcaatgctgagctggctggtgatagtcctgagatcgaaggtgagggactcggctaccagtcggggtgcgggcgcttgcggagttggctggaaacgaagcaacgatcatggtcttcgtttgatcaagatgtttacaacatgatcagcttgattgagtacgtcttccttgaggagggtgtcgaggagagtgattgctgcaaccgcgttctgctgggggtgcgaaaaaccgctgttccatcgacgtcttgttgcccaatgagctctctcgctcgtcgcccaaattccaaggcgcgctgccgtcgatcttcaccctcctttgcaatccggtcgcgatcttgttgctcacgctgtagtcgttctcgctcctgttgctgtcgctcttcctccagttggcgacgttcagtttcttgccatgcgcgctcttggtccacttctcgggctcggcgttgttcctccgtttcgttgtcagccacgaatacgccgaagaagagaggcgtgtagttatcctcatagctgtcgtcgaagttgtcgaagtcgtcgtggtcgtagtggtagccgaagtcgtcgtagtcgaggatctcggttggtcgagaactgacaccgggggagctaaggtagccatccaactcttccgtcgagactgtcccaaggggttggagtataacgccaacctccctggatctagatcggatcggggccgaagccggagctcgcctagatcttcgagcaggagatgtcttggctgtgaagacagcggccaaatcatcaggaagttttatcaggattgagggataggacccgtcatcttgatctggtcgcggaggagtagattagatctcgtccgagtggtttgaagccgactcgggagagatgatcttggagtaggcctcggccgagttcggaataccgaacggcgcggggacctgatctctccccgacta

SEQ ID NO: 67835 - DNA, 1585 bp, Oryza sativa
cgtttcagcataagcagactgatgtttatcggtataagcgtttccatcgtttggcttataaagagtaatggctgattagtggatcttctgtggcatggtgatcgttgagaggtagggttcgagagaggggagtggggaatcgaggttggtctcctagcgatgtggccgtagaaaggtgtcgggaaggattggtcccactaccaatggctgatgcataatcagcccaataagctaaccgatggacttttgctgaaaatctgcctctgcaacattgaaccgatgagagtgttctttgatctttgttacattacatgtagttttggtcatggtgataaaagtaatatatctaactcttttggatggatagaatatattactaaattttcatgcgtgtgtgctataattgggatcaaaatgcttataaacgaccagaaacaatattgtttctatgaaaaattagaggatataaattctatgtatatagctaggattcaaatctggcgataatggtaccacttttacagaaaccaatctgaaaattccgtcaccattttcatctcctaggttgctagccagctgcttatggttgatggaccagatgtatagttactgagctctaaattggctatagtattgtattatcctttttaatggtaaatagtctgaaggctgagattttcttttggctgtggtttataggccataatatgtgaccaaagcaatgaaaaataattctacaataggatttttatgcttatactttcagcggtttaaaagtcagggatgaaaagtgaaaaacgatgggaaaaacatcaagagtaatataaaatcgactttgaaaattcaaattagactatgattctcatgtatccatatgcacatttgtggtacccgaattcgaatttcgctgctctaataatggaagattggttcaggatttgatgggtttataagtcatttctattaaaaaaaaacaaggtcgcaagatacggtcttaatatgttggaccttagcaatttaaattcgtactattcgtgaaggtttctttaaataatgtccaaatttggtagaaatttattcaaaaattaatcttgtgaaattttcccttaaatacccaatcgagtctccctctccaaacgacttaaacttgcttcacacactttttcccaattttatatatcatcttaaccttgctgccatattctttactggttaacggataaatggatgaataggcatgttctccgaactaattaacagtacgatttaaagaatgctttctatatataaatgtattgcaaaactgttttaaagtccaattttcaacataattcatacactgatagagaaaccatctttggtcggtcgaccccaatccacaatagtcccggttccattaaaaaccgggacaaaatgatttttagtcccggttaataagaggaagatctttagtcccggttgttgttaccaaccgggactaaaaatcatctttagtcccggttggtttatttttagtcccggttgattccatgtcaggccgtgtcagggccctatgatctttaatcccggttagtaacaccaatta

SEQ ID NO: 67836 - DNA, 4069 bp, Oryza sativa
ccacccgggactaaagattaatttgtagtcccggttatttaacccgggactaaagatagcgatctttagtcccggattcgtagtcccagttgaaaaaccgggactacagggggttacgaaccgggactaaaaaacatttctccaccagtgataatagttcactcatttatttggccatcattattacaaatcattctgagattcagccatccagcacaaaagaacaacatgaagatatatgcgccaataagcggcaagcatatattgatatataatggttaatttttttttgatttgatagccagccatcaccaatagcaatgctgcgttgaatgtactcccttgctcacagtccaacaacagcgtcacacatacgtacgtacacgaatgcgtgtgcgcaaatacccttttacaatgtcattcaaatatatataaaaccgtgcctagaccttgagcttcacaacccctgcatgcgtccctgcgtacacacggaatctgattaaaatttactactccctttttgaaatcctcttttcaaataaggattccaactactcgatctaggagcttgctcctccccatggcagcaactctctactaccctctaggacaaacacatcacaatgcacaaaaaacaaaactcgagagagagagagaaggtgatacggagtaataaactgaaagtactgaaaatctgaaatacattccgggtgtgttggcatgtgtgtgtgcacacggttgtttgttttgttttattttgttttgtttgagtccttgcttgtttgtttttaccaatgcttatgaatccattttttttgtttctgtttgcatgcttctcttgaggggtgcaagggcatgtgatgtgtgcccacaatgcaagtttgaactcatcagagagaagggaaaagttaattggatagtgttgctttgatttggggttaattaaactattgagatggtacagagatggataggggtagagatatggcatagtccctagagagaattctctatctaacaagtggcactagctagcttagctttatccaggttatatacagtacatactagaagaatcatctttaattactccctcccggttgataatacttatcgttttggataagggcacggtcttcaaaacgtagctttgacaactattttctattataatatatatagaaatatcaagaaatatatgattttattgaagtacttttcaagactaatctacacatatggttttcatatttttaagataaatattttagaaattatttatagtcaaagattttaaagtttgactttacccttgtttaaaacaactaatattatcatcccgaagggagtagaatattaatatgcgttagtattatgcatcatgcccatgtttaaggaggtaaaaggaatgaaagacactagcatttcatttgaagagaaccttttgtttttttcctcttcaaatacagctccattattaactattcagcttatcaaattgcaaccaaaatttaaattctaaatgttaattttagagttgattgtcatatactttttttgttgcattttattttttacgtcgataagaatatattggggatgttctgagatgttggatgcaacagtggtaatgcgtaatgcgtaaaacttagctatgcaatagaagtaacgatctatagtaattacattatgattgagttgaaataagaaactatagagagtaaattcacgagcaaaatgtagagaagatttttaagtaaatacatttatgaaagtaaattcaataaagtctaaaagtaatttacatcaatcataaaactaacttagcacaaaataaaagtaaattgttacaatattagaagtaaactcattgtagggagaaaaatatggtctatctaaaaattaaattgaaagcccacaaattatagaattgatgactaaaaacaataaatattttatataataatttaatcaaatctaagagtaattatatatatataacaaaagtaacttacatatataataaaagtaatttacaaacataaatattttttcatcgtaatataatcatgtaagatcttgttgtaaagattttaattgcaacgaacacaatggtgtaatcagattgtagatcggataagtaatttgagagaaaattttataagaaggaaaaaaatacatgcatgtctatatagatgtgtagtatttctctgatgtatgtggtgtctcccgttaagactaaatagataggcctctcagtttagattttacgtttcttttttgttcacaaaaagaatagagctttatttctttttttagaccatggcttggagatgtgtcctgccaagcaccgtaaaatcggcacaaagaattcctagtatagtactactaccaactaccctctccattctataaaaaataaatctaatacatgatatgaatcttattattacgaatctggacagcgactatccaaatatatatgtatctgatcaattattcatatgctaaaagatatttgagatgttctacgagagatgaattgaggagacatgagagacaatttgcttcgtacagttgtccaaagataaaaacaatattaagacgatacgtacgataacgtagcttcatgagataaaagagaactaattaatcatattaactatatttaacaaggggatatataaatacaaacaatatgcatatatattgcagtagcattaatttctgcataaagcactgccacacatgcatgtatatatactaataaaatggaaaatcatccgccctctcgttttcattttccctttctgatcccggcacttagcttagccacacaaagcaagcagaaatcctagctcattaattcgtccaatcacaatcaaattaactatgtaggcagcaacaacatgccaacatgaatgcaacgagaaacacacacatagggactggagagatctctagtgatacatacacgcacatagaaaatgacggtgaagctaagctagtgatcacagccaatcaaaccaaccaaccaatcgatctatcgaattcgaagtcaattacaagcagcccagggcatagtttggtcaaaggacggcagttcataacgcatcaggagtcaatttattagtatccatcatccatggccatgcaaaaatattgcatatcgatcgatcacacacagttgcagactattcgttggcactgacagctcagtctactctcgtagtctgaccaatgacatgtatcaatcgatcatgaggtgtttagatgaggggtgtaaattttggacgtatcacatcaggaattatatagggtatgacatgaggtgctcagacactaataaaatattacctccgtctcaaaatataacaatttttggctacgaatctggacacacagttgtctaaattcataactaaaaacgcttatattttgggacggagggagtaactaattatagaatccgttagtaaactgcgagacgaatttattaagcctaattaatccgtcattagcaaatatttaccgtagcaccatattatcaaatcatggagcaattaggcttaaaaaaatttgtctcgtaaattagttgcaatctgtgcacttagttattttttaagcctatatttaacactttatatagatgcttaaacgttcgatgtgatcaggtgtaaaattttgggatgggacctaaacatccccgaatgcaacgtgcttttactggatggacgacggatccaccggctgctagaagagtaggacgacgtagatttgttttgttaattattctaactttggtcgccgtcgtcttcttcttcctcctcggtccatggcatgtgcttggactacgtttcaaattaagcttgcaagttgcaactccatctatctctctctagatttctctgtgcctctttttgagagtctatcggtgggtctaacaagtcaaagaaaaaccaaaatttaaatatttaaagttaattttaagatatttttcaacataatttctttttaattagcgttggcttttaactcgctacgaacaaatatataaaatttttaccta

SEQ ID NO: 67837 - DNA, 17366 bp, Oryza sativa
ccgcctgcaaatgggcggggagggggcatggaattttgcaggcggcccccttgccgccctgggggagggcgatttttgcctcccccctataaagcccagtcccccctctctgaaatttcattatattcactaaaaatccaaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaatgtcaaataaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcggataatgaggaagcggacgatgacgcatcatccgatgaggaaggtgatgtaatggccactgattgggcaaatgaggacttctctggacttgttatatcagagggtgatcatgtaccctgggagtataaggagaacgaggtaattgacggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaactattaggcacatcgagaacaaattcaagtacaccataactatgcaaaggcctggagagccaaacaaaagattattgagatgaggtatggcacatttgaaacttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttgtacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaatccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttgggcattacatgatgacccaccaacaatgagaaggaggtcagggtcgtccatcagaaatttcactcagtggattgagaatgagcctaaggagaagtggtctctattgttcgacaccgatggatcttggtatggcataatgacaccaatttgcagaggtgtacaactgggtaatgcgaggagttcggatacttccattggttgctattgttgaattcatccttcacggcacgcaagcgtactttagtgatcgatacaagaaaattggtccgtccatggccgataacaacatagtgtttggcaacgtagtgacaaagtacatggaagataaaatcaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttacattccagatccatctaagttaagggtgaaaaagggtcgacgccaaactagacgcatcagaaatgatattgatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctatcgatttaggaaataaaatgctgttgtgatgtgatgagtgttcggactaaatacttgtatcgtgtaatttcaattgaatgttgttgtaatgagtacctccgactattgttgtactagtagtattgcgaactattcggtgttgtatcataatgttatcgtgatgagtgttcggactaattactcatatcgtgtaactgcagttattgttgtaatcagaaatattccgtatggtgacacttttgtttgtttgtactcttgtttaatatgtgttagtaattcgcttatgaacatttattacttatgttgaactaattatttatatgtttctgatcaatctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcatatttcaactcaactttgctttgtgttgtacttatgtttgaagtttgctctatacaggttgcgtgcggcaggccttctaccactttgtaggcttgttgaggcggcggcggacaaccgtgacccagcgaagcggtgggatgcagaccggtcactccttgccgctctggtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtgctctacagtcgggcctagcaaggcttggttgctccagttcactgtaagtaaataagttgttattatcatacatgcttatttgcgatcaacagagtgttttgtactaacatttcattcttaattgtaggcggaccttctgcaccctgacgctaatgataactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttcttttttttcttcacataacatgtctaattccgatcatgtttattccagcgtcgttacgctcacgtccaggtgagacgaggttacccggacttcgtgttcgagtttgaccgtctccagccgagcgacgtcatttgggagccgtacacagaagaggccgtcgctgcgagagcaccgctaggactttcgtcgttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccatgtcgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggcgatcaacgagctcttcccacacacggaggagaactaccgtgactaccttcgctggtaccttcctcgcactcgtgcgcgtgtgaccttcactccagacgccccagagccgcacgttgccgctgtgacggacgcgtatcccacgcaccgtgaccgagactacttcgtgggggtacgtcgaatttgtattagttcttacaattatttcatttatcttgcataatataggacaactactgaattttttatttccatcttgcataggctgatgctgcacgggatatcagtgccgatatcaccgcagtccaagtgaggttgaacagaggtttgcacttgactgacgttgagcagaggatgaccttcgaccggatgcaggagaagatgcgtgcggtcatgcgcatcttctcctgtcgcagcgccgtggacgtcgtacctccagctggtccggtacaaccacggcctcgcgcgcctaccgtcggagcaggacctcgacctacggtacctgtttcgcacggtactgctcagcccagaggtttcttaagttttgtttctgtttttgtacaaaaacatcaccccgtcgtaacttgatgttccattctcgcaggacctcgtttgccttcgagcgcccctagcttcggagcagtgcgacctacagcaccggtttcgcacggtacagttcagcccagagattagttcatttttgtttcagcttttgcacgaatatgtcaccatgttttaacggcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattaatactattaaatacctgtatgaaactgatggtccttgtccagcaggatttgcagccgggatcttcggtactggggcctcttcgtctcacgccggtaggactggtcctactagccagttctacgacgacaacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcgttcatatggtgctagaacaacttatgctcatgacaacacactttcggcgcttcacggtagtgtcagatccagtagcgcgcacagtccacaacagcacacatgaaaagcggcagctcgagttgtcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcgccattccttgagcgtctcaactggcgaagcgatccttttgctggttggtttccaccatggtgtgaccgtcctttgtgcgatagtggggatagatgcatactcaagtcttccctcatgatacaaactcggggcaggagattcttccaatgcgcgaactttgatcaggtatgcttcatctattcgaagttcaaatggataaaaaaaaactaacttcttcgtacacaattgtaacatcttacgcagacatatcgtccaatgtgcaacttcatcgagtgggtagacatggagaacccacaaaacgacggaacccgtgcttacccacgtagtgaaacaagatcggactacctaaggtggaaggatgagcatgaacgtcgaattgctgctgaggctttagaatggcacgtaaatcccctaggactccccatgtggcgtgagcgtccggagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactcctcagtactatcattaacttaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgaacgtcgggtggaaattgcaagcttagactggaggaacaatccattagggttacctaaatggtccgagcgtccaaagtgtgggtgcagagatcgctggcaggtggctacatcctttgctgaacaaacattttgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggtgccgataggttaccgcatgcttgatttgtcgagatcgacaaatttgtaccgtgtatcgatggcacttcttatctattttatcattacaatgtttaattatggtggtgattttttgtatgcgtaagactaagggcctatttggattgctaccaaaaacatgccctaccttaccaaattttgaatagtacttgtttttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttatacaaaaatataaagcacagtataaattcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggccgtctgccacgtcactttcgccgccctctgggatggcgatttttaaaaatcgccctcccagagggcggtaggcgaccacttctgtcaattttcaaaatgaaaattatttttgtaaaacttttaataaaaaaattaaaaataaaaaaaattcactatcaagctgtgtatacatctgatgagtcctgttactttctcaaatgactcgcaactgagacaaattctgtaagttcatatatattacatctcatgtttctcaaggaaattaacacagtggtcaatcatctggaacttcagctttcatgaaaatacaccatcatcgtcatccagccactgcttaccgctgtatgtcatctcccggtcctagatcgtcgatcgctgggcgttgtttgtggtggtcagtcacagactggtacgccattgccagagctagagcctgctccccaatgcacggatcaaaatgacaggtcatcaactcatcatcactgttcttcatgtcaacacataaaatgtttatgtcctgagacgagaaagaacttacaacgtggtcatggtcaggaggagcgtatatgcccgtcgtcacggtggttcttctccgcgtgccgccttctggtgggttcttgatgctcttcaagcctgtcggcaccacagccaccggcatccccacaaggtttccaagacagacgagctcccagtcggtcacattgccgatgaatgcatcgaccgtgaagctctccctgacttctctgatcagtttaccccgtgctcgttgtgcctgttcatcgatcaaagaacaagaatataagttatggtgactcgcgatcctatagacaggtacactccttcagatatggttagtagagcacctgtatatagtcgactgcggggattaaccgtgcgcggcgaagctccactggccattggtcctgagcttcatagtcgtcgtcgtgtcgctcgcgttgccagttgtcgaaatgcgcaagcatgtcaacatccatggtgatgttcagtatggattggaccgattgaacggtgtagttcagcttgaaaggcactagcttaacacccttagcggaaagaacatgaacaacctgtagcaatgatcaaatcgaaggatcagatcaggaatgggtaacagataaccaggctgatgcacgtaaaaaagctctcaattacctccatctcagcactgtcaagatatccaacagtgagttgtctgatgtcaacatgaaagggatcctcgatagcaacttcacgagatgatggatcgccggcatccttgccgcgaattgcgtcaagtacaactgcgcaatctatcgcgcttctgcagaaaggaccaagtttatcctgccatttagaccaagatactaattgtttaaaagattgatttggatatgactgggaaagcgtaagacttttgaatggaaataccaagctctctgaaatgctcatgacgcccgtccgtgcaactgttccaaatgttgtgcgcaaagcagttactccacatctagcggcaggatatgttatggaacctgcagtttctgaacctattgcaaaaggaaccattcctagtgcaatgaaaaaacttcgctgagtacttgaccatatatacttcatctccttacacatgtaaacatgttgtataaattaacctgcagaggtgctagctgctggccctgctgatgaaccagtagaaaactcctcaatgttccaggggtttcttgttctccccccaaaccatatatcatcataggcgagcgagcctgttacaagttttgctacaaggactgccccagttgacttcaatctgaaggaggacggcatacacataaggagacgtaattagaattgatcacatgactcacacataactgagaagaaacaaaccttttgtagacagaggcttcgacatcaagaatttggttttcaaaagttcttgagccccaggtagttttgtattctggtactgcaattatatccttaaggccatacggaatgccatgtaagggacctaatatcaatatttgtcaatgcaatctttacttttgagcataatgttttatatgtaacacattttcttctagtacgactcacctaaagagtaccctactaatggtataactgagagattttttaaaggcaaacaaaggagagaactccccctttgtaacacacacatggattcaactaaaaaaataccagttgtttaacatttcgttccacaggttctcaggctaataaaagtgattgcatcgcaaaatatgaagcttcaatggtgcataataataaaaaaatgtagggtaatttccacgagcatcaattatgacaggaagctgctatggccataatatattaccaacaaaaggagagaaacaagatcaagactagattgtattgcagtaacagatatatcactgagcatttcaagaagatttactgcataccaagatattttccttgctccagcaagtcatcagcttctttcgcttgtttgtatgctaaatcatcagtgatagtaataacggattcgattataggaccatacctataaacatacaaggagttacatgattaaaaacaatacttctgagcctctcataagtccatctgaaagactgaaacaaatgaggaagacagaaaaaggggtctaacctctttaatctccttaagaacacagcagtaagttcacgcgatgtgacttgctttgtccttataagctccccgagctcaattatctgatatgaagatcagaagtttgaaataaatatatatgaagtttgtaaccaatgtataataacaattgttaaaaaataaactgaccgacataaaagcaatatcttcatctttactagggcgatgtactgaagatgtatggggatattgaaagcttttgttctcactgattttgctttcatcgctccatgatgatttaaagaccaatgcagacgggttatgcaatccaccattctctaacgccaccaatttccggttgtctctaaatgcaggtacattaaattcttttgcaccatcttccatctcccgaagctaacagaacagatagaagtgtagataaaaaagatattaatgcaactacttggttgtgaaaacttcaaataacattttgatagtacttttgaatcgttgaaaaaatcagcatcgaagtacttcatggaagccttcaatgcaatcacaccagtaattggttcttttctggaaacatcttttgcagaaacagcctcctttgtatcctgaaaatgaacagacaaattgctaaaaaaaaaattgtcgcaatgaaaataaactgaatattaaaaggagagcaatcttgccttccagatcttgtggtatttggaaacaagagtatatgaatggctcttcccacaggttggccagggtaaccatgtgcattttgttggccacgcctgtgtttaaaacaaaagcaaataaataaccatagtaataatttgcaacctaataatctatacaattgacatttggcaaagtgaatcccttaagaactaagtaacaggaaaagatgcagagttaagaaaaaaaatcaggagttcatatgaatatgaataactagttctgggcttctggccaaaggccattcctgaacacctctatgccattagtcaaacaatagtctcgaaagatcacacacctagtcagaaattccagcacacaagtgaaattaaataattaatctacttggtaggtaaagccacctatcttagtcagattatcactgtcctcacagcccaccgttttctttgaccgacaggatcatagaggtaaacccaaaactaggacagcctaaagttcagagaagaacactgaataccgatcctcaggtggtggggatgcaaagctagctagaggaatccaagaagagggggaggcgatacgggtacgagcgcgtaccatgtcggcgatgctcctagcgacgccgccgccgccggttcttggcggtgctcctgctcctgctcccggtgcggcggcagaggaggagaggagagacccgaggaggaggtggggtagggggagggggaggagagggcgacgtggctcccgcatggctgacacctggcgggaaggcggggagggagacaacgagggatttggttgcaggaggagaagagcagagtggagaagacgaaagggtttcatgacttcatgcttggttgatgattgtacatttgtactactactactactccacgagtctctcgctttctccttgtttgtttattttgttggagatttggggtttgattttgtcgcatcttatattgcgtgggtgacagtttgtttatgattcactaagaggcataatcctattgaaaaccatggtcctattgatttttttttgacctttttaatttttaattttattagtattcatttccatttttcaaaaaaaaactgagcgtcgtttagccacgccagcacagagttatttggccacgccaaaaggtttagatttgaaaatatttttttaaatgactattaataaaattaaaaaaattaaaaaaaaaattgatcatattatactttcgatatcctgtaaaacatttttttatagaaagctacaattattttttttgttaaaattatcggctattggctaggcgttttagataactacaaacaatagcatatgattttattataaaacataacttatatcgtttattacaaaagggatccatttgtcctgcacgtatgcaatgtgtcggagggataagctccaactgtcatgggaaaccacgatcttggatcgtggaggggtttaaggcattcaaacatgctcgggagtaaaggacgcgaacaagtactcctatatatgtttatatgtttggacctcctgaaagatgataccctattcctatttgataaaaatgtccatataaagttaggagctctcaagctagcaaacctagttcatgttgattattgaaaaactaaccccttctaatcagttttgattgggcttttatacccaccatctctcactattagccgagagaaatgatatactgttgtaacatattcatgtcgaaaataagtgaaatagtaaggagagagaatatgaacagacgactaaattgtcgtcggccctccaagacgagccaaagctactgcatctaatttctccctgcatgtgacttgtgattggatggtgagcttcccaagacaacatgcagcagcagcaattggattacgcatgcaagcaaaatgtgatcatattatagtagtacatcttattattgtacaaaataattttaactcaaaccgtatttgaggcggcatgttttagagttatcagctggctgtatcattgaacttgctcttagcctattttctaacctttgagcttcgagccagtttcagtcgcctatgcagcctttctatgggactccacaccgaatccacctataaaggctcattgttttcaccgtagtctcaatgacactaacttcgttatctttatggagctttctaaaatagtgtatcgctttgatcaagtaaattagtgcttaaagggcttgttcggttgcttagtacaacggctgctaggcaacccaaggcagctgatcgcaagttgttttgctgcatctacaagcagctgcttggctgctaagaagggcgaacaaaccagtatgtagttttgtacttttgttgacttaaacagcaaagtgattagtattgtgataggttttctactgtttagattattatatacttgtaataaatatgtacttggcttgcacatttttaatatcctttgttctaagaggcaatcacaaatttgccaatggtttgaatcgttattacaatactgccgctagaaaattgcaaaaatatcaccagaactgatactcaagtggcattcttacaaaattaaaaaaaccaatggcaaatttgtaaaatgccctttttttctaaaaatagaagcaaactaaaaatttttaaaacccacaatagaagcaaaataaaaaaattaaaacccacatggaatccacatgacactgaaacaatatattccaccttgtttatctatctctcccatcatttggtcttggtagcggtggttgtggtggaggtgcgcgggtagttaggaggtgaggagacactaactagtgtgcgatgtgcccggctggcggcagaggaggcccagtagtcggcggagacgcgcctacaatccaggagtcgatgtcacccgctcttcccaccatcgtgagggcttgctcatagtgccgcttcttgcaccagcaagcagtagaagacaccacggggagcggtgtagactggcagaagtagtggttgtgccggttgcgaagcggcgcatagatttggaggctaggtggagtatggcaggagcggaggaggcccgcggtaccaaggcaatgccatgctccctagacctccctgctttcatcgagcccgcgcttcccctcatcgcattgctgacgacaatgactcctagcttccatctctctcctttctccccctatctttccctctctgttctctcctatcttcttggtgttgaggcctgaggcactcacgatggtgtgatgacaacctatgaggattggactagcagcgaccgacctgagcttccacatctccaccaccggtcaggctcgatggtgtagccgccaccgccacccaactcctcttcgttggtcgcctcccttctcctcatcagtcgcgtggcttggaggtttggacagagatgggaggagatagggggagagagggaagaagacttgtttcactgatatgtgggatctacatacctttttactttatgtttttattttttcctctggtgctttgggactatatttgtatcggttttaaaagatgaaaggatgcgttatatatatggtattgcggtttaaactcgactttaagataaggaacctaaagtgaacttattcaaagaaaagggaaaacataccgtaacattggggggcgcctagctggcgcgtatgcgccgctagcgcgcaccttccccatctaaccacctatactagtattagttaacattacttaacactaataacaataattaggaaagattttaaagatttttttggagatatttttactaacagattgaaaatttttcaagttagaaactttcgatttaagatttaaattttaaagttaaattttgaagacattcaactcagatttgaaaacattcaactcagatttaaaaacattcaactcagattcgaaaactttcaagtccagatttaaaagttttgaaaactttcaactcagattcgaaaacttttaactcgagattcgaaaacattcaagtccaaattttaaaattttgaaactttcaacttgagatttgaaaattttaaagttaagatttaaaaattacaaaaataggaaactaatataaactaattacgattttttttattcgtacggcaaggaaaaacaaacggtgaaaaaaaaatgaaaaaagaagaaacgcgggcgtaaaaaaaaagaaaaaaaaagagagaagcgcaagcgcacgtgcatgggacttgtgggccggcgtgcgcgccggaaacgctcacacgcgaattagcctttccggtaacattgcagcctatgacaaatcgttcatgggccgattcatcgtaggcccaactgacccattccagtccgggcccacctccactccccggggataaacaccacgtgttcacactcgccccaccccccgagggacagcctggcacaactccccaccgtccgatccagatccgaccgctcacatcgccccagccacgtcacctccacctccacctccacctccacgcggccacgtgtcccccgcctccccaaactttttgggaagatggcatttgcgagagaagatggcaaatagtaaaaaatccccgcttctcctcctcccatctcgccgcacgccgccgccaataaaacgacgcgacgcggcgcggcgcggcgcgacccgatgcgacgcgacgcggcgaggagagggagacgagctgagcagcggcgacatggcgagggggagcaggaggaaggggtgggcgcgcggggcggtggcgttcgcggcggtggcggcggcggtggcggtggggaggcggtacgggtgggacggggaggcggcggtggcggcgttccgggggcggagggacgcgctgggcccctgggcggcgcccgcgtacgtcgcggcgcacgcgctcacgctggcgctgtgcccgccctacgccatcctgttcgagggcgccgcggcgctcctcttcggcttcctcccgggtgtcgcctgcgtcttctccgccaaggtgctcggcgcctcgctctccttctggatcgggaggtacgggacgagttcctcctcctcctctttcttcgcttccgtttcggttgctcgtagcgctcgtggtggatgttgagcagggatttgtagacgtcgagatctagacataccgtgttcagttcgtgcgtgccctgatttgattcctgtttcgcacgatcgagaagatctgacaagaattgtgatgagagtcgtatgatcggagatgggttggaggaaaaaaaataggctggcatttgtgctttctcgtgtccttcgaggagg

SEQ ID NO: 67838 - DNA, 4385 bp, Oryza sativa
actaaccaaacctgaaagttatcttaaccatagatagtagaggtcaggttggttgttgagcagcctgaagagctacaacttcacggaaaggaccttgagaggtataactgcagcttgcctaagaactttcaaatatatgtagtgctggcaaagttccaccttttttggtaactttgtggctgctcatagacatgagagaagcaaactatctctcactaaggcaatgaatgcgattagtatcgaagagccaccctgtcaaggagcaagtcaagcaaaaaaaacaaagggttaaaagtcccaaatgaacaagtttaagacaagaagcggaagaatttttccctgatcaactctacgcggtcatgctgaccatattaaggttgtgtttacaaaaggttacaaataattcgcagaatatgttcccttacaattccaatagcccccttcttgttctgggaaaagttcttacccttatttttcttaaccttgtggtccatctggcacttgtaagccttgttttgcttcacttgctccttggcatctatagctgctgtcatctcagtgatctcttcgatactaatcgcatccattagcttagtgagagatacctgcttctgtcaattggcatctatgagcagccacaaaatcactcaagatggtggcaactttgccaacacaacacatgtatgaatgctctccagaaggctgcagtcatactgtcaaggtcctccccatggagttgtatctcttcaagttgctccaagaccgacctgccctctactaaattatacttaagataactttcagatatggttagtttactatgttcaattgaaccattttaaagagagttgtttggatagttttagaggaatgctgatgaagcaatatttgagcatattaaattcagaatttgattacatacatgaaaaaaaatccaaattgtataccaagaagtaaaagagacaagaacttctgctgccttataaacaaataagcactgatattatttatacaactagcatggcaacaatataattgtgataacacataacaagtattactacaggttatgttgattgggagggctattggaagataggggaaatcctggcaggttcttttagctacatgtgtttggcctttgaggccagctcggcccaatggcctaaagcagcccaaagggcctcatgtcagaaatcccgatggatcggtggatagaactttaaacaaacacaaaacacatactatagatgattcgaaaaacaaggatgaatttttctgtttacaaccagaattaaccgcctagagcgattttcacgttgtgcctaatgccacgtccatccccacaacgcatgtcgtttgtctcaatcatggtgagagatgcgggcagccatgagctagcctcgaatgccctccaccaaaactaacatgcacgacatctacacaatctacacatctacgcacgacatctcatcgagatgaatgacgtgcgccatggggatggacgcggcattaagcgtggtttgagaatcactctaggccgttatttccttgtaagaatctggctttaaatgcagcacaaaagttcttccttgttttttggatcatctacagttcgcgtgtgctgtgtttgttcgaagttttatccgtcgatccatcgggatttctgatagggagcaataccacccacatgaagtggctgtagttgtcgacggtcagaaggaagtatatgctgtttgtttattgccataacatttagcactaacatgatttttgcagcaaatccagacattctcatgttttgcgaagtacgtaaactttttcgggttcacttgttcctctgtccatggaagttgaatagcccattatggacatttttgacacttttgctttttatttggatcaataaatgaggtcaaatttcagctaataagaaataataatctctttactctagcccatcctaatcacactatgcaggaatctagacatctagatataaggcccactatatgttgataacttgatattatgatctgctttattttgcagattgatcatcaatatgtcctggatacttttttttttctggttaaacaaagaaagtaaaatcccattttacatgttttgaataagtgaacttggcaactaaaaattagtgttatagtttgctttgtgatgccatgcaagtgggttcttgcagttatgctggttccatattgaatattgatacagttaaaagtggccatgcagtcagcatcttcaattatactgatgctctttcaggcacaataacatcattacgtcaacccgtctagtgtataacgctgtaatgggatttggatgtacatcctattatttgtcctggatcacaatttttttacctagataaagaaagtaatttccccatctttgtgtggttaggtaaattgttttataggtcagttcatttctcagttgtccatcatcttctatatggctgtacccatgggtttgtgctgttatcattcatgcatcatatattttcccttgcaatattgtttttaaaatacttactatttcttggttagtacctttagtcttggctctctttgctaatgtatcttcttaaaattttcagggcaattttcagactctttacttcagcaatggattggctaaagagtaacaagtacttccatattgtggttaaaggggttgaacgtgatggctggaaatttgtgctacttgctagattctctcctctaccttcctacataattaactatgctctatctgccaccgacgttggatttttcaaagattttctacttcccacagttgttggctgcttaccgatgatcctacagaatgtttctattgttagccttgctggtgctgcagttgcctcaaccacaggatctgagaagtctcggatatactcctacttgtttccagtacttggtatcatgtctagcattctcatttcgtggaggattaagcaatattcttctgcccttgttattcctgaagagcttaaaaattcatctactaatggaaaggctaatgtggatgacaaggcagtgtctgaaaataccaactctggggaaactaggaaaaggaggtgaccatcacaatttcttgcatattactgtgaggagctactacgaattatcaaacatttagagtagatgcagatcaagattattccacattggtcaatgactatagtaaactatgttgtctgtttcatgccattgttttgggggcatttagcagatgcgcagtcagctactgtcttgtttctgccatcaagcttttctttttctgacacatgcagatgtttcaccttgcaaacatggtagaagttcatatgctgtacatctaagttgggtagttacggtggtctaggattttcttgttaaattatatctaaggaaaccggctttgatttccttccctacttgtactgaacccatatatgacttggtagaattcagtgttctaatggaccagaattcagaactgtttctgctgttgcaatgtagaacagctgtatcacacctttttatatatatatactcttcttagccacaatccaaagcaaattatgcagtgaactccaagaatgttgcacaggatactcagtcttctgactttggttgcactcctgtctcaacacagtatttaacccatgttctgcttcactgtatttttgtccaacaattccatgacatgaagctctccactgtcctgtgttgttaccttcttctccttggtctctttgctccagaaatcatatcagatagccctcctcttcaggatgtatgccctatggcaccccagggtgagaggaaactcttcatgaatggtttcttctgcaagagcccaagcaccataatggcctctgatttcaagacattgctgctcaaccatgccggggacctggacaacatggtccggtcatcggcgaacatcatcaccgccaccgagttccctggcctgaacacccttggcatttcaatggcgcggaccgacatcgcggtcagcggggcggtgcttccccattcccacccaagagcttcagagatgatgtttgttcacagtggaagtgtggtggcaggcttctttgacaccaaggggaagctgtttcagaagacccttgctgagggggatgtcttcatcttccccagaggtctggtccatttcatcatgaactatggttttggccttgcgacaactttttcggtactcaacagtcagaaccctggtgttgttgggatcacccatgcgatgtttgcgccagattcagaggtagctgaagggctgatggccaggatgttgagtttcagagatatgggaatggatgacagtagtagtgttgattcaccatggttttactgatc

SEQ ID NO: 67839 - DNA, 12054 bp, Oryza sativa
  unsure (1)..(12054): unsure at all n locations
tgcctacccatacccatgcccatgagattatctgtgcccgtgggtatacccattactacatgacaggtaagaatgattgctcatgcccattgcccgcgggcgccttatgcccgcgggcgtgcccgtttacccgccacaacaaaagcagctgacaaaaagtctacaagcttctaagttcgaatcgaacttaaaacatcaaatattctccgcctcggtgtcgtgtctctcctctggcggcgatagagtaaggggagagaaataataagggaaataaaagggaaattgtaaaaaacaaagaacgtggcttatgtttctagtggattttgctcctagcctacatgtaagttcgatttcgcaggtaaatgggcaaagcaggcatgggtagtgattacccatacccatgcccatttacccatcgggcatagcttttgacccaataagatactcatgggtataaaatggagaacaaacccaaccctaatggggtttttacccacgggtaaacggtcaaacgggcacaattgccatcactattcactcacaagcccaattgcagtgtccagtctgatgtcaattgtgacgtgaaaagtgcgtcaagcaacagccaagccatcctccttgcttcatcatcaccaggcaagtttggcatgctctggacaagtagccttcctttgccttttgctttactcggtggaactcaacaccatttgtttagtgtaattagtactgccttttgcttcttgaaagtgagaagcttctctttctttttccatgcctcccttttcacccttgaaaactcctctctctgattaagccaggcaacttgggcacctggctagttatatactccatccatctatttcaaaatataaggcatattttatttcgttaggaccaataataactttgttatagtataattttgtgatatgaaatagaatttattatattcgtatttaaaaatatttagttatgtgcttttaataacataaataatatcccaatagagtaataattgttggttaagcctcgtcataacgagataaaatataccttacatttgtaacagaggaagtatatgccacacactgctttgtgagatggtgctgtaactgatgttgttaatcattgagggtcactgtgctatattgctgatttgctgccacacatgaatgtgtggataacttgttaggtgatcaattgtcttgggagatagaagataacatcaattttgagtccctcatgttcttgtcaagcgatttatttttaatttctgtttgatcagttacagtaaaagtgggtcttgtgtggaaggtggtcacctggagaaacttgtggacttcatgtctctgcttttcattttagtagatgacttggttcctccatctttttcagggatgaattcttcatcattgacatcttggggtgcaaattttggaggattttgaaacgtcggttttgcttccaggacatatttcctcgctgatagtgattttccatgattaatggcttttcttgttttcacaagcaaaaaattgaggaagattgaaatgaagaccgtagtattaaataatatatattgatcaagaattaaacaacagaagaccagattattgaagagcttactaattaaatgatggatgagaaacatttctaggcttgaccaactctccaaagatcaaccaaaggtgtgcaattttttttctcttaagtagtaagaatggaaagcacattaaaacataaaatattgaacctaagtgttatttttaataaaaatattttaaataaaaaaatatgattgatgttcaggaactagcagtctccaagttgatcctgcaaacaggaatttgtcagtttatatgtggttctgtcgtaattgctatagaatcatcaacatcgttattaatgtaaatacagtcagagtacgctacttcgcattgcaataatttatttattaaaaatacgcaagatttggattagtcaagtacttggttttcccacaaagtcaagctgaaacttctttatcatgagatttagatggcaaaaggagtatgatactacataatcttgaccaagataactgtatatgaaaaatatgtttcattatctgatctcggtaataaacaactaaaaaattgacatcaagtttggattatccggcacacttggcagaatttgagacaattttttcttgggagaatttgagacaagttcataaccggatcaggatcagatagaatagttgttgaaatagttaaatggaactaaagttaaaaaaaaaagctcagatttttattgttcaacagtgcatttacagccatgaattgcaaaaagtattattttgcgtaatcccctctttatcatgcacttcacagaatacaatggaataaaattgaaggaacagaaagaacagatattccaaaaagtaaaaaccaaagacaactactctagttgctatgtgggccaggagggtaccatcatgctcatcatcttctagaaccctaatatgttggcagtgctcattggttgtggacataggacatgaggttgttcttgtttgttggtcaccaccatgtgcagtgctccaatatcaggtgtgttcttcaggtccgcaattcagtaccagccacaaaaagtgcaatttctttcttgcaatgggcatgatttttcttgttcttggccaaacatttgtgatatttttgacctgattaggcctccatgaaactctctacatgttactagatacaaactgattttatcaaattggctactctaagtattacaaagtattatctgggagaagatctgtacaaaggggggcattggattattcttccagagcaaaaaaccgatgaaattatctggccaagcctggccacaatcaagcaatacctactttgatctaatccctctacatttccaatatgtatgtcatcatacttgtcatatgtatagaactttgtatgtactaaacatggccgtgcgaaaactttggttttgattccagataactagaaattctccttgtggaagtcgaatttcgtgctcgtctttctcgagaaatcttgagcgagctcacgcagttccttcgtcagcaccggcgcgccacagtagaacacccctgtaatgtcaaagaagaatcaaatttagtgtaaaaattcagaattccaatagtgcatgaagacatgataggattggattgagatgatagcatcatgcctgataatgatacagttaggtaagggagcacttcttgaaaacatggcacaggcatatcttgggaatctttttgtgcatatgaactgaactttatgggtgaagaattttaggatacctgactatgtattgtttaatgtatagctcgagcctaaagggactgtatgccaagcggttgtaactatcatcaagtaacaatgattggtcaatccataaattatatagtactaatatgattcctattcaacctaacaaacttctccccaatccacaaactaagtgcataaataaacaaatctcaaaagtctgatgttgctaatgctatgcatgtattgcttgtcaaaagcttcgacgaagaagtatttagtattcctttacttattagctgaaactaccaggaagcactaacttctattttttttagagaaaaaatgttactcaacattcattgcaatctaattatcagtgacaactaacagtgattgatctgtccccattccctaatctcaccagcaggttcctgttcaaccttgataactgctgcacccagtccatcactacttccaattgaacactcaacctcaaaactctgatcatgcttgtccccatcagctagatccccagaagcaacttatgccaaccccaatgcagctcaaaaccagctcagcctactatatcaagaagtctaatttcccaaagcatgtagtatagatttaaaatttcccctactcgctcgaaaaaaaatatcggttggggattaaaaaataaaaatatcccgacccgacttttcacagtcttcaatatgcaaatttgatttaaaacttgtaaagtctctaacccggcattttacggttttcaagatgcaattttaattgaaacccaattttttacggttttcgagatgcgactctgatcgaaacttaacggaatgttgggagaactagacaacaacaacaacaacgatgatgatgatgacgacgacgatgatggtggtggtggtggagcttaccgacgcgttggtcgcggtggttgagggcgatgcgcttgtagacgttgcgccagttggggcgggcgaagtgggtcttgacgcgggtgccggagacgacgtcgacgccgtgcttggcgtggttgagcgactggagcatagcgatgagcgccgaccgggcgtccccttcctcgtacacgctggtgcagtagttgtgcagctcgatcacccccttcttgtccgtctccgccacctcgtccatcaccccccggaaccactcgaacgacccctgctcccgcgtcacccagtagaagtaggcgcgccgcgtcttgaacgccgccgacgacgacgacaccgagttatcgttgccgtcgccgtcctcgaggtcgccgtccagctgcctcatgttgtttatgatgtccttgatgatggagatcatcggggtggcgccgatcccgaggccgacgaggaggacgatgtcgtactgcttgtagtcctgcgccggtgcgccgtacggcccgtcgataagcaccttggggaagctgcagtaggaaaaaaaattgattttcttaaaattttattaattaagctaaattattaccatattatgatattatctttgattaattttgataaggaaattgaaatggtacggttttgtagacggatacttcactgttgttcagctagaaaaaaaatgggaatctttagtcctacattttacattctaggatggagatagaacatgagcagagaatatgtgtttgttctctagtcaccaaaaagatttcattgtttttccctacaagacaagaaatattccattcttgttctacaaagagaaaaacaaaatcaatggaatatatggcttggcaaaaacatccccccttcaccttatcctcaactaagggccgtcttccacaacacagaaaaaactctatttatcttctcttccacactcatatcatcattattcagttagttgcaacctacttaacttactagtactaccaccatctcaccaaattaattaccattacaccgactaattaaattatcccaccctatctacaaatgtcaaagatcatgctctgcagaacagcaaaggtcaacccctactacacaagaactacatatacacacacatgatgaggataacaaacacaagtgtcaccaacagaagggacacaataattaaacagccatgtgaaagcatgctttgtactactactattactactacattttgctcatgcctgatgcaagagatgatctcattctcacacccagtgcaagcttaggtcagagatcatgcataccatgcatatatacatacacgcacaaaaaaaactatttagacagatattccattgaaaggaacaattattttaggtcagagatggtggctaccaactcatatcacactagcactttacactaatccccatcatgtgtgaatcaaaaacctagtagtggtaattatgtttacacggccactaacacttactaccaaccaccaacctaccctgagccacacaagtgtaaatgtgtgaccaagctgacccgatcgctcggtcgcaaccctgaccggcgacccggtccggtccgacccacctcacctcacctcaccggctgaatcactttccacacgctcgttgtaaggctggaccccatcatgttggaccatgccgactagtttctctttttttttttggtctcttttatgtggttttttgaaaaaaagggggaaaatgtggttgacatttgagggaaatgcggggaattttcgtagcggggaagaagaagaaggggggattgttttgcgttcggggttgtgttctcaccttgggttggtcatggcgccgtcgcggtcgtactccgcccggagcaacccgctcttcccttccgtcggtggccggcagacctgaaaaacataatattgtcatgattaattcttttttactttgcaaaaaaatgtacaagtcatttgttaagctaaaatattagtgatagtaaccgtgacagcgatgataataataatgatgatgaggaggagatttgtaggggcttaaggttggataagattgtgagatttgtgacaaatagatggtgagatgggactagcggagtacccttgagaagacgttcttaagctcccgtgtccagtcaccgagcgtcctgatgtggacgctgacgtagtcgtcctgtggggccgacgtgatggagaatgggtgcctgcaggtggggtcacatggtcagcatcacatccttatcacagattatatatatatacacatatatccagcttatctcctctgctttggcttagccgtcctaataattatataaaagatgatgctcaaagcattcccacttaaggaactttaattgcttaatcaaatcaactagacccacaggtgatttaattaattattagtccaaaaggcatccttatgcactatcctacttccattatatatatatatatatattctgataatccgatcggacggctcaaatcgatcggtgtgcttaccattggaacggcgagacggcggcacagttgacgaagatgtactgcccactcttgtacttgaaaccctgtggcttggagaagtgcagcgacagcacatttccggggtacaccgcaaccttgagtatcttcactggcctcacgctcgaccggagcgccctcgtcagcctctcgcacgcgtacaggaacatcggcaccgccaggtacatccacgtctgcgtccacgtcacccaccatcagcaccgccacgtaggatagagagacgagggcatgtacaatggactaatagataaaggtttagtggtacgtaccgttttcttgtaccaatccttggtaaggaagaggtagtagccgtggacgatgaggagggcgtagacgatgacgaagcagtggtgggagtaccagaaggcgttgaaccccgtgaggcggttgagcgggcgggggaggcggaggcggccgcggcggaaccacggcgtggcgagggtgaacgccaccgccatgagcaccagcatcaccagccccgtccacccctccgtccccttcacgaaccaccagtagttgggcggccgcgtgtcgccgaagaacctcttcatcggctcgtactcggcgtcggtggcatggagcagccgtggaaaatcgcaggtaaggtgagagatgacgtgcagcccggcccccacggtgatccccacggcgatcaccttgtggaagttgaggttgtcgtcgaacggcacgacgcgggcgacggcggcgcggttgcggatccaggtgacggtgttccggcacaccgggagcgaggatgagcgccatgttgaacttgagcgtctcggcgccgcccttggcgacgcagacgcagtagcccatgacgtggaacacggcgcggtgccggtactggatgaacttgtaggtgaagaggcccgcgcagatggcgagccacaggaggagcacccagacgcggcgccagttgtcctcgaggaagtaggaggcgcgccgccaccaccgccggagcgggttgggctccgccgtcggccggaggttctggctcagcatctggctcaggttccggctgttcgtcgtcccgatcctcaccgactggctcggcgcttgcagcagcagcatctccaggttgtacagctgcaaaatcataaaattattatcggccatggttgccggcgacattgacggtgacgtcgattctggaccgaaattgtttgagaatttagtgaaatttgactgaattttgaatatatgtacctcgatgtagccgaggttgctggggtcgagctcctccatgatgaggcgagcgtactcctcggactgctcctgcccttggacagcttgttggccgacgcgctcagcgtgataatctggaaggaagaacacaatagttttaattataattctaattaattagtcaaaaaaaaggattgaatctttctacaaaagaaaacaagaacttgatccaaaaggggagggaaaagaaacacgatctttctctatcaaaatttgatccggtaacaataatcaatttaagaatgcgagtctggttggccattgcgatcgagacacgacacgaggaaaagaacttgaattagaagtcacattaaaaaaaaaagtcaagcaagaactttgctgtcctcaagagagcaggatgtgcagttgtggagaactggtcgatgatgctgatgtgcatgtgccaactaagaaattgagcttcaagctatccaagctactactatcttaactagaacaagaaacagagatcgaaactgatcgaaaaccgcttggaatttcagagaaaatcagcaaatttttctgttcttggagggacaaaaaagctgggtatgtttgaattacctctttaacctcctcttctgtgatcctgccatccgcgttcttgtccaccctggtccattaattaccaaacaagacagttgattaattcagccattgacgagttaattagtcaaaaattaactgttggtttaattggtgattaaacaaataattaatgaagtgtggttgctaaatacttacatgtcgaagaaggtttggagacggctgtcgaagctggtgtcggagatttggtcccagaattccagcagctccgccttgctgatgctgtcgccggagatgttccgccgcctcgccagcgcgtcgaacagctcgccggcgaactccagctccttcatccctgaagccagccagagagagtgattgattagttgatgagaggaagaagacgacgacgatggagaaggtgttcgagatggtaccgatgcactggccgaacttggagcgggggaggaggccgtccttggcgaggtcgtcgaagcgcttctcgacggcgggccagccggcgccgccgtcggcgcggctgatgaacttgaggcccttgagggcgtgggcggcggcggacttggagcggtcgaagcggggaccgccgccgccgccgccgcggcggttgacggaggcgaggcggcggagctcctgcgacacctgcttgatccgcgacgacgcgttccggatcaccgagtggccgaacgacgacgaccgcttctccagcgtccgcgccagcagcgtcacgtccgagtcctcgccgccgccgcccgccggcttcacgctgtgcaccgccaccgagtcgtcgcgcacgtcgagggtgatctccacgtagtcctcctcgtcgtcgtcgttggcgccggcggcggcgngcngcnccnccgccacccccgacggcgcggacagcggcgccgacaccgactccgcgaacctcgcgctcttcctcatcccggacctcttgctcagtggcccgctgtgcggcaccagccgctccctctgcggcggcggcgcctccgccccggcctccacgatgtcctctcctccgccgccggcgccatcggcggcgccagccctggtatggtgcatggcgcaacaacaacaaacacctcaagcgcgctctccaattgaactcccaagaaatgaaaccaagaaacggcagctgctccctccaatggcggtttcgattcgtgtgggtggaggaggaatggaggatggtggggtgggagagggcgtctggcgggtatatataccggaggtgaggtgggtgaggaggggtgtgtggcgtttaccagtcgccatggtcgccatggtcgtcggctcaggccgctcgtcggctcgtggggtaggtgcgtcgcgtgtgtgcgcgtctactgctctgctgctgcgttacactctgcactactcgctccctctttgacgctctggactaatgtttggccactcgttttattaaaaaatttatataaatattaaaaaaaattatgcttaaatcactttagataataataaaataagtaaaaaataaataataattctaaatttaataaaataaatgattaaatagtacaagcaaatattaaaatccatattagggtaggaagggagtagctgctgcgctgcgtttcgttttttttctttttttttttgggtgggaataaaattctgcggtcaagcggcggctgacgcggaaacgaacgacgttaaattaatatatttcttgggctgaatttgggctcgtgttttgttttatctatttacttgccattttttcccttcgctttcgttttttctggactgctctgtttcggaccacagaagagtacgggtagctcaggtttttgtattttgcagcgtcgttgtacagtacagtggtggtatctctggtgtacgtacgtatatacgctttccgtatatacgtttttattgttttttttggaggatgcgttttttttttgttgtcgagcgtttggcggcgcgtgctcctgtgcagtagcattcaggacttttacgtttcggcatagaaaagggaggctccattttgtgccgtttagaaagtgcaagtgtggtttcaacctgatatcctgtcttcattccccgctcgcagtttcttcttaaaaactatttaagaaacaatactcccttgaaatcttatttttcaaattttgttccaattatgatgtagattttattttgatttccgtcactattttcttaaactactgtacaaatgtatctctggtaaaaactttcttatatataaaagtttctttaaaatatcaaataaatttatttcttcaatttgtaataattaaaactcaattaattacgcgctaatgattttttttgttttgcgtgccttgtcttcatattcatcttaatttctatctcaaatactcacttattcccaaatcgacgaaggataatttaaattacatcaatcaaaacaccatacataacattctcttacaatgtatgtatatgatgatcaatttaagaaattttgaattctattatatgattatcaatttgagaaggagctgggagtaccacctaagaatcataattatgacattttggaaataaaattataatcccaataaattttcaaagtaaaggaaccatgttttcttcttctagagccacattgaacgtacaaggacgcgctggtaactctgaaatttcagaagtcgttccgttcaaaaactgtagacatagagacattttttgcatgtagagagagaaatttaattaacttatcatttgtaaggctgtcagataaattgagccaccatcgatcataatcaaacacatactcgtgagagaaaaaaaggatattaagtttcgttaatgtccttaattatacactacgatgttcctcgagcaaaattaatttggaaacggcactgggatatggatgttctcattaccaggtcaatccattcgatcgaggagagtaattgcattcttacctgcattgtacgacttcccgtgtgtgggggcattcactcattcagtactgtccagaggagtatactagtagcagtacaagaatcaccgaacccgcgttttttattctctttgagcacggactaaaaatcttgaggagaacagtacaacgtttcccatcaccactataaaaatccccgtacgtatcgttccataggtgtaggttcatttaaaatcgagtaggtgtaggttcatttaaaatcagtatctataagcttttccttatctttacgtgataaaaaaatactttctctgtttcagaatataaaactttctagcattgcccacatttatatagatgctagaaagtcttacaatcttacaaaggattatatgtgccggttcaataggaaaaaccggcattaatattataggtgtctccatctcaaacataaccactttttctccatgtattatcgtaatattagacgtacatgcatgcatacattatctatcaccattttctcctctaaattcg

SEQ ID NO: 67840 - DNA, 2349 bp, Oryza sativa
tgggtagtgctagatcttataacctgaaacggtggaagtagtacagctctatcggtctatttgcccggaagcatcatgattcgatcgttgattgacatgatgttaataaaacggaagatcgaggttggttcgatcgatgcctcgatgggatgagcaggcaggtcccagcggccacgtgctcgcacgcacgtcatggtactaactgtacgctaatttggtatccaaatcatcaacagcgtcatggaccagtgatgcaggcagcttcatggctgcagcctgcaggcagatcatcaccactgatctatccaaccgagtgggcctaaggctgtgtttagatctaaagtttggatccaaacttcagtctttttccatcacatcaacctgttatacacacacaacttttcagtcatatcatctccaattacaatcaaaatccaaactttgcgctgaactaaacacagcctaaataaatctcttgatccatccgcatgaagatttttctagataataaaacaagaaaaagactatgcgcactaactttttcttactgaattcttaactgatgtcgtaataaaatccgcctttttctttcaagaacttacatgaccgatgtttgaaactaattaagataaaagattaagtaagtgtacgaaaaaataagaaagatattagcgtatgattaattaagttttaattattacaaatttaaaaaatatatttatttaatattttagagcgacttctatatacaaagtttctacacaatatgtattatttagcagtttcaagaacgtgttaatgaaaatcgaggtagaaatctacatctatttctattggttaacaaatagaaatataaatccaggaatcgaggatgcaaagactaataactccaacactttcaaattttttctattatttatcttaagtctatttgtaaatctaaatcccatatcggcatatatccgtatatatgttaatgaacccatcaccaatatatataagcatgatctcatgggcgcggtgccgatgcatgcatattccacaattcgatcatggttccatgcagcatatatatcattgatgccatttcattattgagtggatccatcgtcgatccatccatgatacatacgatgatgagaagttatagcagttaattctcatcatctcgtgatgccggtgcatggccagccaacgcataatgcaaatccccatccatcgatccatccatcaattgtgtccagccagctgggtcgtctctcaatcaccggacaactgctcatgggatcatcttatggctggaaaacaataagatcccccaacaaaaaccaaacaaaaaagaggaagaaaaactaatggctccggtgagtcggcaatgcacatcgatctcgtccagtctcacgagacaatgttcgatcaggtgtgagaatgacgagccagcgacagacagatcaaactagggatacatagttcccggagtagtagcctgccattctatcccgaatttgatcggtgagcatggatgcaagtttgatcgagacagtgtgaagttaagaatctaagttaattacagaaggaaagaaatgaccagtcggcaaatgatttttgcaacttgaataagtaaaatttgaccttatattcttgcgaaggtgatatatttcatattaatctatcttattattttatcaaaaaaatttaataactatttaaatttcatgtatgaaacgagagatgctttctcgagcaacaaaataattaatctctcccacatatatgtatcaatggggcatcgactaccgacatgaaccggtgctttaattttttttaattcctgcttgcagtgcacttttgcatgcgccgggatgcactgtttggattggttatttcagattaggcgtagagacacgagggaactagctggtttgatggcaacagcacagagaagaggggaggagatggatggcatatgcatgaaaactgctaccaaaatatattatggccaataatccacaagatcgaagctagctagcttccatgtgggatcaggacatgcatccaaagttcaggtaaaaaaatacggaattgccatatttcgttcaacggcagaaattcttggaaaaaatctatcaaattgatcacagacctaacgaaaagtgaagtttacgccatcaggtgtaaaaatcacgatggcgtaaacaaaaaaaccttcccctgcccttatcttaaccttcctttacccactagaaaacttcgaaaggtggccacggtccattgcagccatggaagcggtgatccacgggcggaccttgggaagggcttctacacggacacggtggcagcatgcgggct

SEQ ID NO: 67841 - DNA, 2044 bp, Oryza sativa
aaaaaaaagctagggttttgggctactcgtcgtgaacctcaccgcgcccatcctccgtcgccaggcggatgtgagcgccggctccctccgtcgccgggggtgagcgccggctccctccttcgccggcgctcctctccccccgtcgccggctgctcgtcttcccttcttctccttttagcccccttcttccttacgccctctcctcttcagctctctgcgtcgagatcttaggtaagtgcaaggatggtattcctcttccctttccaacctccttcaatttcgtctccactctttctttgatttctttgtttggatggatgcacatctgcacatgtccccttcataaaaaagtagatctactaaaatgtgatgtattttaggttgatttgggtgcaaggaaatgttgcataggcctggattttgttatatatgtttgcaatgttatgtactgttggtatatttttagatgtagctgagcatgactaaaaatgtttttctttgtcgatctactcatcaatcatatttgtacacatgaatatttgttaaatcgattgtctcttagctcagatctgcactggttgtttgtgatttgctcattcaagttagatctatgaccttgttagttgtgcatattactatgcctttttgttatgtccgagcaattttccttggtcgatgatgtgtttgtcactggaggtagcatcccttggatgtggcagccgtggcatgggtccataaaaattggatttgcaatacttaacagtgtcaacaccatcatataaatatgtattgacaatgtactacatatgttatttacatagatggaagaaatgtgacgtattcggcgggccctaattgctaaagcagctggtttagtttccgtgatgtgtgcttatgttcttttcattgtgcgaagagctagaagaaacacccctaggatctcctatggaccaatgtctgaaagagacatagctagacaatcgaaccttagattcatctatcacacagatgatactaattgcttgaatcagcttcgaatgaggagggcccccttttttcaactatgtaacttgttgcgagaaagagaacttttgcgggacatcatccatagctcagtggaagaacaagttgccatgttcctccttgttgtaggccacaaccatagatttagagctttgcaacccacctttaggaggtcaattgaaactattagtagatactttagagaggtattgtatgttgttggtgagctacgacacgagatgatcacaacaccttcatcccacactcatttgaaaattacatcaaatacaagattcaacccttattttaaggtaagaacctaatgtttttgtatttcaactactgaataaaatatatgtttttcataagcttgtgctaatatatctaattgatcattaggattgcattggtgcaatagatggaactcatgtcgatgcttgagttccatatgcaatatctgctgcatttaggggtaggaagggtgtcactacacagaatatgatggctgcggtggactttgatcttagatttacgtatgtacttgctgggtgggaaggatctgcgcacgacgccctcatacttgcagatgccctagaaagggatgatggtcttagtgtccccccaggtaatagaagtgtccaaatttagatgattaaggtttttttggaaaggttagataatgattacactcaaattatttttatctcataggcaaattctatcttgttgatgctggatatgctgctaggccagggttccttccaccataccgtgggtgttgataccacttgagggagtatggtagaagaaactaccctcgtgacaggagagagttgtttaacttaagacactcctctcttagagtcacaatcgagcgggcatttggtgctctcaagaaccgcttcaagatactgtacaacaagcctttccatccatacaagacccaagtcaagttagttctagcgtgttgcatacttcacaactggatacttcggtttgggcatgatggccatgttccact

SEQ ID NO: 67842 - DNA, 19070 bp, Oryza sativa
  unsure (1)..(19070): unsure at all n locations
tcctgcagcccggtacatgggagttctaaagtcgtacgttcgtaacagagctaaacccgaggggagcatcattgaaggttacacgaccaaggaggctattgagttctgtgtcaattacatgttcgatgccgatcctatcggagttccagcgtctcgtcacgagggaaggttgtcaggtgttggcacaatcggaaggaaaagaattaggcccgatcaagcgtcgtacgcgcaggctcattacgctgtgctccaacatatggcagaagttggcccatactttgaggagcacttagcgaaaatccgagatgagaacttggggcgatctgatgcatggattaacagagaacataattctcggttcaacgaatgattcaagaatcgtgtgacaatgtccacggatgtcccaaatgagatagtacagttgttggggatgggaccgtcttggaccatagacacatggcaaggatacgatataaatggatacacattttataccgtcaaacaagatgacaaaagcacagtgcaaaacagcggcgtccgtatagatgcattccaggatcaagttgggtcaaacacatactacggccgcattgaggagatctgggagctaaactacgtcaagttcacggttcctttgttccgctgccgttaggtgaatctacgcactggtgtcaaagccgacaaggaaggtttcactttagtagatctatctaaggtgggatacgccgatgaaccatttgtacttgcgaaacaggtcgagcagatattctacataaaagacccttcaaacaagaagatgcacatcgtgagggatggaaagcgccgaattgtaggagttgacaacgccgtcgatgaagaagaatacaaccataatcttcatgtaagacctcacattgaccttgacgatgatccccaagagcctgtggcatatgctcgttcagatcataccgaaggcataaccttgtgactgatgcatttgtacttatctattgtaatgaatgaagtattttgttttattgcaaagacttgatatgtgtagtcattaatatggctaattttgttttattacaaatgaccaaaataaaagttgtagatcgtgatgagaggatcaactttgttgttaaccatatttcaatttgaaatcatttagtatttacaaatgctattaattagatttgtcatattgtcgaaatcaatttcaagctgttgggaaaaaaattatatagaataatgaccaaaataaaattattagatcttgaaaggctctacaactttgttgttgaccatatttccatttgaaatcttttactatccgaaaatgtattatgactaataaaatgaattattacacagttgctatatattttacactcacaacaaatgaaagatggaaaatgagtcatcggtgacgggctctacggtaaagcccgattgagatgactcatcactctaatataactagggtttctcagatcggatcgaaaatttttctaagtcccgctacagtttcccgcctccttagaaccctagcgccgccgccaactcctccttcaccgccgtcgtcctccctcgccgccaccaccaccgagaccgccgccaccgccaccgagcccgccgccaccgccgccgagcccgccgccaccgccaccgagcccgccgcctccaccgagcccgccaccaccgccaccgagcccgctgcctccaccgagcccgccgccaccgccaccgagcctctacaccgaccgacgtcggccttcctcgtcgtcgccgcttgcctcttcaccgacacgaacagcagcccccaccgaggccggcgacgtccttcctcatcgtcgtcacctactcctcaccgacgcccgacgccgcccgcccgacgccgacctccccgatcggcgtctacaccgaccggcgccgccgccgtgaactcctccttcaccgagcccgccgcctgcaccgagcccgccgccacctccaccgaccggcgacgccctccaccgagcccgccgccgccaccaccgagccccccccccccggccgacctcatgtgagtcctccatcgcgcctccctctgctacctgcatgtgtttgataatgaaaatgtggatgttgggatgaaatgtggatgttgggatgaatttagtgatagatgattttagtgattgatgacttgatgatgaatagatggaatgtggtgcattaatgaatttagtgatagatgattttagtgatagatgattttagggattgatgatatgtggtgaacgaatgattttagtgattgatgacatgatgatgaatagatggaatgtggttcattaatgaatttagtgatagatgcatgatatgtggatgaatagatggtatgaggtgaatttatgattttaggatttgatgatatgtttaatttatttatatgtgccattcaattcattctatcgttgtgatatgcgcaatttagtttatttatatatttcatttatttttataagtgacattcaattcattgtaatagattgtagcactcaattgtgtttttttttgtttttttggaaaaaagtagacaatgtctcagcaaggcgaaccaatgtcgacgacaactagtgggtcctcaagggcacgtactcctaggacagggaacaaaattcctaaggaacggttccgcataacagcggtagacgccgtagggttgccgacatctccaaggaaaatattgagccgatttaggtctatctgcggggtcatagggaggcagaaattcattattctgcaagacgacttcaagctcgtgccggccgtagagaaggacattgcttggctaacgttcaaggagagctttgattatcctgcggagcatgaggaccgtctcaggcgggctgctttcaaggttatgggcactgcttggaagaacttcaagactaagctagtcggcgagttcgtctacaacccggcaaatccagatccaagagagaaatttccttggatcacggaacaggtctggtcggaattccatgcgaagaagtcgacccccgagtccagagctagaagcgaggcatatcgcttgctccagactaggaaccagcatccgcaccggcttggtaccgccggatatgccggtaaggaagaggaatggcagcgtgaggatgaagaagcgaaggaatcgtggtacaccgctcgtgtttggcgatatcccacaccctcgggctaggaactgggccagggctaggtaccagaaacatgatgatggcacaatcttcatgccaaatgtagaagatcaacgagtatacgaagctatagtaagtgtctaatcaaactagatgttcgcattgtttcccatcgtgcagtttatttgaccccactaaattgtaatgcagaaggagttggttgccgagcaacaagcctcgcaagaggcctgctctcaaagacgcgaggacgacctcctcacgaaagcgttgggcaacaaggaacaccgtggacggacacggggcgttgggtcttctgttccctggaagtatggatttccagactacgcgtggcagtacaagaagcggacttccaacaaggcgaagaaagatgcacgccttgaagccaagatccgggagtcgatacgagctgagctgacatctgaattcgacgaaaagctcgagtcgatgagggccaagattaggtaagagatccgagaagagcaacagatcccccaggctgccgctactgctgcgcacaaagagttaggaagtcccaccgaaaaacgcagcagttgcgcatcaactgagttggcggaaaatccaacatcggtcgacagcgccatcgaccacataacggtaaccgtgaacttactcaatacatgaaagacgtaacgaatccatatgatatataatattctaaaaaaattgattaatctatcgcaggaaccaacgagctgcaccctcacagttagggtgatgccgatcttcactgttccagcagccgagggacttgcgtacaagccgaccccagagacaagagtgcatggagcgcaactcagggccgactgtgcaaaagttcaagtcgactcggtgaagcctgaatacgagctgttccctctgaagtatccaccgaacgacgaggtcctctcactaggaaatgcccgtggtaccttcatccaatggcctaaggacctcattgagatcagggttacagcgaggccaaccactgcaccaggcggtcgtccaccaaagagacccgcctctgctccttcagcccctcctgctcaagatcgtcatgcacaatcttacgatgtgcagttgcagtacgacacggatttcggggaggaccgaacggaggccgacagcaaggcgattcatgaacccccaccgatgaagaagagcaggaaggcacactcttcccctcagagaattactctcgataaacccgaagcaaaggggagaggaaggggaggaaaggtgcaggcctcgcttctagctccaagaaagctagatctgggcaagggccaggaagagactaagggcaaagaggtcaagaagaaatacgtcactccacaggagttccaactaggcatgccattggttggagatgacgtgcttgccgcaatgggcaccgcttgcaaggaccttcacttatactacatggagaaatctaacgccaggaagccaagtaaagctaccaatatccttggacagcacgatggaaagcctttccttggtccaacaaattatatcgtggtcgacttcaaggatcttttcgacctctacaggctctgagtggtggacacaagcctccttaagtgctactccttgtaagtattgtcgcccaactcattctggtaataacaatcggtttaacttgcttacaagatcgttgatcctgtgtgtaggttaagttggcaatggtgtcagaagcatgcaccggaagttgccttccttgatccacaagtggtcactatcacaaatctccagaataaccgtcaaggaatggtcaactacatctacgacaccttgtggtcccgccgagacaagaagtacattatgtgtgcctataatcaatagtaagtgtgttaactaaatatacacaacagcatgacacattccttgagtacttaattaactttcactatattaatgccgcagtgcccattggatcattctggtcataacacctaaatggagtacatgtcattacctgaactccagaattgataagaacgcatatgattggaccccaattcaactagcgatagatgaagcgtgggcccaatacgtgcaaagaggaggcctcaggaagacaggacatgacaccctcatccacaaaaaagacttctcggtgaagcaacaaataggtgaccagtgcggattccatgtgtgccacaatatgcgacttctgtatagagaaaaggtgaagactttggctgagtttgaggtcggtggtctcaattgtgatagactaactacattttagtacttatatatgatcgatcaactaatctggaattatgacaatgtagggcacaataaccaagtctctgactaccagctttgaggaggttcgcgaggagatagccagcttcatcctccgcgaaataattaatcccaaaggaatgtttaggcttaaactaaaatgatgaataatgttgaacttctatgtttaggcaatgatgaacacttattatgcaactgtggtgatgtaactgtgatgcttatatttatgtatatatttcatatgtttatgttaagacttgctaaataaatatttgatccaattaactcggttttgcaggtgaaatatgataaatatttgaatggatgtgaaatatgtgaatggatgtgaaatatgagatggctgtgaatgtgtggttgtgtgaaatatgttgatgtctgtgtatgtgaatgcatatgtatgaatgggtgatgctggggagttggggatattggatatctgcgtttgtttctgtcatctttgcagcgggcatggctagcaaaggcctgaggctagccaaaaaacaaaatttattttttttgtggattatagtcatctgtgacgggccataactaaatgcccgattgagatgagatcatctgtgacgggctctagtttaggcccgattgaggtcactagtcatctgtgacgggctctagtttaggcccgattgaggtcagcagtcatctgtgacgggctctaatttaggcccgattgaggtcatcagtcatctatgacgggctatagtttaggctcgattgagatgagtatcatctgtgatgggctctagtttaggcccgataaaggttagtagtcatctgtgacgggcgctagttgtggcctgatagagataggtcatctgtaacgggctatagtttgactggtcgtctgggtcaaagctatcggtgacgggctttacttagggcccgattgagatatattcattcgtgacggctgtttgcccgattgagataactcttcacatcagtgacttctagcctgtgacggacgctgtgcccgattgagatgagggtatccgttctagtgagtgtcttttttttatttactagcagtatgtacttgtcatggcagaaaaacacacatatcacattgaactataattagtaggcactgatcttccgaataccgattctttttttttcataagctatatactgaaatagaccagtagtatatatctaaacctgaaatgcgtgggtgcataattaattattatggagctacatacatgcacgatatggtcattgcattgcatatactgcaaatatcctcgatcgatctattctgccaataaagaggatgaactgaatgtttcaaaaacgaaagaaaacgaagatggtttcattactgtcaggatttcagcatcatttcctcagtcggccgttcgcatcaaaaacatatatatgtactaaaaagcaagaaccaatcgtcatggatttcaggagatcggcacagccatcgtctgggatcccgattgttcgatcggagcaagtgcaagcacaccatattgcggactctagcgacgactagcgtcactagcctctccgaggtgtgcatatgcaccatacgactgcctgggcaaagaagataagattgatatgatatacacgacataagaaataattaagtagtactaaccacatgcattgtcgctttcgaaaaggctttgcgggagatcgacgagtgattgatgccgcctgggttagttcaactattgctgcatcgcaccgtcgactagtcccgtcccgtcgcgccgttgccttggaggacgatgacctgcaattccgccgcacgatgttgccgatcggtcgacaccgccgccgcgccgcgcgtgcaggtcgccacgccgatggatcacgccgtcacctgcaacgcagccatggatcgacgatgaatctcgctgctgtcgcggaatcgacgatgaatcgccgccgccttctccgagttctggtatatcgcggtctctcccagtgacctgattttcgtatccgatgcactggtgggaccgaggaattatgcgagctcatgtcattccggtttctgtgattaaggggtacgtaattttttttctagttaaaaagttaaacgggtccgctcgttaatccgatatcaggatccatcgaagctaatcacagatcgacggtggataagagcaggtgtacatacttccaggtgtatacttccaggtgtatagaaccattttcatatatatatatatatatatatatatatatatatatatatatatatatatatatatatatatataaagtttggtaagatagatgaaataaccttgtccttgaagatatcccttcagtgctctcataatcaagtagtgtaatgtctttcacttagtttgccattgtactaattcataggatgcaacagcatggttggacgtgttcatctcttgattatgaatattttgtccatgtgctccaaagcgttaagcattggtacgaaatttttcgttgttttttttttcttgtgttggattgggtttgtgctacattgggttttgtgatctatgggcctgtacacatcagtttatggctttgtgctatcacaaatggttagatgggtttcagcttatccaatttcctggtaaaacagcttctactcttattggcaaatgttgctttaatatagtgtatgtatggtggcctctcacagtcacaacatagtacggctaccaaatatcaaatgagtgtggaattggggaaaagaagaaagagacaggtggtgcaatgactaaagcaagaagaaaattagacaaccaactgcattatcagacaatttttcttgctttgtggggtctaaaatagtactgaacgaacttgatttctttgagagagactgcagcattttgagtgcttttttatataattacaaatgcaaatatatatcacacacacaaacacacttgcctcctgtttattgcatccagaaatgaaagtaaaaaaaaatattaggaacagttaaaaatcaggcagccaaagaacacagtaacagcatatactatctgctccccaattgattgattgcacctagatccaatatcatccaaataaacaaaagagcacaaggtcaaatctttagccaccaagatcccatcagccacaaatcgatccatctccaagctcaaaatcccaattctttccaagaaagatttttctcggaggccatgtcgaccgccggcggcggcggcggcggccggcgggtcaccatcaggtccatctcctgcaggggcgtcaaggcgttcgtccccttccagaagccgccgctctacgccgccgtgtcgctcgccggccgccggggaagacgagcggcgaccccgacggcggggagaacccggactgggacgccgccgtcttcgccttcgacctccccgccgccgcggatggtatgctgcagttcgaggtgaaggcgcagggcgctgctcgggagcaagctcgtcggcaaggatgtccgntgccgctggcagacctcgccgtcgccggcggcgacggcgcggcggcggcgccgaggcacgtgagctaccaggtgtgcgcccccgacggcaaggcgaacggcaagctcagcttcaccttcgccgtcaccggcggcggcgcgtaccagcagccgcaggtggatcatccaactccaatctcctcctcttgctgcgcgccaccgccgacgtcgacgacgacgacgacgtcgggtgcgccgtatccgcctccggcgatggcaagctacccgccgctgccatcgctgtccgcgacaccgtcagcttcactgtacccaccgccgccgccgagcagctaccctcctcctccaccgccgccgccgccgccgcctcacgtgacgcaaagcttcgcaccaaacagcagctacccgccgccgcctcctccgtcgcagtacatcgccggctacccgccgccaccaccgagcaacttctacccgccaccgccggcaggctacccggcgcccagtttcccctctccgacgagcacctacccgccaccgccgccgccggagtcagcctcatcgcagtatccaccaccactgccaagatcggcgccatgctgcgatcgctcggtggaccgtgcgctgccgtcgtacatgtcgccgcgtccgccgccgcccggcgcgccgtgctaccccccgccggcggcgtggttgccggatcaagaagcggcgggagcgccgtacagcttgtacccccaacccgggactcgctacttgtagatgatgaattctgctaaattgatttgagctttgcgtatatcacaaattcacaagttgaattgaattctgcttttcatcaaaagaaaaggaaagagttggattcgatctgtaaattaactgtgaatgctttaatcgccaggacgggaacaatgaattgatcttgtggatttgtgagcatgtcgggttgttttgagcaagatcaattgtgaatgtttagtttgtttctggatttttttcttcttctccatgttaagctgtaaaaatctcttcttgtgtaaaggaaaagtcatcatcctttcgacggagctgctgcatatgggcttattgtaatgctgtgtatgggtagatgatttttttttttcaaaaacaagattattatataaaattttctgtaaaaaagccaaataaatctagtttttaaggttatagtcttaatttctattcaaactactagactgtgcgtcctcgttgctaaactgtttaagacaattagatgacctaacttctactctctcttttttcacgtgtgtttattccctaaccagttgtgttgcttactacatgatcttggaataagttcaacggaggactctcaacttgatagcgagaaatgtatacccctaaacttatacaaaccgtgcactcaaggtcatgtggcaatatatatgagtggtttcgctgacgtggcatcctaatcaacaaaaaaattaaaaaagtacgtgggacccatatgtcagctgtaatttttttttcttctcctcttctcttttctctcttctcttcttcagcgagggaggccgacggctggcgggcgagcacggcggcgggcctgtgtggcagcggagcggcggcgggcggcgagcggagcgcggcggatgagttcgccgtcgtgcctcccgccggctcctgcgtctccgccacccacactgtctaccactacgaggcggcggtcagagcaacccccgtccttgtcgtgcttcttcccttcgtcggaagcgagcggaaggcgaagcaggtaggcgacagcggcagagcagcgacgggcgagcgcgatagcggggcggctggcaaaaggcgagcacggccgcaggcggcgaactggtggtttgctgccagatagtgccgccacggcggaaggcgagtggaaggtggtgacgcagctgtgcagggcatcgtgacaccatcgcaggagagcgagctcgtcattgccaaaacaggcgacgtcatcgcctcaacctactacatgagagcgtgggagcgcgacgccggcgcagaggcggacgcgttgctagaggagctgtggaacgtgaaggccaagctcgagctcgccgagaccaaggcggtggcggcgggcgcgctggcggataaggcgcgagatgcgtacgagcgtgacagggaggacatgaggtgcacagtgcgccgtgctccaccgctacccgcaccttgacctggccaggatcgtcgtcgcgcaaccgggcgataacgccggtgccagtcggcctcctctctctctctctccctcctccggtctcgctttgtctctccccactcccccaccgcgcttgcccgccgccgctccgcttcctcgcaggcccgccgccgcgctctcccgccgcccgcccatcactgctccgcccgtcggccgctggcctccctcactgaagaagagaagagagaagagagaaaagagaagagagaagagagaaaagaaggagaagaagaaaaaagatgtgcagctgacatgtgggcccccacgtacttttttttttctgactaggatgccacgtgagcgaaaccacccatatatactgccttaggaccttaagtacacagtttgtatgagtttaggggtacatatttcggctttgttcggttacgcccagattcaatccgggccgggaatgacaagtatagtaagaaatttatgatagatacaataagagactaggatttattccagaccgggaaccaatttactcatgatagatacaacaaaacatccgaattagttccacaactcttgactagtgggttgattcctggtctcttattgtccctatcatgagtaaattggttcccagctcggaataaatcccggtctatcattgtatctatcataaatttcttactacacttatcattactagcccggattaaatccgggtgtaaccaaacaaggccttttagaaaaatctcgcccttaagtcaagggacctccggtgaacttatttctacaatcttctctccgaacacaccctaaccagcagaggaacctgaaaattactcctctatattaggccgctatgtctgactaggtgaacctcggcagaggatggaaccaagtggcccattagaggcccaaaactcctggccttgctgccctgggttgaattggtcaaggccctacataggtcccacccttttttttccttgacagtagctctgtaagcaccaggtagccacaaagacctagggtgtgtttggttggatagatgagcctggatgtggatgggagatggccgctcgagtttttgtagtgtttggttggagggccgggtagatggggtagctggaatagggaatattctctcaatatgctggatgagtgcatccggctgatttggctggatgaagccatccagttttggattgggtgatgtgttctattccgattggctgtggttggtttgatttcctgttaagcaagctccaaataattttttctcctaaaccgtttatctaatttatgatttgattacaccattatattttttataattaaatctttaaaataagatctcggatgattatattttgttaaaaaatatatatatgacaaatgggtcccattaacttttggcttttcccatccatgctatatccctccaatcaaataagaaattggatcgtcatatccatacaaaccaaacaaaaaattggattgtcatatccatacaaaccaaacaaaaaattggatcgctatatccaacaaaatatggatggccatatcctatccatacatgaccgtgaaccaaacacacccctagttaatactcgttgacttttttctgtacatacagttttacatatttcacaaaagtttttgaataaaacgaatggtataacatgtttaaaaaagttaacggcgtcaaatattttaaagacggatggagtatgtcacgtaggataaagaacaaaatcactgtccaaattatcgagggacatgattaacactggttttgagagtagtgggtggctttgtaccatattttacgattgatgctaatgaaagttgacccacagcgaggtatctcaagcggactttatcaactaagggagtgacgaccttatctggtaaattaggcccaatataggcccaaaatttctggcccttgctgcctttgggctcaacacttgaaggcctcctcctcctccttcaatgtagaatccaaccgaggccatggagcagcccaaaacggtgcaatggcgtgagcaacagacacattgacttttttaaaaaaaaaaacacagtgtaaatgtagacgctaataacacggtcacactcatcgtccttgtgaacacaaacacgtaaatcctacccctataaacatctccagaagattagaccgacatatcttgatattaacgaagtcaccacgtacacgttgtttaatcatcttgcttagttagtcatcagttaagggatgacagcactagtaatcgacaattactcgatcggtaggaagtgcaggaggagtagaccagttaattaactggagctcgtggttatgctttttactagttgacaaaaaatttggtcggtctcggtcaaacgatggcacagcacgggcgcagtttgtagctgcatctaggccactggtggtgagtagtggttgctggagctgaaggagcatcatccaccaccatggccatgtggggagcaggagctgaaggagagcacgcacgcctatcactatcatagcattgtacgcacacgcgcgcgagcgattcctgttcagatttccatgactaaaatatatcatatatgatcttttattgctactttctttgttttttgttttatgtcctaagttgtttgatttttttttctttgttaaattttttataagtttgagcaagtttatagctatagtaatactttaaatacaaaacaaacattatatcaaaatatatttaatattaaatttaataaaactagtttgacggtgtcgtataattttctctataaattagatcaaacttaaaagaattttgactaaaaaaattcaaacaactattttatgacggggcagtaatcgagaagtatcgtacctatccatggagtgcaaaacaatggcacggtccatgtgtcgtgtcgtactaatatccagtctattcgtgtaagcgcacgcgcacaaactccaccgatggatgaatggatggatgcatatccatcaatctgttgtctaatctcgcagcatcagcagtgcgctcctccggcttaccgctggttgtctcttctccagagaggcagagaccagagtttcaactttcaacctcacagggggcattttaaacatcgtcgtcacgagtctaaaccaaatcaggatggtttctctggtgcagaaatgaaccaaatggtttatcataagtttctcaagggtgcagaaatgaaccaaatagtttatcataattttctcaagggtggtacgaatgaatgaattaatgactactataatacgggatatctctttggaacacattacaatatattaaaaagaataaaaataaggtcttaatttgtaggggctatattcggtggacacacttaccaacggccctgattatagatcttaaggatcaagactctaaataacgaatttaggagagagatgcgttagttaattacatgtatctatacatcttgtattataaaacaacctaaaaagaaaaagcagtcgtgcctttagaatgaagggagtaattgactttgactatctgaacgtgcacatgttaaatcctgcattcctcttccgttaattagcccgaaaccaagaagggaaaggtagagagataaacgtatacgtgttgctcgctgattggtcgcctatcctctctgggacaaaccccgttctgaccgctaccttgtccccagttaaaccctttcccaccattgaccatgaatgcggtacacgtggcaagcaatccacaccttgcattgtccccttcatccttggttaattaccctggcactggattaattaccttaacctgagagtaacatcacagtacgtgtgtagtaaaatactcctgtgaaggatggatataccagcaaaatcttgtcagctggcattttatcttatcctgttctgatatgatgactagcatacactgtaggagcatatttttcttactattccgctggcattaattactgtaagtacaagttatatactccaactatttttatataaggaatattataaagttacaaattcaaaactaattactcaaactatgaatatatatatttggtatgtaaaaattgttccaatagaattatatttttaatgatatttcgattttataatacaccttatagaaagaaaaggagggagtatacgtaaccaatgcaacgaaaaataatttcaggataaggtctttacatttctacctttaattagtggtccaaactccaaagcaaacctgagtgattataaattaaggaaagaaaaccaagttagtaattttgaagttatatattaaatttcaaaattggtgtagttttatactccacaactcaacaagcaatactcctaaataaaaaatccaagcaaagtagatctacctagctagcttaatcatataagcttcacctggttttttgtttgcacatcatgtaagaaatcatgcatatgagtgtctctttagtctatatatacatagagatctcatataattacatactggctaccaagataatatcacagatctgtatataatactccagcatggcctttctactgattgactatgcggatagtacagctaattagacgatgtgctagctgttgtatattgccaagttgatactctcctctgacgttagtaggagtacactataacctacacttaattaattaattaattaaaattaaaaaaatgtgggtgatggagcagataatggtggctggaagcccggatccaaggccccatctttgaccatcaggtcaaaactgctgtgtgtgctgacatctaagcgagtagcactgcttgcattgctacctttctaagcaaaaacaggccattatatagtctagagcccacatgcttaattgttttattttaattcccatcttaattttgagtagtgatactgccacgtgtacagttaggtactgtgttcaaacgaaatttgtgatgcttgtgttaattgattaacactctcacaccgacatatataggaagtgctatgagaagatgcccgatagtacagtgataaagggggtgtggttttaatcctaaagtttcgtattcaattttcaacatgctcatatttttttatgaaaaatgtcaattttttttcaatctgatccttatataggacatgtttaggagtttttaatagctacatccattgaatcccaattctctcatattgcctaaattttactttaggtcgtaaaatctaatggttgaaaaatctagaaatgaacgattatatagaagaaaaaaaaccataagttcttcaaaacccttttttttttcttatcagttggctacttaccatctacttcgtgtgatctacaattcctttaaacaagaccttaattacattttacaccctgagcccacctgccatcgatggctagctcataacttagctaatgtcccaccgctagcaatagtagctacttgctcaatttcctactgataataatgaaggagttcaaggcaagcaaaggagaagtcttaccctgcatctagagtaccaactttgaccagcttattagcacactcaattagtgcacatgattcccggttttttcccgtcaaacaaacaccaccacactcaagtcgccacgtgtaaatattagtcaatactcgttattgaaaccggacatattatattaaatgacacgggagattacaactctgccatcataataaacagataaaaagaatatcaaaatagagcaaagagcctcggcgtcttgaaaattcacatgaaattaatacgatcgcatgagactacccacaatgttaaccagctccgacgaaaataaaaactaatactataccaatattaatatatagcacctcctctaatttcacaaagtttcatatcaaaactcaccggcggtgggccctagatccaattgtcattgcataacaaaatatagcaataggccctctctagctcacacttactccattagtctcaacattgacaggctgtggactgggacccacctgccggcattctcatctctctcacacacacacaccaaattctaatcaaaataaaagcaaaggggatcatgatagtgtcacggctttgaccggctactgccattagataagccctaatcaaagtggattagtgcttaattagagtgtgtgattagcgcgccggatttggatctgaatcggagccgggagctaggatcagtgagctggaagtataatgcccccaatttctcaatctttttttaacctcggagaacgtgctctcctctttcttttaattttctttttctcttttcaattcaatcttgccttttaattttgaccccggtcaaactgctcccatctcgacatctctcatggaaacaaacgcacgcgtcacatgccacacatgcgtttcagtgtacagtaactgaccgaaataattactgacttaacaacaactgtcaaaagttactactaattaccttagctaacaaagatacttagcactaatcaggaacaagatgacgtaatgcgtagaggcatattcgaatctttcactgttttgatccgcttggaacaccggttaataacggcataacgcgtaatatacgccatagtgatttggacttttttttttctacgtacttttttcttttctttttggcctaacgaccgtcatgatgagcatttttgactggatttgtattcgaattcgatttattccgtctgactttgcttgggtaaaacggcacctgaaaattcgtgcgtgcgtgcgtgccttgaattatgcacagcatttgcagtttgaccaaggcttgtgctacgtgcggtttagctgcagagatctcggtgtgagtgagtgtgtgcactgaacgatccaaatatttttgaatggtttatgccaagtggaatttgaatttgctatgaaaattatggtattcatgcctacaaaattgtttgtaatcagttttggaaatttggataccactgtattgctggactcgatgggcgcgcacacaggatgtgaaatgtggggaggaagcagtttaaagtttaaacaaaccagaaactgaaaaaaggggaaagcaaaagtgagttgaaattttgcctgccaccacgcagccttgcttttttttttcttcttttcttttttctgatcagaatgcaacgaaaaaccatgtacaaattagcaccaaaacttttctgtaattacaaatgcggacacagctgcagtcgaagctgcagctgaatcatcatcgcctaaactgaactcggatcgagcttaatcttaatcacccccgttaattaccctcccggagactaattaattgattttagcctagccggagcacgccaccgcgccgccattgccgcagacgagggtggtggtggtggtggcggcggcggcctctcgccggcggcggctgccgagcctgccgaggaaggggaggcctcgacctttggaggatcttctggtggtggtggcggtggcggcggcggtggcggtgtcaccggcggcggcggcgacgacttcttggatggtgtccagcttgggcgaccaccgccgcgccttgctgtagccgacgagctcctcgtactccttctccagcttcttgtccccgcgcagcacgggggggttggtggcggcggcggcgaggtcggcgaccttgtcgtcggcggcgaggaggaagtcgtcggagaacttgatctggagcgtgccggaccggtgcggaggagctcgaacggccgctgctgctgcttcttggcggcggaggcggaggaggcggagaggaggaggaggagggaggaggcgagggagacgaaggagaggacggagtggaacaggtgggcggggaggaggaagtaggcgtggcccggctcgagcacctcgccgggcg

SEQ ID NO: 67843 - DNA, 2556 bp, Oryza sativa
aggtgggggtggggcccacgtgggggtggcaggtttgacactttgaccggcattttttttcttttttcttttttctttttttgcgcggcgtttggatctagctagttcctcagtcgtcacactaccagcttggctttcccactttttttattttcctttttctctttttatatatactactgtataaatataaaaaatacatatagagatattcaaaagatgcgggtgtgtcagaatgtggggcccggtgttcagtccacgtgcctgcgacggtgccagccagtgtgtgtgaccgtggatccatttcgaggcgacgtacgctcgtgcatccatccactcgtgcgtgccaacgtgacaactactactcctcttctaccgtgcaaattttaatggcgcgatcgagttggcaaattgcgcctagtaatcgaggtgagttcgtggatgtttggagcacgtttggttagtgtgagggagtatttttgtaccggattaaagtaataatgttgcgtagctttaggaaccgggactgatgtgtgacgagcgatttctagcgtttggttagagtgattttgcatggagttcttgaaatctggtatagtgcgacaaatgatttttatcctcctgttagagcatagtaatattttcgtgtgtctctagaaaccgactaatgttcgtattgttgtgaagctcttgaaatctactatagtgcgacaaatgattctagtcgattaaagtgatattgttgaggagatattgaaatatgctatagtacgacaaatgattatggccttcagctagagtgatattgtcgcgtacctctagaaatagactaaaggatgcattcagaagtcaatgttcttatttcccactccctcgttttctacgcgcgctactctttctaaactgctaaacattgtgtttcttgaacaaaaaactatagaaagttgtgtaaaaatcttatttattcttttttaacattatttacttaacatttaattaatcatatgttaataagctatctatttttcatgcacgtgggagaggttcccaaccccttctccagaacacatcctaaagtgatattgttgtggaggtcttgaaatctgctgtagtgcgataaatgattctagcctctagctagagtagtgatatcatcgtgtagcactaaaaactgaccaaagttacattgttgttgagcgcttgaaatctgctataatgcgacaaacgattctagcctttggctagagtaatattgtcgtgcagctctaaaccttttttttttgatagtttgtggtcaagaaaaacatttgagttgcatttgtgtcacggaattaagtcatggatgcattgggaaaacacaatgtgtttgtcggtaatcctacctaatatgtggtgagcatttttggtgtcagattaaagtaaatcttgtcatggagctctacgaaccgaccgaactgtgaagagcgatttttggcatttgattaaagtaatttgtcatggagctcttgaattctgttgtagggcgacaaatgaatttttgttgtggatgtgatcttgaaatatgctaatgtgcgataaatgattctagcctccggctagagtgatattatcatgtacttatagaaacagattaaagtaatattgttgtggaggccttgaaatctgctatagtaaaaaatctagcctctggctagagtgaattgtcgtgtagctctaaaaactgactaaagttatattattgtggagctcttgaagtctgctatagtgtgaaaaatgattctaacctctggctatagtaatatttttgtgtagctctaaaaaatgactaaaataacattgttgtggagctcttgaaatttgttatagtgcgacaaatgattctagcctctagctatagtaatattattgtgtagctctaaaaatcgactaaaataatattgctgtggagctcttgaaattttttaatagtgcgataaatgattctagtctctcgttagagtaatatttacatgtacctctagaaaccgactaaagtaatattgttattgaggccttgaaatctaccataatgtgaccaatggttctagcctctggctaaagcgctgaagtaatattatatatagagctcttgaaatttgctatagagcgataaatcatttaagcctctagctagactgataatatcatgtacttctagaaactggctaaagcaatattattgtgtggagcttttaatatctactattaaaaaaattagcgaccggcaatttcgttgtgggatcatgaaataattttagcaacgggccaaaattatattggaatagaacactggatcactaagaaacattttttatggcacactgaactttgccaaagagaggcgcctctagctagttaatttgatcaagaaaatattgaagtaacacttgttccatgaaattaaaaactgtagcgctcggttcaaagtattattatcgtttaatgtttggaagactcaagtgtgtgacaagttcaaagtaataaggtcatgtggcactttattaccaaaaaaaaaat

SEQ ID NO: 67844 - DNA, 3193 bp, Oryza sativa
ccaggtagtacaggtagtactgctttttactgcggtgaaaggagcaaagcttctgcgtctgcttggcgttggtctacgtctaacgtgagcgtgcgtgcgcctgttggtcgtcgtccgaatggcctggtctccaacctcctttttcgttcaacgcctttgttggtcccccggcccctctcttcctcttcttcatcgatcaccaccttttcttttttctttcttcccctaaagattatatttgcgcgcagctgatgcagtgcactgcagcagggagagcagctgtggcactggcagtggctggctgctgctctttggtttgggtttgcctgcctagacgaacctctgcaccgtcgtggtccacctctgtcttgttaagtactcccttgattctcatacggctcgtttggttggagggagtttttaggagagattgggaatttaaagggatgatgttattaagggcctctttgaatcaaagaatttatgtaggaattttataggatttaaatcctataggaaattttcctatttggccctttgattcaaaggattgaagctttccaaatcctatgaaattcctatggaatggcacattgcatgtggattttggaggaaatttagcaagagctccaacctcttggaaaatttccttttagtctatctctctcattcgattcctgtgtttttcctgcgctccaatcaaacgaccattcctatgtttttcctgtgttttgcaatcctctattttacacttcaattcctgtcagaatcctatgtttttcctattcctccgttttttctaccctgtgattcaaaggggccctaagtgttttgttttgtcgaaacaagatttcggctatactaaaaagaggtggctatcaagctagaaaagtggatgggtttggagacgaagaattttatacaggttcaggcctttttattcaagaagtaataccctactcctgtccggggatgattccgccgagtatattattgattgtataatctaggtcaaaaaaccgtgccccgagaggcatccggacccctccttatataggggagggggtccgctttacaaaatacagtccatatcctaaaagaacatggaattacagataaaatacaatcgtaaccgactaggatctcgggtatttccttgacatacaagtttagaatctaacccgagtcctcatgaaggtattctgtctttattcggtatcatgtacccagctggaatatgaccgccatgtagatatagggtatccataatctctacagtaacccccgagacctttgcagtcgacgaaatagccatctcagaacaaaaaacaataatccgagtgcttcaattcaacctgctccagcctgccgagtgctaaaatcaaagactgtgaagggcgaaaagaaaacatggtgcatcgagtagatgcacctaattaggtgtagcccccgactatgtggttagttgaaaaactaaacatgtagtcaagaaccgagtggttttacaaccaaacattatatagcaaagcatgtgtggtagtcagtaaaacacccagccgtctgcttcttagctgcaatacatcgagaaaaaaatatgaaaaggcccgagtgataaacactcaaaaggtcctcaaatagacatatttgacaggaatccgagtaaaaactctaaagacaacccatcaaatatgataaaaaatcatggtaatcaacgagtctaatagcctaggctatggccctcatcataaccaaaatgtgcatataacatgctaagagaatgactattaataaaccagtcatctcaaatcaacccaaacaacttttgcagcctaataaagctgacaaaaatggtataacacctttctgtcgggcacctttttatttgcagcataataattccaaagaattatcgaaccgcgttaaaaaggattttagcagcatcgggccacatcattgtgagcacaaattgccaaagcaaaaagcacctaagtccctagggatcacaacgggccacgctgattataatattgggctgaagtactgtacagacccaggcccattagtactcccgataccctaacaaagcaccgaagtccaagcatcgcttcgtcttccccaccgagactctcgccatttccccactccttgctacagtagcaaaccgcaccgtcgaaactagggttcatcaatccgtcccaatccattctcaaaaaatcccacgaaacttctccgcgtgtccaccgcaccaattcctcattcccctccagctatatcttggaccaaatctaaccatgcaactcgcatccatggcggaggagagagaaagtttcgagagtcagtgggctccctccgatgtaacggaagagaatctgaaagaaatggtggtgcacggcgttcttccgacgaaggaaatcatcgggtggcgaccagcgttcggcaaagcattcccgacccccgacacacacgagattgtggtattctctcacttcttctatggcggattttctcttccaacctcaagattcttccggggaattctgaacttctatggaattagcttgcatcatctgaatccaaactccatagtgcatatcgccaattttgttcatgcttgcgaagcttttctgggcattaggcctcatttcgccttgtttcgccgcatcttcttcctcaaaccctagccaaacaagagcaaactgtgcgttgttgggggtgctggtttccaactcaggggaacactaagccaaaaatatttctccatgcccttcaagacctcaaacaaaggctggcacgccaactggttctatgttcaaaatcctaaaccagcccttcccgagtactcttgtctccctccagtctaccaagatacatggaattcattgcctacaggagatgaggcagcccaggctgtagaactaatggagcgcatgataaagctgaaagagcaaggtttgcagggagaacagatcacttggcacttcataaaaagccgattagctccaatcaaagagaggtcccgcacagcttttgagtttgacggcaaacatgatccaaatcgtgaagatccagactctcttaactttaagattatgaaggaaaggatgtacaagatcttctcgaatgctatcgtcgtcagctattcgcacttgctgctagtcatgccattcaatgctttcaatcctcctccaccgat

SEQ ID NO: 67845 - DNA, 1086 bp, Oryza sativa
acaaatcatataacgatctctcttgcattgatgtgcacccagtgcagaaataatactgacaaccaaacttgcaggaaaccatctgatatagatccttctggaaaagactctgacccgactagcagggaaacaaacttaaaaggaatcgagccaactgacgaggatcagccgagtcacagccagccagcaaccgataatgtaggatctggtgatcaacccccgactgagaatgagtcggccgaagctggagccggagttaatcaggagcccccgactaaaaaccagtcggacactaggccaagccaagagattccagaagttggagctcgggcagacagccctcgtagacaagacgccagcaacgacccgatgccagggtctcccattaaggtgcaagagtcgactcgttcccgtccggaaatcatcacaggtaaacaccttgcctgaaatcgtgttgatccaaataactctgatcaattgtctaacctttgtcagtggatacattaggaccaatgattggtgatgaagaagaaattccccgtatacaagcagctgaagactcgcacccttctatcttagtcaagtggtgggacgatgacaggcaacctcaaggaatcataataaacaaacaaaaagaagatgaggaagtatgcttgctgaaaaaggcactcagccaggccactcgcattgtgaatgtaagtccatttacgcatagctttaattgttccccttcatattttgctgaaaacgccggtaaattcttattgcagagaatccatctcaggaatgaggcaaagaccacgacacttgagaaattagttccccatcttggaactcttgaagccaccaaaagccagttacatgaggtcagagagctcgcgaggaaaactgagcatgatctgaggaatagaatctctgagcttcaaaaatctaactatgaattgagtggttcatccaaaggtaaataccatatccgtctgacatattcgtgaaaccttccttgtcatatcgattaaccgaagagcatttcagtgcaagccgccaggatttccgacctagagaggcaggtcgaagctctggagaagg

SEQ ID NO: 67846 - DNA, 35072 bp, Oryza sativa
  unsure (1)..(35072): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtaggcggaggagtgatcttggatatgattatggatactcccaaatggatgaatttctatttcagccttcaattgttatctagcatttgaatctctgaagtaattatttcctgttctaactgcaggtattggctgtacgctgctgttatataccggtcattgcttgttacaaatgatgagatgcgggaccacttgtttcaactacttggcactagtttttttccaagatggaaggagaaccatcaggtttgtctctcattgcagaagtgaaccacacaaatctgtgttcttttgtagaatgctgcacagtacaacccattgagtaagagatatttcaagttcttttgcacggcagcgtatcctgtgcacccgctcaccttggtgcactcatgcactcacgcgacatgggaccttcgatctccatcggacggatataagatgagagagtcttctttttacaaaataacccttcgattcatcttcttgtctcccgttcaaccactttccccaaatctatcccctctgtgaggcgtccatggcagctttgaatctcgaaaaataaaacaatgctcgacggagatggccgctagaaattaagattaatcaagattccagcatgcagccgtcaaatccttgctcaacgatatgtatgatctcaacctcaggatctttgggttgattgcatgatatatatggcatgccaaaatttcgaatcaaacaagaaattccgatcggatatgcctttgatgcacacatctgcaacccccgggcaaagactcatccattccatcccatgggcaagaactcttctctctacagagtcaggtacactgcgccgcagctgctccatcggccgaacaccatggccgtcgccctggacacgctcgcccgcgcatcgtccctctccaacaagctggacaaccacacgcaccttgaggcgtgacatgccactggccgcgccgccgcgctctggatgtgctatctctgtcgccaaacatggcttaatttgagccgccattgacgtcggatagagattttgaggaatacatcttggaaaggacccaacacaggaagacaaaaggaatcaagggtctatttacaaatttacctgtgtatgtgcgggtggttttatgaaaaaacgtccctttgcattacatccgtccgatggagattgaaggttccatgtcgcgtgagtgcacgaatgcaccaaggtgagcgggtgcacaggatacgttgcccttttgcactccattttaacgaggtgttgccttggtgaagcttgcttgaggccctaagttctgagtagctcttacatattttttttctggagcgtaaaaataatattttgagtgaattttgctcttttttatgtaaaaaaaatggacacaataatcctgggaaactatgtgcaggtcaggttaacattctcgggccgtggttggaattttcacctgccgcctccttattcaattgtcattcaggtgattactctaaactgtagtaaagttgtggagtgccaggaatgcatgaactatacagaatggcctgaggaacgtggtttgatgcaggaatctgaagatggaagctggcatgtaccaacaacaaatggtgatgatattgagaaaccacggcagtggatttgtgctactaggaaaatttcagggaaatcgtctcaagcacttgcaagggcagttgggtaagtgcgatgggttgcatctccattgacgggattggtgcatgggaatggcagccaaatttcgggccaggtatctgcgctgctcctttgttgaattggaggcggcttgaagagaatcacaccattatgtaaggcggccggcagatgttgatggaattgagggctagctgctgagctgacccaaacgatggctgtcaagttgtaggaagcaaagtaaaagatttctgtagcacatgaaaaagtttgccactctcttaaaatgtggatgtcatggttgttttagctggccattggttgtacatgtacatgtattttcctcaaggttaaaatctgaaacagcgaggactagtcaaacaagaggtcgtgtaactgaaattattattactagtaggagtaaagttgaaattgatggagagaatataatactctagtgtacatatggttggtccgtccgttatccttgtgggtggagagtagcgaatgggagcaggccgcgtggaggcatggagcccccaggcaaggcgcgtcgcccttccagccacaacatccactgtctctctctctctctctctctcgctgctcttcatccgattcaactcggaccaccagatttcttccttccttccttgcagaatctttcattgttcttgttgggaggaaggagacgaggcgcgcgaggcggcgagagggaggaggcattctagcatatacagatacagagccaggggaggtatggaggagggccttgcacgagcacgacgatgccaatagaagctgtggcggtcgcttctttaccgatggcgtcgcgcagcgccgccctgtgcttctcctccgccgccgctgcccggagccggagcaggagccggcacggcaggatggccgtcagctgcgacgccggggcctcagatctgctctattcctctctggtactacgttgtactccatccgtttcaaaatgtttgacacatttaactttttagcacgtgtttgaccattcgttttatttaaaaaaaattaattaattatttattcttttcatatcatttgattcattgttaagtacacgtatagttttacatatttcacaattttttttaataagacgaacggtgttaaaaagtcaacggtgtcaaacattttaaaacggatggagtcctagtatattatctctgtctcaataattaggatactaattaattcatgtgtcgctgataaccttctgaatgaatgttattgttatgaggcaaggctgccaagctgcttggccctcccaccagcttcgatgccggcaagctgacggtagagttcgcccacagccacgggaacagcagctccgggttccccagagcttacaccctcacccactgcgacttcaccgctaacctcaccctcgccgtctccgacaccatcgccgccgaccgccgcctcagggcggacgacgtcttcgccgagtggaagcagcagcaacagcaggagggcatggccctgcacgtgcactgcttcgtcagcggcgccaacctcctgcatggcctcgccgccggcttcaggtactacgtcttctccaaggagctgccgctggtaagcaattatatatcgatattttgtactactattacagtagtagtagtagtagtagcaattaggaaggtgaaatcaactatgataagctgaatgcaggttctcaaggcagttgttcatggcgacgcattgctgttcgcggagcagccggagctgctggaggcgaaggtgtgggtgcacttccactccagctccaacgctaagtacaacaggctcgagtgctggggtcctctcagggaggctgcaaacgccgaggcatgccttccttctctcttcccgaattgcaaattgcaaatgcaaatacctgctagctgaactcaatgcaaattccaaatgctttgcgtttgcagacgacgcacaagaggcatgcgctggagcaactgcacaacgcaatcaccaaaggcacaagaaggcgtaggaggaagtggtctagcccggacgccatcttcagcgccctgctcgcccttctcctttgatgcatatcgggaaccccacacattgtcttttttttgctctgccttgtgcgcatcaattccaattctttcatccaccggacacttgacatgtatgtatagtatgtacccactccacgatcaacaaaatgagaaacgattgcctttccaagcattcctccttaaattaactctgcttctgcttgctcactcaaatcatgtttggataacatatgccacatcatgtataaatagttcctctacgttcttcattcagaactggggacaacatatagctccaagtgccatgtgctctacatactacatactactacctcctctgattgaataactaaaggggattcatacatactgaggtagtaactacctttgatcgattccaaggtagtaactaaaagggattcattcatactactagctcaagtgccatacgctctacatactactagctcctctgattgaataactggaagggattcatacatacaaaggtactcgtaactacctttgttacgctacgctacaagggtagaagacagaagcggcaggctcaatctatccatgtcgcatctctgcctcatcctctccaccatttcaccaaacttggctatcaactcaccctcatcagccagctccatcctcttgatcctttccagcatttcatcaaactttgccatgtgttcctcatgcagatcgtcgatctgcatccttatcttctccagatggcttctctcccacctgttttcatggagcattccaatgagctcggctgcatactcctcctccaaagcaacaatccgtcccattgtatctcccaaaccatccatcttcttgctcatctccttcacttgatcgatcaagctctttttctcgacatctctacaaatgtgctcccaaggagcatagcagcgcctcaccataatgtctctcaccttcctgcgcataaataacatgttcaaaaacatgccagaacccagaaggaagtccagggacagtcgtacctcgtgaaagcaaaacgaaaaaaaattgtagggcataaaacaatgcaggaagaagaaactatacaatcgattctacacacagcaagctataacaggatctctgaaaaacaaaactataagtgggatcactgaaaaatgagtaagaaatgacagacctgtttattgcaccgtcgtcacccaaagttgcagtggtctcagttttacagaacaggacgccatgacggttcacgccagctataccttgttgttccaagaactggatgtgcttcttcaaggactcatccctgagatatatgtgcaaagcatggaatataaaaaagttgtacccatacacaaacagacaattatcaaaagttacttaaatttatttttaaactagcacttcggtttggaggaaggccagggcaacaaaacgagggttctgacatcggtatccccagaataaatccattgaaaaatctatacactttgccactttggtgtgcagtttttgactgatcgataccagagtatgaatatgtttcttctgaaacttgaaccttttggcattcaacctatcaaatgatggaaactatgttcacgtgtatcccaaaaaaattacaaattggcaggtgtgaaaaaaaataatactaagaaatacctccagctcttgaggaccataaagaaactgtaatttagtacggatgagaaactaccagtaataaaagactgagtacaatttcgatggtattgaatataacaaagaaccggagcagacttcttacatgacaagctgctgaccattctccacttgcattttgtgttgggtgagagaggcgtcaaacccatgtggcggcaaactagagtactcttgttcattctgaaggtaaagctgtatggaaaggaaagaaccaatgaaccataacttccaatacgatattgtgatatagtgtagagtacgtcacagtctgaattgcagttgtgattgacaagaaaaggtatggcatacatcctggttataaaattgcggttgttctttgcattctgtagctgtcctaaaaagacctcccttgaagatctgaaacagcaaaaaaagggaaattgcacctgtaaattaacatggaaattgcacctgtaaattaacatttgttatccatacaataacttgctgcattcttgtaccgatcaacatacaaaagaaaaaggtcaggttttccaagagatggaagatgaagatgattgagctcagactgttctagttgtttctgtttcatataagcccttatataagtatgatttacatttaacagtttaaatacctgttgcttgtaaatcttctcctcaatggtcccacaagttaccaaacgatatacaatcacatctttagtctgcccaattcgataagcacggtcgacactttggttatctatgctataaagtaaaaaacatatatgattaattgaagaaagttgatgtaaagcattcacaatttagaattgctgggtaccttggattccaagcaggatcaactactataacccgatctgccttggtgagtgtattgccaagtccaccaacatgtgaggtcaacaacaatattggactgtcaagcccctcttgaaagtcctagagggtgcaatgcaatgttatggaatccatggcttaacataacagacagaaaaatgtgaaaaaaataaggaggtaccttcagaatcttcttcctctcagatatcttggtggtaccatcaatacgcaggaacttatggccctcgatagatacagcatcctgctttgttggaatgattatgacaactatccgaagattaaacagacatttcaacaatgcaatgcttgctattaaactttatatagattagtaaacaactaaaggcattttaattctatactgaaagcatatatgatacaagacacaggtaatcatggacacacgtatggcatgattactgacagcaattaactaccgatatgattcttccagtaacaaagcatagttttcaaatgggaaacttttacaaattgaatcaaataaagtgttagcaatatcacaagcacatcacatgcatgataaagcaaataaaggttaatataagaataggctatacctgaataaggttaagcattacacgtgtctgtgaaaatatcaaaacatagtggccctcttcaacaaggttcctctgcaacataaaaaaatgtagcatgatttttcataggaagtggcacattaatccctttatatcagaaacatattgtatttttcttctgcagaacatccaacgtagccttttgacttgctaacttttaccaaaatacaggaataatctatacaagtgttacgttatgatatatccaaataaagtacacatctatataatttttcttttagccagtctagatataagtaaatattgcagggagaagaatttaataagtttaattgctccatatactaagcacattttgtccatggactggagggactataaaatggacatttcataaaagaagcactgaccagtaagggaaggataaaagctatcttgcaggaggcgccttggacaatctgtagtcttttgtcagcataaaggttatcttcaagaatcctttccaccatgcacatatctcggttattcagcatggcacccatttcttccaggaaatcatcagtatctcttttagtcaaaagtagagggtgatcgcatattttcctcaaaatctgtttgtgttgaattaaaacaagtgagcacacacatgcatgcacgatgcaccattacatattttcttcaaaaatctaccaacagtaaatggaacatggcatactagaaatttcaattcactccaaggagtgacatcttaatgtcaacggaagcagacggtaggtaaaatgatgaaagtaaaaacagtcagtacataaataccgtgctagcttccaaggatgaacccttcaatgctccagtttgtgaacgaactggatctttattcaggaaggcttcatacaatcgcctctgcacccgaaacaaaatcatcaataatctataaagcatagacacataacccttttatactcccaacaccttcattatacaaaacctagagcaatcgtatactggtggaataccagagtcaaatgcccaaggagttctataaatggaatagaggtttgcagcagaacagcaaggcacttgcctggcaagatgtcaattttaaccagataaccaattcattcttctgaggtggccttttgtcatctttcgcgccagtatctacaaatatttcacttttcatacgacggagaaagtgtggtttaatccgctctcttaattcctgtgattaatagcgttcagaacagaccaaaacaaatgatgcaacaagattagtacatcaggcacaaacttattatgtcgaaagagaacatacttttgctgcatttgaagccatttgcttctcttgatcagtagcattcttgtcatttccacaaagaattggcttctcgtacctaagttcgaacctgcagtaaccaagagaatctcacaacacttgactttacaaaataaatattcataagtatagattgattttgcataagtattgtataagaaacaagggggagttaagtgatttacgcatcctcatcaccaggacatctgggcaacagaaataaaacaaagcccacatttcctgccagaatagtgatgctcagtggaagtaaaagaagataaatagaaaggttagaggaaaagtcatttgagatgagggtacctttaatttattttgaataggtgttccagtgagtacaatgcgatgagcagaaggtatttgaaacaagctctgtgccctttgcgtctttgtattcttgacaatgtggccctcgtcaagaataacatagtcccacagtggttcttcttcgttgttgtcaacattgttaccgttgccattgcctcttagtaacatgtaattattccggacgatgtggtaggatgttagtagaatgccaccctcctggtgaaagattcaacttgcaagtagtgtacaagtatggaatgggttgatggaaagatgaattgaggatgaagtgtaaagttaagatgagaccttgaaggtgcagttaagttgatagcagcgatcgtttaggctagggccagagtagctggcggaatgcagattaattagagaagaagtaaagcagtgattgatgtgtggatgtaagtaaagatgtggcttcttacagtctgatgtggtgttgaaggccgaggagtgagaggtgatttacccagtgagtcaagtcagtcttaggggcgacaattaaggctctcttgatcaaattggaatggaataagccggccagcaaagcagaaacctggatttggacccggccttgcccttgtgagaccatacattgattgatgtactccagtggattagggatgggaggaggtggaggagaggagaaaagaagagaagagtacctggatggtcttgccgagtcccatgtcatcggcgaggatccctccggtggcggtgcagtgcagcgcccagagccaggcgaggccgtcgcgctggtgcgggtagagcgaccccaatacgcggcgggggatcttcatcttcatcttgatggcgccgacgccggcttccaccaccatgttgactagctcctcatcctcatctacctccacctccacctcctgttgaggttgaggttgggaagtcggggccattggaacgaatcggccgttggcggcggcggcggcgagggctccgcggccggtggtgaaagtggaaggaactttaaagacaacaagggtactactagttgagtttaaacggaacggagttgagtttaattcagatcccttcctgccttcaccccgcgcccgcccgcccgcctcttcttccttcgctttcaaactttcccaatcctttaaagttcgggcctgttcactttaacaaatatactaaaattttagcagcaaactaaatgtagctaattttttaacaactttactaaaatttggtaaagttttaaatagcattaaagtgaacaggcccttccttccaactaccattggattttaggaggggttgtttggttgaagtttgaactactgttgcttttcattcctcaactattatactataataacaaatcaaattatcatcattttcttaaaaccacgcatacagtagttttcatttaccggctacgatattataggtgtttttaagaattatcatgcctttgtaaatataaggggcaaaaaccaaaccaaagcaacaatacaaggataaaacccctctctttctttccccccttttgccaatgaccaaaagcaggctgacttcagctaataccagcgtaatttactggtactactagcactgtttaatttacaaagccagagccttcacaaccaaaacaataggacactccaaaccatataatagtatgtactatgactactgtttttttttttgcaaaaacttcctatagaaaagttactttaaaaaatcatattaatccattttttgagttcaaattagttaatactccaattaattatatactacttccgcccctaaatataagggattttgatatgatgcaacacatctttatacaatgaatttggacagcactagaatatatcacatctcaccaaaatcctttatatttaaggacggagggagtaataactaacatccttttggtcaatattctctttttctcctctcagacacaagcctaagaggcacccgagatcagcatgtgttccgttccgtggtcgtcacaattagtacaagtagcatgcaaaatgtcacgccttagtgactactagcatgcaagcatggaatttaagcaaaagaaacagacatgccctacactagacagacagatcatccaagcagattacttccgttggacccttcctctccaatggctccggagaagactcgatcacggtcagcttttcgtccagctcatttatctgcctccttatcttgtctccacgatctggtagcttcgccacaagcacctacaacagcggcaaatggtgtaagacagacagacaacacaccacaagatgcatgcaacaggttcgggtgtctttcttgctcccaccgtgtttgcaagggtttgcgaaagccggttgattttggccttgatttcctcaggactttctgtgcttgtgctgttcggggagtatgttcgagcaatgaactcttttggcttcatcgcataggcagcactacacaaaacaagcagcacggtacacaacttaattatgcagcccaaaagccattgattaagtcccatgaactcctcttacccattggcaacatagtcagatgaggctcccttgtagtagtgcttggccattggcatagctcgacgactgctgcacacagaaacagcatacatcacctgttagacaccaaaggtaacagcaacaaatggatacgtgttgcaacgtgccagatcaatatttctctgaaagcaaaacaaacatatgctgcactttgaagacagtaaaattaacctgtccaaaccatcattatcattcagtgtaggtaagattgctgtcttagaaaacagaaggctgtgatggctcacgcccgctatgccttgttgctccaggaattgtatatgcttcctcaaggagtcgtccctggtacatgccgcagatcaacaaacttatcatcagtgaacatggaaatcattaccaacaagccagcaagtattgctcagggattgagcagctcttactccagcaaatgcatttgagaaatactacttcctccgtttcacaatgcaagtcattctagcatttcctatatgaatgtgggaaatgctagaatgacttatattgtgaaacggagggagtactacttttttatgcagcagttcatcatcatatgctttctacatatggcagtaaccatgaaatattgcagagcaacctaaacattttgccgcacattttctgctgatatcacaaccatttccccttgtttttttgtgaaaatgtagtagcataagcagcagtcacctcatggaaaacataatagtggtgctagaattaaccgactaaaagtagatgtcctacatcacaagttgttgtccatgctcttcttgcaattgcttttgtgtcagcgaaacatcaaaaccttgctcaggcagactgaaaagctcttgaatatcctgaatgtacacacaaaatagccatattataaattatccaatatgacagagaaaacaataacaagaaccgtatcacactaagtaccctcttgctgaaataacgagtttgttctttgtgctctgtagctgtcctaaacagagcccccttgaagacctggaaaaggggcatgtattatctcattagttagaatctagcttttattttactgaagtaaatatgcaatatgcaaataaaggaataggggtataacactgacggagacattgcaggaaaaacatgtaatggcacaacccagtaaaaagtgtcaccagtcccaccttttcttttcttacatgaacccagccccacattaaactctcaaatttcaaattaggaagagaagttaacttcaatgaaaaaccgtactttatttcaccccctagaaagtacaagttaatagtttggtgctacatagagaatctcaaggaggcatacaactaaatatgaccatggactcatcttttcaatattttttttttgagatatcatattttgaatcagttgcttcagtgaataacaagcgcgataaaaggcataaacagcaagtaaattcttgaccatatttaaacctgcaatttgtatatcttttcttcgatggttccagatgtcataaggcggtatacgatgacatctttcatctgcccaattcgataagcacgatcaacactttgattgtccgtactgaagatgggaaacaggagcattagtaaacatacagagacaaacattcagtaaaataaaaaggcaataaactcagtaaggaaacggcgttgttcaggtaccttggattccaagcaggatcaactactatgacacgagctgccttggtgagtgtaagtccaagcccaccaacttgtgtggtcagcaaaaatattggagctccaggaccctcttggaagtcctgatcacaaatgcattccatgtaagcaatatagcagtaacaattttgcccatggcataaaagaaggaaagggaaagacagagaagaaccttcacaatcctttccctctcagaaatcttggtggtaccatcaatgcgcaaaaacttatagccttctaatattatagcctcctgttgcagtaataagctacattagctactaggttgaagtagtaacccagaatgcatatcttactactccttactactttttaaaagcaggaatttgggggggagggcaggtaacggtaggttttacacccatctctacaccagaacttttgtggctgtaaatatataggcacgtgtgcattatttgtaagatttttacataaaaatattatatatttgcatgagtatatgtaggtggtaattggtctcatataatcgtgtttataagttctaaatttgagtacaatcaatgttaattattagatttacattatatttagttaggatcctttccacgcacgggcatgatgatagtaatcgtaaacattacaagaatgataaaaatggtcaaaggagtaggaaatgaacattgaaaaacacactatggtcagataggctacatcagggattcaggggtgtactaattaaaagcctgctcgaggtcaagttcattctgttaggtaatttgttttcaacttctcacaaatgagtgtacggcaaccactaaaggaaaagaactccagtctgatacaatgttttttctatcattcaacgagcaaatatgttctggaatagttttagggagaagtgtagagcaaacaaaaaaatattcaatttaaaaaaaaacacacattgatgataattgaaaataagattgctagattctgaatttcaagatgtaaaaatcttaacagaagttaacaaaaaaaaagtcccatagaaatcatattttcatgaaactatatgtaatcactcaattcaaaaaatatatcactactagtactgcatgaggataaaccaaaaaagttgattctactttctaccgaggcactgaggggactgtcaatagtatatgtgattggatgactatacattgacaggaagaaatcaggccttatcaagggctcagaacaattactttgctaggataacaaataacaatataccaaaatcacaagaaaatcacagaactgtatgactataaagcaaacaaagattaacataacaagaatagactttatcacctgaataatgtttagcattttacgagtttgcgagaagattaagacgttgtgtccctcgctaacaagattttgctgcaacattaagatttaccatttgttagataaacaaatacataggtgacaactaaaatgtggatcatcaaagaacacttacgagcaaggacatcataaaagataacttgcacgagacatcctgaccaacttgcaattcaacgtcatcatcatcatgagccatatctgcaaggttcatggccattttctcaaccattcccatttcttgattatttaacatcgcatccatgccttccaaaacaccctcagcagctttcttagtcaacaacagcggatgatcacatattttcttcaatatctgtttaagaatacaagaaacagaaacaaacataagtgcaccaatgagtgtacataaatcctttttctgataaattgaggatatcaaacaacatgacaatgtgcatcacaagaacaacaagagaaagcaatgcactctcgcatgaaatatgacatatgataaggaaatggaaagaacataaaggtctaaacaatgctgacaacatataaaagcaaacaaaatcagcacagataaaaactttgaaggtgatgcttaccgtgattgcggccaagggtgacccttgcattgatgaatgaactagttcactgttaagaaaagcttcatataattgcctctgcatccaaaaaataaaaaaggactaatattaagatggcagttaaccaataacaaaaccagagttttgcatcagtggaaaatgatctgtacctggcaagatgttaatttcagccagataattagctcattcttcttagcaagctttttatcttctcccgtgccgctatcaagaaacacttcattcttcatgcgtcgcaaaaagtatggctttatccgttctcttaattcctgtaataaatgatcatgtacaaaaccaaaaaccacatattatataaaaagtagaacagcagacctgaagaaataatctggaagaatgggtggcagttaaagaaatgcaacaaaggaggaggctcaatgtaaatagctttccctctcatggaaccaactaaaagcccatttttattagttggtatggaaacataattccattgctttacaagtcaaattggagtacacgactgtactactttgatgatacatgattgcagtacctataataagaagtatgtctgtgtccaaattgctgtcttctcaatgaaataataataacaaaaaataataattccgcaaaaattggaatagagtaaacaccataatcattaatagtcaaaatgctaatgtggtggaaaatctggctctcctaataattaaatatccagttcagacacaaaagtaacatgaaacaggatcatctatcacaacatgaaaaaggattagtacctttgctacatttgagcctatgtgcttttgtcgattggtagcattcttgtcatttccttgaatgatagcgtgctcataccttgctttgaacctgccaaaaacaagagaaataaacaacactagattgtgtaatatgaagcaacaatggcaatgcagaaaaacaacgggcataagtgtattactgctccttatcacccaagacttctgggcaacagaaataaaacagagcccacatttcctgcaagaataatcaggattacttgcattggttcgtgcgccaattataaggcattaaaaattaagagagtaggataccttcaagttattttgtatgggtgttccactgatgacaatacgatgtgcacagggtatttcaaatagactttgagccctctgagtctttggattcttgataatatgcccctcatcaagaataacatagttccataatgtttcttcctcgtcatcaaaatcattggtgaagttgccttttatcatcttgaaattgtttcgaacaatgtcatatgttgttaaaaggattccaccctcctgtagaaagacaataatatgctaaaacagctggtatttattgtgatatcatggaagaaccgaatattcttctaaatgatgctacgaacaaatacaactcaaattttaacttttaggacttccaagtattacaaaacccaaacttgcaacaagccaggtcaagaatgtggctagtcaaagacacttatgttaggagaccagaccttgaaggcatatttaagctcatagttgcgagcatttgcattgggaccagagtagctgtcagaaaagaaaaagggaacaattagcacgagataacatgacctctatcaatttgagggaagatatatgtcaacacaaaatatcctactctctgatcttatctttgaggctcacaactgaaagttccttggtccaatgagtcagaagcgtctttggagctacaactaacactctcttgattaaacgggaatggaacaatccagccaggaatgcagaaacctgcatgataaaaaaaggatgagaatacacatcagtcgattgcacatttagagcgagacagaactcggctcttcatatgcataatactccatggacactaccatgtaattcgtgcaatgaaggtaataataaaactgacagtagttagacaactggtagtgacaaaacagttctgttcttctatcggacggagactgctttcgatttcatcataaatgcatgatgtggacagcacaaaagattcagatgattaaaagtcctgccctgatcctaccataaaaaacacacaaactacgcagaggcctcccctgatcgtatcattaatttggaaaaggaagagcagtaatccttaatcctaatacatggaaggtgatcactaactagtatcagtggcaccacaagtattctgtaagcattaaaagtagacgaaattagaaggatgagagggtcccagtcccacctgcatggtcttgccaaggcccatgtcatctccaaggatccctccagttcccctacaatgcagaacccaaagccacctgagaccctcacgctggtgggggtaaagcatgttgaatatccttcctgggagattgtagggcttgcgcgttacacctgtcccagtgggctccatcttgaagtcctctgtcttctcccaaccaacatcatcagcatggttttccttcccattctctgcatcttggtcgatgtcgtcttcatcgtcatagtccccaaaaaattttgaggccttggattcggttgtggttttccttgacaccgtatcaaaggcataagctcctttggctttcatcttatcatcgttgccgcggcccccaaaagaagaagaggccttgaacaccttcctggtgacctcctctttaacaccaaaaccaccgtaggcacctcccgcatcatcgtcgtcgtcatcacagtccacaaaggatgaagagggtttggtcccatcattaagctgagactgagaggggtcggggtcggcatggagggcgcagggaagtggggacacgtggggtctgggccttgcggtgggcctgtcgactgacagggagtcgaggcgggtggtgagatcgtccagtatgtcgcggatgctgtcgtcgtctccggcggactcatcgccggcggtagagagcttgcagaggcggcggcggccggccagcttgaccttggcgggttcgggctctgcgaggaattgaagtggatggagttactagaaaacggaaccgagagagagagagagaagggtaccttgaggaggcggcggcggagggggtttagggttagggttagggttagggtttgggttttgggaggggccccgttggtgcgtgcgggtgaggcggaggaggcgatcgttgaggccgttgggtgtcggagcggcgagcggcgtcggcgcaggaggggtggggtcgtcgtccaggtcgccgcagatgtcgaagggcggaggggacgccatcgatctgcttccttccgagttctgacgacgacgacgacgacgacgatggaggaatggattggagatttctctcttatcttctctcgcttgggttgggttgggtgttgggttggttcgggggaagaggggactgaggaagaagaacttctccgcggcctatgtaccagaaaggaggcggcgccgcggggtggttcaaatttcgaatttcatccgaaattcactcctcgccttctatgcttcttcaacacacagcaacggatacattctagcatcgttcgttcaggccttcagggaagataggggagtctgaaactcgttttctccgcacacgcttttcaaactattaaattgtgtgtttttttcaaaaaaataagaaagttgctttaaaaaatcatattaatccatttttaaaatttaaaatatttaatactcaattaatcatgcgctaatagctcacctcatttttttttattttctcaatcttctcttttcatctcctctcaaacactttatagcaggtacaataacaagttataagccagctataaacatattttaaagagataaaagatgaaagataaaagcatatttatagccagctaaagtacggactctacgatataatgtgtgtatgacatataggatcatgtattaataatgacataatggagtagtaagttactattatatgaattgggtattaaattgactatagattatttggagctaatagttggctatactattaaacttgctcttaagctgacaatgctgtgttcgatacagttcccaacttcccctctagtattccacgcacaagcttttcaaactaaaagtttatatacgaaagttgcttaaaaagatcatatcgatcctttttttaaaaaatagctaatacttaattaatcacgtgcttaaaaatcatattatccattttttttaaaaaaaatagctaatacttagttaatcatattatctatttttttaaaaaaaaatagctaatacttagctaatactccgtttttcgtgggcactgttcgtgttgggaactggctggtatcgaacacagccttattgacggccactccgttccgttccatcaaaatttcacaatcatgaagatgaagtaagattaagtgtttcacgcaaaacgagtaataatgtgtgatgaattgaattttaattattataaacttgaaaaatggattaatctgatattttagagcaactttcatatagaaagctttcgcacgaaacgtaccatttagcagtttgaatacgttgccatgttggagaaactaaagcaacctcagttcgatagggactgtatgtattgtttaaagcctgtttgtaaaacacataaatttataggagttatataaattgttcgtttcattccatttgaatttattaaaaaagaaccagtctttaacgggtttttccaaatcttgtccggataattgaattgatggtttaacttttgaaccttcctgattattttaaatttcctttattttacttttttccctttattcgtcgtttgaaacctagtcttctaatactaatttacaatgatctttcggtggtagatgatgtatttgttaaaacatagtagacgacgtatctgttaaaacatagtaactttactaatctcacgatatgatgacataaattttcggagttgcttataagtatactagttataaagcgtactcacgaagagtaaggaagtagccctccagaattgagcctaagggcctatttattttcagcgacttggatgagattttccacgatataaaacatctaattttccacgatactggttataaagcatttttaactaatatttttagcaactttaatgttacaataatgaaagtctatatatgtggagtcccatctatatggactgcttttgctatatacattgttgctgcccatggagtagttaggtaaagtctttagtgggtactgtacatcactgctcgtctgcccagggtttaccaaaccgtttggggtggggttacagccccttccgatttgatggttagggtatcctcaatgttgagccacacaacaaccattagatgggacccacgtacatatatctttttactttacaaccaatgctacaatgtttaagatcttctattgaccttaagctgggacccactaaaaataatctatataaattcttttactaattcttttactatgaagaattaatagacaaagtaattttatatttcttatggctaactttaagctttaagattagtcatatcaatatcctcttacaaacacacatctctatgcataaagttgtattaagaatattattttattgcgaagtgagcatagctcaactagttaggttccttatggtggaactagcccactcgggttcaaatcctagatttgacacgggtgctcgcggcgcctatggtgacttcatcaatctcaagatatgccggcccagtcgggtagggtgtgcgtgtgtgcgttcataggggtgtgtgtgggtgtgcgtgtgtgcgttcataggggtgtgtgtgcgcacgttgtgagcgcctgtgtttgtactatatttctcaaaaaaaattattttattgcttatggtcacatttacatgcacattagagatgcccttattatggtaaccgtgtggtcatcacgaaaactggacgattattgcgagatattgaaaagttatcgcgagataaatataataaccttgtgataaccatgcggtttggtaaactctgcgagtgcccccgcgaggaagaaaaccacgggaaagagatgcgccgttggattatcaatcgcttcacgagttcactgcgcacactctccaagttgcaagtagtgtgtgttgacttcgacacaatctatcgatgtcgatgccgatgccaatactcctcctcctcctgctcctcccccagggccagggccacggcggcgccggcgacatctgcatcgtgggcagcggcatctccggatcatccaccgccttcttcttcaccaactacaccaccgccctctccggtgcccagctccgcgtcttcgagcgccgcgctaaggtcggcggccgcctcgccaccgtcaccgtctccggcgatcacttcgaggctggcggctccatcatccacccacgaaatctccatgtgcgccgcttcgccgacctgctaggcctcgaagccaagaccgatggcgacgatgactggctcgggatttgggacggccaccgcttcgtcttccagacgctccgcccgctaccgcccgggacgtcctggctccgccgcaagctgcacacccttgttaactcgctgcgcctctttaagcgctatggtctctcgctgctcaagatggacagatttgtccaggttcctcctccataatcttctactaccagtattcttttctcactactactagtagtttttttttttgagtaaatttcactttggtcaacctttatttaccaaattttcacattggactagagttagacttatattttcacttaacaccatatatatagttaccatcattttcactttggactgggtttcacaaattacacataatacaatgattgtagatctgatctcgtttccttctttttgtgttagaaaacttagaattcaacaatttgtactagcactacagttgggtattgtaaaacatgtaatatcttttctagaaaaatagttcttaaacttaatatttctccaatactgtctttagtacaagggttgtgaatgttcatatgtagtagttacaatcattgttcttgcactaagcatagttgcatggcgaatttccatatcatcgtttcttgtaaaatgcttagcacctagacaacaactggtgtgatggtaactataatacccggtccaaagtgcaagtaacggtaattatacgtggcgttaagtgaaaatatgagcctagccctagcccaatatgaaactttggtcaataaagatggtccaaagtgaaatttactctttttgaacttttttttatttatttatctgcttcgctattattaatataatactcctagataataacttgccatgatctctttatttgctttgccatctaaactaggtgatatccccgaacgatgctttgtgtacttgtgtgaagcaaaataaacattctaagcattatgccttaatgtagaattgtatagtaagaggatatactgtgtatgttggtcgattgattgagccccgagggtcggtctataaacagagatacacatggttagagacaacaatgggattagcgacaaggaaggtgtccgtataaatcaaacacatatcctaatatatctctaactaccatgtactcttaacacttactaggtaagagtgaacagggaaccacgcagattaaataattgaaatgctcaacttttcttgatgatgtgtcctgtcgctcctctgaaggagcaattgcagttagtgggtgataatcatatacaagtatgcgattagctagttttgcttcctttgtcattttcttgactgagttgaatattctattggctttactgattagtgattaacaacaaacacgctgaaatgtgttattgctgtatatgcatgcaggaaatgttgcaaagatttatgctctactacaatggctttgaatcccgacctgtttttgacacggttgaggagatgctcaaatggtcgggcctctatggcctcactcgcaggacactagaggcagagctgcttgatgctggcctcaattctcaaactatttcagagcttgtcactgtatgatatgattgctctctatgttttctcctatcttgtttcaattgataacccactaatttctgcagacttggttttttcttagcttcccaagaattagtacatttactggtggtcttaacactttttttttcctgtatacatatttcggtctaaagataaaatctcttcaaaattttgtaatctagtatctccaatatgccttgaccagtgcctttccacctttacgtttctcatgaccaattataaattaaccaagcagtggaactcatatcagtagtcattacctgaatatcagtcaagcatatagtcagtgtatagcgcactcatcaggtcaaattttcttgtttactttttcaactgagaaattattttttttctcgtttaattaattttcccagaaacctttatgttaattgtgctatcctgccccatatctttggcaggtgataacaagaatcaactatgggcaaagtgtgagtataagtggccttgctggtgcggtttctttagctggttctgaatcaggactgtgggctgtcaaagggggcaactggcagctagctgctggattgctcgaggctgctaacgccaccttgcatctgcaagaaggcatagactcaattgaatatgcaggggatcactatattctgaaatcgaataaaggtcttgaatataattgtgtagcaacggtggttgcaacaccacttgacgaggtgaacattacattcagccccccaatctccattccagcgaggaagacgcagcatacccatgcaaccttcgtgaggggcatcttgaatcctgtaagtgtgtatggtgctccctgtaacaaactagtttcccacagcaatgcaccaaggcagcaacttaaatgaagaacatgcagcaagtaacagatagcatggtctgaaactttggttgatgaaagggcagccttgtttggttgtaaagtatgagggagtctgaaactttgtttgttatggtgcagaaatttttcggtctaagctcggtatcagatattccaaagctgataggaaccatggaggtccctgagatcccgttttcaagcatttcgattctgaagaagtacagcgagcaggacatgacttacaaggtgttctcgcgtgtgaagctgaatgagagcttgctggaccagatcttcaggtaagcagtaagcgggctgtcgtacatatcttaatcttgctggaattgattgtgtggtaattaatgaatgctgtaacacaacaacaacaacaacaacaacaacagtgggaggaaggagacgatccggataaactggcctgcgtatccacactatgaagctccagaagtatttgctccgataatactggacggtaaacagctgtactacgtgaatacattcgagagcgcagcgagcgccatggagacgggggccgttgcagcggaaaacgtggccaggctcctcattgcaaggctcaggctgcctctcccttcccgacctgctgcgcctgcgcccgatcaccacgaccagcgagcagatctgtaactgtgactctgtgactgtgatgtgaggaggtcatcgcatcgatcggctgtattgtttgtgtctaacatgtctggaacccacatgttcgtaggagttttttttaaataataaatcagccagcaggtatattactaatcaatactaagttctagagttaaaatgacatggaacccacatgtatgaatatgatgatgacctccttagtaagtaggagtatgttttcacagaaatgataagttatactaggctgaggctaagttagttgagactagttgggaacaaatcttttgcgcacagaaaatggagcggtcaattagcgtatgattagttaagtaatactttttttttaaaaaaatggatcaatataattttttaagcaactttcatataaaaactttttgaaaaaaacgtacgcatgattagttgattactattaactattttaaattttaaaaatagattaatatgattttttaaaataacttttctatataatatttttgcaaaaaacaatcgtttaggccttgtttagttactcaaaaacttttcaaaaaacatcatattgaatctttggacacatgtataaagcattaaatatagataaaaagaaaaactaattgcacgctttgcatgtaaatcacgagacaaatcttttgagcctaattagtccatgattaatcataagtgctacagtaatacacttgtactaatgacggcttaattaggctcaaaagattcgtctcgcggtttccaagcgagttatgaaattagttttttcatttgtgtccgaaaacccctttcgatatccggtcaaacgtccgatgtgacatctaaaaattttcattccatcatctaaacaggcccttagcagtagtttgcaaaatactactatttactgtttgttgaatttgaaaggacgaaacaagaacaaagcttggcttactggagtagaaatgtcggatgtaccctcagacattcacaaggaacttaagtgaagaatggtgaaatacctgatatgccctcaacaaattcaggagggaggacccttgatgtggaagcaactactctttgccttccttggtctctttggtctttgctagtgagtgtgattcatttattcattcgttcctcttctctctctgtcgtcgtcgtcttctctcctcgaacccccaaggccccaactcagtccccaattaaaaagaagagaaagcacaagaggaggaggaggaggagacgagcatggcgatggggcctccgcgcctcctgcggggcctgattccgcagctcctgtcagtggacgcctggcttccctgcacctgcagcagccggctgcagctgctgctctcccacttccactgccgcctccaccttcgctggccctcctgcgccgacgccttcaagctccttctcgcccttctcctcgtctccgccgccctcgccgaggtccgctacatcgcctcctcctccatggcccccacgctccgccccgccgaccgcgccgtcgccgaaagggtctgtctactagccctcaccctaccctagatcggctattacacccaaatctgtattttccttttttttttcttcccagataaagggaagggagatagtatttcattactagattattattattactactgatttttgaccgaacgatgcactctctagtagtacttcaccccggacatactccctccgtcccaaattataaggcctatattcgatgacatactttgaccgttaatttatttaatattatgttcctaacaaatataaaattaatatcatatgaaagttcattaaaatatgaatataatgatataatatgcatagtacttaatatatatgtatatatatatatatatatatatatatgtgtatatatatatgtgtgtgtgtatatatgtgtgtgtgtacacactactagtcaaaatttacgaagtttgattttccttaaaaagagagcgtcctgtaattttgggacggagggagtatataactaacaaaatataaatgcaatttctgctaaaaaaatgaacgcaatatcctttattgacatttctctctctctctctctctctctctctatatatatatatatatatatatatatatatatatatatatatatatatatatatatatatatatacacgctctttcagatcacctacttttttcggaggccatctattggtgatatagtgtttttcaaagtgcccacgaccttacaggtttcattctccttcctttccttccaccgtccatctccttgtttgctgttttaagatatggcacctacactacactactttgcatatcagaattatggcgtaaataaggatgttgtgttcatcaagaggatattggcaactcctggagatttcattgaggtacatacactacatccatgtcttttatcctacttaccatatgctgcagcaaaggacatttcaagatgcatacataaatcaattgctgtgctgcattggaatgccccacccaacataatacatgcatttttatttgtaggttcggcaaggacagcttattataaatggtgttgcacgaaaagaacattacacagcaagccatgcatcatacactatggaagcaatggtttgtgcaccacctatctatatgcgagcattgtctccttgaacaacattgaggagttgctattgccaggtccagagatattaaagtgctgttaacacaagggttaacagcaatgacaagagaatcttcatttacttacaagaagatgatcaaaagtggcctggctgctccgtgttgttgacttcttgagtgcctccttcaggcctcagatggtggatgatctcttccatccatttctgttctctcttctcgaccaggatcctgtactaaagccatgtatgatcctgcagcgccttcctgaaggccacgtatttgtcatgggtgataaccgtaataacagctgcgattctcgtgcctggtaagaaacacgttgcgcccacattcatatagatgcaatttgatcattaccaccacttaatattgatgaattcattcatttagctgtggtgtgtgctcttgacgttttgagtgtgccatgaacctggtccaattgtgattatgattaaacatgagcatcctaaatgtagagctagagtggaatgagaacatatgcttattgctagcatatttcggttgtgagaatgcacctcaatttgctgattcattgctggttgtgaaatgaaatgtgcctttatagctgatctccagtctatctttgcaacctttgtctgcgaagtaggggactactgataaacaatcttcttattacttgtggtgcttgtgttagcaggggaccgcttcctatcagcaatataattggaagatacatgatgtcctttacaaggtcctccatccaataaccaaggtaccaagacgaagaagattgatgaccccaaggactgcaaactacctgatgctgtttgatattatggtgataagttgataacgatcgagttgtatggaaactagcaggctgccagatgggtggagcctgcaaattgtatcagtagccctgtagtaggttgggagaaggaacttttcgactggcatggttggttttaggcgtcggtacacgttagtatttgtcgcatgccttaacggcagtatgcatttcgcttgaaactatctattttagtgaatcagttcaggagaacatccagtgctccaacctttttcaatactgccctctatctgcagttctgcacggcaacaggtacacaaacctgagaatttttagtaccttttaacttgaagcatatgcatataccgtgacaacacaacacacgagtcaggagacgtgacgtgagggcctaaatactctgagttttttttttgaagccaaatactctatgagttgtacccaaaagagactcgtcttttgagtactagctcctacagtatgcatgtatatacataccctcctaacatgtagcttagttatcaacaagcggacatcaaggtggtgaccggaatgattctgatgatctaagaggaatgccttcacattcttcgtctgtttgtttggagaaacgaaatgatgaagaggtcggaagacggaacgacgatgaagttgaaagccctacagaaacaacaacaaagtggtttcagaatttaggaagaaacaaatgcacgaccgtacgctgacaaactcataataccatcggccatgtccttcgttttatgaagcaaaaatgttccagaaaggattgttacgaagccacacgcctctgtcacaatttgtgttggattttgcctgtcccagtcctgcatgtcaacaaattcatttgcagatcgacaactataatgttctggctgaaggatgtttaaatacatgctatcttatagcctatgaaattgaccgcttgaaaatttatattgaagcaaacaagaaagagaagatcagagattcagagggatcaattttttttttttaaaaacatcataccttgaacatgatgacactagccagtatggttaaggatgtgaacatggtataataaattggtgatacaactgctgtattaaaggtgtcaagtgcctgaaatcaaggggagaatcattatcacagaactcttagtaatgcacaaagtttcccaaatctcaaggcacaaaaatctagtgaaaactctgaacttttgagtccctactaacttagataatcctgaaggactagagcacagaacgaaattgtatgccacttttctaatattctcgattttggtacagtagagcttagaatttcagttggcctcatcgtatgctagtgcatagtcaaagaagggaaaaaaaaaatcttcactttgattcagagcgaggaaaccagggtaccttgttcaagtaattcatttgggtgacaatgcatgagaggacaaccagggtaaaagcccatgtctgtggatatataagttgattcgttccacaaaaggtcaacttcaaagctataccaagtgctttcacactcataacctgcacaattcaaccaacacctttgaaaaagaacacagctaaattaggcaaaattactgggatctaaattagagagtacataccgagatagagcctacaagagagcaaacaccaatatacaccatgacatgagtttgcccgtaaagtgggacaaatcggcaaacaagtatggcgaccatagcaagtactactgaaacatagaacatgaaggctgaaaacaataacatcgcatagttagggcttggtattaagccacaacgaaattcataaagtacagtaagtgtatctttgggtaatattaggaacatgtttagagagaaagcaatataacagaaaataaattcataaagtacagtaagtgtatctttggggtaatattaggaacatgttcagagagaagcaatgtaacagaaaatgcctggttcagtagccaaatcccacacttccgttactgactcaatctcacgctccgcgggggcatgaaggacaattgtggtggatcccacaacacataagatgcatccgagaatgccaaatatgtgtagcttcttacgcagcataaaatgcgcaagtatagcactgcagaacaaaagatagctctcaagcaaacagtagatccaaaacagcaaatacataataccgtaagtgaaagacatgcctgatgataatgctgagagcaccaagaggagtgaccaaaatagctggagcaaatgcataagctgcaaagtttgcaacttccccaacaaccactgaagaagaattagagatatggacaatatgacaatgaactatatagagaaacactaaacagacagaagggtaaaagcgagagaagagaagaggggtcacttgtaatcatgccaacccaccaaagaggctcatacaaataagaatagccgccaacccctgtcataaacatggcacaaataagggtagcgtaccaacacactggcattcaattggttaggaaaacatacaaatatgcagagcaacagcctgggataacattatagcagaagctgagaattgtgggtgggactggcatgcatcatctagatatatagtctagtctactctgttgttgagacagcttcaaccttcaattaccaggttgtaagtaaacaagaaacgtatagtgcagcagtggacatactaggtcttactaatgcagtaggatggatttctatttcacttttgacaaattgttaagataggatgatttggcatgtgggctagaggaaagtgatcaaattaatgatccacttacttatgcgaaaaagaaaaagaagtcatgatgagcagatagatagataggcgatggtaggcgaggacgagtagtgtaccggctcgaagagcggaggaggaggaggcggccttcttgaggcccttcttcttgatgatgaagctggcgccgatgaaaaggctggaggagagggcgagcaggaggcccttgatgttgtcggcggtggacatgccccccgcgtaccacctcccgccgccacctcgcgcctccatctccatgcctctctctgcccttacccgcctagggcttctttcctttttcccgttttccttttttgcgtttatatttactccgtagtaatccaatccagttaattaattttactctacaaaatactgcatcagcttgctttgacgggagggaagcgaggggtctacaattctgaaagaattctacctacatcccatctcgtggaaaaaaaaatcaaatcaatcagcagtcggatatattacgcttttaactgattgcgattctctcttatatggagtatatatagtagtgtaatacacacactgttacacagagatagatagaaacactacacggcagtatcaggatgcttttaacataaataaataaataggaataggagtagagttatctatcctgatcctagatggatggatggatgatgaactcactcttggtttggcgaattggtttcctatactcctattacagatgattactagagtttgctagatggtgcaaggtagttggagtagcgggcttgagcaatgagtttgcccgatttcttcttgaggtccacgagcgccaccccaactgccttgccggcacgaagaacctttgcttcgatctcaatctcttcctgcgagtgcgaaacaaaaatcatcaaggaaaagtgaagcagtcccgtccctagtgttggagagggaaaacaaaattagagacagatacatacatcggggaaagctgcatccaagtaggagatgttcatctccaggggcgaggtagagctagagctagagctgctgttgccggtggtgtggaagacggcggaggcgacgaggtgaatgagcgaggccgtggcgccgccgtgcaggaagccgcccgaattcttgaggacacaagcaagtgacgagtcagatggatcagatcaggtggaagaaaagaaaagaaaagattactaccaggagtcgggaggggacggtgaagcggcagaggaggcggccgggctccgcggcctccacgcggatgcccctcagcacgaaggcgtcgtaaaacccggagggcagcgccgccgccgacgacgcgtccgtcggagtcggatgctccagcacacgccgggccggctccatccccgatcccattcccctctctattctcaacttctctcttcttctgtctattctagtctaacaacaagagatactagtagagagacaaatttgggtgtgtttggcatcgccttttctcaacccctctccctcgtataaaccgttaatcagtattttttaaaaaaagtttctatgcgaatgttacttaaaaaaatcaaattaatcaaaatatctttttttaaaaaaattaactaaaacttaattaatcatgcactaataaatcaccaaggactctctctctctctcctgacttgggtggcccactccagagtcgagtcaggctagccatggccatggatgccttcggctccatgttcggtgaggccaagccgccggtggcgatgcggatgcgccccatcctcttccacgcccacgcccatactaatgatgtctcccaactccgcctcctcgccaccgacctccactccctcgcctgggaccgctccctctccctctccgacatcgacgatctcgtaatcctcttctcctcccaagccctaatcagtatcagtatcagtcttcacatcgtgctttttccagagagacgacgtcgggatcggcggctcctgctccgacttcctggattacctcaaatcttgcctctcctctggggaagtcaacctcctcttccctcacaatggtcggtacccgatctacctacactacgcttttttacactacatcttccctatgctcatatggataatactataggtcttgatcgcgttcatcttgttgctacaaaggcaaagggcctacctcgcatcaccatttccctcaacacccttactcactccgcgttgaatgatgccattgccaatttctcactatcactctatgccgcttttaggactacgcaggaccatgcatccagaggtcctacccgcttcattattattcactctctagtactattacccctatgcttttgtttctcttaaacattgatatcccttctttttcagaacaagagcgagcgtcaaagctgatggagactctatcatctgaaaaggttgtttccctaatccccttattactttacttattattaactgatgtttctgctgcctgatgaaggagtacatcgttagcataaatggaaccatacatacatttcttctcgtaacaatgttaaaccgtttattagcattctaggttgccaacttgacatactgctagtcatgcagccctaaagttcaaaaggacagtttttgacatactacaactttattgctggatgtttaccatatataaatgcttgattattattttttcagtaatcacttcttttccccacaaaatttcaagcatgaatgctcctgcatccttgttctctgtgttggcctattgtaccaggagatccagttatcattgaggttcaatgtcagatgctgcttgcttgctctgtttaattaaatttctcagcatatttttgtaatggcaaagcaattcttaatctctgccatagtttttttcttcttgttgcaatagttggttatataaattgtattgtgtgatgttagtaacactctttgatttcacaggaaaagaatgaaataatgcaaaagcaactccaagctctttcttttctagacaaaagaaaggcaacaaagccaaagctggtggccaatcaggttccaagtgtgtctgatgtgactcagggctctgatcaggttattgttccagcacagcagcaaacaccaggtaaccatgcttctccatgcagcactgaaacaaacaattctgtgttttctcagctaatgaaattgcaaacctgcagtagtttcacctatcaaagttcctccagctaaagccacgaagaggatagcccctgtatctcggaggttgtacggttttcttgaatcgctacatttacatgaaaagaaattttattgtatctgattgtagaccagctctgactcttgctatttttcttcagggcaagagtgcgaggagctttgttgcaagatactgaggaagatgtcgaagaatagtcagatattgccttttctctgtattgattagttacaaacttctaaagcgtgagtgtgtggtttgttagttttggggccatttttacttgtatcaaatctatgaaatcaagctaatgcatttattgacacaaatctgctcactttttattgtgcacttcatttttctcttgtttacctgtttggcataagctaagtgtgcttattagttgtcttttagctgatgtggtactaagatttttttaccagttattgtattgcgcatggatttttttttaaaaaaaagacactatgaatcagagaaccgtattttaacttccgctggctggctttggtgtatacaatttagtggtttaatttcttgcagtgtctatattcatagaatgtaccagaatgtgtctatattacggttatcatttaaaaaaccatccgcaccttggcatatctacaatagaatgtagtgtcaggtaaccatatagaaagatcatatacagacatctttcatgtttctctgcagcttgcatttctttgcctgctgttattcatggaacgttttatggaacatctaaatcagggggttatggtttgtttgttcagacgaatgaactccatgatgaatgtttctatcatatggaattgcttggctctgagtgttttgcttcaaactacaggtacatggtgtagctactgtgcttgttttttgtcgtatggcatgctattgctccttagtactacctccgtttcaggttataagactttctagcattgcccatattcatatagatg

SEQ ID NO: 67847 - DNA, 12775 bp, Oryza sativa
attttccatttcagcagctgtattttcatggaaccattttatctgtgttgacagacaatggcatgttcttcccttgaaccgcagcagagtcgacagttgaacctgaaaagatcttctttctcccagcaccagcactagcatcatcaccacagggcgaaggcatgaacaacgtacgtccttccatggtctcgttccaggacagcctcttcctctgtgacatgttgtactgctaaatgtccacggcgccgcacagaggcaggtcgtttcgcctggtttcaggattgagcaggagctgcatgcgcttgtattgcttgatccatgattgatagtccattacagtgcatcctcgttggtgtcgtttctagaacaggacatgcgaatgtgagttcgctatgctgtgtggttgcatgtctggaactgaggcggtgaggccccctttaattccaaggaaaatcatagtaattttggtggatttcatttctatcggattttggagttttgagtggagagcctgacactcatccttatgtttatttatacattgttatactcttgttttatattattagatgttttaacttttttctattcaaaatttctttaagcttaactaaattatagaaaaattaacatcatctattacaccaaattagtttcaagtatctattgctatgtagtttttcttgatcaaacttaaaagaagacgccgacccaccgtcctccatccctgtggctccgactacgccgtcaccactagggatggcaattttacccatgggccgatgggcacgggcgtggatgtgactttttacccatgggcacgcccgcccgaaacccaaagatgttatgggcaatatacgggtttcattttttacccgtgggtaacccatgcccgacccgatacatatgtattagctaattttgactcatttcttaattcttatatcatttctctcggttcatttgtgatgctaactgatactaagttatgatgtaattcaaattattgttgataaccgataatttggtaaataaattattgattttacttctctttgttaaattacatatctttcaagttattattcatgtgagatccactaggtacccgccggacatacccgcgcccgctgggcatgggtacaggcatgaagttttgcccgctaactctagtgggtagggtttgggcggacaatgtcgagcatcgggtcgggcatggttttgctctacccgtgcccgacccgacccattgccatcctagtcaccacctcgttgccctctcgagtccaccgcccacgaccatccctataaaaccgacaaactcctccctaaactcccccctttttcccttctccccatcctatgtcacccccaaggccccaaccctaactgggactctaaatggttgggattgttgtttgctggagttgaacaaagtcaaaggagttggaggagaagttcattggagaacgaatcacgaagcagatccgaaggttagacatttgtaaatttttgctcccatttttatgtcaaatgtggtttatcaattccgcaattattattttggacttttatgatgtagtgcttgtgcttcacggaaaaagaaaaaaaaaatgaaaggtggtcctactgaactagtagcagtacagtagttatagagctgcatcctgcacgcatctatggtgaggccatatggagatggaggcagcaatgaaacgaggaaacatgatcgatcgcgttaagggaaacagtagtactaggtgctagtacagtagtagatggtcaggagggggaggtagacgacggcgaggatccggtgctcatgaggccccgggtgggcctgctgggcctgggcctgagcgcaagggtgcaccttgccctgagcacggcgtagccgagcaggcggtacgcggcgacgaatcccagcatgacgcccacgttgcgccaccggcactcgtcgccgagcccctcccggcgcagcacctcgtctccggtggccacgcaggcgcccatcacccgcgccacgcacctccccccgcccgcgaactcgttcaccagcagcgcctcgaacggccacttgaacagcgacaggtagtgcatgaacacccagcacgacggcatcgccgaccgcgcgatgaagtagccggagaagaggaagaaggaccccatcaccccctgtatcgccgcattccccaccacgaagtccggcgccgccgccgcgaagcacaccaccaccgagttcgccgtgtacaggatcagccacaccagcaccacgaagtagccgaacgccgccgccgtcctccggagccccgccatccagtacaccggcgccgcgaacaccacggccagcgccagctggaacggcaggaacaccaccgcgttcgccaccgcgtaagacgacacgcggtacgcgcccgacgacgtctccttggccaggatctcccgctcctgcaggaagatgggcagcgcctccgtggtggacgacagcaggaaggtgaggaggaaggcgaagaggccgacgcgctccgccaccttctcctccccgaggtcgtagaagatggaccccagcgccaggccggccaccagcatgcacaccgtgcggcacgcgaacagctgccgcgtccgcgccacgttcttgaagaagcgctgcgccagcacgcccacctcgcgcgcccaactgttggcgtaccggctcttcttctcaatctccatctccatctccatctccacgtcctccttgtgcagctggaacagctgctgcagcgtgcaccggtcgcgtgcctcggcggcgctccggcggcggagcgcgtcgacggagtcgatggagaactcgacggtgtcgacgtgcgggggcagcgcgaggcccgcggaggcgagcagggagcggagggcgtcgacggtgccgtggtggagggcgcagccaccggcgagcaggaggacggagtcgaacatcttgacgatgcgcgcgccgggctggtggatgctgagcagcaccgtgcggcggcgagtgtcggccatggcgcggagggcgccgacgatgtgcagggcggaggcgctgtcgaggccagaggtgggctcgtcgaggatgagaaccgcggggtcgtggactgcctcgacgccgatggagacgcggcgtcgctcgccgccggagaggtccttgaccctggtgtcggcgacgcgggcgagggtgaggtcgtggatgagggcgtcgacacgggcgtcgatgtcgttgcgggcgccgaggcggaggcgggcgctgaagcggagcgtctcgcggacggtgaggagcgggaagaggacgtcgcgctgggtgacgtaggcggagacgcggcgtaggtcggcggtggtggcgggggcgccgttgaggaggagctggtcgggaagcggggaggggtggaggcggccggcgaggatctcgaggagggtggacttgccggcgccgctggggcccacgatggcgaggagctcgccggggcgggcgcggcaggagacgttgcggagaacgtggcgggtggtggtggtggtgggcggctgctgctcgtcttcgtcttcctccctgctccatatcttcatcatcatgagagggtgagcgcgcttgggaatggggatggggatgcggatgtggtggttgatgccccgagcctccacctcgcaaccacctttctccatgccccccattctttgttgctcctcgatcctgcaggcagctgcagctaaacaacacagtggaggaggagagtattgttgttgtgcatcgttgttccgtgtgatggatgatgagtgtgagctgctagtgatgagcgagcgactactgtgtgtgcccgtgtgagctacgtgcgtgcgtgcgtgccaaatattggttggtcggttaaaaccttttctctttcacaaggacggggggggtgcctgcttggtttatggttggctggtactactccgtactcctatcatgctatggctttccctgttttgcaccctaaactacagtattagtgttgtctgattgaggggcagaagtgtcctgtgattacaactgatctgaggaagctatcgaatcgagcagtttgtggttgggtataagcgagcgcgcagctgagccaagggatcacatgacgttgtcggctagcgagcgagccagcctcagccagccagcttcacatgcatctgctgctttacctccccggccgggcggccagcctcagctaagctagccgtatcgtcgtctcgtcgttggccatcgatcttctaccgcctaccgcccacctgcaccaaaacgcatccatcctcgcacccgtatccgcttcattactgcactagacaattattaacaatgttcaagttgatcaaaacaaaaacaaaaactctaacccggctggcctgtctgcatttcttatatacgttgattttgcaagcaaccattcacgcaattattacccatcttttattatacagaaactattactccagtctattacatgatgtccccatactacttgttatttggggttctaaagtagcaaattttacgaaaaagtatgttgggaaccgtgctctttctgtcttttactattaaaaatggtaacccatgcatctaaatacaatctagcaaaacttcaataactaatcttttgctaccaaaacttttatcaaacaaatttgccacaccaattaggattcgtagtaaatgaaagaaactggcacgtataaccagtcgccttcttctagaaacttctcgttggcacatgaaaggatggagatgacggcctaagccaaacctgctctgctgcatgcaggaataggaggaggtgaggtacgggaggatcggatcaaattcgtggccaggaagactcgagtcgtcatgggttttgtaggttcccaggaagagaaaaatatctggctgagcttggccctcggggccatgtcattgatatgacatcattgttaattaagctctaagagcaagtttaatagttttaaattatctatagccaatgtaatagtcaattcatacaatagttacttactatactattaatacctggtcccacctgtcatacacacgttacgtcttgaagtccgtactgcagctggctacagatctgtagtccgctgctcttccctcccttcctttatatctttaaaatatacttatagttggcttatagtatgttattgtacctgctctaactgttgatgtgttcttttttgatgatatgcggggatgggtgaaaaataattttattttaaaacttactacatccgtactgaaatataagcttatattttatcttatattttaagaaggaaggagtaaaaaatatataataattaattaacacagctagtggagacgggttgattaacacaactagtgctagctagcactgatgcaggtgaggccatatggtgtttgtcctccagcgacccgtgaccggtcgtcccgtgacccgtgccaacatatacgccaccccacgcaccacaccaccaccacctggagggatcatcatacgtaggagtaggagcagatccgcagcaggttacgctacaccaaaataccatcgctgcgtttgttcaattgtaaccaaccatataccccagccactaatagctcatagaatcctccttttttttgtttttgaattgtttttggtttcttggatttctgtctttccgcttttgtttatgtttataaaactttacgaaaaagttccgattgacactttctgtttccaagaatgcaactaaaaagggaaaacttttcgaactgtttttatcctagtttacaaagacaccaacaaatgatttctcactttcacagcaaagacgaatgatttacggtctaaattgacaaaaaggcatgagcaaatgtaaaggtaaaagaacaatttgattgatcgttaaggattcagtgattcaatcaaatcggtcataccacttattccacatatacttctccaagctattctattagaaccaaactcggatctatgcaaggaaacacaacaaattgcctaaattggactgccaaatttgggagtcattaggctagctatcaatcgcagcaaatgactcacggacggtgacgtacgttcagcaaatagccgattcatccaccaatcactacaaaatcagccgccagtgactaattcattcctactagcatagaatagcacattcgcaatgtcaacaagcccactatttcattccattatttttctttttttaaaaaaaaaagagtgcatgatgctaccgagcatgatataacgaggacctgcttaaggcggacgtgtcgagtccatcaggcgttcaggcattcgagctcgagaccagtagagagactacatgaggatgaaagtgaaacatattttcattgaacaacactaacaataaaagaggaaacatcctttcgtagatattcagtaaattgaacttaatacattatatagctgctgacgtaatggagattatatgttttttttgtatgcatcattggggtgggcggttcaacatggaaatatacagaaagcaaaaacaaatcgacacaaaccaagcttatcactttcagcaaccaatatttcatcaacaaagagcccagattagcatcaccagcatgttaacagcagctgctagcggcagcatcggcttctggcggcttctgcttgaagatgttcttcttcgcacctgaggaagcatcagccaagaggcttggtgtgtccaatatctgcatcatgaacgcatatgcatatcattaacagagctccacatcccacatataaattgtatctatcaagagcagctctgtaacaaactaacaaacttgacataattacttttaataatgtataatttttgtgacaagtgttctactaaatatgttttacaaatctgaatatgaaaattgctgtcatattgcaatgtgtattttatctgtaagatggttccgcttatgaaaagtatgatgcgaactactactggttctctcaaaaaataaacagatgagacaaacactaaaacaccgccagtccactatcaagcatgagcaagcaaaccctgaacatccaatcaatcatttgctatggcaccgcaaatatataaagtcaactttctctcagcagtaatttcacagtccaacatgtagcaaaagaagaaagcaatgccatgtatgaatcaaaatgaagcaaatctgtttatattgcataccttcaggacgagttcctcaaagcattgttcaacattcactttggttttagcactgcattctagaaataaacacccgtattccctggcaaattcaatgccctctttttttgtcacagctctctcactttcctgccaaaaccaagcagctatatttagatgtgtagtaaaaacatgaaaacaatacatagaaaaagaaacctatgcagaagaacatcataattagaatgggattgaacttcagtgaagcataaagagcagaagaaagtgtagaactgaagcatataataattaccttgtcaactttgtttccgacaagcatcttaatacaatcctggtttgtagaatagaggtcaatttccttagcccatatgtcagaaagattggtgaatgtttcccgtcgagtgacatcgtacactgagaaatcaatttccactgatcaagatatatcttgatattcgataagattaaaacacaatcctccatttccttctataaggcttattttgagtggggcacaaaaaatatgagtaaggaataaagagaagatggttaaaatgaccatgctacacagaattaaatatcttgggaatgggagaggtgatggctagtgatttttttgtctgattattagtcaattgtttgttattaatgtaagagagtctgttataaatgagagtaaacaaggagtagaagtaaaaacatttacacagagacctatattttggattttttttttgaagaaactacaagacttatagaaagaaatgggagtagtgaagattccttcaatgctgcaaacagaagcaagcatccgcagagatggggctgaagacaattacccataataataccctgtgcacctctgtagtatgagctggtcaaggttctaaatcgctcctgtccagctgcagaaaaggtacacaatgccaaataagaaactaacagaataatgtagctatgggtgttaaaagacacttatgttttctagagacaagctgtatagaaaaaatcagaggttcagaaaacagactgaaatacaaacacgtcatggcttaattattcaaaacagtgaggcaaacaagaagataaacaagatcgaatgtctattctataccattatatataaaatgagaatttgaggatttgccactgcattagcagttgcaatgtagaacttgccactcacacacttggggtggaaaatcgtagatcaccatatactaggccttgtttggcacacagctccagattccaatcaaagctggatttgaagtttgtatgttaaattatagtggtttaaaattttgtatttcatctcaaatgggaacagaatgattcatccaaatgttatcatcgtaatctcatatctagatccatggatttgtggagagctaggaaaacccagctccaaaaaatcttggatccagagttgtgccaaacagggcccaagagatcgcaaattctcaaatttcctaaaatcaattacccaagaataattccttacgcttttatcaacagcaaaaaacataactaaagaataatcgggttctacttttgagaaataacttgcttgtgcttttctgttttccatagccatcccaaaagaaaccttttatattgtttacacctgaacatgcaggaaaaataaaaacaaacggagccataccatttaggagtatgcaagaactagagagagtgcttacatcatgtgcattgagcctgtttgagtctgatgtaataaaacaagtaaaaaaaagagtagctacattaggcttgatttttagttgcaaataagaagaggttacaggttgtctgggatccattgagctcagatgtgctttactttctaccgagtaatgagaataattaacaaaaaaaaaggtaagcctttggggacagcacttgtcttgtgtaaataagcatttagacgacgagtaaagagatttcaagtggataatccacttacttatagtaatatgggatgaaaactaagtgcagcttcaatatcaacagttagcccaggtgctgtatattcccgcagctatggggggctggctattttaagctggcgcttgacttgagacccgtgcttaggaggatcaataaatgatctgaacagggtcatattggatccgcgtgatcagtgcagtgtgataatggtgatgcgtgatacaagaaaagaagaatgatttggaactgaaactgagacttaattaggacctgtgtcccagatggcaagcttgagttttttgccaccggtgttaaccatcttgaccttgaagtcgacacctgaatatacaatccgaacgcgattagcaagaaaaaaaaatttttgtgggggggggggcgcataaattttgagcgggcgagagatgaaagtaagcaggtgccgggggatgatccctgttacctatggtgggcgagagatcctcgaaagagtcggaggtgaagcggaggaggagactgctcttgccgacgcccgagtcgccgatgaggagcagcttaaagaggtaatcaaaatccggctggctctgcgcctgggtggacgacgatgaagacgaagaatccataataacctcctcgtatgggatgacgaaggtggggggatgagatctgatctagggtttgatctggttgcggaggaggaggagaagaaaagctggaaaagggaaagaggaagacgaagacgaagacgaagagaaagaagatgtgcgtttgcggtttgcctctgcatccgcactcgactaccggacctagggtttgcctacaggggcccaattacgcacacccacttctatcataggaataagttcactttaggtacctcaaaatttatcgccaagtctgaaactaatcctgcctgcgttcctcaactcgcaaaaacagtgcagataaggccccataatggtttggacgtgatttcggctgacatggcgcctatgtaatatcaacgtggcacttaaagttagaaaaaaccatgggacccaacccctctctttcccctcttgtctcccttcctcctctctctcccttatatcacctatgactgtgccggggtgctagcccggcgcatccctccccccgccccacacaaacaccaacatcaccaggatgagcaccgctttcagattcatgttcgttggcagcaacaggaacaaaatgatgggagaggaggagggagggatcaacaacagatgcaagcggtggtagtggctacggcaagagaggtggttgtagaggttagggtcgaaacgaagctcgaataaggatcgccacaccaaggtggacggcaagggtcgctagatccgaatatcgacgtggattttccagcggacgagtaagctgggccacaagtctgacagcaagtccacccagtagctgctccagcaggtagagattgccattgttgtcatgaccaggatgtggaccatatcagcattgacgctggtctccgtcgtaccctccctcccttccctgaactttgccctctccaggtcacaccaccaccatatgtgggcagcgcccgcggcttccatcgggttcctcaactccaccaacgcgaatgaggtgcagcccttacacgagaagagaggggtgaagggaagagagaggatgaaaaaagcgctagtcattgacatgtgaggtccacgtggatcccgcacgctaacttagcttgccacgtcagccaaaaccatactatctacaatctcgagtgatatgattttataaaatgaacgacccgttatatttggtttttttggtttaaagacgaattttagactcaacgacaaattaagcgacctaaagtgtgcttattcctcttatatagttatatacttatatgccacaccacattcatcgcttcataaaaaaggggtccagtgaaaaatcagatgtaaggtttcattaattaattgcatctgcaacgtatgggtatggtcaaagatttgcgcatattacatttagtcgttggttttaagaatatttagctgtgccaacatttagtttgcaacatgttcaatctaggttcgttgcgaaaagtcaccatcgccgtctctctctaatctagcctaatagttgagctttgtactacgctgctgcgtaactcgctattgacgttagcatacatcagatgatcagacagaccgctcgtacaggtaaaacaggaaaaaagaagaggaaattcctactagctgcctaggagtactaatttggacggcagtaagcaccacacaagctcaggggatcaccaggaatgtaaggctgtccgctccagaatcaggcttccaacatctttttaaggacaagtgatccaacgtcgccaacgagttattcgtaccgatcccttattggtgacaaaatcttcttcgcaaactagggtaagcgaaatgtccatgaaccacgaattctcctgaattggcccaaactgaatcttcgcaaactagctgcaactcccaatctcataatctgagcgccttcctgtttgagctgtaaaatgcacttcaataaacaggaaacagaagaaccatgacatgcctcaagtaacagcgagcgaacgaacccccgtctggttcaggctataggtataggagccatacctatatataatagaggggattaaacatgcaaaacaacaatgagcgaacaacagagaaaaggacaatcatgagcttaaattaagaaacaacgaacaaacctgtgattcaggtcacatgatcaccaactgttgacgctgaacaggcagcattggatatggtagcattagtggtattgcagatgtcaacaagagacccctgctcaaacctggtctctaattctggatggttctgatcagatagattagttgtcagcagcaggttacatggatcaggatcatcggcaagagaaaaggacaagtcattcagctccaagtactgttcagttttaagtacttccagcgtaggaggaatcaagtcttcaccacatgagttacaatggttggaaatgctctcatctgattgggaatcaagttcatcaagttcattaaatattgcttcaccatcatcggacgatacttcattgtcattatcatagtcagcagttgagtcaggctgcattaaaccaccccccaaaaaatataattacacatcaatggcgtcaatgcatgttgaacagcagatacgacaaaagagagtgttgtaaaacaaattaccaatgaaccatctcgactaacggagttcaaaagatctgtcgagaaacaactgataatctcatctagctgctgggtatgtatggtatcaaaaggaacgctaggactagtcgtcccacagccaccaacagcgatcttgtcattagtttctgaacaatggtccaaagaagatccaatattatcactaacagccagctgctgaccagctgtgtttaacctgccattacttgattccagcgcacaagggggcacagaaaaggcaaaagaggatagctccccgttcgcttcattccaatcatcttcattgaatggagcaccatactgttccccaatcttgggacctggaccacttttttgaaagattttgcagagaacacaagcatcctg

SEQ ID NO: 67848 - DNA, 9684 bp, Oryza sativa
gtcaaataaccactttaagtgataatcttttctcagaaggaagaataaatatccttgctttctatattcttataattcagtttaaggatcaactatagcgatgctctggttgtgacattgtcttggtgtttctttcaatatttgctattcacgatgcagctcataaatataatctcgatataatataaatagagttacacatatgttgaagattaaaatggcaaaagaagttgatggatctcatcataagttgaagacagttgaactggtactgggaaaagagaggttacaggcattcagcaataggttgtttagaagccatacctatttatgtattcagttaactgtaaggcacagcaaagtaatctaacaaacattggaaggaccagaaaagaggacattagatcaaatggatatacataatatatgcttttttaaaaaaaaaagaaaaggaaagaatgcaaaacaaggcagcaaaaatggtgcacatatattcatgtatgtcttgtgttatccacgtaattttcacacgtgcattttatagtttttcacatgagtaaggaacaattgccatgtactaagtacgaaaatttgccaaaagaaatgcacaaggactacagcagcactttaagaaacttagttaaataccgaaaactagatttttgacatgtaacccacttcataagccagatactgaaactactacaaagtacaaccacatcaaggacatcataccagtttaacaccagaagcagacagttccttgtcctccagcctgtattcatacattacccaatcagttctatcaccccgaggtggcttgccaagatgaaacaccaaagttcgcttcatcccaacagtctgagaattatatattactggtctgtcttttccagtagctttccaatacccagcttcagttgatcggttcgttcttgacccactagaatatttcctatcacgtgggcaaaagaaataccattctcgatccttactctgcaacgaagatttctctgcaccaagttaaacaagacagaataaatcacaagagcagttcaaaggccagcgacctgcaaagcacaatgtttttacattcaaatgaaaacatgtggttgcccaaaactgagctaagcaaacagcaatgcatgcgtagaaagtcaaatggaagccattgctttgaggaaagacatgattctcagcagaatactaatgcaacagaaacaagtggatcaaaaaaggtcttgacttggaagggagtgaaatggtaaagcttggaaaacatttttcaagggagagtaaatttacctggaagatcccaaggggcaaatttgtatagatcaagctctgaaacagcattgcaccgtaagtgtttgcccaataattttctcttcaggtaatagacagtcaactcaacatctgttggatgaaaccggaatccaggaggaagagatgtcttggccatactaaggagaatggaacgttgtctatactagcataacgagatccaaatagaccttggcctaagaactaaagaaataaaaaaaaacggttgcagttagatagatagaatagtagtacatttggttgggggcaacaaagagagaagagcgagatgagttcaaatatggtaaagaccaactttggcatattattgagcatccacagcaaggaaaacagagataatccttcctgatgtcaagagtcatttgaagagcaagcggagccctgcatgaaatgatttagatattatccctcagctgggcgtagatctaaaagaaaagacccaacatataggaaaagaaaaccgagacacatgtgacatccggtcggcagtttgacacagagaagcatggcataaaaatgcgatagtgtaaaatgtaagcccccttgaagtgaagtagataaatgaagggatgatgtgcaacaacactagaacagtctatttattatcaggcgaagagcaaaggtaggaaaaatgatgtggtcgaaattaatcacgcggcgtgcgggcatatattgatacatgcatatctaggggagaagaatgaaccctaagtagcgaagtagtgcgggagagatccaaccaagaatcatcataagaagcaatgtagatgggcgacgagcgagcgagggaggaggagagacgagacatacgctggtggtggcggtcggcgagggaaggaaatgcggcgccgccgcggagaggagatggtggtgctgatgcggatgcggtacgacaagggagggatgagagattgagaggagaggagaggggaatgggacgcaggacgctggtgtgttggcgaggagaagcggcgaggtggaattggaaagaggcggcgcgcagcggagagaggcaggcggctcccgtcgccgtcgcccttcctcctcctcccccccaaatctctctcccccaaggccccttctacattcttcttcagcttggggccttgttgggcttttatgggccgcacctacggcctacttctttgttatatgggctggaagcaattcctttcatcatcaatgccttttcatttcacaagggagggcgggccggccggtacatcgcatcgatcattacttaacagtactacaagtttaacatctcaaaaattgcaattcaacatcctctatctcaaaaattgcattcaacatcctctatctaaaaaaattacttactactactactacaatccagtggaaagaaagaggacaagtcaagacgtacagagcagtaagggtggtggtggtcatggcagtgggacaggcgtcctccactcgtggaactcaaccaggtctctgttcacgattgacctgttatgaagccagaaggtttctgcggattgatggaatcgcctcaccttcctctgcagttcccacatgatagcgctcatagccgagcaccgctctgtatccgccgcatacacccataggcatcttatctcccgcccgcgaccaatcatttcctcaactcttccatctgcatgcatccgcttaccccgctcatgctaactgcttacatggcttgactcttctacagattacaaaatggaaaggagcctacctggtattgactcgagatattcaaggagccccgggccaatcttggacgcaggccattttatcgatacttcagtgtagtcaatcacattctggaaaggaagctcaacttcatctgataaaattaccggcacgcattcctgtagtcaacaatgtaaggagcactgtaggtatgcactgaaactaactatcatccttttgaggaagagctcaccacaaagaaggattcatagaagcgaagtgtccatgaagactcgccacgaggagctaggcaaaattttgcattcctcaagtgcttgaagtaatctatccttcccaatttgtctggtccagagagcttcagctccggagactccagctgttcataagaacaacccaaatacacatcagaaatgaacttttttttatcatcacttgattcacttaaagttaattacaccattaaaaagtttctgccataactacttctgatcatattcagaggaaggcttacaccatcataaaatgttaagttgcatttggagattagaaggaagccgaaccttgtcaggatactgctttgcaagcttcaccagttggagacggcctacttttccctgagcacgcccaaggaagtttgctaaatacttcctttttgttaatgggatcggtttgacagcaagcctgtcagacttcaccatagaatcatccacattcccaggtataataatatctttccatgtgttaaaagcgcttatacctcgtttatcagtgcggtcaccctaacaaaaaaaaattgaacatagaaccattcgttaagaagatgtcagaagttgcttgcatgtcgagttaacagaagactagaagaccactcatgaacccacttattactcgcaaacaaattgaggacatctgaagatacagaatttaattagaccaaggcatgcaactgctatcatctacgctaggatttgtgaaaaacactgccgtgttatattatagcaagctgactcatatacgctgcacatttggatgggatggactaaggatgcattacgggccttgatcctcccgcagttaaggatttgaagcgcggtaatatttaatggggatttaacaaaattgcagcaatcgttgtaacagttctgaataagggcatgtttttcgtagatataacaattaacaattatacagaaggcaaacccaataaaacttgtgtaagttatgcttggggatatatggagcattactttactctgtcttaagaaatgcgaagcaaataagaagatgaatgcaaaaatggctgtgtacctcaggagtaaggatgatagacctattcaggaaggttgcccatgagcgaaacaggtgagctccagcaccactacacaagcaagaaaacaagggcggtgccggttttaggtaattggaaggatttcagtggctattgtttgggtaaacatactaacaggaagtcaaataagaagaagaagaagaagaggtggaaccttgggaagacaaaaatgtggtcgcgtcctccggatctgcggaaataaggcatctgactgagaacctgcaagcagagaggggagatgggtaagaaatgaaggcgcgtgaggtgaaggtaaggttttaccaccttgacgtatgtctggttgatctccttgtcgttaagttttcccgtcatccgaacgcatttgacataggtgggaacgaagaagagatccgcttcgtccttgtcaaatgttcgaaatctcgagctgaggaggagctggtggatcttcacctgcacgacatcgaaacgcggtttgtacagtagctcgagcaattggttagggctagaactactagtagctgctacacctacctgagttccccactggcccttgatgcaggttgcagcggtgacgtcgtcgttgcggccgcggagcagcgcgcgcaggccgtcgacctcgtcctcggcgtagacgtagatgcggaggtcgcggtgcggccagggactgtatggtgcggcgcaggggggcggcggagcggagagtggggaccggtcgagcaggcgggtgaggaagaaggtggcggcgacgaggaggagggcggccgcttggtgggccctcgtgcagagaggctggtgcgagctccgcatggtcgctcgccggagacgacgtgcaggcagcggaggggatcaccggagccggcggcgaccggaccgaaccgaaccgacagagaggaatcgatgcagcgcgtgggcctttttacctgagagagctggattcgaccggaggcccattattagtagatgcctagatgggctaaaagccttcgtcacacgccctagcagcccatgcattcggtagaagaattttttttatttatacattttttattaaaatatttacaaaaataattttttgttttaaaaatttacaaatctaatcgcctgccgccctttgggagggtgatttttaaaaatcgcccttccagagagcggcaaggaacctaaatgcaaattttccatcacaattagggatggcaatttcccccgcggggacgggtcccctgcggggacccgcccctacgggggcggaggcgggtacaatttctcacccgcgggggaggcagggccggggccccgcatttttgcgggtaggggccgggggggggggaagttcacccgcggggccccgggggtgtatattaaacattcaaatgtagcccatacaaggcccaacccaataaaatagtgagggataaaaacaaaccctagcctccccagtccccaactccccatctcaacatctcccctccagtccgcatcggcatcacgcacccaggcagaggcggaggcgcagcggcacgccagggtgcacggcgaacttttggatctcgccgttgtcggttgccctctgcccctctcccctccaatcctgtcccctcctgctctccctccggctctcctctccggctgcgcggtcgagcggcgagggcggcggcggccggcgagggtgcggtcgtgcggcgcagaggcgcggcgtccggctgcccgtggcgagccgcgagcgcgaggggacaggtgcggggccggcaaggggacagccggacaagcgcggcagccagctctgggatttgattttgtgttgatttgattgagttgttactcattgcggggccccggtcgggttgcggggccccgcaggggccggggccggggccggggactgatttgcacccgcatgtccactcgaggccggggccgggtggagagttcgggggtcggggtcggggccgttccagcccaacccacacccgccccgccccgttgccatccctaagcacaacttgttagctctataaattacaatttaaaattatactataaagtcagatgaaataaaactttatatcaaaattgtagagctcaaggagatctacaactttgtagttaacaactttttcatttaagatgttttagatattcaaatattcgttacaaaatataaaacacattttaaaaaatctcagatctacatctcaaacgacattggatggagataaacattatataaaagttgtagatcttgatgagatctataactttgtagtttatcacttttccatttatgttaacgaccaaatttggtaatatcaacatcggaaaaggagattagatcaaggtggagtcgaaggcggagattgatccgagaacagagcaagaatcggctgaagtccagatcagctacgattaggatcggctgggtctgagtcggactaggtgagccgatgcagcagattctgtcagtataatttggtgtatgacattgggttgaattgaggtgcttcaagatgattgccgcacatggatagagtcctgagaaggcaattgtatctattaattaggatgttttatgtaacttccttagagatatgtttgggcaaaagtctgccgcaaagacttatggtatcttagagtttgttagagatagtggtcgtgtccggtatggacatatcttgtaattctcgggtataaatagaccccgagccctatgtaatttttaacacacacgttcaatacaatttcggcgcatcgccacctttttgctttagttttgtttcgacgagttcttgctttcgggttgagctgcatcggtttcgatcttcaacaagaggtaaaacttgttatgacgacttgtgttctcgagattagtgtttccatctttatgacactctaatcttgtctatataatccgtcaagttatcatatatcttacataatctttggcaatatcgttatctaacctacaatcggctaacatctgttaatagaaggcaaccgattaggttaaatagcgacgttgtcctaaattatataagatatctaccactttatgaaacacccagcggcttgattgtctagatattgttcttcttttcatacttaatgctacatcagttgagtttgatctattaagtcgtgcttagaatatcaatctctagcatgtcctctggttgccgattagggtagtatgggagtttcagccgatcttatctgatttaaccatattcgatctatatgcttcaatgtcatgttaaatttgccctttatgtcaagatcttattgcatttaagtatattaagcttttgtttggtatattatatttgttttgttatctttatataaagtagtatcggagtattagccgatacatgctagatctatctgatcggctatgctataaacatatataatcctgttattaatatatatttcgatctaagtgatttatactgtttcggcatggtgaccgatctatcccaatcacttgatttaagtatatattaatataagaactatatatcgttaatatctacagccgatcgaatagatttagttccttaccatctatttataaccgctgatcgattcatatatgacatcggctcaaagataaatgatatgttatcggcacctagccaatcggctatcatttatagatttaaccacgaattctttgtatctatttcttgttgattacaggatcaaatcaactggtacgctcatacattcgaaggcgagctttggacctacacaggagttaagcagatctcccaggcctcgtgttttctatcaacaatttaaaatcatttggagtatcgaataagcattattagtttttaagcaattaaaaccggtggaaagggtttgaacacaaataaaaattttgcatttaggtcccttgccgccctttgggagggcgatttttaaaaatcgcccttctagagggcgacaggcgattagatttgtaaattttcgaaacaaaaaattatttttgtaaatattttaataaaaaatgtataaataaaaaagtggaatggaataggaaagggcatagttttttcgcttatgcttatcaaccaagatttaaatttttcgactttaaatttagagttgatttgagaaagaatttgcaaactaataaaaccgggtggacaaattttccatctccaggggaaaagactatcatctcctaccagataaatttctaatacctttggggtaaaactcttgtctagtagggaattgcaaccagagagagttctagtgagtccatactctttctttcgttcatcaaagcgaagcatgggttttttaattgaagtttatttttcagcctttacttttagatcgctaagaatacgtatataaaagttttattcacaaattattttttgtttgcaaatatgtcatttcgcttattctccgaataagcgaaacgatgggtcgcccagtctgaaattcatccctgaaccgaaataacaggtactacgtatccctcaactctcaaaaccactacaaataaggtcccaaggtggttttagatgatggttttggctgacgtggcgcctacgtggatgatttgacttagtcatcatcccatgtggcgttgacgtgacattagaatcgagattaaaaaattaaaataatatagtgggatggtaggtcacacttcctccacctcaccccctccttttctctatctacttctcccaagttccaaacgagtgtgcagcgacggtggccggcatggaaggcagtggtgacgggaggtgctcggcgaggagggagccatgtgttccgcggcggatgaggagaggctgctgtggcagttggaggttggtgaggaggaggtcgcggacccgttcgtggcaagcggcagccgatgaggagaggacggaggcgtaggagaggggaggagagctggcgagctcgccatcttgcctccaaccaccacccgcggccacttgctccgccccgcctccgctgccaccccgacgctaagccatggcaccaccaagacaggcacaggccttgccgtgaggtacgacgatgaagactgcgtggccgccttgaccaccaccgcctctagcgtcttgcagtccctgaccacgccgccacctcctccctcaatggcagcctacagctgaagctgatgcggcgggtcgaatcccttaacttgtatcatcgaaggtcccttgtcttatcgtcgaatgacaaaatcgtcccttaaccgcaaaatcagatatatgtcatcccctatcttacaaaaccggatcactttgggtccttaggcagttttgactccagttttg

SEQ ID NO: 67849 - DNA, 6514 bp, Oryza sativa
tgcactccccgtgcactgtcgccatgctcctcgccatggccgtcattaccttcttcaccgacctcaacatcctctcataccttccccgccactgtccaattcttcccccgtcagttgcacccgacgcaccgtgcctagctgctctctgtcactgccgcccgtggaaatgggagaagagaggtggagagggaagggaataagaggctgacatgtggggcccacgctgactcaactgccacgtcggacaaaaccggagtcaaaatcgtctaaggacccaaagtgatcgattttataagataatggatgatatatatctgattttgtggttgtgggacgattttgtaatcttataataagatgagggatcttctatgtaccttttccgaattgatatgggtagaaagagagccagcgccagccctactcgtacggcggcagagatatgggacacacgacgcttcacctagtgctgcgataggcttagatgggccaaacaaatattcatccaacatcggggaaaaacttaacgaacatggaattaattagatctaacagcttagaagtgccgatggcatttccggctttccgccaccgtaatatactacgatgtaaccttgtagaatgtgtgcaatgatttcatctggtttagtgagcggaatgtaattacgtatagtaagtgtgttaactgaagactaattggccggtgggattcgcttccaaacagtagaagacgatgggacgagagcgcgcgtccaagatccaaccaacacacttgagtccgtgactgcccttttttctccatcatcataaaaccgatccgtcgtaagtcgaagcattttctgtcggtatgcatatgcacacatgcgcgtacacagcagctatatgcatcatcatcgatcacatgcatagatagtaggattattttatactcctatcgataatcagcgtgcatgcatatcaaccgaactgcaattatttaggattaatatatatataattcatgctattgattatatatacatttgctcttttttttaaaaaatattataattcatgtatttacgaacatactattacaattgaagtgatatccaattgtgcaactaattaccccctcaatgtattttttagattttcttttaccaaaatgccattctgtcgtccatcctctcttcttttgtccctacctctttttccacgacgggtagacccaacgagttcgtgacgctggcagcagcattggatatattacctccatattttaatatatgacaccgttgactttttaaccaaacgtttgaccatttattttatttaaaatttttgtataaatataaaaatatttatgtcatgcttaaagaatatttgatgatgaatcaagtcacaataaaataaataataattacataaattttttaaataagacgaatggttaaacattgaataaaaagtcaacggcgttatacataaaaaaaatggaggtagtatgacactgcacacacgggcctccgggcctctacccttgcgctggcctcttccctttcctacgacacgatcacgcaaactcctattggatcagggagggagaggccatatgcatggccgcgcgagcgagcacagacgcaacctggcttgtcgatcaacttgcgttggcctggtcctggacgtacaggaaggtggatcgatgcacgcccgtagccatcctggccctaagttcacgtacggtcattcttaatttgttgtgcactctagcaacgatctggaaaatgttgacctccacacccccggcctctcccgcgacgcatgcaggaagatggcggcaacagctccatacggcgatgggacaacgaatcagatctagcgcgttggggatagcagtggcacgcttgcactgctgaggccggcggtggccggcgcggggcagaggtggaggaggtggccaccgtggccatatagttcatcagaaatgggagagagggggaggacgaagggatatgaagaaagaaaatggcaaattggtccaaaaattcatcgaatggataagtggtggaatgtcaatcaaattagaatgacatgttttacatgatttgtaatgacctttttttttgaaaaaaaagatacatatataaaatttcatccccaaattttcatcgaccggcatttagcaaatcggtaaaataattaattgcaacgagcataaagatacatatataatgcctagtgtgatcaagtcggtcgattgatacatagctagtttggagtggatatatatattagctagtgggtggataggctattagctagtatgacagcaagaggagggagatgatgtcgaggacgacggtgcagaggcggcgcagaccctcctctcgcttggccaggtcggacgggtacgcgcgctgctgggacgacgctcgtcggaacagcgcccggcacatggttgggtactgggcggcggcgctgacgtgcacgaaggcatagtcgtaggcctcctccttgatggcctcctgcgcggagatgagagcctgtcgcgcgtcggcgtacctggcggcgcacgcgcggagcagcggcgcctgaggctgagattggtaagcagccgcgctggcgagtaacgaggctccggcggctgaggcgttggtggcggcggcagagacggcgatggcgcataggccgcggacatcggcggcggtggagatggaggggtcggcggcgagagcggcgacgcagacatcgtagtaggttgtggagttacaggtggactgcacaagctgctggggcttattgttagtagtagcaactgctgctgccgagttggcagcggcgcggccgccggcggcgataagtagtactaagaggagacaacaaccggcgggcgccattgatgaactggctggccctagctaatatacactgtatgaaggttatgtagtctttctggatggatatatatatatatatatatatatatatatatatatatatatatatatatatatatatatatatatatatatatatagcaagctcgatcccctgtacgacgtcgtggacctggaggctggaggtttgtcacactcacatgcatatgcactcgacaaatgcacgatggatggatttgtgatcgattctgaaatgttggttcacgtgacatgtggtatggatattcgctcgcatgcatgggcctcccagacctaagaacaatttgggccagctagcttagcgccttggcccatcccttcttgtggagtggaggtgtggtggctgggctgggctgggctatctgtcctgttcatcatcatcgtctcgctcaacaatggaatggaatggactgactgattgactaccacgaccaacagcaagtgtcggatccgctccgatcagcagaggtcgccgccggagccggagagggaggagatcgcgcgcgatctgcttcttcgttacttggcccttgtggatgtcatctatctagtccgtccgtccgtctccgtgcgcaagtaagataagatcccatttaatttccttgtttgctgcagctgcaaccgcaactgcaactgattccggccgggctttgagttcttctccccccctgttggctgttgcccctgatccgattccatctcatcccatgggctgtgtcggctccaagcaattccatggcgccaacctgcacaaatctgcccgccccccgtcctccacctccaatcattccgattcactcaggcacctcgccacctacgattcaaccaagggccaggaggaggaggagccagaggaggccgctgattccacagcggcaacaccattggcattacctgatcaagtactaatagtgactgataaggaggaggcacctggtgttgatgccaatgccgcgcctgagccaaaaccaaaactcagcctcgtggcccatgttcctaatggggtggattgggagcatgttgccgctggctggccccgttggctcacacaggtggccaccgaggctgtccgaggctggctgccacggaaatctgactcttttcacaagctgcacaaggttgtttctttctctacgctttctttgttttttttcctttcttgctctctgttattctttcttccttcctttacacttttggtgctagcttttcttctactagtagtttgatagtttttcaagactctaatctttttagttgataccaacatgtcgtaccggaccaccggcaaaatctttctattctttattataagtgtttactctgtgcaatagagatatcgaattgccatgctaggaggtactcctaattgataattgctgtacaaactacataattgcattgatatgactgttcaattccatattatctatctatgtgcttcctttctaaactatggattatatgctgctacacttcccttttatttattcagataggtgaaggtacctacagtagcgtgtataaagcccacgatctagagaacggcaaagttgttgcgcttaagaaagtgcggtttgccaatatggaccctgagagtgtccggttcatggcacgggaaattcatgtcttgaggagacttgatcatccgcatgttgtgaagcttgaaggattagtgacttcacacatgtctagtagcttgtatcttgtattcgaatacatggagcatgatcttgccggacttgcagctacacctggtataaaattcacagagcctcaggtttttttctctagacttgttcttgtgagcatgctgttccatctccatagtcctcatgttatccacttaagctgtttctttcaggtaaagtgttacatgcaacaattactttctggactggaccactgccatagccatggggtattacatcgggatataaagggtgcaaatcttcttcttgacaacaatggcaccctcaaaatagcagattttggtctggctacgttttttaacccaaatcaaaagcagcatttgacaagtcgtgtggtaacactgtggtaccgtcctcctgagctattgcttggtgctaccaattatggtgctgccgttgatctttggagtgccggttgtatccttgcagagttgttgtctggaaggcctatcatgcctggacgaaccgaggtattgcttggccctgaataaatgcccatatcatatacgcagtctttatattgtctattgataatatttgaccaatttaaacctaaataaaagctgaacaccaactatttaatctgaagaatgcccttttgtgacaactttggttgggtcataaagtttggagatggctgactgcaaatttagctttgttcagatacttgagctaggaaaccttcaatttcgagaaatgtagaacatgacgcatacagtaagcgtttgcagagaattgcatctagttgagtggaggctgttaccgcttttgtcttatgttagtaaattcctatgtctgcatgctatttttatttttgagatacttggataattaactggtgaatgctagatcattctgcttggtctttcactaagaatcatgggtccattttttattcttcaaatcttgtttcatttgaattgatggcaggttttgtgtagttcataacttgcagtatgttattaatcaacatatagatattttgatctttatagcacagtggccacgatcatatgctcaaccttatccctgcatattcttcttttttgttacaggacccttcataatattcttaccactagcagaagctatttttgagtacttttgctttccaacacctttcaggttgaacaattgcacaagatatttaaactttgtggttcaccatcagaggaattttgggctagtttgaaactttcacgagctacggtctttaaaccacaacatctgtatcatagatgtgttaacaatgtatacaagggcttctcgtcttcagctttggagcttttggatcagttgcttgctgtagatcctgcaagtagaggaactgctgcttctgccctcgaaagtgaagtaagttttacattgttattcttcattgctgctatctgccacttattggttaggattgccagctggctgctctcctttcacatagtttggtttgcttcctctctgtgccactggaaatacaaagttgggattcttttttcatatatttccctattttctgtgggtttttcttcttttttcatatatttccctattttctgtgggtttttctctgtatgtctgtgtgcggatgtccatgttgtgtggacttacattgctagctttgtcttagggacaaccttttgttttctctaggtcaaatacaagaaaatgtttattgaaggactagcagtacctgttttgctaccttatatagcttgcaatagaagctgaggctatccctttataaaacaaagtaaaaaagaaaaagagaaataaataaagaaaaggatctaacagtacctttcaggaacaacttgtgaggacgtcccaaagcctaggtggtgcaacgctccaaggcatgtcagcgcgaaatatctggatggatggggt

SEQ ID NO: 67850 - DNA, 23512 bp, Oryza sativa
gactagttgcccaggaatgcaacatagtcttacataaatcatctcaagcatgatatccaaataataagtggttctaagcaataagcataaataatcttaataaggttctaagtagtacttggcgacaagccataaatattggttcatgcggtaagcgtgctacccaaaagcccataggcaaaccgactagggtaaatccctagttagaaccatcctggaaatctgcaacatcacaagctgcatcaaactcctcatccaaacagtcattacctgcagcggggtctaagcataaacaagtaaaagaaagcaagaaatcagtacattaatcaaattaatgtactggcaagtcggaaacaatcctagcatactacatgttggccatattcaaggataagctgtgtataggttaatttgcataaaagccaattttagttcataacatgtttcgcaacggaattttataacaatagtatagagtaagtaaaacttgtaatgtgaatgaataaataacacacatctacccctcaaggtagatcatcaccactctccatcatctcatcaccattcaccgaactttacccaagttcacaaacaaaacattccaaccattttccaggttcacaagagtttatcaaaatcacaaattatactcatgacacttcaccatgccgctcatgaccgtgagcacggctaatcgattagttttagactctgcagagtttgtacaacttttaagcccacatgatatggatcgctctagtttttttcgatacccgtcggtatcaccacactctacacattgagtgtgatctagaggtcataacggaaccgttacattgtttattgtctagccttgcaccagcacgatgtgtgttttacccacgctactagcaaggtagcgccactaggtagcgggcccacgctttaacctagcgccgtaaggaacccagcccggaatccctcacgaggcacgacaccgttgtattggatagactacccgctaaaatcatcacataccacatatcattaatcaatttcatcatatcacaaaccataggaagttccgataaattaccaaaacccggtaacccatacccttcggcctaccaagatgcaaggctaaactctaaacaacttaataggttgaggccaacccatacttagcacatgtggtttgtactgttttcattagttggtgacatagagtggggtccttaatcgacccgggcgaacgctccccctatcggtgtacaactacaccatatgtacaccactcgccgcccaagtctaaaaacaagttatctccattttcagttcacgatactcacacatttaaatttctatccagcaacatcaaaataaccattttcacatataacatttagcaaaacgagtaatttgcaaggcggtaaccgaatataagcatatagcggcaatataagcatagtataatcccaaagaacacaataattgtattcaaaagcactctatggttacaaccagcaaggattcaatatttcaaggtggattatgcagcaattaggtcatatctaccattcccacatttatatatatatatttttaccaaaagtaatactagctaacgtatgcatgtttgcaatagaatcatttaccccaataaaacttaagatcaatgtgatcaaaggaggggcaaacttgccttcatctgcaaactcctgaacctggtcatcaacaaactcaccctcttcttcttcgacgtactcttcctctatacaaaatacgcatatacgataaatacaaaaatgcataaaaaccaaaatgcatgaaaatgcatgaaacttatgcagtgagtgtgtgctggtcttaggtggtctctggtgaaggaatttttattttgtcactttttatttacagagatatgcattttacaattaaaaaggtttaaaaagggctaagttttattaagcaacatttttgtacagaagtgaaggaattacttttacaaagttacagagcatgatttataaagttaacagaagtggtttcacaatttttatagctatattcaatttgttatggatttaacaagttctaggcaacattatggcaaaacaaaaataaaggaaaagtttgtacagaaagtacccagttttatatttttttaaaatagctcacagctttatggatctaataaaactggtttcacaatttttgaagttaaaatgaattttctacaaattttagaagttctgctcattctctgttttaaaccaaaatagaaatcaattttcgaaattgaattccagccgggtccacaggtcagtgaaaggagatttgcagagaggccctcggaagttgggggaatcaacccgcacttcttctgccacttggacagcaaactttattaagagtccctattcttttgtttatttccatcaaggttctgctatagtaatatgagtcatggcagttttcagattggaccctagtgtcgatcaaattcaagaaatgaagtccccagctagctcacatcgggagcagccatggctgagctcggtctacggctcaccggcggcgatcggtggatcgaatcggttcgagcacaaaagagaaaatgtagaggacgttcttgcgcatccgtgagtggtggtggtgagggaaatggtggtctgtagcccatggaacatgagctacaatggcggtgtgtctcggtatgcccatgcatgtgcatgcagaggcttggttagtgcaaagggttagtgcatgtgctctcatatggtaccagggtgctcaccaagcagagaaacggaggcagcgaggtccagggagcggcggaggtggtggttgttggccaacgacggcaaaactccggcgtcaacgtcgccgggtcgactcaaggcgcgaactgcaacttcgagagtacgggagtgttagagatgagccacagagggtgcatgcacgaggaatccggcggaaactcaccggagcttggtgttgcttcggtggtgaggaacggcggccggagcggcgtcggcagttcgggtggccggcggcgaggacggtgacgcccaccacgtgctcgacagattggtcctagggcaaaaggggtacgggtgagctcggtgtaatgcgtaggtcacgttccataggagggaagagagagggactcaccggggatgcacggcgacaacggctaagtcgccggagccgggtaagacggccgagctctgggcattctgtgcgtggggtgtgttttcttgtacttggaacgcgatgtggggagtgtgttgttgcttctggtgctttggcttgggatataaggaagagtggagtgggggagtgagagagagaggtggctggtgctttcattgtgttccttgggcatccattgggcatgggggacggtggatgctgtgaggggagagtgggaggctgtcatgtgggtcccagagggtgtggggcccactgtcagtgaaagaaattcgaaaatagccttggaggctaagtcaaagagggttgcctgccaaggatctttggaggggattcaaggtggattttgtgcagcaagaaatctgggctagatatcctcttggtcaggggtgatgtggagagtaaatgtgctgaagtggattgggttagaagtctctggtttaggtttgatggagtgatgaacatgtattgacagtgttggttagcagcagttgacagtgcagttagcagctgattggatttttggagggagagaagaaagggttagagagtgatccagggtgtgccactcctcagggtgttagaagaaagttagtagaagactttggctgaaaccaaacttcaaaaagaggttttgaaataaattttacagagagagcaagtttgaatctgctaagcagttcttttcaggattttggagagattaaaggagatcaacaagttagcaaaccttactgaaaaactctgaaaatttgtgggttgatttctgacatatcaaggttttttttttgagaatttttgtggaagttttggatgcatataattaccagattaattgtttttgtgactctaggcctatcaagatgcatatgatgagatgattaagatccaaaaacaattaaaatcactccacaaccacatgatgcatttaaattaaatttagttctcaggtttacaggcttgggtatgttacacaactactaaaggtatattttgtctaaactagcaaaatggccatatgttacggaattaaaaataccacgttggaacattgcaaagaagacacatctattttgaatttcagagcttaattttagaattatttagagatttatcatatttttgtattttagctgtaaaaagtttcaagcggactcgattgacttgtacttctggccctatacaactatttggaggggatagatagtggtcccacatatcaaaatttggggagtttggtggtggcagtagattcaccactcaccaccaccattactctcttttaaaggagtatagattttgaagtcagcgcttgataggcctcttgtgttttagtttgtccagtaagctgaagccctactgccttgtggaagccctacaaagctaaattaccagcttggaggctgggagcaatgccaaacagatgttggtgatttgtatggtcactggccgttgcggccaacatttcctgcctggaaccacacatcagttcttgctctgatgcattcttttaaaaaaaatatatactaatcaaattatatggttcagctcacttatttgtcttcatgtcatcagtgcttcactacaaagccaagataccatatgcttgtaatccatcaattcaacgaacatatacataaattttcttccaaatcatgtcttctgatttgacagatcatttatttttactcatatcatcagttcttcactacaaagccacatgcctgtgatccatcaagtctaccaaaatatcccccgagcaaggaatatgatgctaagctgcgagatgaggaaatcaggaggtaatctgcgctgcaagattttcattaacagggatttgtttttctagcatctgtaaagatgattgtacgatgctcattttcctgcatcaactttcatgattaaatctaagacttgctgacaggaaaaggatgattgcattgaaaggacaaaataatgaaactagacgaaggaaacaacctcagtctggaaatggagatttacaggtaccatgatatttcattacatgtacatctggatgttttatccaaagctgatgataaacctagcgaagtatatgtaagatctataatcctgactcctaagcataacttttaaagctggaccggcgatcaaactggtgagtctgtctgccggtttgaccactggttcaaaataaataataaattttgtgttttgtatgccttgcttcactcaaaaggcttaactaaatatatcttgctttcaaagtcacccaacaggccttagctgcagtgcctgcatagggggaggtggtgggtttgactccccacctgtccttttcccagcgaaagtccttacctggtccaaccacctatggttttctctggttctttgtgaaaccttcctgtctaaccggacttttgtggttcacatgcatgtccggtctttaagttaaaccagactggctctggtagtccggcttttggtttttctggttggtccggttatgataactaggctcctaaagcactatacttctgatactattgaacccacgacctatgtttgcatttgcaagatactgttttatgtatccttgtgaagaaacacagaaacacagtattctaggatgccatgtacctcatttgcctgggcttgtttgggcaccataaacgtgaggatgattgctttctcattcaagagtgcaacttctgtagaaattgatgtagcaactagcaggtgtatttttcagttttattatgtaacttctcatccacataagttattgcatatgccatatccactatttgaacggctgagtctgagtttgatgatatgtaaacccctcatttatgtgcataactacatctagcccaagttggtgatttagctccatgaacatagaacaaggagctagtgtgccatagtttttttgacatacgtttgccccaaccaaagcaagaatcagcaaagcaaaacaatcttgctaaaatggcatctaaaaaataaaaattatgttagatgtatagtgcctaactggtgttgcaacaatctattttgcacgttctctgttgtaggttgttagtctcaagtttttgcttctgttgtgcagcaacgacgggcacaggcaaatagaaaaggcactcggatggatgacggcattcgtggctttagaattgatcctccagcaagagtcggcgaaaatggcattgctcagcgtgttcctctgttgcatgctggccgttcatcgtctactctgggccgatcgaatgagactgatgaaaagacccaaagattttacacatctcagatgccgaacttgtcttgtgctgctgagccacgaggcggtgctactcggtcatctaaccatggggatggtgccaagaggccacatttgagagagcatccatctaggtcaaggtacaggcaattaactgctgttgattcctccggtagatctgaatggacacaccagtttcaagaaagaccgtcatcttcccatcggaaggaaggtggggcggctaacaaggagcatactgtggtgagtcagctatatactatataaactttctttttcatttgtgcgaaaaaaggacaggagaaaattaagaccgcatttcaccattcattgggtaattacccgcctctatacattaataaaaactagcgtggggcccgcgcagattgtgcggctagcatcattatattttctctcatataatagaatatatgttttctcattatattattcaaatatattaaaatgacaacataattttaaattttgcaataactttacaaaactactaatgtgtaatattcatattgtattttatatacgtgttagttattaattattttcaatatcaaattttagttatttgtaaattatatgtattcctatatggactctagactcgtcttttaatatttttttaaaaaaaattctgaattttctgtaaattgtatttttatatagactctatgctttttttccaatattatttatttttatttctgaatttttattatttctaattgtatttctatgtggactctaaacttatctttcaatattatttaatttttaatttcgaattttagttacttctaaattgtattcctgtattgactttaaattctacttcccatgtttttcttaatttcgaattttagttatttgtaaattgtctttttacttcccatgtttttcttaatttcgaattttagttatttgtaaattgtctttttatacggactctaaactctaattttaattttattatgtttattccaaattttagttagttttaaattcctatatggactctatactctacttataatattccttatttttttaattccgaatttcattttttttcttaaatgtatttctatatggactctatactctacttctaatatttcttatttttaattccgaatttcagttatttcctaattgtatttctatatggactctatactctacttctaatattccttatttttaattccgaatttcagttatttcctaattgtatttctatatggagtctatactctacttttagtcttttaatattccttatttttaattccgaatttcagttatttcctaattgtatttctatatagactctatactctacttttagtcttttaatattccttatttttaattccgaatttcagttatttcgtaattgtatttctatatggactctagtctcctcttctaatatttcttattttttaattccgaatttcaactatttctaaattatattttcatatggactctagtctcatattctaatattccttattttttaattccgaatttcagctatttctaaattgtatttctgtatgaattttgctttttctttttctccgattaatatgagaatttctaggtcatgagagcgaacgtggaggcatgtatggcgtatcatcaggtgaatggcagtaagaagaacaggatccactactctgggccgttgatgcctcacggaggtaacatggaggagattctcaaagaacacgagcgtcaaatccagcaggcggtacgaagggcgcgcatggacaaccaggcaagaggcacgcaggcgttacggacggatcgctgattgatctagttatgcaagggagctgagctgcctctggtccatccctgaattcctgatgatggacagagatttttggttggctactatatatatattgttggcatgcattgaattgttcattttttgtgttgcccgtccgtcttcacttgttacttgggcaacaccaaccaacaaaagagcggaagaagagatcgacagcgttgctggctgtacagatagatgatgtaattgtaaccacacgcacgaaacagatatatatgtagagatataactggaatggaaaggaaaggaatgatatatacactctgtcggatggaagttgttttttttgttctgttttgatacactgcactgtatgtctgtatgtagatgagagacatgaaagagtatatgaaaaattgttacaggcgaggcgatcgttgcaaggtgtacaattaagtcagttccactcaaactgcacgagttactgcaaattaaaaggcaacaagttaaggtcatgtacaattgttctttcttagcgttgctaattatgaatatttgttgacatggaaaagagaaatatgagagataaaatgttattgctacggtaacaatggcctaacaacgactcttaaactctatatggaaacatggttacatgagggtgaaaaatagaaaaaaaagttaataaaataaatattcttttagttaatggttagagcttttatcgtctcaactgttgtgataatgacatagtttttaaataatcttatattggctaagtacaactgttgtaaagatatactacctgtgtccaaattcatagctaaaaatgcttatattttgggacgggggaagtggtttttaaataatcttatactcttttaagtatgtcctttattgtcgatccgtgtctagttttaatcatctatcttatttaaatttttttaaaaaaaattaaataaaacataaatcacacataaagtactattaatgttttatcatcgaataacaataaaaatactaatcataaaaaattttaaataatacgtacgatcaaaattggataaaaaaactcatagctacgtttaaaatggaacgagagaagtatttgtttctatcattgaacctgttctaagggagagaagtattgtttctatcattgaacctgctctaagggtgtgtttggttgccctcacatagggtggctcgcatccagcgagatgtggtgcatgcgtttgccgtttggttgcctgtttgcacgcgcgaaccaggctgtgctgatgcaaaatctgcttcccagccaggctgagggggaacgcccgattccttcgtagctccttgtccaggctcaactcgtgcaacgcgtggggacgagcggatgcaggcgcgcccgagcgggtgcaggcaacgcgtaggggtcggtcgatccgctcaccccccatctctcatttgtttctattgcccatccgattgctcctcgccgctcttcgccctcgtctccatcgtcgtcgccgcccaccatcgaggtcctcaaccctcaccgacttctccacagcctccatctccgtctctacttcacgggctggaaccggcggcctcgagcacgtcgccactcgccattggatccaacggagggaggctcgacggaggacgctgccaccatatccaacaaagagaggcagagagaggcgtgaaggagctcgatggaggtttcgtcgactgcccctctctgcgccaccgcctccaacctcgccagccgccggattcctcctcgctggtcacagattccccatcgtggctgcttctcttcccttcatttactagtaatgtgcccgtgctaacgctacggtgatattagtaatgacgatacaggtataacatgacatatgtgtgggtgcacatgacaatcaaattctcacaaattggcatagaaggttctccactataagttattttatgagacaaccacaaatgataaaaaaatactgaacgtacataaaaatgatatgatgataatgaggtttattttaatcaccgatatcttcttatatagtcttaataatctactgaaatgctcacatttgctgaaaaaagggaattactaatgaaaaataaattaaaaatatattaaagagcttttacaaacacatggtcggtgggttgtaaatattccatccagatcaagcattttaagtgaaatatggtttgtgattttaaaaaaaatgtaacatgcatctatactgcacaacagactaaaatcatagtatacattaagtgttatctccaaacaagatggttagcggtctcagtggcagagtaagatgcagagcaaggttatagctccttcaaaaagactatctatacaaaaaagaatcacaaatttcagatatgcatattcatattgtccactaaattttgcttacaactatgattcttccgtcaccatcgcattggagcagaaaagaaagtgcagcatatgcctaaaaccttgttgtactacttcatcaaaagttattgttggtgacttcgataattcagagttcccatcttctccccttcttgtattgcattgcataatctcgcatagaccatagtagatatgttccgtcttcttccattcttgtgccaaactcctaaattttcaacaaaccttgctgtaacactttgctctagaagtccttctaaagactcatcttttttgtcactgggaacccacaacagctctttgattggcacactttactattatcactttctacctgcatacttacaacacccaactaattaccacttaccagaacagctggtaatagcagtgtactgttagtttattaaccaattatttttctgcaaatggtagcacagtgcttaaaatactgaaaatttagcatattgtgtatataggattaattagaagcacattagatttaatagacaatactggaacctgtagcaaaaaggagttaatttgacaaacccttttctttttatgtgcataaaagatatctgtgaaagacaatttgttctggtttgtcctcttactttatatcagattattactaatttgtctctgcaataatgtagtagccagattttagagatatacaggcagggtgctgaaatggcacaaatctctaaatagagcaatcaaattgtatacacctgataaatttgtcctcaatattatttacgtaaattttattcagtttcagggacatgttcaagttcagagaatcattaagagcttgttttcagccgtaaattcagatttcagacacatccaaaatgatctgattttattcttttacttaaaaattcactttggaagcatattttgtgctataaaaatcaattaaaaggttgaaggacaacgagcgaggacagctagcaaacctcagctcaattgaccctacttcaggcatcaacggccaagcaattactccctccgtcccacaatataagggatttttagtgtttgcttgcaacgtttgaccactcgtcttattcaaattttttttgcaaatataaaaaacgaaaagttgtgcttaaagtactatagataataaagtaagtcacaaataaaataattaataatttcaaaaaaaatttgaataagacaagtggtcaaacgttgcaagcaaaaactcaaaatcccttatattatgggacggagggagtaactctgtacatgaacctgcttgttctgatgaggagtaggctccatgaaagctgaacttgatgcccacctatctgagacctatccagcacatggatggtatcttgatcttcaccagatgacctgaaaatacaataatacaaccaaagcaacaaaagatcaggacaaatatgtattaggtaaagatggttagcaaagaaaccatgaaggatttattaaccagctgttcaagcacaacttcatacaaaattgtaatataaaaagcatgaacttcctaaataatcttctttgtaccaagcagtcctgaaagttccaaattgactggtctctatctaagagatggaagggcagagcttttttatggttttcatcttttcataagatcagctaaaaaagctcagtgttgcatagatatataaagataacctaaagagatacaaataattcttggtcatgagggcacgagtctaccatcataggcagtagtccatagagatgatcatttagataaataattcattggaataaataaaaatacaaaatcataaatcaagcctgctctccagggacaaataatctggtaaatttataagacgtaaagaagcatgtgcattgcacaaacttattgtgccatgcaaaccatatacttcctccgtcccaaaatgtagctacctagtacaggatgtgacattatccagtactacgaatctagacagcctcccaaaaataggaagtgcatttcataccaaccaagaaaatagttcgcctataataatgactcaactcatatattctatttatatacaaatcaaaaaaagaatttaaagaaaaagtatatatacaactcatatactctctaaatttctacatctcttctatgacaggacctgataggttaggggaaaaatgcaacatgctggataaataaatacatgctggattgaaaccatttaaaatcaagcaacttgttgatttttatcttattgcagcagctacattttacaactcgcgaatggaaaacctcaaaatcattagaaaaactatttttattgagaaaatgattacctaaataaccaacagaaatcaggaaatggacctaataaagtggatacccaggcagaatgtttccattcaaataaaaaaagaaatatcttgtacttatagagcataaaaaaacccaactattaccgagcaagcacctgaacagctccccttccatcagtcccagcacctccttttctcccctcctagcttctgtaaaaaacaattttgccaatcagaactgatgttagaacagcaaaagaaaaaaaactgagagaaggtcatggacccatccaaaaataataataatatatgattcgatgcttccaaatggttagccttggatcaatcataaggttgaaaccgtaatggtatggttgaaagcacaacaataggatcaaattattttaccgtaaccaaattgttgtgaggcatatccctacgaaatctggaagggaacgcaaattagctggtggactaacagaggtagatcaggctcgctaacatctaatagtttgctcttgtatcgtagtcaaaatcaaataggcacaagaaaaataatgaactgggatggagaagaatcaaacttgccgtagagctctagacaccggacgtctgggcccgaagaggaccgagcgcgctacagagacttgcgggaatagtggtcaggcggcgcggcggcgatttgatgaagtcccgatggagagcggtcggcgagacggcgctagggcgagttggcgcgatgggcagaggggccagatggggtggcgatgaatgcgcgagggcgagcatcgggtcggcggcggtgccgatctgtgcgacggcgagggcgagcgtggactggcggctgctggggataggcggcgacctggcggaggtgaatcggcgacggcgcgatggcaggggagagatgagggcgtcctgtgtcggggcgatggagagcatggcgaaccggcgcccttgatgatggaggattgaaggcctcggtggcggcggcggcgcacttgacgacggagcgggaggggagagagaggcgcggatgcggtacgggagggaggtgcgggggagtcggagagagatgcgtgcatgcgggagagggcacggatgcggagggatctggagacgtctgctcgatcctgacgcggaggggagggatgcggggagatgcgggagaggatgcgcggtcgagccgatgcggcgtcgattgcggcagagagagacagggggtgcgggagaggaggaggagcgacacgcgcgcatctgggacgtccgatctaactcatcagatgattttacaccgttggatgtgtgatatgatgttcaattatagagtagatcagccaaaataccaatggatccggcggccacgagctggacgtcgccagatccggcagcctcgggctcatggccaccggatcttgttgctctgatagctgcgaacagcagcgcgcacacgacggcgaacggcaggtcaaggcttcggcggagcggcaggcctagcgacatcaacgaagctccgctcctctcctctccgtttttttttctgtttttttttctttttcaccgactggcaaaccgtgaccatgaaatgtgggaataatgatgtttactgtatgcattgctaattatttcacttattttatattgccgtacagatgtgctggtgtatatatcctgctcatttgacgattcttaaaataatcgttgccacgaacttcaatatcaataattaatatagaagataaaatcaaatgtttagtacttagaaatttaggcccccatcgtttggcttttttcctgataagccaaaacggcttattagagaataaaaatgaatttgtaggtaaaacttttatatatgtgtgacttaaaagtcaatactgtaaaagaaactacgttgaaagcttaaaatttggctttttctttggctgtttaggccattcgatgggagccttacactcttcttgagttaaattttagctcaccgcagtccccaagttctatgtgataatctcaccctttaaaaaaagagatacctatccctatcgtccatgcaaccaaccaaacaaattctcttccaaaccgtaaaccaaccaaacaaattatctttcaaaccgtatctcttgtatgagtaattaaaaagagatatatggctagcctaatgcaaacaaccaaacaactgcatgtgtatcctctcaaccaggtcaagctcagcctggatgagagagatgggcaagactaaggggatacgagcaaccaaatgcaccctaggagtaaaaggagcggagttgaataagcggatctcctggactagctaggagtaactgttatcgatcgatttttagctaggaaactaactaaaacatatgcatgggtgatggatatatatggctggtgttggtcgttgcatccgctcttgtcgtacgaccatcgatctaaccggggggggggggggggggctggccatcgatcgctggagagcacagcggagggagatcgaacaagagacgaatagccagcaaaataattaaagaggtagctggagagaaggagagagagagagagagagatcgacgagctagctagatggcttctttcggcgtggcccccgttggaaacgcggcgagcggcaagaagatcttccggaccaagtgcgcgcagtgccacacggtggagcgcgggggcgcgcacaagcagggtcccaaccttcatggcctcttcggccgccagtccggcaccacccccggctacgcctactccaccgccaacaagaacatggccgtcgtctgggaggaaggcaccctctacgactacctgctcaaccctaagaaggtcaattatattaattatttctcttttatttactctagctaatttaattaattgttgttgtatatgtataattcctcaatcatcaacaccaagatcgagtacgtacgcaatttgctaataattaataacggctgaggctggctttgcagtacattccgggcaccaagatggtgttccccggcctgaagaagccgcaggagcgcaccgacctcatcgcctacctcaaggaatctaccgcctaacccatccatccatctatccatcatctgcttgctgcaaaatatatatatatatatcgtatcattatgtttgtgtacccctatgttatactccttccgtattttaatgtatgacaccgttgatttttcgaccaacgtttgaccattcgttttattcaatttttttttgcaaatatgaaaatatttatgtcatgcttaaagaacatttgatgacgaatcaagttataataaaataaatgataattacataaattttttgaataagacgaatggtcaaacgttggataaaaagtcaacggcgtgatatattaaaatatggagggagtagtatatagcatctatctcaataagcatgcatgcatgcatctgtttaattatcgttccaaccatgcgtgcgtgcgtatttgaaattaagaagcatcgtatttatcctcttctactgtaaaagcatgcatggatatcatatcgagatcaagttaattaatagtagcaatgcaaagcatgcaggatcagaaatgtgagaacgaaacatttgatgtttccgagcatatatgtacatttaaatgtgttcttcttcttgttcgtctttggcactatgtgtagtcgttctgtcacctaatgctcttgccatgctgcttcaagcttacgctccacaagtttgggatgagtgttccagagaagatgagattgccaaacgtcgtccttttcatcttctccgaagcccgaaggagatttcacccgatatatctttggaatacaaaagatgtcggtgctatcactgaaaatttgatacccgttctaaattatgctttaataagtaagacattttagtcttaatttaatcactattttttataaactcatagtttaacaacacaaaatttatatttttaaattcacggtgagaaaaactttcataatatacagttcacatgttgttacgtatttttaaagtcctatttgtttagctttacaagccagcttatgagccaaaaagtctaactctgaatgactttcgtacatatatttactaaaactagtgtgtcgacgggggatatccgtagaccggatatagagggtattggggtacgctggtacgagaatctacgtaatacgacatcaagcagacagaaaacagagattatactggtttaggccccttgataggtaatagccataatctagttgatatgggattatatgatggaaaatcacagattacaaagggagtagtggaactcgatggtactggcgagatcgtaatcgagctggtttgactagatctcccggtgacttggctcttgtaggctccgacttcgtagactgcggtggatgtgttggctatcagattcgatcccttaggtcctcccagggggtcccttttatatcgcaggtcaagcggttttcaagtaggactcagaaacatcggaccctgcacgatacattgacgacccaatcatgttcgagtaggactccttccatctgtgaaatccgtgatggattttcttaacgtatgcagagaacgtccatatacgcgtaggcatgccatatcgatatgtgacgcatatcgaagggtagagggtatactttacccgtaaccctgacatagtggaaatggttagtaatagactctatcactaagttttaatacaatattttatattccttatgcaggagttaacggttaaagtttgcacttaacaaccatcaacacacatctaccacttgtcctcgagctcgatccctatggctcgcttagggtagaagcaatgcattgacccaattaagccttacattcaatgcagggtgacatataccagcccagcatgctttcgggactacggacgataagacaacacatgccaacactaggacaggccatcgtcacccctcaaagggcacatgacgtggattgatcaggcgatgcggttgattaccatgctgcgctccgacccatagccatattgcactttcttccgatagctggcacgcggcctgatgactgggcccacttgccaagaagcaacaagactaaacacacctaacccttgtactggagcccatttgtaagagcggtcactgtgatatatcaccttgcaactataaaaggaggaccaaggccgaaaaagagtgggatgggccctcgccctagggggttcaacgagtccaaatagcttagctttcactacaacaagttaacttccagcctcgactccactcatggtaactcatttcgagcatccatagtccacacacaggagtagggtgttacaaactcgtgtggcctaaacttgtataatctcctgtgttcatctctcgcgcgattagcatatggacttgactcaccccctggatgaatctccaacgggagtactagcttcccccgctagaggagtttcacactccgacaccctcattgtcctgttgctcgctcaacggctcactaggggtaggaacggtggcggtggcatctcgctcggtgccacgctaatgcggcaatgcccacgttctgtatcacttgctgtcatgctacatcttgcgagcgatgacggtcctggctccggcaacctacttacaccgtcatcaccagcttcatgccgtactctgtggtgctcactaccgacttgatcatcttctcagtataggtcacgctggataccacgttcttaggtgccacgctttgcaccggaatttgcgccatcgggcatcacatccatgaccgcatcgatatccctccacagctccactcctcgctaccggtggttgcgtcgaagacgctcattgactcgaaggcgtgcatggcggtcgtcgtgctgatgtcccttggtgcatcgccatcctccacctcagcatggtatgtatgttggaattttcgctaagttgtacattgcaacaaaaccagaaaggctcaaatcttcacccttcggagcatacactgaaggcataataaggatgacgatgtggagagatcaatagagaatgagggaagggaagagagaggatagagggggaagagatggagtagatacattttttaaattttttttaatttccatgtgatcttgtgggtctttatttttttaaaagaaaattgttttatttttttcgctgattgtacatcatagttagaagagatgctgaagaatagcgtactgcggggtctggtgtacttgggccgaaaccggcccagaagcgaagaggcagaagaggcgcgtgagaggcggagaaggagaggagactagagagatctgagctctggtcagccgagccaagcctgccggtcgccggaggaggcaacgacgaccatgatggcgccgtccttgtccaccgccgtctcctctcttctcctcctcctcctcctagccgctgctatctccgtctcctcctcaccgccgatgccggaggacagcatccgggtcatctccgccgagaaaagggttcgtcagtccgatctctctcgtgtgatgtctaattttcatccacccgctgcacttgcaccttgattgtttgaggaccacaacttcaaaactatagcggctgaaagctcctctgtgactattaatccaaatcactccccttctttaatttatcgaccggtgtgtatgcatgcgtggatctataatttatttgtaatttgttgcactgtattaggatttggctcttgtttaattttcttttagcatggtctagttagtccttgcctgattcaccttgttcgccaggcactccgcacctttatcaaatgggaatatatacactgttatatacctatgctgctttgtactaccacttcattttttttccttttgattggtgaagcacagcaatacacttactcaaatgcaaactcctgcagatcgacctcaccagccccatagtcaaagttttcctcacactaaaggtaaattctgatatcgattcaaccaattgccatgtcagcaaggtctgcatttctagtcacacttgaacctcttccagctcgagaatgatgccactgcccctgaagcatctcaagttctactcgcattcacacccacagaggttgaacatcttgcgattgtcaaggcgaccagagcggaggggaagcgcaagaagaagatatatgtgcctctctctgtgaaagcctctgatcttgctgccgctccaaatggtgctcgcctgtactccattttgctgagcactccattgaaacctgctgaggtgacgacgctggaagtattttatgctttgacacactctttggagcccttcccagcagagatcacccagtcagatccccagctggtttactaccgtgacagtgctgtgcttctatctccgtaccatgttctggagcaggttacctacatcaaaatgccgagcaatagggtggagtcctttacaagggtggaccccaccagtcgagctggtaatgaagtgaaatacggcgcatacaacaaccagcttccaaactcgtatgtgcccatacttgtgcattatgaaaataatcgtccgtttgctgttgttgaggaatttgtgcgcaaggtggagatttctcattgggggaatgtccaaatcactgagcagtataagctgaaacatggtggtgctcagcacaaaggagtcttttcaaggttagctgtgagcctgcaagaatcttacaccttgattttcatcatatctagtattctgctcttggaatccagctgcttgaactatcttattctagcactatcaatgtctggtgcaaatcaaatttcaaaaaatgcgccagcaaacccatgattcatgacttaaaccctgaatcctttattgacatcgactatctgtcaaccttcttccaacaatataggtcctctagcatcggattcaaaattttttaaaaaatatagctgaatatttctttacttctgttctggttatgtcacacatgccatgacgaattcaaacaggtgcatgcatctatttatatgctaacaacatgccttacagatatcagatatgcaattgagtaaccttttgtttgaagatgtatgatatattaacaaatcagtccttccgtgtattgttttggctaatttagttcattgctttatggttactcatttgaaacctttcttgctaggcttgagtatcaatccaggccttctataagtggagtgtcatcatttaagaatcttcttgcaaggttgcctcctcgagttcattcagtatactatcgtgatgagatcggcaacatatcttcatcccatttgcgtagtgattcgcacaaggtacaagatacttcttcatgtggtgtaatgaatcatatgctaatgagtggaatataagatatcattttatcttaatgtaaaaaaaactgagactaatattttgatgtgattgtttttctttaatgcagtcagaacttgaaattgagcccagatatccattatttggtggttggcactgcacgttcaccattggctatggtttgccattgcaagattttctctttgaatcagatgatggtcgacgctacataaatcttacttttggatgccctctgttggatacggtggtagatgatcttaccatcaaagtaagaatacaatgttttaaattttctgatgagacatatttctcatttgattctaattgtagcttcattaaagaaaagcaatattaagtcatgtagcagatggtcatgtccacgaatgttgctagattcatacagaatatgctcatgagtgatcttcaacctaaattcaaccaatcattttatttttggccatacttgattagttatgttcatttgtatgtctcctatttcatctcttgtacaacaaagcaaaaatagattcttgaggaacagactggattgatgtttgtttggaaggaaagattataggatttctcggcatgtttacagtcctacagcatcatacctaaaccttttaatgttacaggtcgtgcttcctgagggatcgacaagtccacaagctgtagttcctttcctgatggaacaatatcttgaggtaatcccatatttttctgtattggcattcttttgttcatatatctgtgttctatgttttaatgctaagcggcaagtgtacaactacaaatttcataatggttattatcaatagatgattcagtctaagaacattggcaagattgcattgttaattcagtggaatcatctatcatctgctaaggcctatgcatgttagactacataatgccagcattatcaccagtggcgaagccaccgtgggggctggggagggcctggtgatcagcccgtataatctggccatcagttactagtgagattaactaactgatgttatatgtggttgcaagcctcaaattaaaatgatgaaatgacgtgacgttgaatcatccatatactaaatatattactgaatttaaaatagatgctatttattgatctaatttaaaattggtgatcatccatatattagtagacacatacgtctaaaaccacatcaacaatcatgatttccataattataaaaggagcgactagacatatcatacgcaattgcgcatattaatataaacaagagccgattgaatatatctttctcttttagctgattgccatgatatgcatgatgctgatcacacatccacactctacagcattgtccatcgagccgcaagtgagctctctcatcttatagatgacaccccgaatccctaaatcctggcttcacccctgattatcacttgagccttctccattatttatcaatatggttgtttgactactagtaagtaattatgtccacagctttcatggtttggtttctgtcgtgatccgtggatagttctgtaggaatgagtaggtaacaggacaccagtaactgttacaaggaaatttcaccataagcatttagtttgctccttcatagatggattttcctatcgtttctagtttgatattatcttgcccttttcggatttcagttcccgaagattattgtttgataataatgtatgctaccaatgcagactagttattcataccttgatgttgttggaaggacgacagttgtactaaagaagagaaacgtagttggagagcacaatgttcctttccaggtactctctgacagataggccttgatacatttttgaatttgattggtaattgtctgaatgttgctgttgtgagactctatctgataagcatgacatctcggctcaactgcaggtgtattacgaattcaatccgatcttcatgctcgcagaaccgttgatgctgatatcagccgtgttcctgttctttgtagcctgcattgcttatcttcacatggatctttccattgggaaatcataggctccttgaaatatttagaggcgctctccgcacttgcccttctaattatcacagttgaatcaaggctgccttttgtgttagtttgtacggttcgcgtggggga

SEQ ID NO: 67851 - DNA, 2956 bp, Oryza sativa
acataagtgctcacttttgtggagagggagacttgaagaattgcgccagaatcattgtggcctttttttttgcagattaaagttggggcgcactggcaaagaaagaaactctggaagtgtgggaaatcgccatgtaaacatataatcaaatcgaaatcagacatgcgagatactcgaatctactccctccgtttcaagttataaaatattttgactttgatcagagtcaaattatttcaagtttgaccaatttgatagaaaaagtagtaatatttttgatccaatataaatttattataaaaatatatttaattattaatttaataaagcttatttggtaatgttaatattactatatttgtatataaacttagtcaaccttgaagcagtttgactttgacaaaagtcaaaacatcttgtaacttgaaacagagggagtaacatacaaataagaaaatctcgcaacatattacgaaatgaatcaaatcgaaatctgccatgctagatactcgtatctaacatacaaataaggaaatctcgcaacatattacgattatgtatatatataaaatgaatcaaatcgaaatctgacatgctagatactcaaataacatataagtaagataatctcgcaacatattacgagtatctaacatacaagtaaggaaatctcgcaacatattacgattatatatgaaaaaaaagagtgaattgcactttgggccggttattattgcctgtgttttattttggactaggttatatctaacgttttcactttggtctaggttttcttgccttatattgcacattggaccacttttttgtttgccactccttgatttcattagcgagcttacctgcaacacaataaaccaatcattattccacatgaccttgatttctttactcattgatttagctgcttgacttctaccattttttcccttaatttatcatgtgagcttggaacaagtcactgtattgagcttgcaagcgacagctacagcagccagctaccaccaggcttgattttgctggttcctcaagctcgggaacagagcagagagagaaggaaccctggtgctttgcttgatcatccctcagatccatggcgcggctgcttaatagagaaaaggagggaagattgatggagaagaagggtggtctaatttaaaacttctgtaaatttatctaatccaaagtgatgaagataacttcaccccttgtccaaagtgaaactttggtaaaaattcctagcccaaagtgcaattaactcaaaaaaaatgatgttgaaatctgacatgctagatactcaaatctaacatataaataaggaaatcttgcaaaatattacgattatatatgaaaaaaatgaatcaaatcgaaatctgacgtgctagatactcaaatctaacatattacgattaaatatgaaaaaaatgatatgaaaaagatgttgaaatctgacatgctagatactcaaatctaacatataaataaggaaatctcgcaacatattacgattatatatgaaaaaaaatgaatcaaatcgaaatctgatactcaaatctaacatataaataaggaaatctcgcaacatattacggttatatatgaaaaaaaatgaatcaaatcgaaatctgacgtgctagatactcaaatctaacatattacgattaaatatgaaaaaaatgtgttgagagtgggatttgaacccacgccctttcggactagaaccttaatctggcgccttagaccaactcggccatctcaaccgttggtaggattatcggtgaaattaaattttataacaaaaaatctcctcctttctgaaaaaaaaacttgcgctgcgttccccactcccgactccccacccagtccccactcaccagcccgtccgttgagtagtcgaagaatcccaaaccctctcctccttccatggcgatttgacccccaaaccctagcaatgccctagactaggactagtaggtagcggaaggaagctggaatcggaaggaaggaaggaaggtgggagggatgggttcgaaatcgaacacggagagggcgaggaaggcgctggaggccatgaagcagctgggtttctccaagaaggaggccacccctgtcctcaagaacctcctcaggctcttcggcaacaactgggagcccatcgaggacgagtgctaccgcgccctcgccgacgccatcctcgaccgccaccaggtgtccttgtcgccaaagccctcctctttttttttggtttacatttcgattcgacttacttagccgctggggttcttcaggagaccgcagctgaccgcggctgcagcgcgacaaggccaacgccggacgatgatcatcacccccttaccctctgtggtgcttcgcgcgacgtggatactgagaccgacgaacctcgcaccaagaagcctagggccaccaactcagatcctcaatcgcctccatcccttacggacgaccaagatgttcctgcagctatctcacccccatcccatggtgcttctcctcaattccgtccacagaccagggcctctgcacgactgcgccaagcttctccttcttctgttacagcagcacacaagaggccaagacagatgatggatgaagatttccaagactctgcattcctcagggaacccaagcctgagcccgatatcgatatggacgccatacaaggcactgctgctacatcagactgcccaaatgcccaccttggcctcattgactatccgctcaatgccagctcctcaagggttgcacttcctctggcattgcttccacctgatcaaaatgttccacagatttcaggttcgcctacaaaattttaattgattcatccatttgttgtcatgccgtggataatagggtaccataggtgttcatcacttccattattagattacggcattttgctgtttgctggattggcatt

SEQ ID NO: 67852 - DNA, 2114 bp, Oryza sativa
  unsure (1)..(2114): unsure at all n locations
gctcttttgggtgaaggtcaggtaatcagcctcgttgtttggctcacgcaagattgacaatgatgtttccacacaatctttctctctgtgtgtggcaactggcaaggacttccttgtgcacattggctatcgttccatccagagcgaggctttctagcttttaccgaacggctggcctttgcttagctaggctataactgtgctagccacctagctgttttaagaaaaagatgtagcctactatcttaagaacacatctttttcattcagttggttactcctctagtcctcttaaagccctagactaaaatatgccatatgcctttccatatattttctttggcacaatttagaatcttctagccttcaaaaactctgctggtaacaggttgcaacctttgtttgatatcttagcgtgataattttttaggggacgtctccaatagtttgatcaaacacatcttttggtcattttattgcattcagtatgcttagtctggttggactcatttaacctatgaactttatacaggtcctaaaaaaagggcaattcaaccttgtagcaaggtgaacacgggggaaggatcttcagtcattgatgtagcatcatccactatgggtgaggtcaaaatgtcactgaaatgcagtgttgacccaaagttccgcatgccttccttagaagcagttttcaagatggtggaggataaatatcttcactcatacaagattctgcctcctgagttttccattggtagcctcatgaatgagatatgccaatgtgttgtacaactgggtagtgatcatattgcagaacataatacagaatcagatgttgctggcaatgggagatgctcacaaaatgagccaatgacaggtagcattccatttgtgaagccaatagcatgcgaggatggtggaaataggaaatgtaaatctgcaggagaatcatttattgtggaagactcagaaaattcaagtgttgctaaacagcagactcatttggcacttgccaacttgaagcctatccatgatgtaactgatatatccaagggagaagagagagtgaggatatcggtggccaatgaatttgcaagtgagaaatgtcctccttccttttattatatacgaggaaaccttgttttccaaaatgcttatgtcaacatctccgttgcaagaattggtgatgaagattgttgtgctgattgctttggcaactgcttgtctgcacctataccatgtgcttgcacaagagaaaccgggggcgaatatgtgtatacaccagaaggtctggttaggacaccattccttgatgaatgtgtttctatgaatcgtttcccagaaaaatgtcacaagttcttctgtaaatcatcctgcccactcgagagatctaggaatgaagcttcaccagagccttgcagaggacatcttgctaggaaatttatcaaggaatgctggagtaaatgtggttgtaacatgcaatgtggtaaccgtgtggttcaacgtggcatcacatgcaatctgcaggtaatatttaatgcctttgacttgtattggtatttatgctatatttgtcattggcagtgtgcagattatactaatgccgaatgtttgaattactgtcaattcgaacgtccaggtatttttcacaggagaagggaagggttggggtcttcgcactcttgatgaactgccaaaaggagcctttgtttgtgaatatgttggggaagtactaactagtacagaactgcatgaaaggacacttcaaaacatgaacaatggtaggcatacctaccctgttctcttggatgctgattggggttctgaaggtgtgttgaaagatgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 67853 - DNA, 10485 bp, Oryza sativa
actctatatccatcaaatatctatctatgaactcttatcatatccttggttcaggaggattcgtcagttttgacccttactaacaactaaaaatgggctctgacaaaatctcagagaaatggtagctacattagcctgatgacacacgttcgtgtagaggcatagtttcaatgttcaatgatggcgcatgatatgattaaataatcatcatgtgctaatcttgccccgattaaatagtcacgttccgagggtatatacgtgtgatcaggaataatagccagagtcacacccttttgacaatgatcttgcaacaatatatacatttttataatataatagaaataaattacatctccgatatttatcataagacacacggtcataagtttgttaaatatataagatttttttccggtccaacaaaaaatatctcacggtatcaaatcgtttccgattgatggatctaacactgctcatcctgcctagctagatctaacgattaaatacgatttagtaccgtgagggaccagtaactttgagatattttttactggaccgaagtaaatctctaaatatatacatagagatatatagctattctcggctcttttataatgtagagtaaagtataaaaggctattttttgtttacatctgcatgtaaattaggtgaaatatatttgtcacacaataatatattacccctctgctagaattaatatagagtacttttctttatcttatatttcttagggcaaaatgagcttttgttatattaaagcaggattgcaatctttgtgcaaaatctcagctaggtctgatgtgggcttcttgccacacgtacgcacttaataaaacccataatcgaagcagcgatacttgcttgtcacttgtatcatgagttgtcattacgatgatcgacttacgaagttacgttttgtttggcataatttcacattcggtttctgtagttgggtatttttaattgaagaaatccacgtatatggatatgttgataatatttggatggagcactttatttctatttaaggtaaaataaagaattttaagccgctttaatttaaattgcaaagctcaaattgaacgtgggatttgagattaaaaccgtgtcaactaggttgtaatatcaaagatataaaagggccccgttaattaagccccttaatctcagcaacaatggcagatctccgatcttaggccgcttgaggaagcccattagttaactgattatgtttgcggtggctcatgagattgttttcagcctaccacaaggtccacattcatctttcaaaaaaaaaaaaaaacaaggtccacattccacacagtttttgtggctgtcgcatttaaacacaaatctcagcatcaagcatctagaccaagttgttggattcagcttaataaggaagtgttccctcggtccaaaaatatgttttcttttcttttcttaaaacacaatacaaatacagacacccacaacgcacgcatactcaccctgtaacatgttcttttcacattccatacaaattttgtgactgcctcatctttatcacaaaactcaccataaagcgtctaaaccaagttatcggattcaatttagggagttagtactccctctctgtatctctaaatatagtaactttatttaaactagaaatgttgccatattttagaaataaggtagtccattagttagtgaaattaaggtgccatttttcaaaacatgaagaatagattcttctgtagcaccacagaatacgagatatatgcacagagccagtggcggatcttgtcttgtgatggcgttgggatttgggcattggacatttggacattgatttcagatgctaatcatgtgatcactacgttagttggccactaatttaaagatttttggtgagaagatttgttgatcgacctaattgtctaacactaaagcaaaggcacaatcggaccaaaaaaataatagaaataagagcaaacacatctatataatcattgttgcgaaaattatttcactgataaaaatattacatgacaaatttagtactattatagttctccattttatttagtgccatgcatagtaagtacaattgtagtatagtttgtgtatatataaaaaacaattcactaattgaaagtacgtttgtagtatagttttgtacaattcctttcactaattgaaagtacaatactcttcatcccagtaatatataaattcgtcatagctaaattttaatgttaagtctggcactgcacagagacagagctggcaaagttgtcttgacacgttctttccacattccagacaaatttaattaagcatcaaaactctccttaccttaaatatagcaacatttctagtgcaaattaaacatgaaagttaccgtattttggaacgaggacgtctagaccgtcaatgaaattaaggtgacatctttgaaaattgaaaatatgaagaactttgcagcaccacagaatatatgcacagagctgataaaagttgtagtaagaatatatgcacatattatctttttaagagacgatatagtataaatgcagacgcacactacttgaagttagtaccatgcacacgtgagacatgtgggcataatttggctgattgcttcaattactagaacattagcgtgctggttggcacgctttccttatagcccgatacattgttcagtgtgtgtttgaaacatgaaaattttataagatattttagcagttagttcaactttcatgttccattaaatattgtattctcttgcatatcattctgagcataatctcctgtaatgttaatttgggattgtgtgttctctacgtttccggtggacgattaattataaatgttgagtttctaataatttcttgatataattaaatactattaagtattaaaaaagtagaaagtaggtggagttaaatattagacggactctaaaaaaaatattagaagattaataagttttcttaaaaaaggactgattgtaggaaaaaaaaagttatgggaaaattgtaagcttacaaagcttgctctcgatgatctataatactcgatccaactcctaaatgctagaagcagaatttgaaattaagttttggcctatgggcggtctttgtgttcactccacccctcatttttctaggtcactacagtctgctcctttctctttttaagtaaaagcagcaaaaactttgttgggcttgagctacagaaaagctgaaaagccctgccaaattgatcagtacgtgtcgtaacactcacctcttatttaattttcttcatgtcttacttctaaccattctgtcattttccaaccatattttatttaataaggggtattgtagttttttcactccatacttgatctccctaagaaaaagggcaggaatattttatacttttggagaaagtacaattgattcgcaagatatgatgataacaggaaacagaaaaacggaggaattgaaatggtcgattggcttggtgctacacagtgatacggtagccgaggagcatgtagctctttttttttattttccttttttaataactctaagttttcttctatcggatatttgaatgcatctaggagtgatgttgctgcaaagggctataatctagatatataaatttggatctagatactttaactggacttattttaaattatgatttttatttgattggttctagaagtctctatgtttattgcaagtgatgtacagtttagaagctaatctggaagcttgcttaactttttttttctaccgcatttatctgaatatttagctgtgacaagtggaccaataggcacacatggaatgtagattaggcgtacatgggagcttagtactcctaggatttgctctggtccaacaaaaagtatctcgaagtatcggtatctcatgttatcaaatcgtttccgatcgttagatctagctaggttggacaatcagaaacgatttgatatcgtgaggtaccggtacgttgagttacttcctgttggacggaagcaaatctcttatataagctagctactccaactccaagctcattactgtgtctcgcttgctctcgtcgacaaggagaagatggtgtccaaccacgacgacggcaagccaccggcgaagtggaagaaggtgtgcgtcgtcggggcgggcatggccggccttgcggcggcgcgggagctgcgccgggagggccacgccgtgacggtgcttgagcaggccggcgacgtgggcgggcagtggctgtacgacccgcgcaccgacgacccgctcggcgcgtccccggcgccggtgcgcgtgcacagcagcatgtacgcgtcgctccgcctcatcagcccccgcgaggccatgggcttcaccgacttccccttcctccccgtcgacggcgccggcggcggcggccgcgacccgcgccgcttccccggccaccgcgaggtgctcctctacctcaaggacttctgcgacgcgttcggcctcatggacgccgtccgcctcagcctcaacaccagggtcctccgcgtcgccatggcgcctcctcaatgtcgcgcccccgccgtcgccggcggcgagcggaaatgggtggtcaggtccgtacgcgtcggcgagcgcgacgacacgggtgttcaggaagaggtgttcgacgccgtcgtggtcgcccccgggcactactcgcagccagcgtgcccaccatcaaaggaatggaggcgtggaggcgacggcagctgcacagccactcgtaccggctgccggagccgttccgcgacgaggtgctcacggccacacatttctaatcaccttggatgctcgctctgccgccaccaaccatgtcagtaatggtaaccttgtattgtcttgtgtgctccatgtctgcatctgcgtgaaggtggttgtcatggtgggctgcggcgacagcggcaaggacatcgcgctggacctcatcagcgtcgccaaggaggtgcacctcacggacaagtcgacggaggaggccacgacgccggcgatgtccaagctgctcgccaagtacgccaacctccacctgaggccacgggtcgaacacctgtgcgaggacgggacggtggtgttcgtcgacggctcgcgcgtcgtcgccgacaccgtcatgtactgcaccgggtacgtctactcgttcccgttcctggacacggacggggtggtcaccgtcgacgacaaccgcgtcgggccgctgttcgagcacgtgttcccgccggcgctggcgccgtcgctgtcgttcgtcggcgtcccgaggaaggtgccggcgccatggttcttcgaggcgcaggggaagtgggtggcgcaggtgctgtccgggaggaggacgctgccgccggtggaggagatgctgcgcgccgtcgacgagcactaccgcgccagggcggccgccggcgtgccggtcaagtacacgcacgagctcggcggcatcgagcctcaggtacacagaagctaatataaaacggatctcgaattgttcttgatcgatgattaatcttgtttaatttgttgaatgattgatttggcgcgccatggatgagcagaagtacatcgagttcggggagaagtattgcgggttcccgcgctacgaggattggaagagggagatgatcgtgtccaccatcagtaggagggatgacgacgacatggagacatttcgcgaccgcgtcgacgacgacagtgaccatgtccggctctgcctcaagagctggcactgctcatcacctgctcgacatcaagcctctcttgctgtttctgctgctgatggccatcctcctcctcctcgtcttgcacagacggccaaggccatcgctgctgatgctctgtagctctcaagtctaaacgattggggtgtatggttttaatcctaaggttctgtgttcaatcctcaacacgcttacaatttctttttaaaaactctccctctaaatctccttttttttaagtctaaactgaacatgttcaggttcaggttcaggttcaggccatggctgaatttgagtcacccagatgatataaaatatcaggccattaagttttcaggaagaacattggcagaggatatacaagaaattttggcatcccgtcagtcatcactgctgatgaacaaggcagcattgtaaggtttggtctcgcttcttcttaaaacggggcatcttcttcttatatacaaaacgtcggcaacggcctgaccgttcgaaaaaaatgctctctaaaggtaaacagctaaacagacgggaagttgagaaagtattttatgaacctagatgcatggcaagttgcgttcagagtttcagcattttgctggctttttcatggctgctaatctggtgaaaacattagattaactttgtgcagaaagctcagtgaaaaacctgagcctccagcctatgtcacaaagcttttctgacccaacaaaaatctctaatatactaaaattatacttcattagacagtgtgtgcactgcagtataagacttagcttgtgcagatgtaagacatctggttctgatttccctcactgaacacaaagttggctgctaatataacccaggcacacgtacacaaagaaaataattggaactcaataatttaatccaccctaattatgtcttaaccatataaaaaactttcagaaaccaaaagtatttcttctccaatgcatcagattactcggaagaagaggtagacgacgtcgcgtccggctccggcgcggcgacgacatggacggcgaggcggaaggagaggtaggcgtcgacgcaggcgtactgcacctgctccttgctcagcctgcgcgcgtcccacctgctcgtcccgaccttcctcggcttcgtcgtcaccccgtcccacccgaggtgctcctccgccatgcgctgcatcgacgtgttccccatgccggccagcgaccgcagctccaccgtgcgcgccacctccagcccgtgctgttcctccagcttgcggcagtcggaccgcacgccgtagccgacgaacacgacgcgctcgtcggccaggaaccgccggagcgcggcggggacggcggcgtcggcgtgcgcgagctggaacaccaggcaccggtgccccgcgcacagctgcagcgtgcccggccggatcgtggcgcggcggaacggcggcgtccactgcacccccatgccgacggtggccacgccgtcggcgcggaggcgggggccgaggcgccaccgcgtggcgtgcacccaccggcgcgccgcccgcgtgcgcggtcaccgtggcgaccacctggcggccgccgacgcgcaccacgtactcgtcgtgcgtgcgggtggagcggtggaggcgagtggacacggcggtgaccatgatggcgcgtcgccggcgtgtcgagcagggagacggcagctttcaaagttgaaatcacacaccggattggatccaaaattccgggaaatttacggtttctgtgaaacgtctatataacttgaaatttgcaaagacaattatacattttctcggtgcgtgttaaggcacgattacaaccctatttaattgcgataaaattaattaattgtgactaactgactatgattatgtgttggtgcaatgtacgaatgtgtaacaaagctaacacttggcactctattttctattttccatatataagacatacttatacatacgattgccttacaaaagtcagttacatactgacattagtactttatacatgacacatttctatgaacttattaaaaattagtaaaaatatggtacattatggtgttcacggactatcattaggatggctatatatgtaggggatatgtagagattgttgcctcaacatcaatactgttgtaccgtttgaaatgctgctttcttcccttaataaaaccggctggcgtttccttttgccgacatggcaaaaaaaattgctatatatttatcgataaattttcttctaaaaatttaaacacagtgtaattacattataatttgcaaataatacaatgtaatttatatgtaactttcacataattttaaaccattcgatttgctttaaaatttttgcaagggagatagaaaaaaaaatcacaacacacacatgtgaggggattcggtcctattacctctgtttcacgaaaataatgtcacctaggaattttaaaagttatatacaagttgcactatatttacatgcaagttacaaatataattgcatcacaattgtaatacatttacatatgtcaaattatttgttaaaatttgatgacaaatctatagctagtcctagaaaaaattacaatttcataataccaagtcattcacaattacatcacattattttcacttacgtttatccaccaatacgaagtgcaatgaattagcacgattaatagataatacaatatacaagcacactgcacaacacaagcgcagacacaaattctcaaacacaaattatcacaggttgggtgtacaaaaattcatctgcaccactgcatctaaataaaaacatcttttcttacatctatccaccaaaagacgcttgtattatagtactccgtacatagtttttaccgaaagcgatcgagtaaatttctcttgtagtaaaagtaaactgcccgtacgtacgtctcaccgtcgtcgccggcgtgggcttcagatgtcgccggcgtcgaggtggacgccgaggtggaaggagaggcatgcgtcgacgcaggcgtactccacctgccccttcgtcaacctccgcgcgtgccacctgctcgtcccgaccctccgcggcttccacaccccgaccaacccgaggtgctcctccgccatgcgcttcatcgacgcgttgcccatgccggccaccagccgccgcagctccaccccgcgcgccacctccagcccgtggtgctcctccagcttgcggcagtcgtggcggacgttgtgggcgacgaaggcggcgcgcgcgtcggccatgaaccgccggagcacggcggggacggcgccggcgcgcgcgagctagaacaccaggcaccggtgcccgacgcacagctgcagcgtgcacggccgccgcgccgccgccgccggcgcgcggaacggcggggtccactgcacgcccatgccgacggtgatcccgtcgccggagcggaggcggcgggcgtggcgccacagcgtggtgtgcacccaccggcgcgccacgcccgggtgcgcggtcacagtggcgagaaggcggcggcggcggcggcggtggctgccgacgcgcaccacgtactcgtcgtgcgcgcgcatgcagcggcggaggcgcgtggacacggtggtggtcttggcggcgaccatggcgcggcggcgccggtgtgcttcttggcttcttcttggggtttcttgggagacgacgtcgtttattttagcaatggaagcagaaaatctttacctttttataactattgattgattgacttgccacttccaattttcaaaacacaaacctaatacaacccaaaattccgtgaaattttttcaagttttctaagaaaggggaatatgaaaacctttcacagcacgcggccttgaatttgcagagtatatgtgttaagccgtgttagtgtgtactgtacgtgtagtattaggtttagccccgtttctcgagaagataagagacatccctatttcagtttatgcatgtactaccacactgttttactttgtgataacttttacttatcacaaaacggatacgatccaaaatcccagaaaaattttcaactttcctcatagaaggggagttttgcatcttttatagagttgtaaactaagtataaataggcttgaattttgcaaagagaataacaactcatcatggtagtatgtgttaaggcacgtatatgaatgcgtaaaacattgtttgcatatgttccagtttttaagtactccctgcatccttttgtttaggaagtttctgacagtgacatgtttgacaaaatgaaagaacatttgaaatgacttttggaaaatgattttcagtgtatataccaacgtcaaatattaaaatatttttttgagttgtatatcagcgtcatacaaaaatggaagaagggagacaatattccccgtgcaaaaggaaaaaaaaaaccttgtaagtatcaaaacacgattccagattatggtgacatcataaatttagaagctggtactctagttactttgatttttatatcaaacgtagttatatacaaataatggtcttactatgatctatcacattatacttaaatcacactccacatttatcaacttaacaattgttgaattttttttagataatgtagcaattggtgatacatgacacatctaaacattacaaatttacaataccaagtcaccaacaattacatcaaattattcttcacttacacttacacttattttaccactagagtaccaattattattattaactaaatcggcatag

SEQ ID NO: 67854 - DNA, 5128 bp, Oryza sativa
ggcaccggctgcccacgcagagctgcagcgtgcccggccgcggctcggcgccgccggcgagcgcgcgggacggcggcgtccactgcacccccattgcgacggtgagcccggcgccggagcggaggcggcggccgtggcgccaccgcgtggagaacacccaccggcgcgccacggcggggcgcgcggtcacggtggcgacgacgcggctggcgccgacgcgcacgacgtaggtgtcgtgcttcgtctccgagcgtcggaggcgcgccgacacggtggtcttctgccggcgcgcggcggttctcgccctcttggcggccgtgtcgccggccggcgcgtctcccggcctcttgccggccatggcgcgcgcggcgaagaggacgccaagagacgtcgcttggtttcgcaggcaggcaactgaacaagaacgagaaccaaacacactgaagaagaaatggttagagacagagtgtgtcacaaactcacaattcacaccaccattataaactccataattacgtgtaaataactggcgataactaccccattaaccccactacgcccagaattatgcggcggtaaatttgttcgccggttgctgcatgcaaaactaccacaaggattatctattaaaaaaaaaaaactaccacaaggatatcaatcaaactggagtggctgccaaagaaaacagggttgccagaacaccagttgcgtctgtgatcactgaatagaaacaagtgaaacaaattgtgctcatcatcacaggttcatagcagttggccaattccaaattagtactatcaagcaagcaatttatatagatattagcagaatcaacatatgttcatccaacaagagtatgaaaatctgggactggcatataaaactcatcatcacaacttcatattaccaccaagcaatccctgcagcagcattgtatgtttttaggcatcatataagaagaaggatctgaaatccagtagtagcatatactacaagaaagattaaagatgacatgaacaaaattcacctaagaagataaccaaattggccaaagccaaaatcacctccatcacaaaacataaggagcagatataaatccttcctaactaaaatcccttgcttatcatcagtatcagcaatgaaatgtgggtagaaaataactagtagaaccctccacttgtatcataatctaaaagctcctcctcatcctcatcgtaccaatcatcttctacatacccgccctcctcgacatcgtcgaacgcctgactgttcccctcaaatgcttcatacccaccaccaccctcatcgacagtgaccgtgccggctccggtgacaatgtcatcttcctccaactcctcaagcgtggccactccatttctgacaaacatttcttcagtgccagccatgtcgtagttctcaacagtcagaattccaatgctgctgtgctcgttgtagctctgaacagtcagaattccgatgctgccagtgttgccattgtagtcatcgtcgtcgtcgatgtcgatgttgagagctcccatccccaggacgaagtcttcatagccatcctcatcgtccgacgagagcagtccatggccgacgagctcgaagtcatctgaagagaagacatggtcatctgaagcatagcttgatgagtggatcatggagaggccatcgtcgtcttcctcctcaatgtccgagtccgacgcggcgacgcgtgggcgcacgttgtccgtgatcttgctgctgtactctgactctgacgcgtcgtcgtccacggcggttgctaccagcgcccagtgcgtctgagcagcagcgggctcggcgcgcgcaaccgcacggtacaccgggggcgccacacgggcgcgcacgggagcgtggcgagcgggccgtggcgcgggggcggcgagcacggcgacgcgcggaccgagaggcacatggtggtggtagacgggcgcgcgcggagcgggcggcggcggcggcggggcgcggaggacgggctggcgcgcgggcgcggggcatagatggacggcgaggcggaaggcgaggtatgcgtcgacgcaggcgtactcaacctgttcgatggaaaggtagggcgcgtgccaggcgctcatggaaacgttcgtggcttggcgatgccggggtagccgaggaagcgatcggccatggcctccatggaggcgttgcccatggcagccacggcgcgcagctcgcgggcggacgcgacgtggaggtcgtagtaggcggagagcatgcggcggtcgttggaggcgccggagccgacgaatgtgatgcgggtctgcgaggaagcggcggagggcggcggggatggcgtcggcgtgggcgaggtggaagacgaggcagcggtggccgacgcagagctggagggtggccggtggcgggggaggggagccgcggtggagcgggcgtcggaggggggtccactggacgccgatgccgaccaggaggctgtcggagcggaggacgcggtggtggagccatcgcgtggtgtggacccagcggcgggcgtaagccgggtgggcggtgacgagggcgatgacgcggcggtcggcgacgtggacggtgtaggcggcgtgggtctgggtggagcggcggaggcgggtggagacgcgggtggcggcggcgtccatggcggcggcggcgggaggaggggagatgggcgagggttttgggtgtcgtcttctccgcgtctgcgtggttaagttgcgaaaacctcgtggttaggcggtttcgctaactcgcttcatcatcacatacttggatatgagattttttggttcatttttggcacgcttttagatccaagattcattatggatttagatttaataaagttttactattttttttctctaaatagagacagcatggttcatccaaaacttatgaaagtaattttagatctagttaaattatctttggatttggaaatataccaaatagatacataaaatgatttaaaagatatttatgctactcttaattagagattgtttggttatccagaattaacgtggaagtcattaatacatactatccatgaagcattgagaattttacgatcttcctattggtataattgaggattttgtggtttcacgccttgctggaatataagctagtgtcatatgagacgtaaagtcttaatcatatcggtatcgtataaataacttaattatcaaatagattatcatattctcttatattcagtgacggagctaggtttggaggagaggaggggctcagccttcttcttcctctttcagcccccccctctctctccccctattttcttcatcctctccctctttccccccctcccgcccccacgctggctccgccgctgcttatattaggtcaaaatttaccaaatagacgctaaaaatgatttaaaagatatttacgctactaaatagagattgttggttatccagatttaaagatatttacgctaatgctagaaagcatggttcataatatcgataaactatttttggataatttcgaatgaattttgacaaggttaaatgaaattcattacctctcaataatcgagatgcacatttcgagtcggatcaagatgatagtcgaggttgtgaaaggtacaccctagaatggagctagtcattaaaataggttatccacaaaggttgagaatttccgagacatgtttgcaattgaggactcattgagtccttttctcatactccgtataatggccttgttcatacgtggctcttatcccgtaagtcaggtataaattcccagttatcagtttcaccagaaagaaattcaattatcatttgtcaattagattacggaattttcttagtattagctcaatttttcagtgttcatgaaaataataaatcacgttctgatgttcatgtctatcaaaataccggggaaggcgcaaggctcatcgtacgaatgctacgacaacattttaccaaagcacattgcggcttacaactgtaattaatctgctagtctttttttttttgttcttttcttttgaaaactagagcacgtacaccggtacacgtatgcacgacaatacaagtgtattcccttttttatacatcttgacattttagataataatgatatggtgtccaaaatctatttatgactatgtttttaaatatatttttatttttgctatagtactttgtaagacaaatctatataaattgttctagttactttaaactaaacatttttgaaagggagtagctatatttatggcgccatatttttcactaaaaaatagtcggtatgcatttacattgtaagtccataaattacatatgtaattttagtgtatttacaatgtaagttttaaaattacatatgtaagtcaaaaaattacatatgtaattttagtgtatttaccatgtaagtctcaaattacatatgtaagtagatataaatagaagagatgctagtgcaaattcaatgggaaactaatgtataataggagcaacatgttcgtagtacagagagatcaaataactagagacttagcaaatcaaacgttcgttaagtcaagcattaacagtgcaacacgaatctacatgatatccaagggtcaaattaaccgactgtgatcaagctaattttgtgtcgccataaatatagcattgtccattttgaaattattgatagttataagagtttcaccctattttttaaaaaacattgctttttcaccgaaattaaatggagctagctggttagctgcgccctgagtgtcatcttctgtatatgacgaaaaggagtcgggctttttataaggggaactgttttaatccctcgaggggatatcctatcgttctttgcatgtcacttaaatggttatgaaaaaatttgaaaaaaattggaaaggtgtattaacatttgatataacactttacaaacatgcaagttcaaattcaactttacatctcgtaacaaaaaaaaacaaattgaaccgcagctagttaacgtatattcagagtcaaatttgttttttttcgttgcaagatgtaaaagtagaatttttacttgcatgtttgtggagtgatatatcacatattaatacatcttcttaatttttttttaatttttt

SEQ ID NO: 67855 - DNA, 3849 bp, Oryza sativa
gttggcaggcgagcacggtggagtcggctgctgttggcgccccgtcaccgcccaactccggcggcgcccgccccctgctcagcttcgtgccaccgcccgtctcggccccgtcggcgtcgcctacccgctgaagaagagaaaagagaagaaaagggaagaaataggagatgacgtagatagtatgacatgtgaggcccacgtgatcccacgctaactcagccgtcacatcgaataaaatcagggtcaaaaccaacaaagaacttcaagcgaacgcgaacggttttgatagttgaggaacgtctgtatctggttttgtggttgtgggatggttttgtaactcgatgacaagttgagggaccttcggtgtacttttttcatcctagaatatccacgtgactaggctgggccacatctataaagggccgtattagaggcccaacaaaacgaggcctaaaagggcttcacaactgaggaaataggacccatttctcattccggcccaatacattcacaagctaaccgacgcagggatcctacaactgtcggttggtaaccagtaacaaaaattacggctagtttaccattaattcaattgctggtactggtagagcagcagttgtttgatccctgtcactcaccgactacatcctcttaagcttaagcttggttaagtaaaccaaaattagtgtataacacaagctaaccaccattaattagagtaattaatataggccttatctatagcagtagtaggtagtgttagtttgcacaagggtgccaaaaaatgccaagcaaaaatgagcagttgtgaagagagtgaagacatggagtggtggagaagcaaagtgtccaacctcttctttaactgtagcctgcacatggccacatcacatgttgcatcactcactcactcacccactctctcctcttcttttctttttcttttttttgctggcaccaacaatcacatgcacctcaaaataataaaaataaaaaaggggaaaattactcttgctgaactcgtgtgagcttaagaaattactgctccgatatagagggggggggggggtaaaaaatgtactcttcttaattcacacttgctacctaatggtagatctttgcaacacaaacatctcaaaataattttcgatcgatctctaggagaaagaaaatccaaccggccggacaatgctagagaaatcaagaacaaatgaacttacaaattacaaaccgagcaagaaaggaggcgagcagaggtagatcagatcagatcagaatcagagcatcctgaggaagatgatggcgacggcgaggagggcggcgtatgaggggttggcgagagaggaggcggcggcggaagacttggacttggaagaggcggtgtcggacttggaggaggaggaggagtcgccggagccagaggaggaagaagatgcggagcccttcttggcggtgacggcgagcttcatgcctttgtagcagtagccatagctgcagatgaagtagtagtccttggcctccttgagctggaacgcgtagctgtgccccttgctgtagctgctaatggcgttcgccttgtcgcagttgtcgtacccgacctcgtccacctgcaccacgtccgacctcccgttctggtactcgaacactgcttcccacaccattgcgttgcgtcatcaatggcgatcgatcgagacagatcaagaagagagagatgaatcgatggaggtgcttacggagccagtcgcccttgtagaaggggcggtgcttcttgacccaggcggtgtagtccacgtcggggttccaccccttctcgtcgcccaccgtgtagttggtcgccaccgccgccgccggcagcagcgccaccgccaccaccagcaacggcagcatccggtggcacaccatctccagtggcagatcgatcgatctgagctctgagctgagcttgccttgaagacgaaggggaccttgcctcacctcactctgctctgtcactctggttgtctctgctctgtgtttgtctgcaatgatagcagctgtatgtatatatacctccatatctcttgatatctcatcctcagcttcagtaaaagacagtaaacttcactgtcaaaggttggatgcccagctgcagctggtagatttacagctttgttgttgttgtacattttgtacacatatgcaaacagccatactctgtctcaagaatataatgtgataaattcactgcctttttttctattagggggtaattaactgaagtttggtgatgatgtacagtgagacaaatgcactggctttattagggggctataaattatcttcagtttcatgatgctgctactcatttgtaactgtattagttactcattgctgactaaacttgcgcaattgaactatgcacctttacagtagtataagcagtgctagtgtgcaattgaactatactcaaatcatcattctatgattatcatatatggatactgaataattatgatatcaatggagctagccagggaaagtagtagctgcccagctgtattatttgaagtgatttagaagcaaaagccctttcttattcctcacaaacattcttagtctaccaaaaggattcatagttctccctataagaaaaggcaaaatgccagccgtggtggttgcgaaaatatatattgtcaacttatgcattcaagattgataatataggcaaaacgacaactgttagttgattgtgacaacacgatgatcatatgaaaatccaattcagtggaaagctttctgcaaagttggcctaataaatactatactagttttttttagaacaaatgctatactagtttaggtagctctaatcatacaataaacagaaatggtgaaaagctcaaacagctagctagctgcatataaacaatatgttcaaccattttctattgacaaaaatgaattctagaccttgtgctagcgtttcgtattttccagtacaaaacatgagtaaaaaactaagaacttcctcgcattccagattttactctaactgttgtactagtagccccatttggagaacaaagtttaactaaaaactgtatgaagcaattaaactctcacacaatcaaatcaagatagatatacgattgtaaaaaggtacatatttttaacctggaagtgaggaggagatccaaggtcaatgaaagaagacaggtagggagggccatgtgaggagatgcctctccatttgcccctttatttccgacaatgccactcaagttgatcagtatcttcttcatggccccagtagctgtgtactccatgagtgtaattaactttcttcttctctccaactgcttcagctaactttcttattaatgagcaccatttttctgctctcattatatcatgtggtttgcttctgttacctgctgacctgtgtttgtgtgtgatctactatctgcagactgcagctaccacttgggcttgctttgtcacatgcagttttacaccttttatttctccttaatacaaggtaagtgttggatcagtagcttgctcaatgctcactcatcctgccaaagagagactacagacttgttctgaactgtaaagtctgttgtttggatcctctgcatattgttcagtcttgtccttttgctttacagcccttttgcaaatgcaggaaccgtgtgataaaacagtagtagaagtttcaccggctcatggttgaagtaacagtgaggatggagccccagggcgaagccatgattcttcgagtgcatggctagaaaataataaaatgcatttttttcatttagatattcttagcttaaaatcgcttactctgcattggaaaattctgct

SEQ ID NO: 67856 - DNA, 8469 bp, Oryza sativa
ctgggccactttgggccttgacactctaggcggactagtgcaacatatgccccggcccatttacaccgccccgcgataaaaactgggtgagggcgaccaagaaccctaggctgtcgcggatccatcccatcccatctcttctcgtctcccactcctccggtgagccttgcctccctttttcctcgattcagttcatcagatctttcggtaaatccaatcgagttgatagggtttgatgtcctaatctatctatctctctctgggctgctgctgttgttgggggtggcaggattctttctgttcttggttgattgccggagatgtcggattcggaggagcatcacttcgagtccaaggccgacgccggcgcctccaagacctacccacagcaggccggcaccatccggaagaacggatatattgtcattaagaaccgcccctgcaaggttatacacctctgaatcttgttattgggataagacttttcaggacttgcatctaactgtactgtagtgtatggcgacttacatttgtgtatggcgacttacatttactgtattgtattgtattgtatggttgtgttgagtgtatggcgacttacatctaactgtattgtatggttgcgttgggttaatggaatttgtcatggtttatgtctgccgttagcaattaataattgtagatttggatgtgttaaaggtattagatccactactcatagcaaatggactctctgttgtagatgtggatagaacaatagatgtacaataatcttttctttttttttatgagaccccatttgctcacatatttctcctatgcccataaaagttgtcgttggttggtgatgtatgccgttctttagctgatgaaaaaccatctgaatgggctcctgtctcgcgatatgctgcacaattaacttaagaattgttttcaataaatctttctgaggcatagtcctgcatattttttttattgaaaatgcaatgcagagataactctgtatgtttggaaagaattctatttttccttaggctttttaatcgtaaaaattatcatatctatggttcttgttataagttaatgattcactgatacattagtgttgctaagtttgagctatgcccatgtagtagtgccaggttatataccagccaagtgatctctttcactttataacctctgcctttactctgtcttttagacgttttatgcagttttgtcgatgtactgatttattcttgttatgtaccagaatttgaatacgctggtatggttttgcttgtaattttctgacttgattgattacgtgttgcctactgagttaaggtttatttaatttcgaattggacagatgatggcaagaatgatattttcccttatttgtacatcttatggacaaataaactgtcactttttgacccatcattttttgacccatcattccctgcgcttttctgccataagagagccattcgtagtataacatgtattatggtgataagtttggtttaatctatattatatataggtggttgaggtctctacttccaagactgggaagcatggtcacgccaaatgccactttgttggtattgacattttcaatggaaagaagcttgaagatattgtcccctcatcccacaactgtgacgtaacatacatacagatcatgctctacagatcatcccctaatcccacaactgcttgctttaactattttgttatccatgtatcatgcaggttcctcatgttgatcgtactgattaccagctgattgacatttcggaagatggatttgtatgtttgctttcaacctttcccttgctttatttgtttttatgaaaagcctgtacagtttctaacatggtaataaattaaatgaattttacaggtgagccttttgactgagagcggcaacactaaggatgacttgaggcttcccactgatgatactctgactaaccaggtcaatgatttagctaaaactctttatcatcaatgtgtgttatctcttcaactaccatactctgactaaccaggtcaatgatttagctaaaactctttatcatcaatgtgtgttatctcttcaacttccattatatcttagtcgctttcatgtctgaatctcagatcaagaacaatgtgtgttatctcttcaacttccattatatcttagtcgctttcatgtctgaatctcagatcaagaacgggtttggtgaagaaggcaaggatatgatcttgactgtgatgtccgccatgggtgaagaacagatctgtgccgtcaaggagattggggccaaaaactaagcggctttgctcgattgcctgcctgcctacgatactttgctatcttagtgttgagagctgagacacataaatagaagttttttttatgctacctgtggatgaaatgacgatcaaaaccttcatcgattttatgttacactggatggtcatgagatacttgttaatgcttttcattatcagtttcaagtatcctttgaatcgagtggcagctgtaattcgtatagtaaaagtgggaaatccattctgctatgagatgtgccatgggagcagccgtccaagctcaattcatcaaattttatgttacactgaagattaaactgcagcaggtggggcagcccaagctcctaaggaaacattcttgctatcatattctggttttcttctcatagagaattctagctttgatctaccatcagcaagtgtgtattaagaagagtacatagagataaaaagaaaggcaacaacatagatgtgaaataagaacatgaggagagtacataacaggggaaaacaatataccatcctgaaaatactatgcatctatacaatcctacggtgaacaactagccactaaataaaaggtgttgacagcaaaaaaaaaaaaaaaaccataatccagatgctaaaattactccagctgcgttcatcactgttaaagagccactgattttgattctaaaacaaagttaattacgcctgcttgaaagcgtgtgcgttggatatgacttcttaagagagaatttcctgcacataatttcatgcaacattacgcctgtttgaaagcgtgtgagttggatatgacttcttaagagagaatttcctgcacataatttcaaggtttaatccgatgaatgattaggtagaaaaagaaagcaacattagtaaactcctgtaccctgtcttctccatcaaaggtgacgaccctgaacgggttccatcctgaattactgatttcagctttcccgtttgatcagagaagtgcagaaacaacgtcatcttcttcagatagtgtttggttgcaggcattggcgaatgctttgggatcaagctctcccatcctcttgatgccaatgctggctcgatcacttgttaactaactccttcaaaagcctgcacttacaatagatattgatgttgatcatcagacaaagaaatcaagaaaggaaattcgatgaattgagttacatgtacgagttgtttccggacggcctgcaacttgtaattgcttgttcgttcattgatgagcaattgagcagagcttggtttgagcgactccattgctcacacatcaagtgattgatactccttagatagcaaagctcagataattgactttcttttcctccggacgcgtaaaagtagcacatcaatatattaggataattgactttcttcatgcttaactaaatctatttcttcacgattgtgtgagttcgcaagatatgtatttttttcttcatggtcctgtatcgagtctatgttttatgtctatcaaacatatgtgaccaagtagatttatagttgtaaatctattttagaacggagctagtactcgaggagtataggcagagtcctcatcagttgttagatggtgatcgatctccccatgaaaaaaaaaaactacaactaattagactccaaacccgtgtactccatgctgatgggagtataacttaataataataataataattacgaattttcaaaatatcaaatcatgaaaatatctcataataatgtttttccttaagtatcaaacgatactgtaagcaacaaattgcagcacacacacacgtccatgggagctcaacgcttcctcgtgtgtcctccactgcttaacgacgaactggatggcttcctccaatgtcgccttgcgcttctccttgtagttccacagctccgggaccgggcatcgttcactgggattgtactccttcatctcacgcagtgccgttgctaccaacctgtaaacttcttcaccgtgttcttctttcaactccctgagcttgccatcatccccacagagaatttcctacattggaggatgcagatcacatacacaaccgttaatcctaatctacacaatgaaattggtactgtatgtgctggttcgttaaaaaaaagaaggtaattttaccatccttgaaaagatacttagaggtaccacactttatagactaaaatttgatacctccaggtaaggttggaaatttcggtcattttggacccctccaatacgatattatttcagccgaaatttttcaatttttttattttttttcatgaattttggtaatatttgttcaaattcaactaaattttgttcaaaatttcggacccaaatcggctaaaccaaaaagtttaaccttgcctccaggtactaagtacctcgagttacaaaaaaaaattaatataaaatttaagtattttgagatacttttataaggaccataaaatttctcttgaaaaaaaacatacacaatcgttggtactatgagcttgctgccattctcagagagaatttcctacattgaaggatgcagatcacatacacaactattggtactacattttcatcatccatttgtcatcaagatatggcatgaatcaaactgattgatcatcgtctatatgaatactgactcctgtttgctgcgctcacagcgtttcgggggtggcgtgctcgcttccggcgctatccacgtcgacgcggagcgttagagcggctggttttgctgcgtctctgttcgcctctttctagccgttggatcgtggatggacggcgcctatttgatgtggcgtttggcccttccttttaaccatgttgatgggcttgcaaacaggagatcgacacgttagtctacgcacctatgcgtgcctatgcgtgtgttcgtttctttctggccgttggatcgcggatgggccgtgcttatttgatgtggcgtttgggccttggtttaaccgtgttgaggcgtttgcgaacaggagatcgacacgttggtctacgtgcctatgcgtgtgttcatgcgtggacatctcctatggtccataactctatgccaatgtggctctaactgaatgggtccagtgcactcggtgctggctgttttggccaatcggtgttgtgtgtcagggcggacatgcatgcgaggttggagcagtggagtgtcagggcagacatgcatgcgaggttggagcagtggaccagtagagatggcttttgtgagcatggtgcacatgatctgtgtcaatggcaggcgggccctcaccacagttctttgtgggccgccatcgtgcgctcttcctgccgtaatggtagtggagatacgggatcctagggtaaaacttgtgtatgggatgtgtccatggaccagtgtgcttgctacgggcactgggatgtggggcttggccaatgtgtctgtggtgcgccgggagttttctcgagccgcgtgtgctcctgctatgtacgacggaacgtggcacggtcagtgtgtggtttgttgcgtgcactcgggtgcactcggttcacggatattggctcgctgctgggtgggccatacagctggttggatagcgcttgtggtgtgggcagggtttacacagatacgggtcgaggtacaggctgaactgttcatgtttcacgccggtgaaagaggaacactttccctatgcttgctgcaaggttttctgctccctcgccttctgctcctcggcattcgctgttcctcttctccttcggtgtgttcgtcgatgtgctttgctgagcgataatggcgaacgcgaggtttgtacggatgaattacttaccgatggtttgcttgggtgttgccatagatcctgagcgaattgcatgtattttgtaggtgatttgagaagggctttgctgctgtgattggttgttcttggtttacttcaccctgttgcttcggtggactttctggtgatctaatctagtataatagatctggcaaaagagaggtatttgctgtcgctagcattttgcaggaacttattttccttttttggggttgcctcttgcagttcatctagctgtttggtcttgctggtggtggtgggtgagtgttgggtgcgcaggctctggggtaagaaaagtttctctttgcattttatctgtttggtcattttctttgcatgtggtttggttttcttgtgttggctgttgttgtgtgtgtgctgtcgttttcttacgtggagtcacgtgactgggccgtgccacttttttttattttggcttggtatgcactttgtttggtggctgtatactactacactgtattatattatcctgagtatttattcatatagataccctacggtagtgtgtctgtccatcgttggacacataagagcagagtggtaggtcgagtgtcttctttccttgaatgcttggctctggcctttccccttattaaaatcttctagccgttgaacttgggatgtgcttttctgtagtctcttctctggacaaactgttctcctccacttgcctatcttatcctctcttattttttttccttctcccattggcagtggtgtagccgcgatgttcgccgtgggagtatctcatgtctcgctgctgaatgccgctgctcagcattgcatgatacctagcattgcgtacctgtgggagtttagctccgatggtacgttgttggctggtattgaagtcagtctcccgtcgattggttgtgccagtcatctggacactatgttcttttgggagacggccttagctccacttcagagcgcacatgaaatggttgctgcaagagcactgaggtgtctccaacatcgttatggttttgtagtgcatgactacaattttaactctatgctagcttacagacggctggcacgtgatgctgtgcaggctgcattgtctgcttctggttgtgtggcacatttcagatcttcttatggtgcatttgttccttggtgtgatgatgttcttaggacatgtagctcactgtattttagttttttcgtagaagacatggaacaaatgggttcttttgaaatataggtgtttagaagttcctatctggttttagactgtgtttgtattgctcttggctattcggaattggcagtttgtattgtcagcttttcatgtattgtcagtaaaatgatgtttgtgttgctgatctgtgctgattgtataggcatgttatactgatgttgaaaaggccatgcgatagagtatccagagcacgtgcgagccgtgaaaggcataaagcgcgtgctttgacataggaaatatgcatgaggagcgccctggctttgccaggtgggaccaaaagagctcgctctcttatggattttagccctgcattggcagcttctaatagacaacgacgccgtctgcttcgaataggaaattcttcctttctttcgggtgagggatggcacaaatcgtatattaatctatgtcacactaggtgccttgcttaaaactaatatctgattcactgcagctaatgttgagcttgatagaggtagttcttcacgctctcacaaggatcatgttgaggctttaaagggtttgtgtttatttagatcccctataattgcgacggctggtttagcaatgttatgttagaagtttattgattgatgatcttgcagcatcgtacccggggaggtcgtactatggtgcaccgacgtacgagtgtttgtactgtggtgctgtgttttggttctaggagagggttaaaagtctttctgctatttcaaaacgaaaaatagtttacaatttgtgctgcaaaagtggtaaaatagagttgccgaaactacgtgaacctccagaacctcttaaaccattgttgaaatttaatggagatgcacgttcaaagagatttcttaggcaggtgcgatcttacaactctatgtttgctttcacctctatgggtgcaactgtcgatagaacgataaacaatggaagtgcaccttatgtttttaaaattaatggtgttgttcatcacaaaataggtagcctgctaccagcgcaagggagaaggcctcaatttgcacagctctacatctacgatccagaaaatgacatacaaaatcgaataaatatatttgacaatgatggcagcaatagtgacaaggctgatcctgctatagggctgcaggaat

SEQ ID NO: 67857 - DNA, 4432 bp, Oryza sativa
ggctttgtttggacctactataacaggcatacagctccatcacccggcgacggcggcgttggagctcatgccctgctagtggcgacgcaaaaaggtgcgagcgaaggcagtgaagtttcgagtcgtctgaatttaatgtttgtcttctggtgtatttaatatcgtatcatttatatacttatatcgatgtaccccaatactctcagaatatgatctatgtatatccccgtcgacagattaagctaaatattttattaatacaaatatcatagctacatattttattaagacaattactatataatttaagtagtcaaatttgttccttccatgttgaaaaccaaatacaaatttatagttactgggctaaatagtttattattattattattattattattattattattattattattattattattattattattattatttataatttaagttcccagtttgatcaaactaaaataaatttaaacagaccatgtgatattttggaaaaagaataatagaacgagtagagtcgagggaggataaatagaaaacacctaaaaataaaaaaaaaatagaaaaagcattgaaccattcgtgctaggctgctagcaccactttgtttactttaggagcctgcataaaatattttggacgagctctcgtgatgtgcaatttcattgcggacgttgtatctcagtgcccactttgatgtcattttttttaaaaaaaataatcagtttttgatatttatttttgaaataagttgtataaaatgattagattgtcaaaaattcgagaaggggacaatcgatcaacgcctgaattgtatcggtgtttccttttatcgtcgttttgtttggttgaaactacgagtactatacatgtaccaccggtggctgcgtgtacgtgcagaggtgcagccatatcgtaggaacgagagtttgtgaaacttctttatttaaaccgcatggtgttactataaagatacgtagcacaatttggaaaacgtactttaacttttaaaattaagttttcaaatcccttctttctatataaagttaagacccaaaactgctatctcctgcctccacgtcaccagctaattgaatccgttggatcaattcatatcagctactgccaagcgtaatattaagcaccatgatctctcttcagatgcactttggaggcccatttctcagtttaggcccaattgattgcgagctcagagcgcaagagaaccttcatctctttgttcgaggtgcctgtggctgcagcctagagcgacgacgcattgtcttctctcaaatcaatggcctcgctaattaagtccgttcaaatgcatggcactacactaatctacctcatcactacagttgttttgtgtgctcatacactgattcaataatccgaatagccattttttttctttttttccttaaaatgattcaattgaaagaaacttgcttttatagtttcattcataagttcacagggtctacagtataatgtttgtgatgtgcaataaactgacctaacaaaagaaaaaaagatgtcttcgtgcatgtctgggattgcatgcactttggcctgccaacacaatgcaataattatatatgcattttgtgaacgaatgttctatacatcctccccatctctcacaggtaatttggctatcttgatgacttactctaatggatcaacatgcaaatacaacttcaagttctttgtgtcatatcttattgatatcttattgctttctctttattattattattttttatttttacaaatatacttctttagtttaatcaagagaaaatttggcttcaatcaaatccgctctaattcctgtgccaacgtttagtgtccaaattgcctgcctctttcttcttctcttacgaaaccaaaacaacataaatttgtcttcagatgattcatctatattgtttcccttccttttcctctctcataaagttacatcaccttagttttgcttagttttgcttttagttgatcaatctataatttaaattgtcataaaccgtatcatctaaattgcttatagcttttttcaactatcaatcaaagatgcaaattttataaagtatataaaattatgttgtctagctactccctccggtttaattttaattgatgttttggacaatggcacggactacaaaatatatctttaaccttatttttctatcataatatatatattaaataaatacatgtttacttttgttatagtgctttgaaagacaaatctatatatatattgttctagtttctttaaactaaatatttttaaagttattaatggtcaaagttataaaaatttgtccctaatcttgtccaaaatgtcaattattataaaaccggagagagtacaaaacaaatcctaccattatcatgcaaaataaattctgcagcaacgtgcgggctttcatttaaattataaccgccatttgtaagctggagggcaaatgacggggagtcccctaaaaagatcaacaaccttgctacttgtacagtcaccgtcaggtgggccacgccactcgctcggatccagggccccacctgtcattagcactggccaatatccccaacttttcttcttttttttctttcccctttccctctcagaaaaaagaaagaaaaaggaaaaaagattcatctcttcctcctcgtcttgtccccttccctcgtcgaaaccctagctaggctcgccgccggcgacgcccgcctcgccgatgcgctcccccacctgaccgctccgcctcgctctcccgggtcgtcgttgcctcaccgctgtgcccgcccacccccacctgggcagcgggcgggatccagtcccagatcggcgccatgtccaaggccagggtctacaccgacgtcaacgtgctgcgccccaaggagtactgggactacgaggccctcaccgtccaatgggggtgagtgcctcccactcctacctcgctacctcgctcttgcttccaccctgtgttgtcgcctctgcatctgcgtgggtcagtttagattcagtgtcggatgttgcgtgctgatacgtatgataaagctttttagttacccgtttcatgactttgcaatcgccggtgttatcatcaagttattaggattgtaaatagaattgtttgtgaatcaactgctgctcttgttgttattggagttccattgtttcaggttgcatgttagattagtgatcttgtgcggagagctgtcaaattgtttagtttagatagaactcggtcttatttattgttacagtcgatttcaattaattatttgttatactccaacaatacaagccaaggattatgcaatatacagagctaaattgaagaatacgacttagtgtacactggtaaaccatgtcaatgaaatgaccgtgtagattataataaacttctcctacatcaaataatcataaattggatctatgctaatatgtattctatcactggatcaaggaaaccgcctgattagcttggaatggttttattggtactgtattcttgtattggtgaaagatgatataattaagtgtaacaacctgatatgagctgggctccatggcctttgtctagtatatgactaacagctatcctgattgattgtgatgcaatatgctgtatgtctagagtgcaacagtatattaccctctcaagtgtttgttatggtactagtgtttactgcttgttcttcatcttcctaagaaacgacaggaagatcatgttctgtaaaagcggccaaacaaggtcctgggactacgaggccctcaccatccgatgggggtgagtgtgtcctacgtcgcaattgcttcgcgcccacccacccacccatgtgggcagcaggccctcccgcatttgttgctgcctgtgtatctgcatgcggtgaattcatccattcagttagattcagggttggatgctgcatctggagtgtgtgctgttggaattctagacgtcggtgatccagggaaggtattgttgggtgcgagcttgattgagtcgtgcgattttttttattcgcatatattatattgggaaaatggatatactccctgaaatcattgggacaattgattacttactaataatttctgttcactagtggctacttaaattacccattttttgacttgcgattacggtgtcatctacaagtttgcatcgtaaatacatttctctaaaccacgtacatggaggcaacaataacacataaactgctgtcgttctcattgaattcccattgtttcagattgcatgttagattagcgatgttgcgcagagggcatgttttttagttagtttcaatctgtcgaatgatttagtttagatagaattgggctcatcatttggtgttacaatttaatttactttgtaataggaatccaaggcatgca

SEQ ID NO: 67858 - DNA, 10641 bp, Oryza sativa
caagtccattgaaatgactatatatgttataataaacttattttacttaattaaccatgacaatggacctttgtcaatatgtattttatcactgaatgaaggcaatcatgtgattagcttgaagtgtttttattgctactgtattcttgtatggattaaagatggtatgaattaagtgtaataacctgatagtactttggttctttggcctttgtatagcttgaaaaatagatatcaggattgattgtagtgcattatgcctagaggttatagctcaacagcacattaccctcaagtgcctggtctggcactggtgttttctgcttgttcttcattttctaaagacagaacaggaagatcatgtactctaaaagcaacccaaaataactttggttgtatatgattactttagcatgacgcatgtcttctccccacaaatataccagtgttcatcacttactgttttgaatagtgtacttatatctccagtcaattaggaattcatgctgtgagtgagctcacaaaaaatgtccaactgggcacttatattttcccagcctatcctgttaacagtatctgaatttatgatctctttgagcagtgagcaggatgattatgaagttgtcaggaaagttgggagaggaaaatacagcgaggtctttgagggtattaatgtcaacaacaatgaaaaatgcattatcaaaattctcaagcctgtgaagaaaaagaaggtagttcatgattcatgaatcctgttgtccatcctttttttccttttcccctgaacatgctcttttactggtaacatggtactgtttccatcttacacctagctttgtgtcaatggcattagtgtttattattttaaccatagttttcttttgtatgcagatcaaaagagagataaaaatacttcagaatctttgtggaggtccaaatatcgtgaaactgcttgatattgttagagatcagcactcaaaaacaccaagcttgatatttgaatatgtcaacaacacagatttcaaagtgctatacccaaccctgacagattatgacatccgttattatatctacgagctactgaaggttttattctttctcaattttttgttactgtaacattgccaacaagaaactacttattcagcacttttccagagtatcgttcttgttgaaatgaaatctttgaaatttgcaactatatgcataatatctaacttctagttccaacttatgcttaatactatttttcttccctgagggcttctctgtgtgcatgaaggctttttctatgctagtaacgagatgaagaaatctttgcccatgataaaagcaatgatatcatgttctttttcttctataggagaatccaagtcatacatcgtttggtttgagcaatttttggctgatccaattatgatataacacccttttctgttgatgggtgcaggctttagattactgccattcacaaggcatcatgcaccgcgatgtgaagcctcacaatgttatgatagatcacgagcttcgaaaactccgattaatagactggggccttgctgaattctaccaccctggcaaggaatataatgtccgtgttgcttcaaggtaggggcacatactgctctgttaatgggtttatcatttgattttcttatagagtaattaacaacatgtattaatcttagtatgtttggtgaactatttaagttagaataaactggcgtgcagtttatttgatgattgttttgatgatttactgaggcaataggcaaatctaattcttgcggatattggattgtttgcgttaatgatgtttaaagtactatgaagaacagaaaaatgccagcagcatgagcatataatcacgtttaaagaatgttttctgtagctactatgtttgctgtgcctgtactactctcattccatattttccctgttgcatccctttctttttttttttttggttgacatgttctgtttcactggaattcaggtacttcaagggacctgagcttcttgttgacttgcaagattatgactactctttggacatgtggagtcttggttgcatgtttgctggaatggtattaccatgacatttatacattactttttctcatttcatcaattttgtaatgcaactgcctttttctataaaagaattaactggtgctgattcgctaataatgtgttgttgagtgcagatcttccgcaaggagccatttttctatggtcatgacaaccatgatcaacttgttaagatcgcaaaggtgatttctcagcttgtttatgttaaaagatgatgttcatacaagaatgaaatgcatttcatgtttagcttatcattcatactgtacactatggtttatcttatttcatttgcagctcaagttatccatgtttgatgttaggaattgtttcatttgttgttatgatgcgattagttctgatagtaatcaggagcaacagttgtaacgctctcctgcgtgttcgagaaaaaaaagtaacagttacaactatttttctccgctgaactttattctggtcaaacttagtcactaacattttattcaaacttgcacgttaactatggacacccttcctttctgttgagtactgcttcagtaaaagtcttattgaacttgagctagatatgtgataaatcatctttagttatttgtgttgtttccctgactccctgcattcacaggtacttgggacagacagcctgaattcatacttgaacaagtaccgtattgagcttgacccacagcttgaagccctcgttggaaggtatatgaattacaattatatgtgatgcaatgcaagacctctagttttaatatgaattaaaattttgacatttttttttcatatgcaggcacagcaggaaaccttggtcaaagtttattaatgctgacaaccaacatctagtatccccagaggtatttccagtgccccttcttcagaggttatcacaaatgtacctactgtcattaaagtattaatggttttcaacatgatttcttttctatgttaggccatcgatttccttgacaagcttcttcgctatgatcaccaggatagacttactgcacgtgaagctatggtaagtaacttgttctgcacttcctttgatttccttttttctatgcaaaatatgcgttttactagtgtacaacatcatgatattttttttgcgattgttcctgggcattattggtctctgacctttgatttggtgtaccattgccatgcacttatataacattggatgattgcaggcacacccatactttctccaagtgagggctgcggagaacagtaggcctcgtgcacaatagacaaaagaacgggactattgctgactgtcgattagcagcagtcatggagctgcaccgtattagtgacttagtccagtcacttgtattgggagtttgagattcggtaatggttgaatcacctggcaagaggattctgggagagcatgtaacagctcatgtgtgcttaaccgcaaacgtggattgtgatttactcgtgctgtttgtatctttgtttctgacgattgattgaaacacattgttctcgttgagtataaatgtttttttttaatttgcgagttggtccgttttaagactgattgtaatgatcaattagctgtaccttaatggttttatgcaccttgacttcggacatcatcgctgaaccatttcaattccctatattaaagttgtcagctatccatgctaactgaaacgctatttatgcgaactgaattcctctttagaatgggcgttctgaattctgatgaacaaattcgattctttttcctctaaactgacccaagttaggtttacagtttctagcgaagtattccagaactaacctattccagaagttcaaacatgattagcctagtaaatctgaagaaaattacgcttgctctcacctataaatcagaggttacaggtcgatcctggcttataaatgataaatggggtctatactgtaaaagttgtgggccaatcctgtatttcagatgcatacaaatgtacttgagcccccaatactctttatgttagatgcatacaaatatacagtagtaggagctcatagaagatcaagcacagaactatatctactactacgtataaacaaggtgctccatggaaaaaaaaacacgatggcataactgttaaagaaactctgggttgaagcaatgacttgtaccacaggagacaccggaaattagtgaagagtgatgttgcaacataacatattgactgaacacaggcagcaaatccacacaagattaatatcgttgcacaagaggttgatagagcattacatatttagatgaggcacacaaccaaagaagcagcagcagctgaccaaagtttagacccatacatagggcaaccagtcattgcatacaagatgatactagtggattatggcagcttctctttttctcttctgattgagcagagagatgccaccgccattatttcttgaggtgagggaagcacgcggtgaggtcgctcttcggatgcttcgcctcagcatgctctttgcacttggtctcagaggtggtgcagatgaaagtctgcatgcatatcttgcactgcattgagatggaaccgttgttgagtacaccagattaagaaaaaagattaccacaaaatcgtacatcgtgatggctacaatggaaaaattcaccaagagaatgcactagatatcaatacgactacagattcgagaaacaacaacgctaggagcacaaattcatgctttacatatcttaaccagtgaagccatcggcaaacttcggcttaatacataactagtggactgatgaaagatacttaacaatcagttcattaatttgttgaggacataacttccatcacatatattctaacgattacacaacaggataatacctcacaaggattgtcgatgctattgctacccgaaggttcagataaatcatcacactgacatatacagaactataagagtacatggatctcaactaacaaaacctggaattagatccaggcaagcataaagctaacctggaatcattaacagcagcctatcttgtgaaaaataaacgattgttttacatcagcagttcttttttcctttataaaagctcaaaattaacagaactttgagaacataggctgtcgatatatgtctgaacagagccgaaggaattgaacccgattgatttcctgcgtgtctacacgcgcgtaatcaaaaaatcctccctaaatcccaccataaatcgtggtcccaaaacacaagcaattgggggaaagaagaagatgaggaataatagaatagggttaggtggagggagcgaatcgggaggggggaggagatggatcgggtgctcacctggatgttcatggccttcttgttggcctcaagctggctccctgcgaaaaatcaacagcacacacaacacacgaggatgatgagatcaagaagcaagaaacacatgaacaaggaccaaatcaagaccaaatcgaggcacgagacgattgggaggagaagggggtaggttagtatacccttggcgcccttgttcttctccatgttcctctccctcgccatcttcgacttctgcccattgccgccgcccatctcgtcgacctcgaccttcctctcccccttcgccgcaacaagagaagagaagagaagaaaagaaaacgagttttttttttcttttttggaagtgatgaagggaagcgaaggcaaaggcacggaatcatcgggttttaataggaggaggtcggcgagcgtgtggggcccacacgggctgatctgggccgtccgttttgggcgtcccgtgggcctcacgggagagccggtccgatccagccaaccgtctactgtaacgaggagtaatgggcgtgcctaacctactactctttgctttgttgactgccaaattggtcaaaaaaaaaccaagtaatgataccaaaaataaaaatacaatatacccaatcccatgattattaccaggtaaaaactaccatcatatttaacaaaagataataatgcttatgtgtggactagtattttttatgagcttaatagagagccagaatagcaaacccctcgactacaggagtaatgggcatggctaagctaacgttttgtttgttgttgatggatttgccatattggtcataaaccagcaaacccaataataataataaaataatgccgccacaatgatgtatctttcggtgctgtaaaaaaaagtgaactttcgatgctatataaccaattttacctgataattattagtcctaccaaagtaaaaaaaaaatcatcctacaatgtcgtgtaaaacttaagccatgtttaattcccaaaacaaaaattttcacgctgtcacatcgaatatttggacacatgcatagagtactaaatgtaggggaaaaaccaattacacggattgcgtgtaaattgcaagatggatctgttaaacctaattacgctatgatttgacaatatggtgctatagtaaaaatttgctaatggtggattaattaggcttaataaattcgtctcgcagttttctggcggaatctgtaatttattttgttattagactacgtttaatactttaaacgtatccatatatccgatgtgacaactaaacctaaaaattttccccaactaaataaggccttattaagctgaaatctactgttaaaagtaattatatggtccgacaccgcatatgatggttatatatagggttttataggtatgactcctttaacatttatggcacctataatcttatcatcgggcatagtataaaaatgaagttgactaggctatgttcttttccacagctccaaattacaacttgctcatttttcgttagcatgcttttcaaacagttcaattgtatgattcgtgcaaaaaaaaaagaaactatgaagaaatttcttaaaaactcaaataaatatatttttttaatttttatagctatcccgttctacgttgccgctaatttgctcatttatattgttcaaatggtcactaccaccagcttccactccctaagtataatacagaggatatatttaacctaggattaacagtgtaaagtagcactacccttccctctttattttctcactgggacgtgggacccacatcaggtaaaccgttggaacaatccacgttctgttaccgtggcagtgaaccagggagagtggccagcagcggagaaaaatgtcaacgccaagattgtgatcgagtcgagtgccccccatctttgactagcctctagcttagctggaggagcgaagagtaattaagggtatatttagattgtagctaaaataaatcttatcaaattttgataatttgacaatattacaaaaatttagcaggatttcttatgtgttttactagagtttggtaaaaaactaaatggatacatatatttgacaactttatctaaaaaaaatttggtacggtttaatatgacatcaatctaaacaacccctaaattaacaggtgtcttgggattgctaactaaattttagccttagctatagctacagaagaattgaggcgtctttattttctttgccgaaagaaaaaaaagattctagttgtagtacaaaaataattcatttcttttcaactgaacaagaatatggtgcttgggaccaatgaaatgaaatagctaaacttagagcacctgcaatggtaaagtaaggtgctctctataaaacatgtacatctcagcaatagattagattaatagtaaaccacctcaatagtatgtctatatgggtatctatagctctctaatgcattgcctcgtttttctctatagactatctccatgttagtagatagctttgctctctctcttcatttaatctcttctaagtaggaaaatatgctgacatggatatcttgtagagagcctatagataaccattacgggtgcccttagccattgtgagaaatgaaatagtttaaggaccaatgctcatcgtcccacctataataattagttgagtaatatatattgtttatgcccttaagattatacatgtatttttttattgacaatataataatctagtattatatgagtcacatttaatagttaacgtactttttggacaaaaaataatcttatgtagtagtaggacggttcgttggcagacgaggtgaggtgagatgagaggcggctttgacacaagtggagtgaagagaggcaatctcagcttgtggctggagattgacgacgatgcgctggcatggcccacgcagccaccgggtgggccccaccacccatatgtgatcatcattatctaaagagtattttattttattaatttataattgtttttttttactttttacggaacacactactacgtttaaataagaagtaattattaagaatttgggcattagagggagtgtagcaccgtacttcctccgattcttataattattatgttttgactaatgctatggtcaaattttttaatttagaactctgtatcaataattctaaaaatattaagtttaaatgtgctaataaataaataaatatcattatagaaaatatagttaaagatatattttaaaatatagtatatcgtcatttaaaacatcacgaaaattcatggaatcatttaaatgtcatggaatcatttaaaggcagatcgagcgcgtgcaccgacgcggaacggcgttgacgttgacagaatcatcagcgcacttattactaccagatggaccccaccaatggtaaattaggctgagagaagaagcttctggatcttgtccgaacctagctgtacacacctgtactccatcaaccaggagaaactatacctcgtcaaacctaggtgtgggcattcggttttttctgttaaatcggttcggttttatcggttttctaaaatgtcggttttcgtataatggcaaacagaaagcatacagaaaagttaaaaaccgaggaaaaaagagaaatatgttttacattttttgatggattcagtaaatttggtcagaattttaaaattttgactagacgttgtcctaaacaccaccgatttataaccggatggagcaggatttccagaaaagcgtggttattaagatatttcagtgtttgaatgaaaataaagaaaacaagttaaagtagaaaaacaaatgagaaaatatcctaataaagaagggatgattttcgtcaaaaagaaaagtatttccacatatgccgctaacttactgctcctaaatggggaagtagtgtattttccaggatcaaattgtttcaacaggccccctattcagtataggtctctctccctgatagctgggcctaggcccatgatggagaaaactgaatctgtcgtgggccacgaattttgtctggggtgggccttcaggcccattagaaggtgtagcactgttgctagggcttgtttgaggaagcttctagcaactgcagtttctcctagaatctccagctgccagaagctcctccaaactgtccagctttttactagattctgagaatctatagttgtagaatctagaaaataagctagaagttagaagctgggaaacctagcttctccagtttctcactatctagcttctcagaatcttggcttactcggttcttggcaatcctcacaagtcacaacaaacactgagctcaaaactgtcacgccatttgattgctattatgctatatagcatacatgtttgacagcatatataacaaatgatccatcatcatattgcgagctccaagtgaaacaaattttcagcagccaaaataggaatttgcatagccgttgggctcgtgatcagaagtcagctaatttaaacaacagtaacctcttccaaacaataaacctcatgattgattattgatgccgttttactcgatgaagttgtattgctcaatgcttggaacagtttaataaataaatttacgtacgtattgcgacgtacccgtcaacagcgagacgcctgtgatgacttcgtcaatctctctagaatttgccggcccagtcttcgaaaatgctcatagggatagggtttacgtacgtgtgttcataagggtgagtgcgtatacgttgtgagtatctgcattgtactgtgtaattctaaaaaaaaatttacgtacgtattaatatattactcttgcatctgcactcaccaatccaagatatggctacatgcaacatttttttttactttgacaggactttgtcgaatagtttttatgaatacagtaggctttgtcaaatatgatgccaccttcggctagcatagcatctcagagaatgagaaacgcaccatggtagtagccatgaacgaacgaaaacaagagcaataattaatcatcaattatgaaaaaaaaaagaatactccctatatcttggtcgtcaaattaacatttgcgaaaggaggcagtagtagctatttcttcctagctagttgtatatatgtgcttgcttgctttcttgcagctccacttttgttcttcagcttattagtccaagctaaaatttactcttaaaacttaattttagagatgattttatagtttcttcatca

SEQ ID NO: 67859 - DNA, 1398 bp, Oryza sativa
aacacactttttgataaaatttgctactctaaactcccaaatgacaaatgccaaattgctaacttttgctactagtgtttagatccattttagcaaaaagtgttttcaaacagtaaacttttgctatttttaaggaactaaccagggccttattagagggcgtatatttttttttaatgataagaccaaggggtgggtgtaggtggtggtggtggtttctttgactgcatgtgcatgctcaagtattactgtaattgggtggatctgtataccaaagcgttacacgcatgtatgaagacctaacatagaagggcacatttggaagaatcactgcagggaaacccatctttaatgtcggttgggaaccctctgttgtcccggttatgtaaccgggacggtgaatccgggactaaagatagtcccggttaaaataaccgggacaaaagaaacatcctctagaacggataccctcatctcaatcgggcatggcgtctgtcacaggctagaagtcactgatgtgaagagctatttcaatcggtcaaacggccgtcacggatgattctatctcaatcgggccctaagtaaagcccgtcaccaatagttttgacccagacgaccagtcaaactatagcccgtcaaagatgacctatctcaatcgggccacaactagcacccgtcacagatgacccttatctgtgacgggcattaactatagcccgtcacagatgagggcattaattatagcccgtcacagatgagtataatccaaaaataaataaattttattttttggctagccctcactcgtgtgcacccacgcgggaagttcaaacttctcggtcggtcacccatcccgaaatttactcatccaaaaataaataaattttatttttggttagccctcactcgtgtgcacccacgcagaaagttcaaacttcctggtcggtcacctatcccaaaattgctccagaccaagcacacttaacgtcaaagttctttggagattggcttccggaaaagtagttgtaacatgttggtatgagtattctattaatcatattatgcactaggccaggatgtcaaattaggtttattaaatgatttcaaatggaaaagtcaccaaaaccaaagttgtagaactcatcgaggtgcaaaatttttattttggtcatttctccatctgactctatttaaacaattcgaaatttgaaattcaaagtttgaaaagttcaaatagaattttagatcagtgaacgacttcaactgaaaaagtcatcaacaacaaagttgtataactcatcaaaatctataacttttattttggtcatttttctatataatattttttgaaccgtttgaatttgaatttgaaaatatgacaacttcaaacatcatttt

SEQ ID NO: 67860 - DNA, 3725 bp, Oryza sativa
aaattattcatgttttcattccccatcattttaaagttgtaaacaaatattaaatttgttttacttaatttaatttaaattaactaagttttctaatctttttcatataattttctatctttttctttctcatctcttttatcacaagttttttttccaaattctaaataatcaaatttgattataaaataataccacaaattattcatgttttcattccccgtcattttaaagttgtaaacaaatatttaatttgttttacttaatttaatttaaattaactaagttttctaatctttttcatataattttctatctttttctttctcatctcttttatcacaagttttttttcccaaatgctacctaaacaaaatttctatattatttcatccctacacaaactttctctctcatcatctcccattcccaaatttccagaggcagaaaagtagaggaggatggagttgctaacctttagactccttcaaattgtatattttcaccaaaacaaaatcaccaaaaattttggcagcacctccccttaaactcaacaaatttatgaagccttctcgggctagctggaggaagaagaagactttatatggatggacttttagtcccagtttgtgttgcctgacacaccctaacaaccagcgaaccgggactaaagacgggactaaatctttagtaccaaccgggactaaagatcaaatcttcccgttgaacttataaactgggactaaaaattgtttttagtcccggttttttgatgaaccgggacaattgtggtttttcccctacccgataaagatcacttctccagcagtgatttatgcctaacacagaacggcagaaaaaatttacgccctctaatatgggagggggggagtagtatagtaggctagtagctgtaattaagctccaacagtgtgtgcaagtgcaagccttgtcaaagtcatagccattagctagctttcactagtcaagatgtatattcatatataacacgtgaatcccatacgtacacaactagtgcataggctcctgcttcatatatgtacgtgtatattggttcatcagaacatatatttatctttggcaggacgatggccctatgtgataaagcacatagcaagctgataacagcccatcccctacttgcctccgttttcgcaattgtttttgttcctttaagagatttacacgtgttgggctgttttgcagaaagctcctcatttttgtacgatatatcgcataggtctttaaaccgactaacatcccggttgtttttttttatctggaaaagctctcgtgttttagagaaatacaatgcgaagtagtgacaatctcggttttagggaatagcgctgtaaacatgggaaatagagaagtgttcttcaaaaatacgtgcctttgtcactaacagatagatctacctgtcggtgacaaagatatggtgtctttgaagacagaggatctaaatcccttccatccacgggccgctgctccctgttcccctcttccatcccattcatttcaggactccatcacgtaccaacatgcaatgtatgtgtgtcacaaagacttgcagacttcattactccctccatcccttaatataagagattttgacttattacttgcactatttgaccattcgttttattaaaaaaaattgtgtaaatataaaaaatgaaaagttatgcttaaagtacattggataataaagtaagtcacaaataaaataaataataatttcaaaaaaattttaataagatgaatggataaattacagtgtaagaaaaagtcaaaatccattatatgatgagacggagggagtagatagttttgcaccggcggtccccggacaaaaaaaaatcgctaccgatccctctagcatatagaatttcagagaaataaaaaaggaaaaaagaaatcgatgcgacgcaccggagccatagcatagggtttaggaaatccggctgactcgcaccgcagcgcgcgcgttagacttgcgaagccgatttgattcggcaattccatctcgctgttgccgatttgatttcacgcagatcgcggacgcaggccagcaagcggcaggcagcgagcagcgtctccgcgagatagtgatggcggcggcgacccctggacggctcatgtctggacgactcctctcgccatcgtcgtcaggaaaggcgatgcatgtgggtgtagcagcaggcggcgtgtaggcgtggccggcgtcggggtgcatgtgcagtactggcaacaacagcatccaagctgcgcgcaacgaatcaaggcaagagcaggtgaattaatgttgattatatatttttcagtttcgatccctcacatcttactgtactgttgactgttgtattaatatagatggttgaaatatgaagatagataatgattaatggacacattttattggcattagaaagcctagacccaacaagaaatactatagcaatctagccatatatgtgtcttttaagataaattattacttcgttgataattttaaaatggttataagatgacttattaatatatcgttgcacttttggccaattgtattatctatattagtattgtacatattcgcattattgtttttcggtgctcaaacatattttttagtcggaccacccatacactaatgctagatacaccactgtagttttgtgttattgtgcacgtgttcgaagaaattaaagttcggttgtcggtttcatggaaaccgtagagctgaaatcttcagtccaaagaattaatagtgtttttttaataaatgtccaattaagcgttgtcaaagtcgtcgccatatatagcatggcactactcaagaaccaagtcaacatctcactcgtgagtcccacacaactagtcaaaacacggatatgtttaatcagttatgcttaattaacacatggattaattaaatatatattatacataaaaatgttagtactaatatcttaatgttattagcaatattgacggagaaagttttttataattaatgtgaataattataaatctacttttgaagcatgatataaatagttaatgtgaataattcactccactattaactagtagaaagaaggcggctttagcccctattttttcttccatatgcatgctgataatacacgtatgacatattagaaaagaaaggtgaaatgtttatatatatgttctttagtaattcaaaaaccaataataaaacaataaactatgttgaatttttttttaaaaataaagttctaaaatttaaattctggcagcgataattctatatatatggggcaatcagtgggagccttagtccaactaatttgacaactagatggtagctcgtgtcatttttcttcacgaaaaatgtatataaaccaccacaaaaagcataagtcgtagagatctccaatgcaaagtattgtcaaagtcgtcgccattatatatattagctcaagatattgcatgccctatagtcaagacctgtcatggacaccaaacaagtagttaatattgagttaattagtcaagagccgccgtcagctccagagcttaatttttgacataattccatccagtaatcacgatagcaccgtggccaacatgaacaatctttctcttcgctccagactaacaagcaggcactagtaaaagtcaccgccatctagcagtgatccagaaaatcgatttgttgg

SEQ ID NO: 67861 - DNA, 3937 bp, Oryza sativa
  unsure (1)..(3937): unsure at all n locations
gccggagaggagaggagagtcagtgagggagagggatctaagggagagagagagaggtgagggagaggataagtgagggagagaatgtgacttagaaaaaaatctgctcagaatgggtctatttatattgctcctcattttttcgcaggcaccgcttaagtagtctgcctgcgaaacagcaaacatcaccccaatttatatttttgtaggcggtcatttggctccaaaagtcatgtccgactgcgaaaataagaccccaatgttgaggaaaatgctttttctagtagtgtggagcaggacggtcagaaatttagaatatttgtatcgtgtatataaatttgtaatcttattttcaaaagattttctaaataatttatacaagaaaaaacagggagatatatgttctcgaaggtgtaaattgttttatttctccccgttgtgatttgtgaatattgttaggggttattatgaatttggatcgaggtactgacgaagaggatgaacagctgggcacattagaatttggatcccttgcttagaagggattccaaactacacggtcacggtctaatagtctacttcatccgttttacgttttacaatgtaagactttttagcgttcctcacatttatataaatgttaatgaatctaggcatatctatgtgtctagattcattaacatctatataaatatgggaaatgctagaaagtcttataatattaaacagagggagtagatcatactgctaagcgatacagtaaacccagtcaatgttactacaggattttcggcacagtaccgtgcggtggttactgtagcatacggaggtcactgttatcacaggggaactctatgttgtactgcagatgatccggatccggttattacacacatatataatatatatctcatcatctaggaaacccactcgcaagagcattggtggagatttgaataaaaataattacacatctattaaagtataaaattaatccttcttaatcttttctaatccctatctaatgaggattaatcgaacaagcctttaccttgtgataagttatgttgtctacttcgtggagaaaccttgcttagttatgagatggtattgctccaaatcttgatcagtctgaaacgaactaacccagcctgcacaaaaaaggtccataataaatcaagacttgcatcaagagtcgccgtcatatccggagctttaatttggacataagatcacaaatccagtgaaccaaaaaacatcaattttctttgcttcgaactggatttacaaacgacgaattgtaccagcaacaactaacagtagtcactacctaacctcgaacaactaacagtagtcagaaactcgaacacacttttcgtcgaaaagtgattaaacactcgaaagtacgttgtgttgcttgagatttatatggtgtgtgcgtatatatgttgtgaaatccagcttaagcggtagtttgctatgagcacgttttccaaattgccgaacggtatctttggtgtataaaagaaaaatcaatgttgaaggttttttttaaaaaaaactaaataaatctaatttccatgtgtttcaatagttaatggacacgggagaatctttattttttttattacaattagatcatgttagcatatgtaaataaagcaaatttgtaggcagaaattaccggagtaatttttttctagattcacaaataaaatactaattgatttgtaggtagagaacatccgataatttttattctggattcatcccctaaggactcgtcttgttcccgtgttagaataagtcaagctcatacaacactgtcgaatgaatacttagtcaaaccgatttaacagccagctggaaataaacgaatctagccgaatgagtgtctgtttatagtctaattttgttccattttttcccttatgtaaatcaaacttgatatttcaaatttgtgtaaaaaaatataatattccataatctcgtattactccataattttgtcataacttataaacaataaactggtactctcgattgaggggacaggcgcatatgctctcgattgagggggttaaaattaatttatttctcactttgtttagatgtcatggtttgacaagtcctgtctgcttcatggaaacaatcatgcttatgagttgctattgattaattgctccaaatattcagtctaaaatggactagcccaccttaagaaaaacattaatcgatcgggacttgtagcaaaagtcttgatttttcttcgttaatcgcagtccagagctttttgacgtaattgcatcaagtaatcacgatcaccaccgaacccgtgaatccaaaacaagtatagccaacacgaacaattaatcttgggtatttttcttcgcttcagaccagaccaacaagcgacgacttctcaccctactagtagtagtcactactacatatagctggagcagaatggtcagagagatttggacatttttccgtgtgaaaaaaataaccaaattactacctacattttttataaagaaaaaaaaactatgttgttgatttctagacatgattttcaacatcaaacttactgaaaaactatacaagtatcatttactttgttatgacttattttagtattaaagttttattttcaaaacatgacttataattttgttatatttgcgctaaatatttattaataaaaactgtcttcaaacgttatatttaaaaaatctacagcatgatatattataaaatagatgaaaaaggcaaacagccgagagctagctatgcagcaaaatatatatagatccggccaaaaagaaaaaaaaaacgataccattaagataagaccgaggaacaccgtgttggaattattggcaacaagtccacaaagtcaaaagtcaaagctcatcctccccatgctgttgcagtctttgccacatatatgaagccaagcaggtcagtcacgggcttcacgtcgcctcgccggagaagaagacatcgccaacatataccccccctccctacctagactcagatcagatcacctgcccatcgacgagcacaagagcgatccattcctggtttgaatcgagcttggtttgtttggttggttggtttcttggagtggatgatggcgaggtggtgcgtggggtggccggcggcggcgaggggtggtcgggatgagctgacgtggcaggcggagctgacggcgcacgcggcgggggagttctccatggcggcggcgcaggccaacgcggtgatggaggaccaggcgcaggtcatggcgtcgcccggcgccacgctcgtcggcgtctatgatggccatggcggccccgacgcctcccgcttcctccgctcccgcctattccctctcatccatggtgcgtgcgctcgccggcgcgcggcggagctcgatcttgtggtttgatttgaatacgttggcaacaatccttagctgatttgttggcgccaaaaattgatgagcagagttctcgccggagcgcggcggcgcggtgnacgccgacgtgatccggaaggcgttcctggcggccgacgaggagtacctccagctgctgcggtggtcgctgccgaacatgtcccgcgcggccgcctcgggctcctgctgcctcctgggcgccatctccggcgacacgctctacgtcgccaacgccggcgactcccgcgctgtcctcggccgccgcgcggcggccggccagaccgtcgccgagcggctctccaccgagcacaacgtggcctcggaggaggtccggagggagctcgccgcgctccaccccgacgacggcgaggtcgtggtccacgccgcggcgcgtggagggtgaaggggatcatccaggtggcgcgcgccatcggcgacgtgtacctcaagacgccggagttcaagcgcgacccggcggtgcagcggctatgc

SEQ ID NO: 67862 - DNA, 1071 bp, Oryza sativa
gggggggggttgggctgggttgataaacacatttacggcccaccacggcccttttgaccctacaattattactcccaaatgattacacattgcagctcccaaatgattagataagaggtgtatacgcgctagtacaggatgcaagcggggatttcacatttgttactcaaaggatattattacatttcttcagttcaagcaggaaaacccaatgtgtaaaaaaaaacctgaaccattaggtttaaatccaagtgtctttcttttcaccaacactgaactcaatcctcaacatgcagtaaacaggcataggaggaccaagggattgatgatgcagctgaagttagcataaacaacgtaattacagttcagttcatcatgcatatgatgcatccatcattattgttatctccagatacagatcgatctctctatatatacacatcatgcacgtatggctgtacattttgcggatcgagcatgatcaggtatcagctagcgttattctcagatacttgagacacaattaaaagaactactactactactctccaatctgaatcttggttgtagctgcttgtttttgaaattcagatatattcgacccggcgaaaattcagacaagcttcagactttcagtattttcagttcaggttcatcacttgaaatgctgaaaataccagttcaacaaattacacgtgtatttctcagcaaaagaaagtcaaatatacaaagaccgagttataaacatcaacgccaacaggttatgacttgcagcatgcattgatctgataaaccactccgcaagcgatcaaatatatataactgaacctattattcataagaagatggttttccactttctaccatatagtgcagttgatagtgttaatttgtgctactcagaagtcataacacaacatacataacattacaaaggttcctctagattccggtttattccttaattttatacagaaactaacttaaaagtgcaacaaatagtaagtgcacactgatcatcatattactctcaaactaacttaagttcgtaccactgataatacaccaaac

SEQ ID NO: 67863 - DNA, 786 bp, Oryza sativa
gtcgagctcccctcctccctcgaggtgctccaggagcagctcgaattcgtcctccgcctctccaccgacgacctgtcctcctacccgctcctcctcgcctgctccctccgcaagaacgcctccgtcgccgtcgaccttgcccccatcgattgatgtccatggcggcgcttcaccaccaccacagccaccagatcaaggcgccgacgccgacttggctcatcgtgaaggctatcccgccgccgagggacggggccaagaagctagccgcggcggcgtactcgccgctcctgctatcgccgtccgtgtggcagcgagcgcagcaggcgagcgtctggcaggcgagcgcggtggcagcaggcgagcgtgtggcaggcgagcgcggcggcggcggctgctgttggtgccccgtcgcagcccaactccggtggcgcccgccccctgcttagcttcgcactgccacccgtctcggccccgtcggcgttgcctacctgctgaagaagggaaaagagaagaatgacgtggatagtatgacatgtggggctcacgtgggtcccgctgttgactcagctgccatgtcggacaaaaccggggtcaacaccaccgaaagacatcaagcgaatggttttgttaattgagggatgtccgatatctggttttgcggttgaaggacaattttgtaactcgatgacaagttgagagaccttcggtgtactttttccttctaggatcgaggcctccacaaacaaaggccttataaaaggaagaggattttaatccctcgagggg

SEQ ID NO: 67864 - DNA, 994 bp, Oryza sativa
gtgcagggtgcagcattcatgcacagatattccctccacttctccaggtgttcaagcctttgctgacagaaggaaaggtttattatttggattcatatcgtgtgaaaacatccaacaaaagctataggccagtggccaatccactaatgatgactttcactaagtggacatctgttgagcaatgccttgatgtgcctttcaatttccctactgttgtatacactctgactcctttgaacgaggtgtcaaactttgtggacaagaatgagtcctttgttggtaagacctcctggggttatttgttttattagctatttagactaatcaacttagattgtgttaatatgttatatccttgtgtagatgtcatcgggttcattactgaaatatctacacctacgatgctacgtcctaagtcaagggatgctagcagcttgaaaaggataattcagatatgtgatgcaaagtaatgtttcctatatagctcaattcttagttcatgtttacttaattttgttaactactaatgtctaacgaaaaaagttatcaaacaaggctaacatccactctaataaagtttacctatcttcttaacatatctgccacattatctccttctatcttttacacaaatagcaattctaccttgaatgtatctctgtgggctgaacaagcactggcatttgatgctgagagtatacacaaagctggacaaagtgagcctcaaattgttctgtttgttgggacccttgcaaagaactatcctggcataggtaaaaaatataactacagatgtatctttgcttatgtagagcactgcaactaactattttaacaatacagggttagctctgtcgagaggctctgcatgcaagtggtacattaacataaatgtacctgagatggttgatctaaagaataggttggtactagatactaaatgtactataaccatctatatggtcaaatttatttaaatgttctctgatacatg

SEQ ID NO: 67865 - DNA, 8817 bp, Oryza sativa
agcaaatgtgactattcggaaaatatgcaatgatagctcttggtggtacaattcatgcgaaaagtgtcttagggttgtcaaaccatttggttacacctacaagtgcactggttgctacaatattgcaatggcagtaccaaggtaatagatccttaatttttgttttatcactgtaactacttgtcaccctgtttacctaagcgagatcataatgtataggtacaagttatcggtcttagctggggacgatactgcggatgctgtgtttattctctttgggaaaatagctcagcgcattgtgcgaaagccagttgagcttcttgtcgagcagacacccagggagagcaaatttatccttgatgcaataacagctctgcttgagatatcatttacatggaatgtcagcttcacagagaatacacttaggactggggatgtatcattccaggttaacagtgtgatttccatgagtgttcttggggaacctcttatgctaatgtccccaggaccagcagattctcctggttcttcagctatcatgtcacctggaccaagcacttccatcatgtcacccacaagaacatctgagattgccatttcctcacctccattagctacaatagcttctccagtgaccaggcgtgcagcacctcaaacaccaactagcatactttctttggctaccacagagcaagcaagtcatgttgatccactgtctccacccatgactcaagcagtggcctctgagagtacagaaatggtactgctttccatgcttacaaatgtttgctctaaactataagaatatgtacatatcacagtaagaagctaacactttacttgcagaaacagaaggctattattatttctgatgacatcacgctgccactggctgcatctattccaaacagctcaaccaagaaaaggtacattctttagacccattcagatgctatttcattgttttcatcgcttctttgctcaaactacttgtgttgctcgatagaacccgcccacttcaggcttcaccaacagctaaaaaactgttcactgatgatggtgctcaggaaaaggaggttactgacaggtatttcatgttgaactgccatatctacagatacatattatatgttatatataaattaaatgtttactcaagcatttcttgttgttgcagcctgtcagataccgcttgatcatatgctcatctggctgaagtattttgggcattgacttatggaatcttcatgggcatgagaaaggaacaatagcatgctcacatgtctagatcttttgctccagactttactccagactttagacttttatctcttattaattagtaccaagtgaaaatgtactgcgatttcttttggacaactacctctatgtataagtgcacctattattattatgccagctatcatcccaccacatgctcagggtccattactattgcatctgcgatagcatggcaatgaactctgaacagttggctcgggcaaagctacatggcactaaaccatgttaagactcatcgttgtttctcttatgttgctaccttgctatcaaaattgagcatatgctccatggttatatactattgtgtgactatatgctccatggttatatgctctatggttatatacgatagggcgcgcgaagcgcgcttgatgtctagtgtaaaagaaagagctaaactgaaataggagtaccttgttttttccattgatgttgatgaccctgaaagggtgccaggatgagtcgctgatttcagcttcccactttgaatagagaagcgcagaatcaagctgttttttagtcagtgtttgtgtgcaagcattagcaaatgcttttggatcaagctcacccatcctcctgatgccaatgcttgcgcggccacttgtcagctcctccaaagcctgcacccaagatcaatttgaccgaataaatacaaagaaaattgatacaagttggtcaaaaaataaatgaaaatataatttagggctcagtctttcgttttcggcatttgtattgggggtgccgatatggcaaaatttcttacggaaatttcggtctgaaattatttgaacttttgaacaaatattgccaattcacaaaaagtacaatcaaaatttaaaatcggccaaaataatatcacaatggggtcgatagaaccgaaatttccgaaattcgttccggaatttcgaagcaacttacatgtatgagctgtttgcggatggcctgcaactcatcgttgatcgccggagcctggttgagcgactccattgccggcatttcatcggtcatcttgctcttggtgtcgtcgtcgtcgtcttggttgagcttcttcgacgtcgcggcgatcccctgcatcttcttgctcaccgccggcggcggcggcggcgcaaagagatccgggttctgcgcccagatgagcctctgccagtaagcgccgttgcggcacgcgtccgtacgccgccatctcgccatctccctcatctcgttctccgcgagctcacagaggagggtggcccagtcgacccagtgcgcctcgccgcgcctcaccctctccgcggcgcggtccacctcccggacgagccggtccgccgtgtccagcttcacctgcggctcgacgtacgccgccatgaacgcgccgcggcggaggcggctgcggcggcgtcgaggtcggcggccgcgcggatgtcggggcgcgtgcgcgggagggcgagcgcctcggcgaaggcgacgcgggagacgacgatgctcccgccgcggacctcgctccgcttggtcagcgcgttgtagttggcgacgagctcggcgacgaggtcggggcgtggggaggcgaggtcgagacggacgaagtcgaggaggccgagggcgcggaggccggcgtcgtgggtggcggacggcggagccggcgggtcgaggaggcggagcgggggaggtgcgggagccgccgcttggtccgagccccgccgacgcattccgccgtttggccgagtacggggaggaggcgagattgacattggcggcggcggcggccggcgagtggtcacgatcaaagcgaatgaagaagacgaccgacgaaatggaatcaaaggcgcgattcttattcaggttcaaaaatcaaaggcacgattttttagggatattttggttcactgccatatctaaaaattcgtaagcgctaaaatgcaggcaacttttgcgaaggactcgccttgaacatctttggtttcttaccaaatggattcaaatcagggaaagtgcattcctccgtcgagcagatatcttctcgttttatgtatattatctaaatagtcaaaaaaaattaaaataaaataacagtatagattaatataaaatatatcactctataaacatgtgtaagttaaaattcaacttatataagttataaaaaaataacaaatataactgtagataaatatttgtgaagtgatatattttatattaatctatgttattattctttttaaattttttataacggtttaaatgacatgcaagtgatgagaggacaaattgtgatacagtgttagtaatcggtagccggaaagtcgccaggcatttgacttcaatccagacaactcaagaatactttcgagttaccgagccctgctattatttttttggcaagaaatataattgatatcaatacaaaacactgtcaagaagtacaggtgtattttttttgcctttttatttatttgtcgattaaagttgaacattaaaaacaacggcaaaaaaaagtactccaaggcccaagcaaattgttgcacaaatataagcaactaataatgcaaaacagtttaataatttatctctccattcaaacaacaccacaaataaaaaaaaagtcaatctactaaaatcttgaaactcgtgcacaaacttgggttaaaaaattatattaagataaattaattattaacctcatacgtctggaatgatatttacgaattttttgaaagatctactagtttaacatagaaggggacaacatcaatgataactaggtggtaccccgcgtgttgctgcgggatacatgaataaagtaaaaaataggcacgcctggcaggatctgtaacaaaaaaggattcagtaatcatcataagaatattttaataataataaagtagctatgggtgattgcttcttggtgaacgaattatgttggatgcagctgagtagacccacattgtctatgaattacaatcgatcatcatgtcaatgaacttggatgaaacaattcaaatagaagaaaaatctatagtttgcaaggtaacacacttgcaaattgcagaaaatcccaagttaagtaagacaacaacgaatccagatactctgcagggcccacatgtcagtgagcagtactgcagattaccctcgggtccacatgtcagtgagcagtactacaggtgcagtactgcagaggacccttactcaacaacaacagtgttaaaatataatgaaaaatcaacctacgttgacataacttttgagttgtcacagtatttacatgacctcgccaacatgaatggcaagtattccaaaagattgcacaacaaccgtgatgtacggtgttgctagctggacttaggtgcatatagtggcgattgagtacatagtatccatgtagcaagtagcaacaaaatgaaaaaggaactaatgcaaagaacaggaagtgatactgcatatctgggtgaaataagaaagaacatgggccactttttattcgtaaaagtgtcatcaagtattgatacagacccaaggatcgatctagaccggcgtacgcgagagacatcaaccacctctctcgttagctaacaattatgtacattgtaactgggccaacttggctgctcgcacaggccacgtgcgatgaagggcctcctcgcctaatgggcccgacaccgagccttgtgtattatcgagccaacgcagctgttgtgggtcgccgcggccttattcattttccctatatttttcacccaaaaatatcatttaatgtttacaaaactaatttgtaatcactttgagccatcattttaagatataaaattgctgaaaaatttgtgtgtgcattttaatttatttctaactaaatggaaccaaggaaagaacctagaaaaataattaaggcttccagtaaaagtttttatccatcattcatcacacgcggaatcaacttcggtaattagtttcttttggcaatatttagttttctatttataatcacatccatttcctaatctacaaggtataaaattcagagatatttgtgatgtatatacaaatttgagttgcacatgtgttataagtacacaagcaatcttaaccatccaaccatatttgtttgatattcagttccaacagacatatttgctagtatacacacatgtatgcgtgtgtgagaaaaaaacatttaatatctgtgtgtttttagcggtttaaaagccaatgctttaaaataaactacagcaaccccctcccacctaaaatcgaactcagacaaataagttttaaaaattatattttctctttcagctaaatgatgatcctccaatccatcctttcattaatatttaacttacaccacgctaagacaaaaggatattaggtgcaaggactgtgatagcctagccagcaaaaagtcatcacaaaccacacgataataagagtatcatataacaggagtacatgtgcagattccagccgaagacaggacagcaatagtttacaatagtttagtgtgcttacataacgcacagaagcatttccaccaaagattttttttattttttttgaacttttttattttttaattttaaaaataacccctttctaaaacttatttctcgaatctaaaccttttggccaaaacaatactgagttttatcctggcgtggccaaataacgctgtcacgccagctagaccggcttgaccaaataacgctatcacgccggtctggctagcgtgataatgttgttttgtcaacccagtccggctagctgggccaaaaggttcatatcttgaaattaagttttgaaaggatttatttttaaaattaaaaattgaaaacgtttaaaaaaaaccgtcttccaccaaactcggcatgcttacacactcccatctattttaattttagcaatcaatgacccaactgcaccggatgcaacaaatatggcagcaacattacagccccacattagcttatctcgaaattcccctttgggcatcccacaagaagtcaacagcctgtgtatatgcatgccagtacatatatgaaggtgaatctagggtggaaaacaataataagccttaaactcaaaagctaacataccggttgatacaatctctatcttcagtcttcgctctctccaccttctccacatcctcaacaatttccctttgcaccatctcctcaaattcatcaaatcgttcgatccttttgacctgattatcattcagtagcttgaacatcaaattacaacaagattgatcaagaagttgtgaattcctagtgttagagagaagcattcatagactcaacatcaacagctgtttccagcatgtcttcctagtatattagggaataaaaaatatcttcctagtatattagggaataaaaagaaccagcagcatactgcagggcttagaagttagaagcagagttagggctagtgctgcatagcgctttgcaatctagtgagttataagagtagcctttaccaatgcaagatatatttttctgttagtaactcttcaaaatgattgcattctctgcacatgcttttattacaaagaaaagagcagattgatctaacgtgaatcacacccacatttcttttaactgtgtagttgtttttttaggtgtacgtatttgagactgatgcatgtatgggtattatgtttgcattcttaacatgtacttcataaacgtagtttcctaacttcgatttgtgttggcaactcggcatgaacaagtaagcaaaaatcacatcattcctataacatatcctccctaaactttgaatagaagtccatttagcacttcaaactttaaaacaggtctctacaccctcgaatttgcaatacctttgatataaccccttaaagtgaactttgtggttttacttatgtgggatatacatttgaacagacactaaaatctaccggaacaatgccaccatgtcaacacagtgtcgtcctcctttgccaaaataaggagtgagaattaatgaggcaccaaagtgtcgtcttaatttgccaataccgctcaaagcttccccataggcaaaaccaccatgaaaaaaagaacccattttaaggggttatatagatggacttgtatgtggccatctttttcctttttctcttgtatgtggccatccgatgctaaggtttgcctaaaaaacacatcgatttcccatcaattgcttccttgtcgctgctaattgtaactccgtcttgtctgatcccactgcaatgcatgcttctggaggcaaggaagtacgatcctaacaagataatgcaagtgtgggcaaagatgctgagatggaaaggaaagagtttggagctaacatgatctgggaggtgttagagatttagagaccattttagatgataggttacaacttacaacgtctaattaatttttggtttgttcttgattcactattgggttgttgtggtcagaagtttaagttcgatgaactcaaagacatgatcgagtactaccctcagagctaccatgctactgatcgtgaaggctgaccggtgtacatcgagaagcctggcaaggttgattgaaacaagctgatgcagatcacctcagcggatgtccatgttgtggtatatataccaatgacagggctccaaaattctgaatatttgtgtattgtctgtactattgaatttgtcattccatcagtttatttctactgttgttgcgttgtttgttgttgcaggggctaaagaatttctcaaacaccgcaaaggagcttgttcaccatatgcagaaaatagacaatggctaggtaattttatatttcaacggatgtgctgtgtatggtgtttttttttttgagaaatgccaagttggaaaggaatgacatgagcaactacatttgccaattgcagaaaatattggttttgagctattgctgtatcaagcagacatactgaaaggcatatgactttagtaagggttgatattgatctgttctttacattggcaagaaattgaccaggatatttgcaggatgttgatgaaggaagataattgcaatagtttttttgcaaaagtaaagttggatcagattattgtgatggtcttcagtgtgttggcttcagttcttcagttcccttgcctgctaatgagttctctcttttttttttgaaacctactaatgagttctataaatgaatttttaggaggaatagaatatttgatccttgatatgctaatgagttcgggcatttttcagtatcgaagggtactgtaggatatactatataaatgattattttaagaggcaattgctatcgcttgacttcagttcttcgctatttataaaacacattctatagtgtccttgttagggacaaccgggagcagttttttttttcaaatgaacctggagctatggttgatgaatcatgaataataactcgtgtttaatattaatccttctattttgtgcttgtttgaaaaagcatatattgtattcttttggttgtttaatttgtattactgaatgctatcgtagcgttagcagtagcacagg

SEQ ID NO: 67866 - DNA, 2913 bp, Oryza sativa
actagtacgagtactaggtatatattacaaaaagaagagagaaaaaaagggagggggctagtagtggagaggaaaggggaataatttgatactcttggaagcgccggtcaccagaaacataaacagaaaagggaggaggatgatggtaacagatacctttcccgaggaggaggaagacaagctgctgcagaaggatcgggagcggtggcggagaagcctctgggacacggcgcggctgagcatccacgccgccgacatcgctagggttcggtggtttcctctctttcgattcgagttggaggttttttttttttttttttggatataggatattatgtgcattatgcagtaggctaccaaagatgatgggccgggcctacccaggcagagttaaagcccaaaaccgagtcctctccccctctcttttctttctagtctactacgagtagatctctctctctccgtgtctgtgaggtgcaaagcgtggaaccctagatctgatggcgttgcgatcggtgttggccggaaggttgatggtggcggctaaccgcgccttccgcggcaggcccgtctccaccaccaccaaggaacggctggaggtaagtaattgattagcttgttcatgttgttgcttctaatttaattgggtatcaccttttgatatcgatcgattaatttgttgtctctctctctctcccttgccctcgaggaatttgatcgatcgattttttttttggtgaattaagttgaagatgagcagctatccctggacgcaaaacgcgatggacaacaggctgcgggagggctgtgccatggctgtcgataaccacaatcggaggatcatgaggcttgctaacccttacagtgggtatgtttgtaccttattatatattctctctcttcttaacctttaattaattcgagactactcaatattataatgttcgctcgctgctaattaatctcctattatccccaactcaacagcacaatcgatcgatctacgcgttgcatgaactaatctatctccattcacatacattgatcgcaggccagctgatggagacatcctgtataactgggcttggagtaacaatatttctttccttatcattctctgctcgtgctttggattgtgtcatgctgtgctccatctgccgcatcacgcgtccaacaatgtgtccacagcataactagctaggaggttttattatgctataactacacaaatgtaatgtcctgctgaccgaaactagttaaagccaccattgaggttctgttggatatcatactctctatctcttaatgtactctactcctatacctactataccgccttaatttgtatgctatcgtgataacttgatagttgctttctatgttagctttatatatgtttctggattttctgttgtgtctgccccaaaatacaacttgctcagttgatatttctcatgctatcttttgatgatatgttcactacgtcggttaacatggcagcaatattttacttattatgcaatgaacataatggatctcttattgcaaaatcaatgtcttacttcatggatatgagagaataggtgaacagtcggaaggatcaataaatctctctttttttcatatacattcatggtttaggcacatctttcttgtgttattacttattagactggaatatcatcaagctagaatgtggccacctactactagtatcttacagcatattatagattcatagtaccctactatgatattgagcttggatttggcacacttcgtgcctgcatgactatttaacatgaacaatagtagaatgtgtggcttcgaaattaaagctacctccttaggtccctcttacctgatagggcaaatgtttccagtaattttgactctcttgccctgctgctgaagatgaacacaacatgtttgttgttattttggttaagtagtagtgcatgtgcaaggcatgtttttacaatatatatttacataagtaaaatcacagggaaaagcagtccttgcaagggcatgttcatacactgaattgagaaacatggcaagggtatgtctacacactgaagtcagatacattccctgtttaagttcagacaataatctggattttataagtgcctagcaatccaaatcgattgttaagtatgagttcgtataatacaaatgcagtatgaacttctagagatcaaatgaccttgaatgttaataggagtatattgtttacacatattgcaagggccaagattagacactaaacccgaacaaagcttacatccgttggtgaaatcgtaaactttcggtacttgatctactggaattcaaaacataacattaattagctcggcaaattaaaacattgaacaacatttagatgcttttccaagctcagattctaaatcagatactcctacatcatgaggataagcctgaaactaatacgccaaatgctcagaaaataatataagaaatgttcctacatcatagggatggcaacgggctgggtcagacaccgacagagcgaatccatgcccagcctgagacccacgtgcctgcatccgatccacatccgcgaggtctatcgggcaaaaatccatgcccatgcccgtgcccatcgggtacccgtgcgccgtcgccacctacgcccagcccgctgtgcgccgccgctgcctgcgccccgcatgtcgtgcgcgtgcacccagcccggcgccgcttgtgcccaccgtcgcagcccgcgctagcaccgccaagtggagtggacgtggggataggatttggggatattaggtttagggttttatgtggatatatattgctgctgctattgggccaaatgaagggaggtacttgaactattgaagttacatgggtcaaacattttcgggttgggcatgggtt

SEQ ID NO: 67867 - DNA, 9136 bp, Oryza sativa
ccgttgggcgcggtggcggtgcttagcacgccatcctagtgtggcctcgggcacggctgtggcgcgggttgctgccgggtgcacgacggcgcgggccgcggccagtgtgttttgtcggcaggcttgcggccatgatgtcgcatgcgtgagctcgcagccatggcagggctcgggttcgccaccatggtgcgtcgtcggcacgctaataccgtgtttgccgaccgcggtttctaccaatcggcatacgccgctgactccaagtcagctgtagtagatttcgtcaggaatggcagaagtggaacgagaatgacgagaggaattcattttcgtgattaaatctgcgagttcttacccatcttttttctaggtctccggtaaaacgtcgtgctgcccctgtgctacgtgcgtattccaaaggggttacataatgtcaaccaaaaatggtgacgcaagatgtaagggtaggacattctctcattcatttatccattgctcaagcgaacaatatcttctcctcccctctatttatagagatagccataggtaatttccatatttagtgatgggtctaattagtgagtaactaggccaggccttcgtggaccaccggtttcctaatggttccttagtgcggtacaatcttcccaaaatcgcatcaatagtgtgaaacttatagtagtatagtgttgatgcgaaaaacacacactggcctgagagatttgcttcaatctagtgcaggtccaaagatttgctttcgggttctgagcgtgccagttggtttgatcctgcaaccaacaagaaataagaggaaacaaggttaaatccctaaacgatagccgatcagctaggctgccgataacgtatcgtccagtgtcatgccgatgtagtatgggtcagatcagcaataaaaacatgtaagataagaatagatagatctactcaatcatctgcagatatcaatgatatataatctatgcctcgaaatatgcttgaactaattgattggcatagatcatatagtatgccgagacagtataaatcacttatgtctagacagtataaatcacttatgtctaaaggtacttcaaagcaaagattatatatattcataggatagccgatgaagcaaacctaatgtgtatcggctagtactccgataccactctacactaagatgtcaacgtagatgaacatactgatcatgaatcaatctaatattaggaaaaacttaacagattgacagcaagcttaatatattttaatcaattgagatcttaatataaagggcagatttagcatatcaagtaaacatataagaaacaaagtagctaaatcaggtaagatcggctgaaaccctaatgctatctctattagcaattataagacaaattaaatgttatggttctaaacattacttaatagatcaaacttaactgatgcagcattaagcataaggagaaacataagatctacacgagctgataaaagcctttctgagatggtggatacactgtataatctaattcaatgtcggtatctaaccctatcggctgtttttgatgatggaggttagccgatggggttagataatgatattgatctagattatacctcatatatgataactcggcgatttagatgagcgagattagagtgtcatgaagatgtaagcactaatctcgagaacgcaagccgccataacaagctttaccttttcgtcggagatcgaaccctatgcagcccaacttgaaagcaagaactcgccgaaacaatgaaagtagaaaaaaggtggcgatgtgccgaaagtattattgaactgtccttttttttacatcgtctcggatcatatttatacccaaaatacataaaatgtctttgtcggacacgactctacctctattacaacttaaaaatatgaacaaatcctttaggtggactcttaccgaatatatctataaagaaactactaaaaacatcctaattaatagatacagttgccttctttggactctttccatacatggcattaattcttgtgcggcgtctcaatcgatcccaacaatgattctagaaccaccttcctagaattgtctagtttagtatcaactgatgctgcagacgatagccaagatgcttcccgtagccggccgatacggtttctgcttctatggacacagaccttctcgtttctgaccttggatccaatctatgatttatcaattttggtcgttaaatcaaaaccttgtgctacggtaggctcgaaagaaggctggtccggtttgtatccaaagataaagtgaataggacttttagtttcctcttcttcttgagttgtaagacgtcgagaaaagaaaagaaaaatgatttttcgagcaaaaaaaaaaaggctatcagaatttttagttgctgggccgagttctgttgagggtccaagaagaataggcctgtagagtaaaaataagacgatggcgggagagtgatcgaatgagatgagggtttccaatattaattagggatagtgctctcatcgggcaattccgcaccctaaccctagtcgccggaagatgctgcgacgaccagccgccacggcggcgggcagggccatccggcgagccgcgtaccactccgacggcggccctcctccccgcaagctccggggcccccgattcagccctctcaacaggcacaaccacgaggtaccatacctggccctcacattgttcctgcacccctaattaagttcattctttggctacgatctagagtttaccaccccaaatatatagggttcatgtcttgttcaaagttaatatatattattatagtcccaaatcctcctgtgtcatctgtttatcattgcacttgtttcctcctagcttgaaaaaatttacctttttcatgtgctcccaaccttaccccgcgcacacacacaaaaacaacaactatggattcaagtatttagttactgcctcaaaattcatgtgcaactttccaaagtatttggttcgccttttgggattgctctatacggttgttaatttatgtggcaatcaaaagcacactcctcttgggtaagagatggcacggtcaaatttcattattgcattatgccatagattgtccatgcttatttatgatgaatgaatttgtacaattgagttatataatttcataaggttttaggcgttgtgatgtttttaaggtgtgttaagcatctgtcactttgcactagattaattctgactcttgctgttaccacagattaaaagcttgtcttttgttcaagcctccatctctaatttatttatctctataacttaaataccttatcttagaggttgaattaagaacgctctcacaagaaaaggaaaagctttcttgtgcacagtgcaatgtgccaaatgatgcatttaaagccttcatcttttgttcctccttcctatgttgttcaaagttagtttggtgaaaccctcgtggctcggaaaacaatcactgtacttgttcacagttacacctgttttccctgcaaactgggggggggggggggggatcaccttttccttttttttttacaaaattttacctgtcctcccatattgtcagggcttaaccactacaaattcccaaatatttggttcaagtgccaacatcaaacttcactcaattttaaattcagtatttctgatgatgctgcaatgttataactaatatgccaattgaagctcaccccccttgatgaaaataaggcactgtcaagaaagaacggagctgcaagttttccttctattatggccctctgaatgcatgttccctagattatatatcattgtgtacacttatttatgataaatgagtttgtggggtcgtgttccctaagattttggttgtgctcactgtgaagttgtaagaaatccagtagttgttgtgtgcttaattatgtagtagcatctgaacatcttactctaaaattttcaattctaagttgttcttttacagtttatacacatatgattagctttttttttttgcgcaagcattcatatacaatgtttttccttatcatagtggttgaatcaagaaactttcacatcttaaagaaaggttttgtcgggcacagtgcacttgtttaaaaaggatagatgctaatccttcatctttagtcctcgttcggaagtgatgaaatgtggatgaaatcaaatggatggtctgcttgattaacacaaaaaattaatattttgagaaatgaacttaacaaatactccctccatcccaaaatataaggcacaaccacttttctcttatgtctcataatataaggcgtgcatgcatgcttacattaactaccatcttttggatctataaaattgatttgttttaaatcttatatcattaaatctcccaattacattgcttgcatgtatcaatgtgatataaccatgaagttgattaaatgttttcttagtttttgtgctatgagtggttatgtcttatattttgggatggagagagtagctagaaacaagtgttctaagcaatacagtagaataaagttattttaaggaatcgtattttcagaagtgtggagcaaataaattgatccagggtagattatagttgatcatcacttcaaaaaggggccttaattagttttatggatgacttaattatgactctgtgggtacactgatattgtgccaaattttatggagaactgcagttaaatataattcttttgtgtaaatctgatagcagatgtggatgtctaatattacgcacgttgatatatgtgcaggttgatgcgttgctcgaggaagtcaagaatacgccggttagcatgatttccgattacttaattatcagaactgtgcggcagtacgtaaacctctgaattccagcttatgttattttttgttctgtgtcttgttaaccatcctaaattccttgtctgcttctctagttctattttggctcgtcagcagattctggttcaaaatgttctccggtcatgggtgattgctgcagcggttatctcaggctattgctgggggtacaacagagtgatcaccaaacgtcctgtggctggctctgaaccaccaacagaaggtgaggtggagtagaggactggatagtgttttcttttggagatgggagtctggaagtctgggagaatcaagaatgcagtgaagatatgtggcataatctatcctgtgcataataactataactaatttagtcctagatctaattggtgtgggaattctataatagtactattatatacatagatctcactcggtttgaccggcctgtacatgtgttcatgtggttggggattctctgttgctgaaactgatatatatgtgcactgggagatctctctttgggttgatctgtgcttcaatatattcacaaggttcttccattcaccgctccactgccaccacacatgataacaacgacgtcacccgcttcaagtttgcctcgctagctctaccgcaaggctgaacatgtgcgagtcccagctcgatccaccatgtactcacgctcacagtgtagaagtggctccccacgaaccagggccccatcattctgctccaaattttaaattttaagtttatttcataatatatacttttaaatagctaagaatgtatatatatacaagtttaatttactcacaaattattttgtcattgataataaacggctcggataaatataagcgaaaagatagggcactagctgcgcctgaaaccgcaaatagtacgtacacaagtagtagcatatgtttaggttcataattactagaattggattttatttatttatttactacctgagtggccgtgagtttcaacgggataaaaatatattgaagctaataatatttaacaatttgctaaactaaattcgaattaaaatcagggagaatctaactccccatctgatttgctctcgatttgtgcttcagtgagtttctcctcgatctaaaatttgctcctcctatgtgctccagcgagttttttctccaacttgggtgaccttgatgaagactcagtaattaccttcaccggttagggctatgacttccgatcgagttgaggtcgaggtcacttgtggcaattttgcaacaaggataacaatattttatagtggaagtaaatcaaatgtgttatgcttttctaaaaacgaccccttgtatatataattatcctcgtatatagagagagagaacaagacagagaagagaggagaataaaagagaaaagaaaaaagagcaaaccctagggagcggggatggcggtggcggcgcggagggcactctggtacagcggcgtgtcaccgaaagcgcggcacatgaacagcgggcgagggcgaggcctcgacatctctgagcctaatggacctctcgatagctacatccggaagttgatggtgcgtgcgtactccgcaaattaaacccgcttcgatcttaatttgctacactacaattttggcctgaatatctgctatatggaaatcctttttgctgtgctgtacaaaagtataactgccaacctgcttgtcaactcccagatgatctaataaatctctggatcgtcagggtgccgtgctactcttttttattttttattttttgaggggaggtacccttgatttttttttccgggatttggtcgtcgacctaatttcattatgaagggaagttcagttactacaaattacaacactgtgcttaattacaagcctcagtcccagcaagcaaagaacatatataacagcccgaaggcttagacgctaatggatgctactatatattacacgccgtgaaaactcctgcggccttccacaccatgcatgatttcctctttgatctcttccaccagctgcatgctcagtgttgcgctccttccacagaaattaagctactcttgatctagctggttttcagttaagcaaatagcctcctgtctaatcgtcctggaacttggtgtgtgaatcgccttagcttgtactcactcaaaccccctattctatgtggggcagctgctgcttaattttctgttcttgattatcttgtgtgatgagttcaggtaggaattcagtccaaacatttatttgaaatgctaaccatcaaactcactgcaatcaattgattattatcttactctttcttgctttttctcgtatgaagagtcgatcagattcttttttttttgtgaataattgggctccatgtattttccctgaagtgggcctctgagaaggggatagtcagtttttataaagtattccacaagtgcaccgagcctgaattcatggagaaatacattgagctaaaactgtgttttgttcggtggaatgtggaaataccagatgttcccgaacatactaatgtcagtatatccttgttgtctagtgttctttttcccttagttatatccaccctataactaggtctggattgaaacttaacctgttttgggaattttttttctctcttgaattcttgggatctgggtttgaaatttacactggtacgtcgtttgcagcaatttatccaaagttcccaacagaacagtgacagtcataaatctctttttgagtatgatagctttctgaatgtgtgaggcaatacgaaatcttaagtggagcagactagaagaagaggaaaattaaagctccatatgcatttgttaactggaatgcaccaacacgcaatttatattacccagtggatttatttcagtaggacactgctggagttctttttttcttgtaccattttttaattgggatggaagtttggagaaattttaactttgttatgttcttgtttttctttttgcaccacttaccaggattcttatttccctgcccgtactaatgtcctactagcgaagtttcttgtgtttttagggctgtggatttaaatgtgcagatcaatgaaaattgggatatggactgaattttacctgtcttccaaatttagtcttgattgctttggttgggtatcacaactatcattagttttgtgcaataccaagtatggccccgtgtattggtatggtttgctttgttgagactgaacatacaggtgagttgtgagtgtcgaagaacttaatcaaaaaataaaaatgcacagctgacacgaacgcaatggcctttttggctatctgacaaaatttcgaatagaagagggacagtcctacacttgtacaaaattcgttcttatcctccccttacgactatgatatttatctgaagtaatacggataatatatattagtacattacatctttggcttgtctgaggttatcgctcatctaagccttcaccatacagcttctggcatagaaggtttgtatattaatcatgttgctttgcaggatgcaggaaacctggaggaaataaacagaatagggaagattttgtcaaaaagggatatggtgaaacaaagctccgagaggtagaacttgggatgcaacatgcatgaatttttcctcactaatgtacccttgtctctgcacacatcataatactccatccgtttctaaatatttgataccattgactttttagcacatgtttgaccgttcatcttatttaaaaacttttgtgaaatatgtaaaactatatgtatacataaaagtatatttaacaataaatcaaatgatagaaaaagaattaataattattaaaattttttgaataagacgaacggccaaacatgtttaaaaaaagttaacggcgtcaaatatttaaatatttagaaacggagggagtataacacttttcaatatactgcagcctgatctttaagcgcaagaagaagatgggcacacacaacatgcaagatatgtggaaggttgctggcatcactagttccgcgttcttgttcgggacagcattcatttccctttttgcagggagcctgcatggagaggaggaagaggatggaattctacaagacaagaagaggcttggacttgaagagtagtaagagggtttaagtttaaccttaagaccgaatataatggattagaaataatgcttccatccatccatatgcttaaatcattgttgacttgagacctccccttttatatcatgtaactgcagtacttagggggt

SEQ ID NO: 67868 - DNA, 2383 bp, Oryza sativa
cacaccctctcctcctccctccccgcctgccacggcctcgccttggccgcgcccttcacgcctacgccttcaagctggcgctcgccggcgactcctacgtcgccaccgcgctgctcggcatgtacgcgcgcgggggcgacgccgacgccgcgcgcgcgctgttcgacgaaatgcccgatccgcacgtcgtgccagtcacggcgatgctcacctgctacgccaagatgggggcactcgacgacgcgcgcgagctgttcgacgggatgcccagcaaggacttcatctgctggaacgccatgatcgatggctacacgcagcacgggaggccgaacgaggcgctccggttgttccggtggatgctgcggtcaggtgtcgatcccgatgaggtggccatcattcttgcgctctctgcagtcgcgcagctcggcacagcagagtccgggaggtggcttcattcctatgtcaagaacagccggcgagttcagctcaatgccagggttggcacggcgctcattgacatgtactgcaagtgtggcagcctggaggacgccgtgtcagtgttcaacagcatcggcgacaaagacatcgtcgtctggaacgccatgatcaacggctacgcgatgcacggagatagcaggaaggcactggagatgttttcgcagctgcggtcacaaggcctctggccaactgacatcaccttcatcggcttgctcaatgcctgcagccattctgggcttgtcgacgaaggccaccaattcttccaatcaatggaggaggagtacgccattgtccccaagatcgagcactacggttgcatggtcgatctcctcggtcgtgccgggctcatagaagaagcattccaccttgtccagagcatgacgatcgcccctgacaccgtcatgtgggtgtcactgctcgccgcgtgccggcttcacaagaacatggcgttaggccagcagatcgccgactatctcgtcgccggtggacttgccaactccggtatgtacatcctcctgtcgaacatctacgcggctgttggtaactgggaagaagttgcaagagtaaggtccatgatgaaggccagtggcatccagaaggagcccgggtgcagcgccatcgaggtcggccgcaaggtctacgagttcgtcgccggcgacatgagccatcctcgcacagatgagatatacgccatgctggagaagatgaacgggattgtgaaagagcagggacatgttccacagaccgagctggtgctacatgatctggatgaggtgaccaaggagaaggcattggcagttcacagcgagaagctcgccgttgcgtttgggctcataagcacggcgcccggggagacgatcaagatcgtcaagaacctgagggcgtgcgccgattgccatgccgtgctgaagctgatatcgaagatcactgggaggaagatcgtgttcagggacaggaacaggtttcaccatttcgttgatgggtcatgcacttgtggagattactggtgatgccgccatggcgtctcacagctcataggattgatttggttttagcattgctactagattttggtagaatagaatgaagtgttgatgtttggctttgctaaaaatcgagttagtataggttacattttacagtctgcttccggctttcctgatcatgtttgcagccatgttgggaaatcggaggcaggcatcttattatagaaaacaaaatcaagttgtaccattcaaagtgtaattctaagcatcattctacaatttcatgcgccaaggagccaacaaactagcatcaaaacatctaccagtccacagcagctagcacaacctgttccatggcaaggatcagttggcacattcacacctgacctgagggtattcattccataataattaaaagttagtaacaggatactcacaaagaaccaaaggagttttattctaacacaaaactccacaataaatttgttggtttgtctgtaattgtccaattcaattacatactccatccatcccttatattttaggatggagagtgccaaggcttttgcagcttctaacattatgtggtctgcctttctcttaatctttttcacgccatcgtgagaatttcatagtacagttttgtgtgtatttgagtttacttttattagtacagttttgtgtgtatttgagtttacttttatttttttgtatgattatttcttagtatatttgataggttgatgttaggagaactgtgcataaataaaccaagcaatctcctcacctgcaaagctcaagattaatatttcttgcacgcataagtttatcttgagagatttggcacaataagtgtctccatgtatgataagattataaacagatcaagaaacgaagat

SEQ ID NO: 67869 - DNA, 1434 bp, Oryza sativa
ctggctgaccacaaatactttacccatcagtcacctagtaataaccatgcataatactaaataaggaggatgcaattttaccttccaaggctgtaagtccactatcagtacatccgtagcacatgaaatacacaagctccataagcatggggtcctgatgataaccgcaggaacagtttctccgcatgtggaagtatagttatgtagtccatcatgtattgcttgtcatcaaggttctgttgcagcaaagtttcgattagtcaaaaagaaaggaccacatatacatcacatagccacggaaaaaccacaggcatctttttgttaaaagaaaaacaaatgcaagggaacgagaacaagaacaagtcagccttgtcgtaatgctagaggaagtgtcgcaacatgttctaaaatattagctatcattatgcaaacgatgtcattaccatcatatcacatatatatgtccagaactaagtcatagtgttactttctaattttactctataatctaaacaccgaaaacctattaaacaatattttttctcttttaaaaaattgaagtataggtaatgaggtttagtgataaggaagcttgttaagactttattgaagggcaattagttggaatatactctattcgtaaaaaaaagagtaattgtagcattcaaaacatggtaattgtagcattcaaaacattcaaaacatgaattagttgggagggaaaaaaacctaaatgcctctcattaaatcattactcaaataaatcattttgagtcttagatttgagctgtgcatgtgaggaagttgtcggtttgcttatgcacaattctcttaacattgacctatcaaacgtataaataaactgttatatgtttattcaaagattcattgagttatacaagaatatcaacaataaggagtacgtaagttattctgatagatttggcatccaatctctcgatatgttgtataagtttctaaacattaacatttggcacaccactagcaatcttcatctattttagattgactatatatatgcacacgacacacgaattgttatgaattcatcatattgatgtgtaagagattttggaagtagttatgtatgaaaaaagtgtttctccgtcatgatgccattcataatcacaagatatcataggtataccaaaggtacaggctctggcatgcatatgttgttttcgtttgtttagaaactggtagaagcctaagacatttagatcctaagacgctcagatcaattgaagctttccagattactgcgagagaatccaatttgtatttcttgtgaatccaatttgtatttcttgtgagatttgtacaaatccacactctgttccaaccaccaaacaagcattattatgtacaagtaccacatacataaaattcacttgagaaattcattgaaatttg

SEQ ID NO: 67870 - DNA, 3341 bp, Oryza sativa
gcttctggaagtaactgagactgaagcgagaaaaactgaagcagaagctgcttggtgtgcctccaaaatgaccccaacgtcactactgtataacatcccacgttcaactccattttaccctcgaatctaaacactaaaaaagctattaacaccaaaaaattgtccataaaaatttttgaccaccacacacatattttgaatcaataacataataactatgcagaagaacacaaatcatggtaaacgatcatagcaaggtaaaatcagagtaccaaagctctgtatacatagtactgcaaccaggtaaaggtgacactaaaagtgtacatagtactgcaactaggtaaaggtgacactaaaagtaccagcaacaacaaccgttttaagttttaattgcagttttaccaccacaaggtatcacaccaccaaaaagtatcagataccaaagatcaagcaacatacttactaaccataataatgatcatcaggtgtcttggtgaaattgctttgccgaaattcatagaacaccccactcgtattctggtgtatttcaaggcaagccccagggtggcctgctacaatctcgcgtagcttctggcatgattcctcacttgcatcagccatacaatctaaagttatcgtcatttttttaagcgctggtgacaccaggaacagtagcgccacaaagttaaaatcatgctctgttcctctgaagctgcgaatttctgcttcctcgagaccatgcacgatggcttcccattcattccagtctgggtgctcatcacactcgcaattcgaatggcaaggactattcgcctgaaatcagtagacaatatactcatggctgattgattggtatataaacaaaatgaggtgtgacaggaaatatcactaaaaacaatgtagtgtaacatttaagcctagagtattgtgcccatagttgcaagtttgcgcatttaataatctttacaatggaatatcttaatgttcatgcctcatagtataaaagtaggccttctcaaatacaccaatcatatgacaaacataaccaatcttagaattatatcctaacaacgctttcaatgttgacgtaccgagtaacatatcagcccaattaccacgaattcaaatatattttctatctcaacatgacagtgatagagatgaaatggtttgtatcacaccggtagtcacctatgaaatcacaggtgcatggcgcaactaccaaggataatacctatgaaatcacatgttcaggaacaactaccaaaatggatgtgaacataaagccaatctaaacgacagaacattatagaacaggtaatgctacaccccctgagtcagcaaaaagaacttctaatttggagtttcttgtgcctttgcgcatacatcaagttttgttatagtttacaagctagcatacatatgaaaataggcacagtttaaggttcccaacgaaccaccagaaacatcagagctaagtatcatattcaaaccaacatggtatgtgctattaggaaataaagccttagtagtttaccactgttccatcaagtaatgtcagttgtaatcttttaacactggggcatagcgagagcaaatagaatactgaagttccaactgaatgtcctcttgcgtacaaccataaagacatggtattcatgttgggaagcttggttatgtattccatcaaatattcatatttatctaaatcctgcactaaattaaaaaaacagtcaaaaataagaagggtcatataagatagtacaagaaatgcagaaatatatagttttattcatctgtcataaggaatgctttataatttaaaatgagcatttaaattgacggaaaggtgaaaggggtgttatctatttggatattccatggtcacaaacaaacagttgcattgctaattctctataaacaaactctgagcatgagtatcaacactgaagattgatatgacacggagggggagggtggaatacaaaacatgggactttcgaattcagcttttagtgctatgctctacacttcttcttttttttatctgtttggccaacaataaggaaacctatacttgaattctaggcacatgatgcttgatcatgaataaggaaacctctatgtggtaatgtaatacaatttgaccaaataaacaaatactccataaagataggttatatttctcaactctcgagttctaacataataatttcttaattttccacgtttgaactatgtgtgttaatgatagttatttttttagcttaagctacgcatctcaaatactctccctattccacttgccaaattcagaacatggatgcatgccgatgtccgacactcgcatttacatctcgtaagcattgcaaacatgcaacgacagtaccaaaacaagaacatatataataaaaatatgccattcatgtaactacatacacttaatcctcccgtggtcccccttaactaattttgatggttcgatctcgcaaagagattaagaaccgtttaaagcgttttcgcgggaactacttgctaacttatttccacattagagtgttttcgcgggaactacttgctaacctatttccacattagagaacaggtgttatgttttccatgtttgaactatgtgtgttaatgatagttttagtttttttttagctttagctacgcgtctcaaatactctccccattccacttgccaaattcgatgcatgccgatgtccgatactcgcatttacgtctcgtaaacattgcgaacatgcaacgacggtaccaaaacaagaacataacaaaaatatgtcattcatgtaactacatatgcttaatcctcccgtgcttcccccttaactaatcttaatgcttaatggttcgatgtcgcaaagagagtaagaaccgtttaaagcattttcgcgggaactacttgctaatctatttccacaatagagagagcaggtgataagtactcactctttcatagctgagcaggaggtctagacggtagacagccgagaagcgccccaagagcaacgcgaattcctgaatgattgtgttgtccggccgaccaaagacaggaatggtgaaggcggcgagctgctggaggcgcgcgaagccgacgaaccgcacagaacctatattaaaccgatcgccccatcgaagagactccagatccggggcatggatcgagcaattccactcctggatgtagtagaagcaggatagcagttcgagcgtcctgaggccgggcgccatgagcgtgagctccatcaatccggggacgaactcgagctcgaaatggtggagggagtcggagtagatgcccatggtgtcaatcc

SEQ ID NO: 67871 - DNA, 3551 bp, Oryza sativa
gttggcggcgatcccggggccgacgcagggcggggtggaggggaaggggaagagcagcctggggagcttggaggggaggcggcgccagcggcgggagaggaggctggtctggccggcggcgggggtggagccgaggcggaggaggatggagcagaggagatcgtctgggagcgcgctgatgcgatcctctcctccgccgtctgtttccatgccggctctctcgacctcgccgtcgcccatcggaggaggaggaggcggaggcggcggcattttgggtttcggctcggcggagggggggtttgcgaaatttatcggtgttcgtgtcgccatttaaagaaagtaggtcgaaacccaatgggcctatccaaacttgggccgcacagaggcccacgtttgaatcataacgggcctatccaaactgggccgtagcaggccacgtttgaatcatattgaacttttagatgtggcaattaattatttgccactggacccatatgtcatagacacatgtgaacccacatatcattgagataggtatggcaaatagttaattgctaaatctaaaagtggcaaatagttgaaagcagggagactgaactttcgaacgtaatattttcagtttgaactaatatgcccaggagtcgaacaatccttcactgaatctgaacagttcttttgacaaaaacaaattccaccttcttggcaaggggataatactatcaggactgacagataggcccgaaatctcaaaccaaaattgcgaatccatgaagaaacaaggctaaatctgaaccacccatagcataagaaacaagctccgtttgtcaaacgttttcatgaattattggtaattattattacaaagccatcgttcaagggaaaaagaatgacattattgtgtcaaacaaacagcattacaacatacaggtatacagctctatgaagcaactgaaaaactgtagcaaaccgaaaaatgctcgacaatctatacaaagctgttttaacagttcatgggggtattatggtgaaacaaagacgctaacaattcatccaacctatagtatccgctgaaatcaatatcaaactcatgtgtcaacacaagttaaggccgctacaaccgatccttgtggtgctgaatgccacgctgacatctgcatagtctttcacgttcctgcttgtttttattgatggatacagccagggcttgattttatcaacaaatgtgtcaggatcttgagacagaatggcctcccaatctacctgaaccccatgagggatgctagcagtgacatccatgtttgctgccagaaataagccaagcaacaccacgtaaccaacgacagctgaacctcttgaaagcggcatgaagttgtacctgcagcaccccacaaaagcaattgtcgtatcttttacgggaggagagagagagagagagggaaagagaagaggttgcagtaagtaccagtaatatgtcatacgcaatattgctgccttcacagcatcaagcatatcagggtcacgcgtcgggttcgtgtcactacaatatgcctcgcaaatggcctgcagatcacagagctattagtttgtctgaaactgtaaatattacagaaacctaaacacaagttgtctgctgcagcatcaactctttctattgcaactcatgtgaagttccaaggctcccataatgtaattcaacagtgtacaacaataaatttaaagcatgtcatggtttctaagctcttccttagagaaccttccccgataccgtgtaaactcaagagaccataaccaacaaagctacactacaataaatctaactgtacctcccaagctgcagacatttcttcatcatattcctcccaccttgatggtgtacaaggtgttcgtattgcaaagtcgaatcctgtcttgcccctgcgatgccatcatgatacaagtaagcaggaaagcaggagggtgtagcaaaacaaagagaactgattaagcaacttacatgttttgagtggtaattcttgtcccttcaagacgcctcctgaaagagcccaaactttgttattaaataagcacaagggtagtgcaacactgtttgtaagtactttgctgcagtttcacatgggagaacaacaaacacatcctagtaaatatccgagcaagtaaaaggtatttacccctgaaatgcaatgctgtcgcatctagtagagacccagtaggtctcaccaactatatggtacaactccgagcacgacgatgcaacttctatctgcaggtttaattatcatgagaaaataacacattaagcttcatgctatctattggaagaaggaaaatgatgcaacaaagaaaatatgctagaatcaatcaaagtgctgttgaacacagaaattcatcaaaatgaagcccatccttcacatctgcttgataccactgcttatgtaacttatattagatatatgtaatgagaaatactaatatagcatattatacaaatgctacatcaccctgaatgcccttttggaaactttcctcaactccaatgtggaatgctagaactttccctttgttcctcttagggcttggaattgtattgtataaacttactctaggtgcaaaagaaacattgatatgtcatgactcatgcatgagctatgacattcaacagcctattgtataacttaccaacttaccttcttcaacttttcaatatctgtaaggaagattgcacgatcctccgcattattgacatatttcaagtcaagcatgatattctttgcagcttccaaaacactgccatgttatacaaaacaagttaagaccattactgacccagaccattactgacccactgcaaattgccacacgtcaaagtaaaaagatagtggtcatttcctaacctttggtaatatggatagtaacgaattatttttgcttggcctagaagcatcggggtatgagaaccaaatccagaattgaactcttcactggtaccagaaaatttaagcaagagaatgattgacaaaataaaatttgtaagcatgagaatgattgaaaaaataagaatgattcaataattaattcttttcaccagaaattaactcaccttagcttattgatccaaacaactgggtcacaaggttcagaaatttgtctccatttaacagcaatattatagacatcatgccaggagagagaaattccagaggaaatcctgtcttcatttggactggatgttggtgatccagacaaagtacttgtgctgcaataccctcccctgttctggcacgcgttaagcttatcccttctcctaactaactttgcattgttctttggatttctcagaaagcgccatgctttggaaactttctgggcaatctcaatagcagccaacccagccattcggtactacaagaaaaaatatactagtattagatcactaatcagtaaaatgtacttataaagcaaaattatcggaatcgggatcattttgttattcatgattcatgaaatgcgtttagaaactatatgaccagattaatcagctgaatcatgaatta

SEQ ID NO: 67872 - DNA, 11033 bp, Oryza sativa
ccagggaattcatggtattggcataaggaacaagctccatggaaaaagcaattgaaagggaataaattatgtacctgatagaaggccaaacattgtagcacaaatttatccatggagtcaagctccaagtcgaggacatcatcataatctttgatcttcaaaggaaaaaggattttttttgttaaaaaagcgcaaaatgtagtagtatatactagtatagatgacaaaatagacatagatgcagtcatgcaactgatggcagaatgatagctttagagcagtcacaatcattatcatccctaataaagtttaaattagcatttgccggttcactaaattaaacagtaacataccgcggccttgtactctccaatcgcatgatgacaagaggcacgcaagtataggcactctatatttgaactctcatgttttaaagcaaccgacagatctttgatagcactcctgcaaaaccaaaattagctttaaggggagcttagaagatacaagtttgagacaggaactaggacagacagcacttgcccaagccaataaaagcaatcaatgtgggagggcaaacaagtaaatatatgttacatttgagttgagaaccaaatttccagatgcatatcgtaaaatttacagaagacgcatagaaataggctaaagtagaatatgaaccaagacattttctggttctagcttaagttggtaataaaacaggaaacccagaactcaagatcatgtaaaagtttacaagtattaaatatggcagcttctacgtaactagatcacatttatggtctgtatgccccattaatcttggggccattaactaataaactagacaccaaatactatggcactaacaggagagtaactacgcttggaaattcattatcagtaatcacatcgacataaaacagtatgcccactaaactaaagggacctaacaattatgaataaatgatgaaaatatgtcatagatgtatgacttagacaggaaaaagaagtaaatgaaaataagtgtggacataaaaatgtagatgtagagaggtagcatatgtctactcattccatggtacagaattcatgttattataccatgggaaataagcaacagcagaaagggttacctatgtctacccattccatggtagagaattccacgtagatggtatgcttttccaaagctagaagcaatcaagaaaaatacataaatgggcaaataaataaataagccaatcacgtagatgaaagaaggaataccaaatacatgaaatttacctgacatcaatttgaagaactttctcaacattattcaacatcttctctggacaacctatatcaaggtaaagctaccacacaagacacccaagtagccaaatatcagttacttgacacaagtatgtgtatagaaatattaacatgaatgaaaatgtgtacaaaagataacttgacagaagaaactataagacatggaattgcacgtccataagacaacagaactcacctgagataggtgagcccaactgtcaaggaagttctcatcatattttatgccaaggagatgctcatcttcagcacgtttgtactccccaagtgccgaaagagttagtccctgaagcaataagaagattaatactctgcaaatacatggcaaatttcctaaatgttgtatgtcatttaagatggttaattccaaccttaacatatttttagcatgcaagttaacttagtcaaattacaaatcctgtgttaattacttaagtggcagagtccctacagaagaaatccaatggataatcccaaaattattgtatcaaaaatggtggaaaagtggaataaagtgctgttttggtgcataaggaaaatatttccatatggttattggatgagagaacttgaagtttgtgggtaaccaaacctagcaggagaaaacagatttttcagtggaaacccatttacttactaagtaggtgtgtgcagaactgtttttcttgtcacgcttcacgcatgttgagagatcttccactgccgcattgtagtccttgaatttgaagttcacaattcctaccacaaggatatgctatcagaatacaagagtaggcagtatgctcttgcagtctagacatatggctttattactagggtgcacgaatcaagcgtaaatgcgaagtgagattcaaccatcggtaaagaaactaacctctttcatgtaaaatatcaggagaatttggttcaaattccaatgctttagtcaagtcttcaacagcctgaaaagaacagaattaatgagtttagataacccctactgcttttctcaatattgaatccatgttagtgttgatattgtgacaactacagcgagcttgcctcggtgaactctcctaaagcagcacgagcttgtccccgccgcttccatgcctcaccagctgatgggtttgattgtatagcctgccatcaagaaaaggccacaaggtcatttttacacaacttgaaaggaaagagttaagcatataaaagttcaaccttggtgaagtcagaaatagcagaatccaattctctttgaaatgcataagctgttcctcttccaatcagtgcctctggatatgttggagtttctcgcagtatctaaagagatcacaagcaaaatttcagctccctttccaattacaacaaatacgcccaaaaaaaactgatattagacaaatacctgatcaaaaatggatattgcttggtcataccttccttcattcacctgaatatgtattgtgcagagataatagtcagactattgagtataacatatcctcctagatacttttagaaccttgaacatcaggctgtcaaactctaacgattgtttctagggtaaaaaaatgcaattgttttaaatgcaaaatgtgccatctgaacatggttattcaaatgtttactgagagtagtacatactaaccgaagccatactatttgataaaccgatagtcagaattataacaaatggaatgtacctgtgcaatgcctctggaaaggcggaaatccaagcttatggattttgatgattttgatatttttgaagcaaatagtgtttgatctactgctacagtttcaccggaacttatgctatctgccacatcttcgatttggctgtttatttcttttctaccttttgctttgcttttcttatctggctttgttgttttcttgggagtatgatgtgtccctgttgtatcttttgttggactgctgcattctttattgttgtccgctttattatcattagccaatatcacagcaccattcgatataactccagagttcccgatgttttcttcacaaacaacagtttttgtatcagccattgtagttgcagtgcatgatgtgtcaacaacacgatcttcggatataacaactttggtatcacatggtgatgcatccacgacacggtcttcacactcgatcgtctcacagattttaacagaggaaaccaattcttccaactcaagcaattgtttcaggtccattgtatcacgaacagcaacctcatgtccttgctcccaacagccaaagcttcctctcttttccctaatgcagacaatgccttgcctgaaccaaaaatatatatcatcatacaaagtttgctagaggcatttgcctcaataaaggagtatctggttatagaaaagatgggtcactgtctaggtaagtctcattgcagatttttttttttcattcaggtgttcttggatcacacgtaaagatactagcatgaagaaaagaaaaattcagaaatgaaagaaagcatatataatgcagactcatatcaaatccacgggccctgcctggtcatcattattcactcccaaggtacttgatagaataaataataatcattgaactatacctaataacaatatagtcacgcactcacactacatttttctatcagttgcatgcgctgatgagaacactgaactccaatattcatgggtccatgagccctaccagacaggcacaacaagcagttatcaggggcatgcttcatgctcatctattaaaaataaatgttctttacagtaaaatgcacttaaacaaaacataaaactatcagcatatgtcaaataagtcttgttagctatctgcagatacttgtactgtgaaattaagggcatatatatgaaccaaatgaaatcttgatatactcctaaagactagattttatcttcaaaagttagctatgatacccttgcaggagtctacaacaaggtttacaaagaaacttcacttgcccattctaaagtaaaagaaaagaactaccgcagaatggtaaaatggcatttcaaagctagcttgcactacaccagaaattattgtcacttcaacataaacattagcatttgcaaggagggttaaactttctatattagaagtagataaaagggcattcaatgctagctcgctcatgaatcaaaagttcagataagctcaagttctcaacaccctggtttcctggaacattatagctattacttgtttaggatggcacgctttcattactttgttcataataagttaaggccttaatggatttgtcagtaaagatgcggtctttctcatcactgaaaagttgatccagagagaccagaagacacaaagatactcaagctggctagagagagacagatttttccactcatatcatttggttgaaagaagatatttttggtcagagatcaacttcaattcagcagtccaacttaaccttgtactgctaaccaaaggcgtgtctttgttccattcaagaagcaaagaacattcatccaagatacttgagcttatgacctactccatccatcccaaaaataactaagtaataagttcttcaatcaagaaaccagaaaatattttttttgattaaacactacactagtaacagaacaaatcaatgctatgaatccaatacgaaccagctaacgaatatgatgagttgtagtagcggcaatccataatgaaggaggaaaccgcaagggaagcagaggaggacggaaacctttgagcacgtaggcctggagcagcgccgggtccagctccagcgcgcggtcgcaatccttgacgacgtgcttgtggagctcgagctgggagtagcagaaggcccggttgctgcgagagagaggcacgaatccgcgtcacaaaccctagaccagatcagagatcccgcggatcggcgagcgagagattactagagacattagtactaaccagaggtcgtggatggaggacggggagcgggcgaggtgcgcgtcgaggatgcggatggccttggaccagttgcgccccccgcataccctcgccagctccgcgcgctccgaccccatgacggcggcgcgcggcggcggcggccggtcgccggggaaggggaggggaacgagaggtgggaggcgaggcgaggatggatttgtgaatttgtgagaggagggagggattagttactcgttttctctctctcacttgtgttgtgtggtaactttagcacatgggcccctctctttttcggttttttctgttgcggtttgttttttttcctcttttttttatacttattagggtgtaactttgacacatgggcccctctctttttcctcttttttttctgttgcggatttttttttttgtgtgtggggaaaggaagcagggcgctttggtgcgtttggatagattagttattttttcccctaaagcccctgatatcataatggattacagaatgatcctaggtcctcagatgcaggttcagttgttcagactccaatgtgaaatggattgaaggtttttatcactttattttccttttttttcgctaataagtgtaaccgtttataatcggttataggtgaaacaatatgacatctaaatatgcaccattggatttggaacatgaatcatcctctagaaaaaaaatcacttgcatcattcattttgtaatgaaagtttgatgtatgtgataacacaaagatacaaaggatacaaagccagacatatatagttaggtctgttttggaatgagtctaaaattctgagaagcagctggtgagaatttgaaaagctagaaaacctagcttttgacttcttataatctgagcaaaaatctcaaatgtttgatttaaagagaatttgtagctgcttgaagttcctcgaaacatgcccttagtaacttctgatgtaagaattgtacatgaaacaactttgatgtttcatatgggaatcaactttatccttttttcttttttccgtccgaaaacgtatacatctaggatcttgctttctaggacctctaattaatacgcaaactcccctctatcttttccctaagaaattatatcgcactgtaaattttctctaaattttctcttggaagaggttgcttaacatttggaacttaggaattatcctccgaaactatgtacagtataagctaagtattgtatagtacaggcttgagtaaagcctcatggacgtagcaatttgagactaacattttcttaagatcgaatgtcattagccctgtttatagtgaaagcgaaacgtgagactaacattttttagaaagaaaattacaactcgctaacacatgtgacaatgtccacagaatcacagtcacacatggaccacctgaaaatgaatgatggtagacacacccatacccatcatgacccatgcttaattagtagattatatttgattatataaattatgacacggccggcaatcttctgcatgttaaacttgcagtttccatacatcaaaaagcaatgtattaagcacatattattattagtagtaatagtagtactactacaaagttcacaccagtggtcaactgcagactgtcagctgcatctccatccaacttttaatatataacactgttagtttttactcatatttaaccatttgccttattcattttttaaaatatgtgaaaatgtaagttatatttaaattacctttaatgataaatcgagttataacaaaacaaataataatatcggtgatgtgggccggggggtatcagttctagagggaggaggccgcacgtggccctccccggaggggagtcaggcccgaggtggggtggcggccactccttcccaaagactagtcggaggaggctgccccccgatgccacgtggccctccccggaggggagttaggcccgaggtggggtggcggccactccttcccaaagactagtcggaggaggctgccctccgaggccacgtggccctcccccgagggggggggaatcaggcccgaggtggggtggcggccactccttcctagagattagatggaggaggctgccccccgatgccacgtggccctcccctgaggggagtcaggcccgaggtggggcggcggccactccctggccgagactagagggagaaggctgccccaagcgccacatggccctcccccgaggggggatcgggcccgaggtcgggcggcgggcgccccctcccatgactaggggtcgggctcccccgacatcctctctaggtcaccatgtacggtgggttaagtgtccgcctccaggtgcccacctacccgcatttatggcggcccgagtaatcgcgccacgccgcatttaatgcggtgtgcaatgcactcaaccggtctgtgaccggtcgaatgaccgatgggactggggtagtgcgcctgtgcactgctcgtgtgtcaggcgacgtgcagcctgacatgtcccatcaaataatgatggtgagaggttctcatcctcttatcccagccaaagtcggttctcccgctctggtcaaagcaaggctcccgtttcccggtgtaataggagcccagaagtccccacccattaaatggtgactgacaggggcaccccccgtgtcaggcggcaagatttgacaggcctcgtcatcaagatgacgtgcgcttgcttcccaagtcaagagataagacatgcatttaatgcaaagattgtaatccttctccactaagttgtgttttttggcccatgtggtaaccccttaagatataaaaggaggtccaggcctagtaggaggggaggctggagcccctgatgatcaacaccttctaccccaacaagaagatcttgtaatttctcacaagatcagctaagcacaggagtagggtattacgcttctcagcggcccgaacctgtataaactctttttgtctcatcatcttggagggggataactccctcaagatgacacagcttcactcaccaagccctcgaatctcacccgctgcccccagccgaactcacaaaggggggcctcacggttccctggtggaggagttcattctccgacatctggcgcgccaggtagggggcgcgttcgtgatttttgaggttgtttcgagcgccggcgtgacgagcgtcacggcgccaatgcaggggaaggcgcagcctcctcaggagtgtcgcgccaccctaggcagggggctaggccccccacatcctcatcggaaaaggccagcggccaggcttttatggcgagtcttcggaatgtccgatagcccccaaagttctggcctagcctcactgagaagtacaacggcggtgtcaacccctccgagtccctctagatctgcacgatgatcaggtcatggcgagcttctttcccatggcccttaggggccaagcgcggggttggctcatgaacctgctgcttgcctcggtctactcctaggaggactcttgcagttgagctccgggtgccgtcgaagcccgggaccccctgtgctggctcttccgcagcggctagctttggtcccgccggctggctacggtgcccggcctagctcaactaatcatcctgtcaagtttcaagtattttcaatttttcaattcatcagcttgaaatcttatatttgatttccccccattctactctcatggccctgcgacgctcgcgtgttgcgcatttgtttgctccctcggtggtaagagcccaacccctctcccatctacatgaacgattcatcactaagtgtaggggctaagttttctagccttatcctagccttaagttgagccctgggtgccgtcgaagccagggaccccctgtgctggctctttcgtagcagctggctttggtcccaccggctggccacggtgcctggcccggctcaactgtggacggggattgctggctctggagtttttcggctctcacactcgtgcggaagtaatcgtccatgtgggaggaaaagagattggaaggaggccaccgaaaggaaagagcgaacagaatgtgtagcgtggggacgtaggctcatgggaacctgacctcgtttgctaagtggtcgcagcgtttgctaagtggtcgcaagcttcccaaatggttaggaacccatggtgggaggccctcttcgagctaacggtttgaaaggtcacgacatgcaagcaaggtttgtgtttgcttcattcgtacaagcgattctttgctataagtgtggggggctacgattcctagctccatcctagccctgcgacgagctctgggcgccgtccacgtctagggccccctatgctggctcttccgtagcgactggctttggccccgccggctggctacagcgcctagcttggcttgatcgtgggtgaagattgttggctatggaaaatttagtcctcgcactcgtgcgaagataatcatttgcatagaattattattgcttatatttatctctcatctcttcctcgcggtcccgcggtacccatgtgtcacgcgctggcttgcctcccttggtaacaaaaagtttgtattctctttatccatccaaacgattttttgctacaagtgtggtggctacgattcctagctctatcctagccctgcatcgagctttgggtaccgtcgacgcctggggccccttgtgctaactcttccgtagcggctggctttggccccgtcagctggctacggtgcccagcttagcttgatcgcgggtgaagattgctagctatggaaagttcagtcctcacactcacgctaaaataatcggttgaatagatgaagtagaacacgaacagaggttaacaagaggcaggggcaagcgaggtacgcgacatgaggtcgcgggcccgagagaatctaaccacgtttgctgaatatatacagaaaataagttcacagcctaaggtacgagctggcgagtcgccctcaggctggggcgaaaaaggtgcatgggtcctagtgccagcaaagaaagaagaagagaccgggccaacatatcatcacactaggagagtggcgtcaaccttgaccacctgggaaaagttttggtcagggctaacgccgggggctactatcggtgatatgggcccgggggtatcagttctagagggaggaggccgcccctcgatgccacgtggccctccctggaggggagtcaggcccgaggtggggtggtggccactccttcccaaagactagtcggaggaggctgcccccggatgccacgtggcccttcccggaggggagttaggcccgaggtggggtggcggccactccttcccaaagactagtcggagaaggctgccctccgaggccacgtggccctcccccgagggggcgaatcaagcccgaggtggggtggcggccactccttcctagagactggatggaggaggctgccccccgatgccacgcggccctcccccgaggggagtcaggcccgaggtggggcggcggccactccctggccgagactagagggagaaggctgccccaggcgccacgtggcccttccccgaggggggatcgggcccgaggtcgggcggcggccgccccctcccatgactaggggtcgggctcccccgacatcctctctaggtcaccatgtacggtgggttaagtgtccgcctccaggtgcccacctacccgcatttatggcggcccgagtcatcgcgccacgccgcatttaatgcggtgtgcaatgcactcaaccggtctgtgaccggtcgaatgacc

SEQ ID NO: 67873 - DNA, 7697 bp, Oryza sativa
  unsure (1)..(7697): unsure at all n locations
ccccccgtgtcaggcggcaagatttgacaggcctcgtcatcaagatgacgtgcacttgcttcccaagtcaagagacaagacatgcatttaatgcaaagattgtaatacttctccactaagttatgtttcttggcccatgtggtaaccccttaagatataaaaggaggtccaaacctagtaggaggggaggctggagcccctgatgatcaacaccttctaccctaacaagaagatcttgtaatttctcacaagatcagctaagcgcaggagtagggtattacgctcctcagcggcccgaacctgtataaactccttttgtctcatcatcttggagggggataactccttcaagatgacacagcttcgctcaccaagccctcgaatctcacccgctgccctcggccgaactcacaaagggggggcctcacggttccctggtggaggagtttattctccgacaaataagaataatagcgtaatatttcaataagccgaataataaaacacgtgttaaaaagttagcattgttacctactgaaaaccggaggtagtaatatgctccgtctagcagcagctttgtgactttgtagagtttaaacgttaactagtggtaggttaattatttggttagtttccagagctctgagactaatttacatttttacagaagtagatagggaaaataaaggtgccatcgtcatatattttcatctggtgtccaactgtctgctgtctagccgtaccacactttggctttcagctagtgggggtaggttgcactcatccaactaatctattgacttttggtacgatgaagtaattaacacaaaggttaaaacacacatggcagctaaacacggagtcagtgtcagtctcatctctttgtcatcgagcaacaaacagtaatatgtaaaccgctaattaagttgcttttgctgcatctattaccaatcagatggcagagctccttcccgttacctcaaaaaaaaattacaagcagtagagctagaattaacccatgataactttggagattagtgtactccctcctttcgtcttaaattagtttatgtttttagttaaacatttctaactttaataatcaaattttaaaaatttaataacatgtgaactatatatcataaaagaatttctaatgatggatgtataagcataatcagttaaaaatatatagatttttagaacatgatggttaagttagaattgtttaacttacaaaggagtagtttgttgtgtctccgaagtatcggtttcagccagatcattcactgcaactgtaatcgtcgcagccgtacatgtgtgatgtatatgatctcgatcatccgtcttatatctggaggttgtatgattgatggcctccttaattaattaattaattaattacattctgcatgcatgcttgatgtgctttctttcatggagaaaagaaactaagaaagacagtttcgttgccatcaaggcaagaataatcccatcctttcgatcagctttgattcgtgaatattagggaagaatctaatatcaaataatatcaaatgattaaaagaggtgaggcttcgaacccggatcgtctagcccaccatcttgtggagctagccgaaaacccccggtgtttttctcaatcagctttgaagaagggcatttctttgtctgaaacattatccagccttatttcaccataggccatagagctagttgcatgcaacttcgtccatgcatcaacatatgtgctgctttcataaagagcacgatcgatcgatcgatcgacttttagttttcatccgtgatcgaatcgagaaacgtaattaacttactaataataatgccaaacgaatgatgtgttcactgttcacatgcacatatacacacatggtcgctttctggctttgagtttcacatgcatgaacaattaattaattattagttggagagattaatataattaagagaaacatggatggaatcgtgcgtattgcgtgagctgcaaggatcggtcgatgcatggcccgacaaggttgcccggcaatgcaagcgagactaacaccttgtagtggaaaagagaacagtgacagaaattttgcaagaaattctacaggctcaattatggtgcatgatgttttttctcttagaaactatgataacccatgtagacgctcacaacacgtacacacatacccctataaacacacatacacactttattcttataaccacattcgaaaaattagactggtatattttgagattaataaaatcaacatagatatctcgtcatcgacagatatgatacttgtgtatgaatatgttcgaaataactagttgtgacagcattgcacaatcagcagaacctagcaagcgaattcctactagaacagctgcagcactacgactgtacagccacaatctagctgaaccaaacatgagaggcaaagtaaattgtgcccatcccccacaaaaaaaataaaagaagagaaattctacggtcaaaagggcagggtgccagggtgggccgcaactgtccttaagatagaatttcaaaagggccaatcatcggcccaccgatcaatccggcccaattctatccctacacaaaagaaccgatctcccgtgtggccgtgtgtcgtcgcgatcgagtcgacgtcaaacccagcccaattccaccaaaagggaaaatcacaaaagaaaccgatcgatctcccgtgtcccgtcgcgatcgactcgacgccgacgcggcgctgccgcgcccaaagctttgccgtcggcggccggcggagcagccaactgcctgtccccaacggtggctccaccgacgcaggtaggttatcctcgcaagtctcttgggatagagtttgaattttaacttgaatgttcgtggagtcacatattaatttatcttattatttttttgaattttttataactatttaattcacatgcaagaaatggatggagtgtttaaaagagtttccctagtctcctgttggatttcggtatccctcagttgcatatatgatttgcttgcctgatgaattcggcgtggtcgtgtcgttaaccaaactcggtctctaaatcaatctcatcttccattgatcagtcagaggggagaagcaatgccacttcaattgctcagctcattcgccatgaagatcctgcgtgaaggagtaagccgccttctcctatagtgtcatgtcacccccaaattcccaatgcaaaggcactgattgattttattgtgcgattgaaattttcatcagggccttgctaatcatgatggaacatccatcaccagttcaccactaggcttctgaggtactcaatccgttccaaaaaataaaaaaatctatgtgctgcaatttacactttgttttatagtaataggctaggcttgctcattccagttgaggagagaaatcgaaaaacctgccttcccacggcacctaacgatggtcaccgtctttcttcccaccctcatctcctctcaatctccctcttgccacccaaacatcgccgcctcctgcctttcgaggtgctccaacacgacagcgagggggtcgatccgttggagcagagctcaatggccaatccaatgtacaactcttcgatctggtggcgtgctaccagagatcagagttgagacttaatctggtgccatggagttctatcttcgctgcgaggttctcgtggcggtagttggtcgcttctgcctggctaatggcagcgagggtcgacgggttgactttgctaaggttatcagtacccaccacgttactgcttcctccacctaacgaggaatgttctttacctctctctgcatattttcttcgtgtcccctcattctttgtgttctgctctgtatcgttgatatgcttttgctgtccgatagagccatacgatgattttaaggaatagggatatggagcaagcttttttttttgaagattcattctcattgaagggaagacgagttagaacatgattgctgctagattgactggctaatatttgttgtccaacaaattttcttgtcaacttctctctcctttgtcccctgcaatgccccctattttgctatgcacggtgcataccatgtgacaactattgctgctgtgcagcttctttgttcactattgttcctattattttacttttgctgctttattgccatattagttaattaaccttgagtatttgggtgttgttttatagcttcagttatgggaggaaactgaatgcttgccaaccagatttatcttatgtagaggattgcaaactcataatgcatatactctaggtttgtcatggcctgtcttgagtttccaatattttttcttacatttttttcttttgttgtcttaactgatctcacaccatttctttccattgtctttatctagatcgccgtttacatggttttcgtcgttaccacctaattctatcagaggttgggtcgatttggaaaagcagtttcacaagtaccccccctcggggggttaattttttatcatcatatttggttgtgactgcattaaatgcttaaacaaaatttctatcaatgaagcagcaaggcacacatgcgatgcatcgtacgaagcatttctgccatagccccacctaatatgacgatcaaatatgattttttttgaaaatatgatgatcaaaagtgaatagggggagtatttctttgctggagtccaggagatgaagctatcatatttgacttcgatcaagcaaagatctgatgaatcagtgccagattttattcatagattcagagatataaggagtagatgttatactccgagtttaattgattcacagttggctaatttgaggaattgttgggggccgattaaagacaaattttcttcatttgcttttgaaagcttggctcatttagtacaaaaagtatcggctcttaaacaacgcttccagaagtctttgacagaaaaatttactaaaaaggccaacaatgttaacaatgtatggaattaggcttctgactcagatcaagatgaagatccagatattagcttgatagaatgggcgaggataaaaatgacagttgttggtcaatgggttaaagatattggaaatgaggaaatatttgattttgacatcaacaaagccaataggatatttgatcttctattgcaagagaaacagatcgtgttgcctcagaatcacatgaatccatcagtcgaggagttgaaaaggagaaaatattgcaagtggcacaatacaggatctcatcatactaatgagcgcaaagtcttcagacaacagatacaatcagctatagaacaaaggaaagtcaaatttgatgatagtaaaaagtcgatgaagatcgatggacatctttttccattaaatatggttcatccctgaagatctgaaggaaaaaataacagggtaattcatcggaccaaggttagctcaacaagtttgatcaacaaatatcagaagaggcaagaaaagaactactatgaagatgatagatattgttttgacccacattgggactgtgagttcttcaggttttgttggaataaggggatgaggttaccgaagatttttcgggttgcagtggtggagagatagcttatgaccaggagaattcttctcgccgatatgagatgaaaagttcacatcaactgattcaaaagaagcttccagttcattagcaattggatccgatccatgaagattattttgaatatgaagaggaagaacatgaagagaaagggcagtaacctcaatggtgtcctagtgaaacttctactaaaaatcaaaaaagaagagttcaaagattgaggaataggtagcagatgcaagaagtggaggaagaaattagtcatcaactgaatagtccaaggaaggagtggcgtgtgaagattacaattgcaagattgataatgcaggaacttcgtcctctataaacatggtttttattttgcctgcagaatataaagtttccacatccgatgaggaggttgttgaagtatcaatggcgtagttagtgttgtcacctcaacaagcaatatttgagaagcctgaagaaactaagcatcaacatcttaggcctttgtatattaagggctttgtcaatgggaagccgttgtcaaagatgttggttgatggaagagttccagtaaatttgatgccatataccacttatcggaagcttgagaagacaccagaagatttgagcaagaccaacatagtactcaaggattttggtgggaattgatcagatgccaagggagtattaaatgtggagttaacagtggggagcaagactattcctacaattttctatcattgatggaaagtgatcatatagcttgttgcttggaaggtattggattcatgctaattgttgcattccatcaacaatgcatcaaagtttgattcaatggcagggagaccaagtagaaatcgtgcaagcaaacaggtcagttaatattactattgccgatttgtctatttgggagatggatgaagttgattgtttatcataaaaaacagttccctcctgtgatgcaagaatcacatattagctatattgcatatagtagtacaagttcatataaatgcccatttgcatctgtctattggattgtctagtagcaaagggcattgagttatgcttgagtaaatgttgcatgcattttagatattattattagttaagctactaaagggtaatacattaaggccgatgggccaattaagagggctaaagaaaaaaatatctctgtaaatatctcatcaaaggtaaaaaaaaaaaggtaaaaggccaccaatcctagggttggaaactcggattgtaaacctataaataacccccaaggggtgctttataggggttcatattttttgggaaattaatatatataattaccattttcatgttccactcactaagagggtgctttctaggggatcatatttttttgagaaattagtatataattaccatttacatgttccactcactaagagaagtttgttgttcaacaacacaagatatcagcatctccataggagatatagattagttaaaaacatacaacatgtttgatccacaaataactaaggtcgcaatacttctataagaattataatttcatttcatgaaaatcaagattagttgaaaactttacaacattgaagttgtccatagaaaaacatgccatatcactgtttgttttagtgtgtttgtggattaatgtgcatagaaatatgagagttcacttagagttaaaaatgaaagtgagttcacttagagttaaaaatgaaaagtggaaagaattttgctttgcttctttataaactaggcatatatcattgtgaacaaaccatacatactactacttcttaatttaatactcgttttaatatgacaatattatgtgcactaaataacagtcttgccactaactttctgaatttgcagctacttgcggtctgtttgctgttgtcggtagtgttgagtctngtgcacttcaatgtaaactagaacattacaatctttgtctgaataacaaatattggattgcaatcattgggatggaaattgtgtatgtggtggcagtgcatgccaggtgctcatgtatatacagatgaatggcctcactacaactttgcgctatccataccgtgcaaaaaatgctggg

SEQ ID NO: 67874 - DNA, 766 bp, Oryza sativa
atttttcagttgctaggacagctacggttagtaggacagcagcagttagcatctcctttatgcctcctttatgctttattagtttggatgccctctaggacagcatcccattcaaatttcgaattttagactaggagggtgcagcaataggctagtagccagctatggctatatatatgtatccaacctctctcgggtaggtatggcttttgtgttttgtgaatgaagaaaaccagaaaattgccccatctcgagtgccatcctcttctcaatgagagtaaccattgaaattctaacataggaattataccaggggagttagcaggacagcgagatatagagctcttgggaattcattccaagttgatacagttgcctaccacctctctgtgctgagggacatattccctaatggcatgaacgtcttgtccttgttttctggtattggtggagcagaagtagctctccacaggcttggaatctgtatgaagacagtggtcttagtcgaaatatcagaggtaaacatgacgttgctgaggagttggtgggaccagacccaaactggcacgctgattgaaatcgcagatgttcaaaatcttactgctgaaagaattgaactattcatcagaagatttggtggctttgacctggtgatcgggggcagcccgtgcaacaacctcgctggtagcaacagataccaccgtgatggcttggagggcaagcactcagcactattctatcactactacagaatcttggattctgt

SEQ ID NO: 67875 - DNA, 3454 bp, Oryza sativa
tgactgtgcctgaatgtctatagcttgcacctccaatgcaagtacatttccctttttcctgttgatatgcacaattcacttgatatatctttactataacaaaatcttgaatctttgaaggaaagttgtttcgccatgttcgcaaggcccttctgttgaaacaatcctcctccttgacactgaaaactgaacaagatccttccaataacagtgataaggattccatggacaaataagactgcacctcattcagtgatacaagcgatgagtgtagaaaatctaatacgttgtattttggtattttctgttatattggatcgaccctctcatggggtatatataggagtacataggggataaagacttggagtacaatacaaataagagtagatttatctctaggattctatctctaggactctatcttatctctaggattctatctctaggatatatcttatctctataatttgtatttgactcttatctctaactaccatattatacttctaacattccccctcagtcgtaacgggagcgaagtgaacgattgcgactggatttgaaatcttctatttcttcatctttctttgactcaccatcatcgactgcatctctgatggacggcctccacctggtgcctgcgtccccttctgtgtcgtcccttgactctcctttattccctcccgcagtcatagcgggagtgtcatggacgatagcgatgacacggacgcttggactggagtttccgtcaatgatttttgttgtagacgttcgtcgatgtagccgatcatgaagtagctgtggttgtcggtgtagccgcatatagccgaaggcgaaaaaaaaatatttacgccatggtgtgaagacaaaaactgtaattgttagcatcttgcaccttgtagatgtcagaggatgccattggggacgtcttgcatatgtcagaggacgtcgttggcgatgaggccaccactttggttggtccttctgcgccgtatagcggtcatcacaatagtgatgccgggttgatgcagtcgttgtagtcgtacatgacgtgatcgatgccgttgtcggtgacgcggtcgttgccgtcgtagaggacacggtcgatgtcgtcgatgaagcgtcttgcagattaatctgtcagaggatgcgaggtgtccatctatgtagacgagtcggcagcggcaagttgatgaaatgatgtagaatcggcgaagacgatcgtcctggagagctcggcgacttgacttggactccgcgaagacgtcgcagatgatcggccggtgtcttgatgcaggtgtgcagcacaggcgtgtgcacatgttggcgacgaacagcatcaggcccttgcttcttgtgaagtaggcgatgcagatcgatccatggatgaggccggatggtatgatgcttgttgacgttgtctgctcctgtaacacctgccgcattgctcctgacgatcatatggttttctgtggctagctaatagatctaaaactaattattagaaaacgcatctaatgatatgcggtaaactaatctgtaaatgattggagaggctagctagctaatgcggtgcggtgccccagggagaaattgatctcatctccctggggcagcgcggatggaacctagctggaaccgaggatcgatcgacgtttgtctacggctctgataccatgtagaaaatctaatacgttgtattttggtattttctgatatattggatcgaccctctcatggggtatatataggagtacataggggatagagacttggagtacaatacaaataagagtagatttatctctaggattctatctctaggactctatcttatctctaggattctatctctaggatatatcttatctctataatttgtatttgactcttatctctaactaccatattatacttctaacaatgagaagcaattgttatccacctgaaagaacatgtatgtcaagacatttgaggatgtggacgaggagctgaggcaacattcttgaattggttgcatttgtagtggcacaaccgctgtcactgtcgttacacatgtattagtactacgattacagaatctttcaactatttttgcaccggcaagagtcttgtccatatagtagaactacaccatctctacctaaaactaagattctgaaatcatagcatgcaagacattgaacattgaacttgccaaattttgtgcgtatgtcatatatagttatagtttgtagggataaatacaaaactctcgaacccttgaattgccctgttttcccattgctatgcttttgcgtaaggtgatcacctgatgattgcaaatttgggtgatccgtgtgctgttctatgcccaattgcagtccaactcaccactgactggaaaccaaatactattccaggtgagcctctgaattttagagatgtaacgggattgtggcgtactgatatagttgggccgaatggaattgtcacgtacatgcgggcccttattagttgggccggaatgaacatgcggccgacgattattgcccgatggaatacatgtggcccatctatccatcctagttggcgtgcacacgatgatggttgactgctgggcccagttgttgacttccacctttgcttggttagctcgtcctttcctcttcttccaagttccaaccaacaatggcggtcctcagttgcatcgcatatttgcatgcaacgtcgatctctctatttgcattgccctctcatccgcacaactaaaaacagccatcctcttctctctgcaccttccacaccacacacctcctccatcatatcgatcatggcttccctccctcatgcacgctgacgctgcaatgctcctcctctgcggcggctagatcattcattccaacaattaaattaacaataattgaattgaaggacattaattagtttgatcgatggcgggtgcaaacgcgtcgacggtgaagccggtggtggcggcgtgctacgacaacaacctggtgaactcgcaggggatgttcctgggcgacgagccgctgcgcttcgccctcccgctcctcctggtgcaggtctccatcatcctcatcctctccgccgccgcccaccacgtcctccgccgcctcggccagtgccgcttcgtgacccacatgctcgtcggcatcttcctcggcccctccgtcctcggccgcaacccccacctccgcaccgccctcttctccgagcgcggcacctacatcctcgagagcgtctccctcgtcgccctcatcctcttcctcttctccatggccgtcaagaccgacctcaccctcctccgccgccccaccgcccgagccctcgccgtcggcctcgccggctccctcgtccccctcgccgtcaccctccccgtcttccacgccctcagcccctccctccccgccgacctccgcggctcctccctcatcaccgagctcgccgt

SEQ ID NO: 67876 - DNA, 8266 bp, Oryza sativa
cgtcttcttcgtcgcccgccccgccggccgctacatcgcccgcaagcgcaccccgcccggggacctcctctccgagggctccttcgtcctcgtcgtcatcgccgcgctgctctccgcgctcgtcaccgacgtcatcggcttcaagtttatgatcggccccatgatgctgggcctcgcgctccccggcggcatgcccatcggcgccaccctcacggagcgcctcgactccttcttcatcgcgctcttcctcccggtctacatggcgctcgccggctaccgcaccgacctggcggagctgagcctgataggcgtcagcgcggagcacgaggagaagttctgcgcgctggagctgttcgtggcgctgtgcgtggccggcaagatggtggggtgcgtcgcggcggggctcttcttctccatgccgttccgggaggccaccgtgctggcgctgatgctcaacatccggggcatcgtggaggtggccgccatcaacaactggggggacacgatgaaggcgacggcggagcactactcgacgctgacgctgtcgatggtggtcatcacggcggtggcgacgccgctgatcaagctgctgtacgacccgtcggggaggttcgcgcgggcgaagcggcggaccatggaggagtcgcggcccaacgcggagctgcgggtgatggcctgcctcttcagcgaggaccacgcggcgccgctgctggacctgatcgaggcgtcggggtcgtcgcgcgacgcccccgtgtcgctgatcgtgctccacctgacggagctggtggggcacgcggcgtccgtgctgaagccgcacaggaagtcccggagcagctgcggcaacccgacgccgtcggaccgcatcgtgaacgcgttccgctacttcgagcagcaggcgccgctgggggcggtgacggtgagcccgtacgtggtggcgtcgccgtacagcagcatgcagcacgacgtgtgcctcctggcgcacagccgcaaggccaacctcatcctgctccccttccacaagtcctcggacggcgcccggagcaccgccaacaacgccatccgcggcatcaaccggtcggtgatgcagtacgcgccgtgctcggtgggcatcctgatcgaccacggggtggcggcggggtcggcgtgcgccacggcgtccaacagcacgctgcagcgggtggcgctctacttcctgggcggcgccgacgaccgggaggcgctggcgtacgtggcgcggatggcggagtgcggtttggtggcggtgacggtggtgcggctgaagctgcgggactgggtggggatggggggccgcgacgagatgagggacgaggaggcgctgcaggagttctggcagaggtacagctgcgcgggcgcggagagggtggcgtacgtggagaagacggtggaggacggggaggggacggcgtcggtggtgcgcgccatgagcgacaagttcgacctgctggtggttggtaggagagagggcggcggcgacggcgcggaggggtcgtcggcggcggcgctgacgagcgggctgtcggagtggagcgagttcccggagctgggagtgctgggcgacatgcttgcctccgccgacttcgcggccaaggtctctatcctcgtcgtccagcagcaggccgccaccaggaacgacgccgattactgacttaattggctagtcatgctgatatactaccacattccctctgctcttctcttctctgctctgctgcaatattagtgttcttctccaagtaatcttgtgttttaggatttttggcgagcttctgtattttactgtacctaggattgcataatcttgctttgattctggacacagtctagatttctatcgctaggaatatgtacaagtatgcatatgatattgacatatatcatgttcgtgtagagtcaagtgtttctgaactgaacatctcattttggagttcagactgttatctcaacaatcaaaaaagaaagagcaattttatagtctttgagtaggtactatgaggtaccactttttctattgtaaatttggtacctcttggtatctaagtactacgaggtacttaaaaaattagtgtaaaatttagtatctcataatacctcctcaagaactgtaaaattgctcaaaaagaaatccttcttttgtaatggactagtgtggcagtgtttggtactctctacaatatggagtattattgtgctggactgctggcgcaaaaaaaaaatgtcggtaatgcactaaacatctctaacctgactaatcccccaagtcgtaatcctgatcaagtacatgacgtaggtgctacaaacacaaatgacgatggcatttggagccatcgacaacttgcgcctttaatcacgggggaaaggagaacatcaagtacagtgccgacctactagtacagagagtggctatttcaactgaagctcatgctcatcggccggagctgaaggacaatggtgaaggtgtatggatattttttttactgaaatttggaaataccaataactgttatagatactggagtagtatattctgatatgtcaatattactgcgtatgattgattgtctttcttttttttttttttgactacatgagaacaccaacacggtaattattgagtccatcaggcaaaccatcatagatggtcaatgttgtatattatggataagctatctgaatcaaagcctagagagtgtagtgtactagtgtagtctcctcctttccttcccacttgtagcaggctggtgggacccacaagtcacctcctttctctttgcttttcttcactccgaaatttccccgagtccgagtagagtagagttcccaagctcctctgtcacagactcaagtaggcaagtcaagcagcagccataggccatagctgcaggcctgcaactcccggggaagagtggagtgctgatacgatagaggtagagcaagaagaaagcatccatggggaacatcctccggtgcttcaagggagacgacgatggcggtgatcactatccctactacaagccaaccccaggccacactaccagcctcctcactaccatggtcaacctgcagcccccccagctccactccagcagcagcatctcggcccccatggcgtcacgccgtccaccgtcggcgtcgccgccctggcgcacgatctcctcaacttcgaatccacatccatggtaacttctacacatgctcctagctacatgcccttactcccgctttcctctttcattcagcttgcaactgtactaactagaagaggttactgtaggtctgacattaatctatcagcaattcagcatgcatttacatcctaattagaggttatccaattacaatacaaggtttctttggttggttctatgacaaaaggtgggtttggactttggagtaggtgttaattgcatcacatatgtaacttttctcagctttgaacccctctgcaattgaaaccaatctcttgttaccgaagccaatacttacaatattcctttttattggatttatcttgttatatgtgattcattcagtcatttttgtaaggggtttagtgtattgtaaaccaacctgattataagcacactttcgtctttttttcccctctgtttcttttggaatactgatgaatatcttttatctggactgaaaaaatatgctgcattgcgatactaccatttctgttagcacttgcaaatatgttcatattctaatggcgcatcatgccaagttcaattacttctttattcccagtttacatgtataaaataagtattatttgtccatattatcaggttcctgatggcctcagtcagcacgttgtatcatccaggaaagcacaagttaaatggtaaggatcagctctaaaagtctttgtagagttgattttttttttttttagattttgtacgtttggtgtacctactgatatcaaaattgctttgctttgtaggttaattttttaaataaataaatgattggttactgttgtactagcttaagttgggcttttttctaaatgattttatgactgtgcggttaaatgattttgatttgctatcctaggataggatgttccatacttggttcatatgtagacaaatccttatttgagaaggtgaaaaatataaaaaagaacgacattgaaacatacaagattctgttcatttctagtaatggaaatgggggtgtcatgcccttgataaaaaaaaatattgaaacatacaagcaaaagttgatgcaccactgtatggtctatttgtccaggctacttcaggtgttgataaactaaaaccttctcttttttttagggaagggtattttttacatggcctctacattcaaccggatatatgcagccatttaaattgggaagttatccccacaaacaatctaatttgaaattcactcatatgaagatttaaactcaggaccttggggtgctactcaggtcactgcaaccactaggctacatgcctttagcaaactaaaaccttctggcaatggttaaaacagagagtaggataagagtacgcaacggttggagtttgggactaaaaaaaaaatcttaccaaacgaaatgtatagttacatattcacatggaagttgaaattgattaagataaattgtgttcttggctacatttctggtacattctccagaagactcaggctaaattcgaaatcagccatgttgacgtacaagcttcggtcttgaattcttttacatattttagtaggatagaatttcaagtagcgtaaaggtatgtttaatatggttcttgttccaatggtatgttatactgtcagtaacgaaccagtttgtcacaaagcaaatgtatttggcaaatcttgcaactagcagctagtatatatgatattaatacaacttccactgaacaaacttcaaaggaatgtttgatctgatatcttagttggaataataataggtaccagaaactgttggaggcgtataagaatacaacacctccaccaaaaacaccagcaaatgctgctcagctaattgcaagagcccttaatatgatccagagagctgatttggaggtaactttgtttttcctattttgaaatactgaatagttcaacccgagtgaccacagaacaattcatgatcaaggatcgttttttacaaactgaaattatcaatcaaagcaattcactgcaatttgtgttatttctattgcttaaattggctatagatactctactcacctcgtctagaaactatgtttcctctcagggtattcttgaattttacaaccttccgatcccatcactccccacagcatcgtcaaactaccaaccatccttgctaccagagggcgtgcagtttgtgctaaacactttgccggtacggtgtgatcaactattacaactattctgaataactagaaaggaagcccgcgcttatgcgcgggcatctaatttaatgttgcttgaaatattactctatacatgtgaatataatatttgtatatgcgtgactgttcctgattctattctcaacctgtttttttgtcaatattttgtttgtgactattttaaatgctaattatccttgcaacacaaaaattctaaactaaaattacttacaaccatgaaatcttgaattatatgaaagtattatgttgcaacaatggagttggcccctataaactgtcatctaaactatatgctctttttaatacatatcaaatcttcgttttgggttctaaactttatgaaattcattttcttaagaatagttattgaacttcatgcaaaaaagttcaaatgttttgtgcaatttatatcgggctttggattcaacaaaatttgtttaaatttagcccaaatttcgtttgaattccagttgtcctttctatttcttttggaatattagaggcccatgttctatcaatcgttctcgaaatgattttgatctcttaaaattgggatgtaaacagaactatgttgagtgtacaactcgctatgggataaatgcgtcctttctaaaatcttgcctccaaaattgagccaaaaatattataacagtagacatagtgtgttttacttcctccgagatcaatatgtatatgagacatcaatgtgagtatgaattcagggacatgtaaaaatttgatttgaactataaaaaaaaacaggggaaagaaggcgcatatgtacttattgtagccatgcatggagaatattttagtattttatttgttagatagatctaactgtctagaaccatcagtttattagaaattttgtgaaaagagcattaaatatctttaaactactgaatctaactaaaaaaacagggcaaaaagggaatgtgataaggaaacggctacggttcctggttttgtcccaatctttcaaaatgctttgtatgtctgcagcgataatatatatactgtaatctccattttaataactcaagagcagcagcagtattaagatgatagagatctcgtccagcaaagtatatagggtcagacacataagatcgataactccagataaactaagctgaatagctccattagatcaaatttaaacagatagatgattaggtttacaatgaataaactaaccaaatctgtagataaactccacccgtgcagcaagaatgacacacaatcagagcaagaagacttcggcagaaatcagaacacgcccaggaaattaattcccgatcatgctcgtccaaaccaacgcagcaacaatggtggcaaaacgtcaggcagatggaatcaccatctccttcctgacctaggcggcggcggcggcacaatacaaaggaaaactaaaagccaatctcctaatacaaggaacatggcatatataggtggcacaaaggcctagccagctgaacggactaaagcccaacatgggctcctacacaccgatccaaataacagagaaaaacctcattaatgtaataccatgattacttggtaatcctgccgctaagcatggaaggaaagcagccacatgcatgcatacatgcggaggttgtgggagatgattttgtttttttctgtgggtcctcatcttctctcctcgcatcacgtggcagcttgagagcgtttttaggatgccacatggcagcttgaaagtgattttagaaagtttaatggacttttagtatataatagatagatagatagatagataggtttatcaccaagaatccgacatcacacattgaacaatgatttacagaattattgacaaatgctaactctcacatatcactgatattataggtttatgacaagtgcattggagatggtgatggatttactgcatatgttcccacaacggatccgagggaatctgcaaatgtgccattggaagtgcatgagttggtgatagcaagaactcaagcacgcaaatgtagggattaccagagtgctgatgctcttctaagcagccttgatgaagctggatacaagtatggaaactgatctgttttgatccttatcagttaatagcacaagattgcatatctgaatgacgaatcttctaattttccatacaagagttatggtcctaattttctgaatattgtcttttcatggaacaatgcaggatgcctaatatagtaggcacaggaaaataacagagcttaaaaattaaattgattttcttctaataattacagttaacacacaatccttgatatgtatatagatgctcttattgtccccacacagttgacacatgcatttatgcattttcggaacaaaacagtgaagatttttatagcagctattcatgattaaatgtggacaataattacatcagttcgatttggtttaatcacatatatgtgctagctttgcttggagatcacaggaaaacatggcttactatgaattttgatgagcaggataatatcttgttcagatgacgaggtcctcgcaaggaaatacagaataagaatgaggtaggtatctacgttgcacctctagatcgaataaaaatttgatgtactactgggaggggtgaagtgcatgatcttttataatttctatattaaaggggaattgatgcaccggagcttaagatgccctacgggaaggaatcacggactgcgttggtgaaactaattggtgggaagagcgtcaaaatttatgtatatgatctggaccagtttgggcgctacgttggtgatatctattgcaatatttgttcattcaggtgaaacataacctatttcatcagtacctccaca

SEQ ID NO: 67877 - DNA, 11982 bp, Oryza sativa
cctcttctctctctatttctctctctctctctctctctctctctctttcccctctgcaggatgctcggcgggtggggagctcgtcggggcgaggtgggagaggacatccggcgggccggcgatgcggcggcggcggcggcatcgttgacgatacgggagaagggagagcgtcaccggctcaccgcgcgtgcgacctcggggtcaggccgctagagaggcccgagcggtggcggcgaggacgccaaggcgcgggactccgggtggcggcggcggcatacgacgcgctgccggcgccggtttgggaccaattagaggagcagagaagagtagggccaggccgtcatctcccgacaacggcggcgaggcaaaggaagggcggcgcggcgaggagggagcgtggtgctgcgggaggccatggcgggactcccggagcacggcgacagccgcgtgaggtacagcaacgcgtgacggcgggcaagcgagggcggcgaaggcgagcccgcagcggcggtggctagggaagcagcggagacacggttgaggagtggacagcgacgagcgggagcaggccgacggcggcaagggagttgggcgagcgcggtggcggagaggcagcggcagcagcaggcgagcgcggctgcggatggggagcggcggcgccgactactccgcgccgctcggtctcattgtcgtcggcggcttcgggtgggggcgccgcgccgccggcttcttgtcgctcgtccgcggcgggggtgccgcgccgccggcttctcgtcgcttgccacggcgctggaacgggggaggacggccggagaggcggctcgttggggacaggctcgcggaagagcaatggccggaaggacaacagcagcggcggcggcgacaacgcgtcggccggccaactccctcctcgccgcctccatccccacttccctcccgctgtcgccatctccgtcttccgctcctccctcgccccggatgggagtttcgtcggagcggcgtcctcctcctccacctcgccaccgccattccctccagctcccccttcgctctacccctgtggtcccgccaccgacgcccctccccgctcgcgtgcgccgacctcgtcgaccagggtgacttcaacggggcacgccacgacgggacaccgtgctcgccgccgccgacctcgtcgagcggggtgacttcgacagggacaagagaggccgtggcgacgcccgaccgcggcgtgctccttgcaccggcgaccgcgcccgcgcctgccgcaccgtcctgccacaccgccctggctgctcttcgccggccaccgcccatggagagggaaggagagaggaagtgagttgatggggagggtaagaagtggtgacatggatagtctgacatgtgggtcccacgcagactcagccgccacgtcggacaataccggagtcaaacccaccgaaggatctaaattgaagggttttgtaacttgagggatgtcatatatctggttttgtggttgggggacgattttgtaactcgatgacaagttgagggaccttcggtgcactttttcctgccatcgacggaatgaaaactcgaaatcttgtccattataaaagaagaactgactacgggtgaaacttgaattaaggggctgtttgggcagaacgatggagtactttcaataatctaccaacactaattaagaatctgtctatctgtatataattctctcccgatctgtttgcctgaattttcagtgcatgggctcctctttctctgctcccagatcagatgaactgaaattgaaatggagtttaatccattccagataatcatcaatcatatatgtccatttaatttgttgatagcgtactccattaaggaaggaagaatcacaataaataaatcaaacaaaggccaccacatccaacagctaggcaatcattttcagctactacaagagagggaggatagcagcagcagtatcggtccctattccgtcaactcaacaacctgaatgcgacatacgtttacgtcaatcaacttctaaagcgtctccctaatttttgccatttaaagcatgtaatcaaaccctctggattacgttttccggcaacgaaagcgactgttatcaatcaatcaatcaatcctcgcctcgtcgtcttcctccagcgacgtcgaccgccgccgccagctcagcacggcgcccatccgcggcagcctcaccaccgagttcacccgagccaccccctccagagctctccatacattcgtcccctcctccgcctcgccgccgccgccgcccaggacctttcggaagctgcccgtgaacgacacggcctgaggaggtttcgcgtccccgggggtgctctccgacgacgacggtgaaggcttcaagaagaggcacaccacggcgcagtcgtcgaccatcgacgtcgggaacttgcgccgccacgtgcgcaccgcccgctcgacgagctgcttggcggccttggaatggtcagtagccgacgatacgatcttgatcacctccttgttcgacagcacgtcccatatctgcacccacaacaatttgattggttgcattatctgaaaaacaacctctatccgctattctgatttataaattccctgtggatgaaattttgattggttgcattatctttaaaaaaacaatttgattgattgattgaggcaaaagcattcatgattcagttaactttcgcttttctggctgcaaccatatggctttgcactattaattttgtgctcatttcatatctagtactggaactggagtagcagtgaaacaaccaagagaaaagtgttactcttgattatgaaaagatggtgagtaaatgaaactgaatttggctgccatcatcaggcaaaagtctttctgtttgcttaccccgtcagtagcaagtaccaagaagtcatcttttgcagatagcttcctgtagtagacttctggtgtacagattagtccatgactcttcaagcagaaatctccaaatgcccttgccatggcgaggcccggcgcgtcttggtctggtagccacatcctaggcacgtccggctcatcgtccatggcgaaaacccgccccttggaattcaggattctctcagcttcgcctgtcagaagcccccatatgaatgacaagtgaatgtctgaatttagacatctctgtactttgagaaattcagaggcttacttggaagatttggtttcaggtcagtggttagttggactgaaattgggcggtccttgctgtctcgggtgcaaagaaccgcacgtgaatcgcccaaatttgcaatgatcaggtgatcaccctgtgcataagaatagtatttgggaatttaatcagaatgattacgagtttgagagttctgtatttaggcacaagtatagctgtaacatacgcataaaattcggcaagtttctttgttgcatctgatggtttcagaagcttgttttttaggcagaaacggtgtatttctagtgcataggcaagactattggcaatacaaaaaaatgttgcaagtttgcatagttgtagcactagtacctgcctaacgacagtgacagcagttgtgccactacaaatgcagtcaattccagaatgttgcctcagatcctcatcaacatcctcaaatgtcttgacaaatatgttcttccaggtggataacaattgcttctcattgcttgtatcgctcaatgaggtgcaatctgacttttccaaggtttccttatctgtgttgctggatggatcttgttcagtcttcagtgccaaagaggaggatagtttcactggaaggacgtcgcggacatggcgagcaacttcccttccgagagggccatgcccatcaaaaactccacaaaatatctggcccttgtgccccgcaaagtcctaatgaacttgacacaggtagcacatcaagacctagattatcttatatatattaagtaaaatgtgcacatcaaggggaaaagggaaatgtactatcattggaggtgcaagctagagaggatcaggtacggttgaagtaaatattacagaaatgtaggtacatttatcagtttcagcaaaagcagagatgaatctagtgcccggtgctcaaatcatgttctgaattcagcttgtagtatctaatcaaagccccttactagcactacccttttccctccatggctagctttagcttgtgtacatatatcacaaagatgagggaatttgcagagacaagaagctaagcagcactgaacaaacatgcaagagcaagcaatcaggtctagttgaagatttgaagtaaatacaggctattacagaaatgcaggtacagctcaggctacaaaaaaaatcagtttcagcagagcatggatgaatctactagtgtatggtgctcaaagtcaaatcatgtcctgaattgaagttgtagtaggcaaacaaagcccctttctagactagcattaccccattcctccatggctagagactcagcttgtgtagtactagtacatgatactagtatcaaaatgagagaagaatctgtacatacaagcaaaggaggactgggaaaaacatggaagcaatgaggcagcaatgtgatgagcaagcaatccaatgcaagagagatgtggttacctggcaggtagtcatggcgtcctggttggcgcccttccagccttgcttggtgtgcatggagacgccagcgctccaaagctggtcgtggaagaaggcgtcgtgcttccatggaaatccctcctcctcaagctcctccttccccttgctgcagcatatccccattgcttctgctgctgctgatgctcccctaggaaggaaggaaggaaggagggggtagagagagtagaatggagttgaatgcgtaggggtggttgaagtagttttgttgttttatcattgatggtgatgttgggcatcaggcaccccatccatcggccattaatggcgacggatgtgcatcgatgatggccaggccggctgtctatcgtcttggtgactcgccgcgtcggccatacaacgaaccacctcactactggagtaacatgcatgcctgtcgtacaggtaaggtaaggttggagcatttcgtccttcatgactgaaaatttcaggacaacatcttactactaccatcttttatgttgatcgactaccagtgtatatgtgtactagtctactatactgcagatgaaactacacagtaaaactgaaaggaaggaaatgacagtgcaaatgcaatgcagtgttgtaaaaggatacgaggttttctctgaagatgaagtgagctgtatctgaattctgatccatcgatggaggcgtggagaagtacgtggagatggagggatccctgtgcacaacggcgatgatggatagtagagtatacaggagtatacagtagttgcggatggacggaagttgctcattattacaactgttggttgggttgggacgttggttgcttgcaattagagtatttatttattttctcagctccagaatcaactgctgaatcgcctacctgcatgcatctgcagttttgcattgcgctgcgcaccatccatcctcctccgcttcagtcttcaatgctttacaccgtgcctacctgttgttgatgttccctcctctcacatatttcagttgtaacatcgacttgtgacttgcatttttatgacaattgccctcacctatttccccggtccttggagacaattgcccaacaccagcaaaagttaaatagtgataagcatttttatgcattggaccatgcatggaaccttactgtgtaaatgactccatctttctgctgggagagatgaactggagtagcaacaaccaacaagaacccgtgcagtccgggcatgcctgacaaaaccgcccgctaccatgtctcagctctcaactagctagcattcagaccttcgcagaaaaccaatatagtgttcagtgcctttattcaggcaaggaagctatgagacctcattccagataacactccacataaaacactaggagatggaacaaccaaattatagtgagaatgcaatgttccattccattaatcaaattgtgcatcaaaaaggcacagcaaggcatatcacatactccgcactacttacaacatgctttaccccaatgatctctctttgattgttgattcctacctgcgctatatacaacacagcaagaatataacctccctcgcctccactggcatacaagcaaaataccagtactagtatgttgttctgacaatactaccgtcagcaattcaatacactattcagccagttatggcacaaaacttttggagctcattctctaggactggagatattgctctagataaattcaacaccacaaaacacgccccagtttccacaacgtttatctttgaaacatttcactgtacaagcaaatcctgcgactgctgcttccatacatcacacggttctaccgcaacctgccaagaccacacctgttattagacactgctttctaataaactgcataccagttaatgaacatggccaaaacgcaagggtgaactattttgcacttcaattcttctacacaagtaaaccgactagcatcttactttgtataaccagaaaagaaatatagtagaatacctggtagggtttattaatccactggaaaagacaaccacgggcttcaacaactttgagcatatgtgatggcaccatggatttgaatgcttcatgaagcttcacttttctcaaaccacagaccataagagcagctatcagtccattaggcgtaacacccgctaaatgcacaatggtcatgttctgcaagccacatatgcttgaaagggatataagcccaatgtcggtgaccgaacaatatgacaagtttatctgcagtgatgaggagatgttattaagacaattggaagcacggtattgcgattatttcttttacagcagaatgggctaatacctgccggaggttgtgagagaattgggaaaggaaaatcattcccatgtcattgatctcaaagcatttcttgatatcaagcttagaaagtagcctgcatcctgtggcaatttccgagagaccagcagatgaaaccatggggcagccacgaatctccaatgtgttcagctttatgcattttgaaagtgatctcagtgaacagtctgttaattttgtgcagtaggacaaattgatagactctaacattgggcatccttgagctatatgagtaaccccttcatcactgatcgccccagacctgaaagagaggctattagttagtcttggctcctatcacggaaggaaaggaaatcaaatatgcaatgtgtagggaataacctgtacaaatcgatatctcggagatctggacaggacttgctaacgtgtctaaggccctcatcagttatcctcaagcatatgccaatttttaggcttgaaagtttgctgcatccagagagagctttcaaaccttcatcatccaaatcagtgtcagtaagatccaattcctccaagtgagtgcagcgccttccaatcagctgtagtcctttgctggaaacaaggctacaggactccattctcagagagatgagggaggggcatgaggttgtgatggcagctaatgaaacatcagtgattttgcgacaacaagtaacatccagcttcagcaaatttttcagtcttggcacgacaaaagaaagatctgtgtctgtcactccagaacatttgctcagacttaactccctcaaagaaacacaggatttcccaatggattttaatccatcatccatgaattggcaaccatccagcttcagtgtctgcaatttatgaatcatttcgaagctgcttgacatagaaggagtaacctgccacaagaaaagtgtagataaactgagctcaagttatgtccaattgttcaggtgataaaactagacagtgggctacttacaggagagcagtatgatagattgagttccaacagattcggcattgccttcacaatggacagaacaccgacatgagtgacattgtaataatttgacatatcaagaacctgaaagagtacagatataatttcagctctcagttaccagaaattgtgatactcttattgttgaaggctaacaatgatttagtccaaattgtttcagttgcaatatccatatagcctgaattgaaatgtaccaaacaatatacgaggtatatacatgttagtatccctacaacattagcattgcaaacctactttacatgagaagctaactgaatatactcagagcagaagacgataaacaaggatattaatcagatttaaatttagctagcacaatgctcacagtgaaaaagataggggttgatgattacctgtagtgatttgctgcattcttgatcaagactagtaagggcatcatcatcaattccattacatcccaccagtagtaacacttgtagactttgtagcttcatgatggctggaaagcatttttttacaatctgcacaacaattttttcttagtctgatgagtgtgatctaaactgcagggcaaataattaacctataaccaaaaaatgatgataaaacaaatcaacgggagaagtagttactactggttctgacaattgaaaaggtgaggcaaatatcattttgggtatagataagagcatctgcagatcaagaatagtccaatttccaaagcgcttctgtcatcataggctaatgttattttgtgggcaatattcatgtcaggtgcagagaaccggcagattcacaaacaagaacaagaaaaaaaaaaccactaaattaagtttcctaaaaaaaaaacctgaccttgaaatcaagaagcgaatggaaggggaaaagggagttcttttttccctttctgtcgtctaggtacaataagaaatacagtaaatgaaatggaacagagagatgaagaggcaaggcacaagtaccatggtgtaggagagatccaggatgttgagcttgttgcacttgagggcgaggaggtctagtccgagatgagtgaccccgatgcaccacttgagcgagagctcgcgcaggtcggggcatccgacggcgatgcatccgagccccatgtcagtgatgcgcttgcatcgcgacagcgagagcctctgcaggcggcgcgccttggccacctccgccgccgcggcatccccgaggtcgaggccattggagaggtcgaggtccgtgagattggggcacgcggcgacgagcgcggcgaggccggcggcgccgaacccccgggagcgggagaggtcgacggcggagacggacggcgcggcggggagcgcggcgagggcggcgtcggggaggcgcgggcagagggagagatcgaggcgggagagggcggggtagcgggcgagcgcggcggggaggaggtcggggcggaaggggcggagtacgcggcggtggcgcgactcggcggcgtggcaggcgcgggagacgagggagaaggacttgagggcgcgggggtcatgggcggcggcacggtcgaggatgaggaagaggagctcgtcggcgaggtcgttgaggtgcgggggcggggagaggtcgaggcggcggcgcttgacgcggtgggtaggcgttggcataggcgaggccatggcgaggttgactgcaacaagaagaagggaagggaaggtagtaataatggtgggcgtttggcgcggcgcatgtggagaaggagaagaagggaggaagaaacgaaacaagggggagatgagatgacgagagtgccccggcggcgcctcgatctgggtgaggagaggtcaccagctgggttaccgtatttgcccctcgtccaagtacaagcatggctggcaaaggacggtaatatacgtggtcatgtgggggtggaatggtaaatgtggggaagggacggtaatgtacggagagagtacagggtggggtagaagtggaaagcgaaggcgagtggagagagtcagtggggagggggcgatgcgggggaggagagatagaaaaggatcaaaggacgaacggaacggatcgtacagcttgtgagtgcggactcgtacgaaatcacacaactactccttctacccatggaatcttttcaccctacccaccgacgcatgggccctcctcgtattcagctcttcgcgggtaacggaaaaagcgtgagaaaagatagtagatgttggaagtggaagaggacgcgctgcacttgggggagttgttgactggtcccgtgcaccccggggacggctcggcttgggtgaaggaagggagtcgccattgcactcaatccgtgggttctgcatctactttctgtttgcataacgttttccttctcattttctttttctgcttgcacgcacacgttatatgcaaaaagatttaaaaatataccttttttccctgaatttacattaatatatgacttctaattagcgtgcacaaatataccatgttgtcttcagcatagcggggactattgcttgagaacgcgagggtcagtttaaagacggcatcatataactcagcaaacttgtgagctactacctccgtttcaggttataagacgttttaattttggtcaaagtcaaattattttaagtttgattaagtttgtagaaaaaagaatattttcaactcaagaaaaatttattatgaaaatatatttaattattgatttaatgaagctaatttggtgttacaaatattattatatttatctataaacttagtcaaacttgaagtagtttaatagtcaaaacatcttatagcctgaaacggatggagtactttgctgcatttgagttggcaaatgccgagccaacataataaaccagtgtaataatgtaattaaatccacctacctttctgtataattgtgatcatatttgattgacgacatcatgcgccagcatccagacgagttcaagcagatgggatgcaaagtcgatgatgtcctcggactgacccgaacgagtgcatgcagacatggtgcgagctcgtgaccacacggcccagtttacatagaaaatatgccatctcgcggccctataaaattacttcgcttcatgcctgtgcgaattcttgcaattttgtggtgtccacatctgatcttattgaccatggctatagttcgcaaggtttcagcgcgaactagttgagtgttcgcatgtcgttctcgtgacgatgatttgttattgtgaaaattttcagcatttgtatacttcaaaaaatgatataattatataattattatactttcaaaaatttgtatacttccaaaaatgatgatttgatatataattatttttccacattacatacatcatcgaacacatacagatacagtcacagttagatagtggtacataagtagtcacatgtaacatattgcgtacaacggtttttactttttaacctttacaagagcatgatcggtgccatgctcatacattacaacaggaccatatgagaataggttgcatgagcccatagaccgaaacaatctgaccggtatttttgaaccgatttttttccttttaaccaatagtttgatttttctttgttttttttgaggatgggtggttatgcgagtgatgtgagggagagggaacatgtcgtctgcgattttatagtagtagagatgtactcgtgttgttcaaccgcggtatcatgccgttgccaatcatattttgtgtaatatatatgtatgtactccctctgtcaaaaaaggcaacctagtattaggatgtgacacatcctagtacaacaaatctggatatagagaggatgtgatatatcctagtacaacaaatctggacatagagaggacgtgtcacatcttagtagttgtttttttttgacagaggggttatagggatgaaagtatatcaaattatgtttgatttgtttcaaatctaatcaggttgatgatatagtaaaagaattctaaaagccaacatattagtttttcttttgaaataa

SEQ ID NO: 67878 - DNA, 1317 bp, Oryza sativa
attgaagccaaaaggctatcgaaaagcagtagcaattagcaaaaggtgaaagcatatatctggccagccgttcatgcatgtggagagatggaaaaaaaactgaataataaaaagcaggttaggtcggtcggtctgagtggcacgccgtacctagaaaggacagaattcagttccgttccgttccgtttggtactggaacatgaactagctagatcctctcctcctcagtacatacctgtcctgataagcactcgctccaaaccaccactccagactccactatgtacacccaaaatcttgaaagaaaaggcgcttcaagtacaggagtaggcaccagctgattgcttatctttatctgctcgcatttccagtaaaaattcctccttgtccgttctcttcttgggaaggcttcttctacaccgtactctaacctgcaattgttttgattctacaaaagttaagggcccctttgaatcgtagggtagaaaaaacagagaaataggaaaaatatagaattctgacaggaattgaagtgtaaaacagaggattgcaaaacacaagaaaaacacaggaatggtcgtttgattggagcgcaggaaaaacgcaggaatcgaatgagagagatagactcaaagaaaattttccaagaggttgaagctcttgctaaatttcctccaaaatccacatgcaatgtgccattccataggaattccataggatttggaaagcttccatcctttgaatcaaagggccaaataggaaaatttcctataggatttgaatcctatgaaattcctatatgaatcctttgattcaaagggccctaaggctgtgttagttgcttggggttaggagctaatccctcacacacgtaaaacgagatgactcatttgtgcatgattaattaaatattagtttttttgaaaaaaataaattaatatgattttttaaagtagcttccgtatagatttttttttaaaaaaatacaccgtttaatattttgaaaaacatgcacgagaaaaaacgaggaaggtaagttgagaactttatcaaaatttattaaaagacgtgggccaactataaatataggatatcaatatatttatatgaaaatataactatctgttcgtaatatctagggacacaaggttcctcaccaaaattttgagaaaatgtgcaactaggggtaactccaactggacatgattattgcagttgctttcatatatactactcctccagttgatgctaccttagtaaatgacgattgattaaatagtggcgtaccacgcgcacacagatcgttagtagtacagt

SEQ ID NO: 67879 - DNA, 4593 bp, Oryza sativa
aaatgaagagagagaacaaagttatctactaatctggagatagtctatagagaaaaacgaggcaatgtattagagagctattgatacccatgtagacatactattgagatgatttactattaatctagtctattgctgagatgtacatgttttatagatagcaccttactttaccattgcggatgctcttaggctgcgttctggcaatactgctgctgcaatgcgctattatcatgacaaaataacgtcattgttaaccaagcatgaaagctggacttaaataatataattgccggtgcatgtgttcatccggccgtacgaaccaatgtacgtatatatgtatacaaggtaattatgccataattagctgcatgttggcggaatgagtcgccagtttgaagcggcacatatatatactccagaacttaattagttggctgatttatgcaagaagacgtacataaagttagttgaaagagaaagggtaagagtacatggcatatatatgttgctttcttgttgagctagatgctgacatcatgcaagtatattgacttttcatgtgttgatccatatcatcattcatgccgtacgtacgaacgtgctacggcgttgaaccgggatcatctatcggatagataattccaattccaagttaattatagttgacattttctatgagctggagcagtttggagtactagtcaactttggctgccatccgtacattatatttgtaggtggagtagcaaaccggcggcactcgagtaaatttgcatcttaaaacgatacgcattgtatgtaaattaaaatggagtactcatttgctccctccatccacaaaggttattccctgatcggatggcaaatgctttggctgatcagctatttaagcaaaataagctaactaatttgcattgaagtttggctgaattggagacagctttggctgatcagccaaagtatttggccaaccgatgaggctgttagatatggtatatttcacatttaagttttttcaaataagttgtttatatttgttttttatacatttaaaacttataaatgaagagataaattaaatgtttgattagaacccaaggagtcatcttagagtaagtttaatagtatagccaactactagctccaaatcatctatagccaatgtaatagctaattcatacaatagttgcttactaaactattaatatctggtcccacctttcatacacacattacatcttagagtccgtgctgtatttggctgcagatctatagcccgctgctcttctctctcttctgttatctctttaaaatatgtttatagctagcttatagcctactattgtacctgctctaaatactcattggttgcatatttacattcactccttgattttgtaatatctaagatgatttaaatttctctttgatcttgatgacaaaagtaataggtataaattttgtggatagaggaagtaattaagaagaggaagtgatcagctggttaattaattggcacatgccaggatgtaaaaagaaagctagtggcttgcagcaaggagttaatagggcctcattttttcaagaataagttcaccggaggtccctcaacttaacagcgagatttctttgaggtcttttaactacgaaaccagaaatgtatatcccaaaactcacacaatccgtgcataaaaggtcccaaagcagtatatatgggtggttttgctgacgtggcatcctagtcagcaaaataaaatttaaaaaaagtacatgggcccacatgtcagctgcacatatatttcttttctcttttcttctcctctcttctctcttctcacttctcttcttcaggccagcggcgggcgagctcggcggcggcaaggaggctggcacgacgacgtcgcgcgtcaccgatatgcacacggttatggcgtcgacaagctcgtcggctggcgcggccttcccgtggcagaccgggcacgaggcgtgggacgagagccacatgtcgatgcactcctagtggaacacatgcccgcacgccaggagctgcctcacctcctcctcgtcgacgacgctgaggcagaccgcgcactcgaccgacgctgccgtgtccgagacctcgcttccccaaccaattgcttacgtacgactacttctccaaaattccccaatccccaatcccatctcaagctcatctcatctcgtttcgttagctacctaccaaattaataagctactgacagtgtagcggacgaggaatccaaatcaaatccaatcctcaatcgaaggagtccaatggaatgcgagccggaggagctgcagttcctgggcgtggtggggatctacagggaggcggcatccatcctgcgcgcccaccggccgctctttgcccgcatcgccgccaccttcgtcctcccgctctccctcctcttcctcgtccacatcgccatctcccacgccctcccacatcgactccgacgactccgccctcgacttcgccgccccaggcacccccgcccggtgccgtctcgctgctctaccgccgcgctcgcccgccgtcggctccgccggcagcccgccgccgcttcgctgctctgccgcctcgctccgccgtccgctctgcccgccgcccgcatccgcgcgtgcccatcgtctctcctgctctccgcccgccgctggcctgaagaagaggagaatagagaaaagaggagaggagaagaatagagaagaaaaaaaaatatgtgcagctgacatgtgggcccatgtacttttttatatttttttttaactaggatgccacgtcagcgaaaccacccacatatatactgtcttgggaccttttatgtacggtttgtgtgagtttaggggtatacatttctggttttgtggttaagggaccttaaaaaatctcgctcttaagttgagggatgtccggtgaacttatttcttttttgtcagatagtagtatttttcttgatgggctttgggcccaaaactccgttccatatgcacgttgggcttaggcccataaaactcactgtcccataaaaattaaaattctagctaatttaaaactcactgtcccataaaaattaaaattctagctaatttaaaacaaattaggaggatagacaaatgaccacgataatcttatttaatcaaaaccatacatgcatacatttcatataaaaaatagattaattaaaaggaattttgagacaattaacccacattgttgtcgaataacaactgcgtcacgtcgaaggaggtggtaattcagtgaataactggaatggtaaagcaatatattaatcggttaaaaattttggaatctctccattacatggcgtacctagggggctatttatactcctagtatatgctcataccctctagggttcggttattataggggaatttacatggttacccttatgctagagacattaaagtgggtatacaatgtctttgcatttatgggccctgaggtggtcttcccgggctggcccattaggtggcgaagggcctccatgggttttgcgggttttgtgggttttatacacccaagacaaagatcgaaccgagccgcaccaagctaagccgaactagcgggttttgcggttttaagccagtttttattttgagatgcatcggttttcggtttacagatcggtttttgttggcgtgaaccgagctcctgataaaaccgaagacatcgttcacagccgactggagcgagcactagtagtagtgctgcggaataagtccattttacctccctcatctcttgcgcttgcgtgaataacatccctcaaccggaaaaccgggtataatgcctccttctctgaaaaccagagcaaatcacctccctctgtggttttgctggtggtttcgtccgacgtggcgtgttgacccggttgacaagctgactcagtgtggtgggacccacatgtcagtgtgtagctctctctcccccttatctctctccccctcatctcttgcgcgtgggaacgacagtggggagcggcgcaggcggtcggaagcggtggcgatggcggcggggacggcggtcggaagcggtggcggcggcggtggggacgacggtcggaagcagcggcggcggcagcggcggtggcggttgggacgacggtcgggggcggcggcggtggcggtggcgtcggcggtcgggagcggagaagtcggcggcggcggtggtcgggagcggcggttgggacggcagtggcggtggggacggccgaagcagcagacagcgcctacggtggtcatggagtagagacggtagcggcggcggtgtggaagcagcaacagcagcaggccgccccggtgagctccctccacagcgctcagccaccttgcgagctttctcccaacacgcggccaaccgatgagctcctcccccgcgcgcagccggccgacgagctcccctacctgtgcgaggccgaccagcgagctcccttcccagcgcgcgacctcccggcgacatcctctccccatgggcggcggcggtggcgagggaggcatcggccggcgacggtggtggcagatcggaggggtaaacacggcggtggg

SEQ ID NO: 67880 - DNA, 3736 bp, Oryza sativa
tcgccaggcgccaggagatctccgttctcaaccgccatcccaaccgccaccgccgccttctcgctctcgaccgccatcccaactgccgtcgccgccgcctccttctccgctcccgaccaccgtcgccaccgccaccgcctccgccgccgcttccgactgccgtccccaccgccgcttccgaccgccgtccccgccgccaccgtcacggcttccaactgcttgcgctgctccccaccgccattcccacgcgccagagatgagggagagagagaaaggccgagggagagagataagggggagagagagctacacactgacatgtgggtcccaccacgctgagtcagcttgtcaaccgggtcaacacgccacgttggacgaaaccgccagcaaaaccaccgagggaggtgatttgctctggttttcagagaaggaggagtcattatacccggttttccggttgagggatgttattcacgcaagggtaagagatgtgggaggcaaaatggacttattcctagtgctgcactactactaggcaacgctagcccagtcggatgatcgcaggcccaaaggcccattgtgtggagcttgagggatttgatggcccaacagcaacaatacagcatcagcacgtacgtcctcttcctttttttgtttgtagagcgcctggtcggtatcttcggtacaaaccgacactgaacccaagtatagatcggtttttttaacatttttcctgatggatcggttgattgcagaaaccgatctcttacaagaaaaaaaccgatctcctgaaaaataacggtaaaaaccaaactaaggaatccatataaatcgattggctacatatatacacactagatgaagcattattattagttgttcctgcattgctcaatagcaaggaggcgaggccgcggtgatatggccacccacgggtatccacagtatgcacacacgaatccctcctgtacgttccctgctacttgcttcaagccctagcgtgcatggatcgatcgcctgcttgtttagatatttgatttctcgccgactcgcttcgatcgatcgcctactgccacgccttcctgccttgttattttctctcgcgttgatgctagttcagttgttttaatgtgttttgttcgcgttgctgttaattcaatatactataatccatgcatccacgatcgaccgacttgccgcttgcacaactagttagttggttggtgttttattttgtgaattagcgcattatattcgtttttgttcgatcgataatgatctgattgcctggataggttcatttaatgtttcgctcgctctgatttgatttgtttgcattgcgcactgttgatcaaaactgctagttatggaatccgcccggccgtgcacgctagctcttaaatcacagtgtttttgttaattacagtgtagttaattagtaattatagttatatgctcgctgctataggctatagctgacgtctttaattaagtgcattttagtttaatttgggtgctggaaatatatatgtgcatctaatggcatgtagaaatttgatcaatcgcgctgctcctattcattcatgtgttgtatacatacatgcttcaccgatagattggcgatcaatatgttccagtctggctagttgcatatccgatccttacggtgcttgcattcttatgttaaacacattaatttgattatttttttatcatgtttcatgcctatgttagtatgccttagactagggacacagttataattaaattaatactctgtttgatggagcaagttgggaacttcccccgttggcacggaaaatgagatagcccgttagttgattaattaagcatttgttagaaataacttgaaaaatagattaatattattttctaaagtaaattttctaaaaaaaattgtgcaaaaagatatcattttttaaaaaacgagaaaatagaaatgaaaaagtgacttccgaacatactagcatgggtgcataggagttatatacctgagtactctatcttgtatataggccccgtttggtagggctccaaactccaactcctaactctaaactccaacttcagtgagagctagctccggttggagttgaaaactcgttaaaagtgtctggctatactttcagctctagatctgaaaaaaaaaacgaaaccaatcggccccagccgtgccgccggccgccggccgcgcgcgccgcccgttgtcgtcccggccgccgcgccgcccgtcctcgtcccgcagcccctggccgccgcagcgccactgtggccccccaccgccgacgctgccgcagcccgccgccgctggcctccacccgctcgtcatcgtcacgccgcgccgcctgtcgccgcctgtcgtcgtcccgccgccaccgccgccgacgctgctgctgccaccgccgcccgccgtcgccggcgcccgctcgggattgggaggggaggagagagaacgggaggaaaggaggattgtaggggtagttgagtagcattttcgtgtaaatactctaaaaaaattagagggtagtgggtcttttggggtggagtggagctgtggagcagcaaaaatccagccccacccccgtagttcattttctaggagtagctctgccaactccactcaaaaaaagtggatttggacgtttggcacaactccggctccaggtaagttggagttgagagctagagctgtgccaaatggggccataatagctttacatccatgaatattatctctctagcacaatcgagttgttccataattctgtaccaataaattgatataaatcttaattatttatgccttcacttactgctggtttaatttgctatgtacaccaatttgctagttagaaaattgtgttctcatcattttgcagcgtacatttagcttctttcgtatttgtaatgttaggtactacttcattcctagtaccaaaatataacaggttttgagattagatataggattaggaaagttggtgaaattaaatgcaacaaggttgttattaattagttgagaaaaggaggtagtagagccaaacggaggaatgctgtgattgatggagaagatatataggtagagaaattgctacattttaagataaatttttaacattttgctttgggacaaagggagtacgtagtggcggaagattgaacaaaaaaattgacaaagttacatatcatgtatacatgcatatcggtgttacacatcatatcatatactgtgtattagaagatatattattaagtatacgatacttcctactagctagctatctcacacacatgtatatatactccctccgtcctgaaataaaccaaaaatgtaacacaacctagtgcaacaaatctgaacaaccctatttttagatttattagctagtttatgtcacatcgttacttaggttggtttatttttaaatggggagattatgctggattatattccctccgtcccaaaataaattaacttaatataggatgtgacatatttggagggagagtataaattttagttgataattgagtactgcattataggcatataaaagctagaattttgatgcttgcaccgtgtcgtaggatgcatgcaaactacactacttggttaataattccctttgtttatgagtgattataggtctcatttgtggggcttcaccgccaacgagaaagaggcatactcaggagaaaacgatgaacgccagca

SEQ ID NO: 67881 - DNA, 4946 bp, Oryza sativa
ctgcttatgtatatcaggtttagtacatatgtacttactatatacctatataggatacctatatgggactttatggtgcccgggttctaaggtataaaacacacaaattctctcaaatttttaaaaaattttaaattgtgagtatatacctaggtatatgaatttgattcatacaaatacctaacaacaaaacaactcaaactcaactttatttcacaatttattattacatacctaacgaattatatgtttggatgttatacacctagaactaaaattgaacaaaaaaaaattcaaactcagttcaaagttgttagtaaagaagttaatgttcatatctaaacatttaaaaaaatttcatactcattcaaattgtgtatatactcaatttgaatcttggagcccatactccatgtagcaccagttaatttacctatatatatacacacacgtactgacatatataagcactaaactaattggagtattatatagcaagttgaaaatgcatcagtatgctcttttacttaattatttgcaggttgataatagaagagaaacaacctgagatcttggaattgcctggcggagggatacaagtgcatcaggagatagacgctgcggttgcagagctgatagaacaagaagcccttgatgaattagagcaactggtgaaagcccaaccagaagccgctgcagatcagcaaaatccagttgagccacatcaagatgaggatgacaagtgagactacttgcatgcaagcagattcattcatatatttgacattctagctagtcaactaaacgttgcaccagctcacaccacaaaattatatataacctcttggtttctactacatggtgcaggctgagtttggataatttgttggaacaacatcgttgggagggagctctgcggcggctgacgcgcatggtccgtaatggtgaagccatcaatggccctgtacctgacgcgccaccccaagacatttatgttgctcatcccgagatcgttattttgcgagtacctaagaacacccacaatggttatctatagactctctacaagagatctatgtcagcatattttcttacatggaagatattaaatgaagagagagaacaaaactatctactaacttagagataatctatagagaaaaacgaggcaatgtatgagagatatagatacccatgtagatatactattgagatgactattaatctagtctattgctaagatatacatgttttatagataacaccttactttaccattgcgggtgctctaaggctgatgcgttctggcaatactgctgctgcaatgcgctattatcatgacaaaattgagtccatttattcaggagataccggaagtgcctttgtcaacggtggtgttttgaaagaaatccgggattgggttaatgcaaagagagatactccattgtaagtgtcacttggctactagcactcgatcttttcagttgttaataatcttccatatataataattaatataattgcattacgtgtgtgttgtgctgataattgatctgtgttgttgcaggggagaagatgaagctacgacccatatggagaacacctgccatgcgatccatgactatttgaagctttatttcccggcatacaggtaattaaacttaatttgttgcattgaattaactaacatgctcctctgcctattgcaatatactagtactgcacgcacacaacaattgattgtttaatactaattaattagtgtagtgttctcattgtcacttatgatcgatttataaactagtaaacactgaatttgcaggccacaaattgggggaaaggttagaggtcaccaagtaagcagggtctgggagcttggggagaggcttggaaaagatgacggccgctgcttagcgtgccacaagagagttaaggggttcaatgtgaccaaactccagaatcacctgcaaggatcggttaaaaggcaaggaatacaatgcccggcaatcaacaactacatcctgagcaggctcgaacggattttgaaagaaatgaacgaagatcaataagaacaaattaaattgaacttttatatgtgtatgctaaatttaacttctacaaattacaacaaaaagaatatattaaattgaaaatagttaacatatattcacggttatatttgttaacattgtagaatttgaatttgaccttgcttgcatgtttgtggagtgatatttttcatattaatctatctggtcaattttataaaatttttaatggctatttaagtgatatgcaagaaacgagggatgaaaatacactttctcaaatccttctcccttttcttctccatcctagcatgcatattggtatatgttagacataaatacaaggcatatatgtaaagccacatattttttattgggctctaatgcaaactagaaagaaaaaattaatactattgtccttataaattaggaatatagtattaagttttcctttattagtttgcattagagcccaataaaaacaaagtggcggagttcttggtcagatcaagcggtcacctttgctccgccgctatcattttactatcggtagttgttaataaattagtcgatcactcgaaaacacgttattaatccgtttgggctcgctccttataaatctcacagcgcgagtacgtcatctcaaaataataaaaagaaaaaaaagaaaaagaaagaaaacacacacagcgcgactgcgcgaggtccagcagggaagccggccgcgtcggcagagactccagccaacgggcgccgccgcagcctccgccagtcggcagtgggagcaggcagaagctgcagcggggggcctcgagcaggtggcggcctcaagcggaggcgagcaatctcagggaaaccaagctcgccgccgtcgtacccattcttccgtcgcagatttcgctgtgactggttccttgtgattgaatccataggaacggaacccaaatcttggaattgtttttgcagtgcaagtctaatccttgggaggaaaaaaaaaagaaagcgtaataaggttggtttcttctccatcactcccatcacctacccacctgataactcctctcctcctgccgccgctgctgccacactccaccactatcgtcgtcttcttatcacccctacctcacctgcagtcctgcaccaagcaagcaatctccaaagtgcaagctttctcttcttcctgcgtctggatctcgctcaggtatgcgtccacatttgctttcttcttcctccattcccattcccccctactctcagatgcgtggataccccttcctctgatctacaggtttctcctctgcctgccactccccatggctctggattcaggtcgctcttcagcattcactaccgtattcacttcttgaaggccaatttctggttcctcaccaaaggttggttactctttctttctttcttgtcatccactccaagttgactgcctctgtaaatattctatctttccaactgttgcaatggtagcccatatttactagtattttttcccttggtaagatctagtggccaatttaacttacatcttcaaacgcctgtaatcatctatgtcaattaattatgtcaacctgtagctgttcgattctgaacaataagtgggaacggtagttgacaggtcagacctgcttcattgataattgatactgtccaaatggcgatgtgttgtcttgaactcatggtcattatctggttgctaccatgtagctttctcatgaccactagtgttgccgactcaacgagttgtagtgttcctgaccattctgttaaacattcatgccttgtctttgtggcaacactaagaacatttgatcggctagcaagcttatatgtacgtaactctttttgattatttctttctactttactgtcatggcatgtgttatatgctgttgcagaaatgcactccttttatgtttgagggaatggtgatttgcatttgtgagtgacatgttcttatcttccccatctaggtacttgatgatccgaagatgtcatcaaactccactctgacagattctcttcatgagagaacaattgtttttggcctgaaactttgggttgtaattgggatatctgttggagcatccctacttggtgttcttctcatacttattgtatgcctcaccttacaaacttggatcaaacggtcacgtaggacattcaaggaaattccaattacccaaataccttctgcatccaaagatatcaaggaagtgagggcagtggacgaatttttgcccaatgatttcgttgtacatgatgggcttctactcgccattcagaatgaacctgttgaaccagtggataaagatgtgaatcagtttgctcaagaggacaagacgatacaaggagaagaaaacagtcctgttcctcttcattacgtggacaactatgatgtaattcaatctgtttccacatgtgaacagtcttcctcgcatgctcccgtcgactctgttctgttgccaggcttacctgagttctcttaccttggctggggtcattggttcactctcagggatctggaacttgcaaccaactgtttttcaaaggataatgtaattggtgagggtggatatggtgttgtctaccgtggcagattatcaaatggcaccccagtggctgtcaaaaaaatccttaacaatctgtgagtatttttcgttttttcttataacaattctttggtgatgcagtggcagtgcattggttagtttgttgtccttccttttacttaagctatgaccacttgccttgggcagaggacaagctgagagagaattcagagtggaagttgaagcaattggtcatgtcgacacaagaatttggttcgccttttggggtactgtgttgaaggcactcaaaggtatgggtattattaggattcat

SEQ ID NO: 67882 - DNA, 17261 bp, Oryza sativa
agctttgtgattaaaggcttactagtcagtactgttcacaagtagtcgttgtctatactatcatgaatataaaacaagtatagattgtatcatcttactgcttggtaaatactaattttgtacgaaccaccacatttgcagccttgcttacttacatgaggcaattgaaccaaaagttgtgcatcgtgatatcaaggccagtaatatattgattgatgatgagtttaacgccaaaatatctgactttggtttggccaagatgctaggtgctggtaaaagtcatattgctactcgagttatgggtacttttgggtaagtttttcatgcctttgtataataaattgaggcatgttctctttgtattacgttcaaatcttggccactgtaatttcagaaaaattctgttggtgctaatcactaatggtactcaacattgtgttattattttgcagctatgtcgcgcctgagtatgctaacagtggacttttgaatgaaaagagtgatgtctacagttttggggtggttctgctggaagctattacaggtagagatcccattgactatgatcgccctacagatgaggtaatacttgttgattttttttctgtattgttcagtaccaagttattacataaaagcatgcaactacaatcacttgttaagcaatcaagaagctatgaacttatgatttgacaagtactgtaacacactactgatcttttgtaggtaaacctagttgactggcttaaaatgatggttgcccacagacgatctgaagaagttgttgatccaaacctggagagaagaccatcgacaaaggagctcaaacgtgcccttttgacagctctgaggtgcatcgatttgaatgctgagaagagaccaaggatggaccaggtggtccggatgttggactctaatgaacccattcctcaagaggtttgattcgtttcaaaaataaatgtgcatacatatatatcatatagctgtgtgcatatcagatgcaaaggctgtagctctaaactcttcctttacctaaagagtacgattagtgatttacctggaaatcatgcatattcgtgctatattgtgttataagtacatccaatgttcatctcacagtaaaattagtgacagatggacaacatgagcaatcctatttgattgtatcctatatacctgtcttatcagcattatcggacataaagagcattgcataacatggtattaatgtctaccataaggaaatcatggctttattctgtcattgcctcatgaattaaacacatgtcaattgatttgcaggaaagaagacaacgacagaaccacatctctaataattcagagaccgagccattaagaggcaagagcagcagcggcaagagtgatgcccctgaaaatgagatgaggccacctcggtataagaatcgatcatttccccccaagtgaaaagtgaaaagcatactagagtggaagttatggagttacctgcgatgctctcaatacataatgaattggtcaattgttttgtttctcttttattatttctcttgacttgatcaatttttttgttccctgggaggctgggggagcggccattgcagttacacatatttgtatttcttgaaacatgtacagtgctggtgtgtgatacatgtacagtagtttgtgtgtgatagatagttgaaggatgcacatgagagcataaaagctattatttagaagctagtggctggtatggttgctggtgtgagaaagtgcatgaagaaaccaatgaaataactttttcatattttctgtatactctaagagtataaagaggcaaatgaaagaaaaattgactttcagtttgtgttgtgtgcgacaaatgaacgaactgaatctctcagtggtcgagttcagtgctgtatttatcagctcttcaggcaggagatagaccattctctgaggtgaatttggcaggtgtggatttctattgatacatgcaacctcagcaatctgtgttaatgagaatgccgtttcttgatcatgaacaaatatgaaaaatgatggtacatgcaattcaatgcctccaaataaatgattaatcagttgctaatagcataagagatgcaattcacaattcgcatgcaacagagtagtgttgtgtatgacataccgatgaagtgaatctgtcatttatcaagctcacttgtagttttgtccttagcagctcttttccaggagataattaacccattaataatctttcaggtgaatatctttctctctctccgaggtaaggacttttcttgatacatgcatgcaacaaacttcaatctgtattgttgttatacttatacatgcaattgggcgttgaagtgaatgctgttctcttcttaatgaatcaaatgtgaaaaatgatacatgtaattaattgagtaatgctgatctccaaatgattaatcagctgctaacaataacataagagattaagaggtgattaatttgatgtgttggtcgaggcactagcagagcggcaggtcgggtggaggcgcctccagcgactgcagctcgccgacgccgtcgtcgacgaggaaggccatggcgaggccccaggtgatgtgcacgtcgagatggcagtgcatcagccacacccccgggttgtccgccacgaaccgtatcaccgcccacccgttcaccggcacgcccaccgtgttcctcatcggcgggtcctccacgttgaacttgcccgtgtcggcgccggcgtcgaagttgcccaacccctcggcgaggatgtagaagtcgtagccgtggaggtggatggggtggttctcgccggcgaagatgttggtgccctggagcaccacctgcacggcggagccgtacttgagcttgtacaccttggtgcccgccaccggctgccacagcgcgcggctcacgttctgcgccgtgtagtcgaactgcaccggcgggttggccgggaagtcggcggtgaacacgccgccgggcgcgccgtggtggtgcgcctggaggatggaggtggaggaggggagcacgaaggagacgttgttgatgctcgccgcgaaccgcgtcccgttgggcccgccgcactgctgcgccgtggcgttggtgcagttgaagaggccgacgccgacggtgaagaagaggctctcgtccacgcgcgacgggagctccgccttgcggaggccgcgcaggttcgtcgtgaaggcggtggcggcggtggtgtcgttgtacgccgggagggtaggcatggcgatggcggcgctggaggcgttgttggcggcgccgtagtcgaagatggcggtggtggtggtgttgtcgaaggggacgccctgggcgctggcgtaggcgcgggcggcgaggtagtagcggccgggaggttggtcgaaggtgacgaggacgtcggtggtctggccgggggcgaggaggaggagggaggtggtgtacggtttggtgtaggaggcgtcggcggcgacgacggtcatgttgtgaccggcgagggagacgaagagctccgtgttgagcgcggcgttgatgaagcggaggaggttggtctcgccggaggtgacggggaagacggccgtgtcgtgggaggagcagctgtagaggtcgccgggctgggcgttgacggtgagggcgtcggagatgttgggagcagcgccggtgcgcgtggcggcgcgcaccacgtcgacggggttcatgtcccaccactcccctgtaaccaattttacacgtttcagggctcaactcctcagatttgataaaaaattttaaatttcaaacattaattttttttaaaaaaatgcttagattttcttaaaaaaatatacgtggatttgcattgaaaattataatatcgtaaactaattatattttataaacttattttagtataaatcagtttgactgtattttaaaacgttcagagttgcgtttagccgctgtagaagttttttccacttcagcttttgtttttctttttctctcttctcttgatataaactggtatggctaattgtgttatataacaaaaacttttttcttttaatatattgacgtgcaattattttacacgtttgcgaaaaaaataccgtatttttaaccggagagaatatgattttactgattttaatttattgagaatcaaacatgtaatgagcctgctggtatagtgacattccttctgttaattgtaccaaactgccagagtaaacatggatttgcaacatggaaatccatggccttaattagcagtacagtagcaccaaaccattttgcttatcagacttgtagtgtatcaactattaaccattcaaccttcaactaatctttgtctttttcttgtgctcaagtgacccctgtaactaccaacatgttcttttgcttaaaaatacgaattcctcttattcaaccactaaaaatacaaaagggaatagctaaccctatacattgagccatgtcggctacaagctcacaacgacattctgaataaatggctgaattgtgcaatttttgattatgtggtttccccgaaagttctacttttgaggactgaggacgaaccttttcaaacaatgggacatatgctcctaagaacattttcttcacttttgacatgttcagactagtgtatgcatctctctacaaattgataacttttaatgcaaccttcttttgttaacaaataaaaagtatgtattgcaaccttgcattgcacattcattgagaatattttcttaattattagggagcaaaactttgagacaaacctcaaatgtactttgtaggagaaagatgatatcttagttcttaaggttcaggtacatgtaggagtataaaaatgtttgtaaaagtagctggctagctctgaggaatattgagcattgagcatgctttcagcatcaattttgcataggcagcatgtgcatgtttaagttttgcgccagaattcagattgatgagtaaagaaggatctgagaaacatgcacaatgatgaagtttttgatacataaacatgattggttagctagctttttcttgagatagatcatgtatggctctttggaaagctatgatacactgatgcttacttgtttggtaaccctgccctgactcatgcatgtgttttgactttgagctaagcagcttgtagtaagctggtaccaaccaacctaagggctagaaagctgttttttttttttctgatgaaaggaagatgtggttgataacaatgataaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaatagccgttaacatgcgtgaaaagcagctaaattatgacagcttgaccccacactatagcaatggtaccgaccgaccaatcgtggctctgagatcaatttaattccaataaattaatgtgctataactatcattagctcgcggcatgctattcctgatcatgaaaaaaaaatatagaggaagcataaaaatgcatcttctttttctttggctttataaatcttttgcatttcggccaggacataccttttgacctgtaagtgattggctgcgtgaaatttcagtgatgatggttgcacaattttttgtaggtttggtaatgtgtgtacactatccagctaggcaatagtggtgaaaaaaaaatgctctctccatttcataatactttgcaattttgagttggcatttttgtgtgtgaacatttatactttaaagataaaatcataggtattaacaaataaaccatattacttaagtactacattgcaaatgtataaacatatagatcgatatcatccataataaattcatgatcaaaatgtgttagaataaaccggtaggatttcagtgaggttaagaacatagaagcatgtgtgtgcgtgtagcggcgtgtatgcatctgctatgcgattgcaaaaagaaaaataccagaagtcaaattaactaaacaaattggcggccaaaatagtgagacagataataattaaaaagcatgtagcagaagaaacgtacgtaccgagcaggatgggggcgagctctctggtgggctggacgtcgaaggggtagctggtgccatcgcgggggcggatgaggagggcgccatagacggtggcgcggagccaggaggagtgggcgtgccaccagagggtgccctcctgcgccgccaccgtgaagcgataccggtagctctgcccgggcctcaccgggcactgcgtcacgtactccggcccgtccgaccaccccgtcctcatctgccgcaccccgtgccagtgcagcgtcatgttgtacctcccacggtttatcaggttgatgatcagcgagtccccttcgtttatctccagcgtcggccccgggaactgaccgttcaccgtcattatgttgtggctcttgcacagcctcttcactgttgtctccctgatctgcagcacagatgatgaaatggcaaccaaattaagctagctgctgcagatatatatgatgagattcagacgagctaagtaactgcatataaatgatcatgtatatatgtactgaccacaaactcatggtattgctccttggcagcagccagggagcagagcagtgccaggcttaagagccagcatgaacaccctctgcttggcatgctgcttgatagtctgaaactaactatatactgcaactcgatcggtcgatcaatcaagatgcttattgtcagcaaccaaacatatctggatagctatatgcaagcttacaagacctgagactgaattgattgcgtgcagcaatgcagcttatatctgttgcaatacagctcgccctttatataggagcagcctggccgatcgaccacatccatgagatcagagtatatatatgaaaagaaaggggctacaggtagtagactccggccggttgcatgctttcttgttggaaagaataggtaggtctttagcacttgattctctcgttaatctacatatatacatgccatcattaatttcacacttgcatttgcattcttcatttcaagctgcctcctcaatcaatccatggtccatgcgcattggctaattaattgttcaatgtacttgccaatgaattcatagttaatgtaactccttccattttaattcattctgcaagattagtacttagtgaattttgctacagttttgattacaaaccgatcatgcgatggaatatttgcgcttcaggtaactcgtgtgatatatgatgcgtccatcacaagttatgttttcccccaggacaacatgacacaatcataagagcactccaagactaacgaatgtgacatttcaagattttgtcctaaaactacacaaacgagatatgatcctactgtgttgcatgatggattgcagtgttaaaacgtagagtcattcctgcgaccttgatttgcactgcaagtgttattttagtcaatgtggtatcatgctaaccccatgcaagttcttgattttatcttctgtcctacaagtactaaagaatcagtgaaccaacacgcatcaacttcacctagtactatctataatgatcttaagattttttttcatcctatcaaaacccttccttcactttcagcaagagaaaaaacaaatgtaaactaagtatttaacacgtccatttcttaagttcagttcttaaaaacggtgcttaaagctatagtctttcgatcagtatttttatgacatgcataaatatcacagagatgcatgttgcatcttgcatgtgcatgaccggccatttctataattatatggtgagccctctatatcaagaaattctgacctcaaattatactgagcttttctcccgtttcagggaatcatgaggaatgaattaacgtatcatttccagtggagccaccagtcccacaagtctccactggccaaaaaagtaactttagtttttgcctcattttgtttagaacaaaagacaacatttttttcaagtccaagaaacaaaatgttgttaacaggatgagacttttccaagtctctatggcccccatgtcaacaaaggttaagtgcttgattaacaacttctttttgacaatagaatcaatccatgaatcactcccttcctttccatcattgtctagcatatgcataactaaaactgtgattactactcgtagttagcagttacactgcgtggtctttgctctggtaggagttgttgggcttgtgctctagacatttgcattttttttagataatggattaaacatggtgtttactgctgtttgatcgcaccattccatttgctagagtccaaggaacctagctaagatgtgatgtacactaacaaaggtaacttggttatggaggtagagatcaaaagtttttagaattgtgaatttttgtttgaaggactacatgtacctatatattaatttccctgttaaagaagttctcgtgatgcagatactcttgtgagtaataagtaaataatgtatatttcaggcaaatgaattttctcttcaacataaaaagggaaaaggagctactattagttgaaattcggatctacataatgggccaaatccttgccccatcaaatgattcatttccacaagctctgattggcaaaagtattggaagaagcatgcaggtgctaagctgctaactaccacatattcaattgcaaggactgttagtaggcaaacgtccaacccctttagctttatgtggtttcttctgttcaaggtaatctaaagtcaaaatgttaacactaggaacaatcttcaaaatgaaggaacatgctattggcatgagcaggatcaggatggtttccttggttggcaaaatattttaggctgaggctgatatatagcttgataccaatttggaggcatttaacaaccctggtgctccactacttgtcctttcaaaattgaaaagatgcttcacatgttggtgcatatgcactgaatgccccacaatgttctctaaattgcactctgctgtacgttacttgactgaccaggtgtattatgaatctgaacaattggctgcgctcaacatatgagagaaatctcagacaaaaaagattaatgattatgaatggttgattgaattggcacgaaggcagtggtggggagccaaaggagtgtgcagttatgcaaccaacaagcatgagtactgaccgtcactaaattctaaaccttattaaacttttagatgattatattttcataaaaagggtgcaacaaacgtttttgaaggaagatgttacagcaaaagaagcattaaaaaacattcagataacagattgtcatctttgttgcaaaaagttaggtacaatgataattaatttcagatgtcaagttttcatgacatacatcaaccaaacttgaattggaatgctaggattggttcatggagttgtatatggtagtaaatgtcatcattgtcctttaacaaatagctagacatcatggtccttaagctggaagttaacaggaatcattttcctaaaacttccatataagtgatgcagtaccattgacactacaaaataactgcattgtcactacaaagctcttcacagttgtcattcccaagaaattactttgcatttccaaatgaatccttgtagataagttacttgagtagcgaagagtaagatggagctatgaagaataaatgctagaatagttgtagcattagtagtaggtggtgggtgttaaggagggttatggtgagaacgacggtaactaacaaggagaatatgtagagtctgtcaacatccaacattctttcttcgaaaaaattcctgtctaatgtaaaagtgatcgactccaagtcagtacaacagctatggaacaggtaaccaactgaaccgaagggtattcaggtgaggttgttttatgtaaacatatcttttctcttgagcaaacacgattccagtattgacatatgcagctacctaacacaggtgttaagctagaatgtcaaattgtttggtactagtgattaatatggtgtgcatatacccacctgccacatcacaatgtaaaagaagggataccatgttgatatgttcaagatgtagtagcatacaactgtaaagtactaggtcagtagcagattagtctctacatttttcgcggcctgtacattttatcaaaggaaacaacagagagaaaaatgcaacagattgattgatctgcatgactatatgtattgactaagttgtttaattgaactgacgaaatgtgcgtttggagtttggactaaatggtacaggctcagagttttttggcctgccgtgaataagggcagcaggcacatttcagaaagcttgattgctgtacctttagcttcttgctttgttcagaggaacatcttcactttctttttctgtttgcgtgcttctggagatattcaggctactaattaaacaaccaaacagagcatagtattttatccttttgtaggctttttatctcctttataaacagtttccccagctgtcatattctatcaataaagaacatggacttctggaagcaaaattaagggtactttcaaatttccatactgaattgctgaatgtttgcttcttatgagggagacgttgaatgctgatcgaacaatgcgttgtgtgtatctgtgatacttgttctggaaaattaattttaggagaagtgttctgaattgctgaatgttattcgcgtttcacaaagttaaattctcgtcatcagaaaaggaatactttcaggtttcaatttcccggttgagttttcagcggtggaggaagaattgataaaggtgcttataaaaattctaaccatgaattttctacatgaacgcggcgactgctctagctgtattcctttatgtaacaccgtgactgactaaaccttgtttgacatttacttctaatataatagtgaacggcagagtctgcatgttctctcgaaaaactttcacacaagagtgattttacgtgcttaaaaatgtattggaaggtattacattttctaatgtaaaatttgatacttctcagaacctccagtacagaatttgcactaaaaatattattacttatttgtatctctcaaggactgtaaaatttctcttcacatatgcggaagattctaaccataaactttatacgaaaataaaaatatatattagaaacttccaacaattgttaaaagttctaccagaatatacaactttctaccaaaaaaaattctaaattggataatttatagtgacacttttatcagggaaaaacaaactcgaagtctcgaacatgtactttgtacaagaatgaaaagaaatcttaaaatggttaaattttgttttaaatacgactaatatgttttttttaattcaatacgactaatatgttttgatggtcctagaaggctagaacaagctaaacagtcagtagaattcaataataataataaaaaaaacaattgagccaaataagtcatttggcccaagcggcattgctagcccacgaggcccaggccacgttcgagaaagaaacgcgagaatagatcgacgctgccgccgcctgagcctgctctgcagtacttctccggcagcgccggccgccggcccgggtatcaatctagggtttccgcccgccgcagccacctagctagctagttcaacgtacgatgaccatggaagatggaagctgtcctccagcagtcgcccccagtggcagccaagccgaagattacggatcatggacactgaagcagaagcttgaggatctcatcaactgtgatcctatccatggtatcatgccaaaaaatcctaaatataaagcatatttcgaggaaaagttcgaggtacgtattttcttcgatccatcatccatggatgcaaactaattaattaattaattttgacctcaccagcatatatatatttattttattgtatgcaatcgatcgatggatcaatctatcataaatattattgccattgtaggagaagttaagtacgtacgttcgtgttgtattgccgaaacttcgtccagcaattcagaaggatagcgtgaagcaattctatcaagtctataattgttggtcaggtttcatgggactgggagagtttctttaccctgatatcctcaccaacatggcctcccagaacgctctgcgttgtgccagggtcgcactccagggcacctctcctctcttgcgttgccgccgccgcgctgaccccaacacccgccaccgctacggcttcgcccccctgcacatggccgccgagaacttcagcgtcgacatggtcaagctcctcttccgctgcggcgcgtccgccaacatccgcaccaagggcgacaacgtcattgagggcctcctccctctccatgttgctgtggagaatgccagcatgcacaagtacattgaggatcattgggctcatggggaccatatcatcaacctcatcttcctcctttgtcttcctgagatggtttttcttctttattcaattcctatatatatccctctattatattactgccactgccagagcatttagcccatttcaaatacgtactactgacatgcagaaaatgttcttggacacgactagattaattgccaaacagacggacaacattgtcgacgaggtatggaattacattcagcatgaagagaagcatgtccaggcagcaattttgctgctcgctgctgaaaagcagctccgtggtcgccttaacaagagcagtggcaaagcctctctgaacgggtttgatattgttaaaagccgcattggtgatgctcttagcaccatacatcttgagggcttaaatatggttcaagagggaaagaatggcagggcactaaagagattgaaagacaaaaaggaagcccttcttacagcacttgtactagtgtgcattgttcacaaagctggtgaagctcttgacggatacattcaaactcattcacaggtaattgctgaaatttcctcattgttaccattgctttctgctacccctgtgtgttttgattttccagtttcattctctttaaatttgtgtgatgcttacttcccatgattttgatctaatagtgactcgttttcttcaaatttgtatgatgcttacttccatgattttgatctaatagtgaaacctcgaattaccctcgttttagaaagctgtggtgggctagctggcttagcttcgaagcctcacccattctaattattttatattaggtcattccctaatattcgcttttttttagaaagctgtggtgggtgttgatcgtttttctttttctttttggtgatatgtaaacagttggaggagctcctgctgcattgtatcaactagtcacatccatattataaaaaggagttaaaaagaactggacccatgcggtaaatggcatcttttagcccccatttttatgtaaatccaagaagttgaatagcaggcccagcatagcggtagtatgctgctagtttcaagtctaatgcatgagtcgaaaatatatgaaaacacaggggagtagatgcagtgttcttaaagcgaagcatggtggcccaccacctttcagatgcctatgagttcaacgcataagtcaaggtgacaccttagggcagtagtagtccaaggcacggcatgcgtgcctccatcccattccagcgaggattttggcccaaattttatctctaggtcacgcacctcacagtgctcggtaccccacaatactagtgcgccgtgtcttatcctcacgccccaaaaaatcagccttcatccagactcatccccgcccgccgcttttctcctcctccctcgtcacgcccgacgccgtctctcctcctcctcggctctcccctccttcctccgccggcgtcctctcctcctccctccaccggcgtcctcccctactccctcgaccggcctcctcccctcctccctccaccggattcacgagataaactctcgctggattcgataggtgctcagagagagagagagagagagagagagagagagagagagagattcgaatcccccacggtggtcgccaaagatgaagccgccgccgccgccgcggaggtggttctccctcgccggcgaattgagcctccccaacgatggagcggcaagctcagcaacacgggggctcgtgagcggcggcgctgagcaaggttgtagctagaggccagccgtcgagcttggagcggccccatccgtctccacccaagcccctgccgcctccgcctccgtcgtacgagcaggcggtggggttgtcgaggatcgcgaggagcgaggtggggtcgtcgaggagggcgaggagcaggcgaatcaagcaacgactccaacagcgcagatttccttcgccgcgtgccctcgttgcggcgagaaaacgtgcatcccagataggggccaagcggctgagctagggtgcgggcctcgtcgccacgtcgacctgaatccgagctggagcaacgagatcacgcgccaggtcggtgcactgtgaagggccttacatctaaatctatacaaatgctgccaacttttgtattacacacgtgcttaccaattattgagcccatgtaccattcattcatcctttctaaagaagatttaagaggagggaagagggtcctctttgttggaaatatagtcattattcggcatattttaatccaagaaattgaaacaatgatcatggcataagcagtgtagggtgatcttaacataaccagtagcatactatgcgcatcatgaatgtcagaaacaggaacataccagtaacgcgataacatgctagaggcatcatgtagaacaggaacaagaacatagcgcacacagtatagcgctaacaatgggaacaggaatagcgctaacagcagtagcaggaggagaagattataccccgagaatggccctccgctggatggtgaggcagaattgcctccgttgttgtagtcgttcacggcacctcctcctggcgcaccagctccggatccagctcctgtcggcggcggcgcaccagctcctgtcggcggcggcgcaccacctccgccggtagcggcggcagcaactccagacatggcgatgagcagtcgtgcaggaggcactccccaaaaacctgatcacccgcctacccggtgcagatctcaagcaaaggtgtggtttcggaggcactgcttcttccaatctctcgtgcgcgcaagagatcagaagcggggaagcgagagcaactcaggcgcggagagggagaaactaacaccgggaaagaagctaagaaatcggatcggactcgcggcctccttatctatcaggagaaagaacgtggacgcgctgttgcggagggaatcgtgggaacgtgggttagtggctgcaaaaggatagcgacgtgacgtgacgcacgccgccagccagccagccacgcctcgccctcgcccacgccccggcccggcgcgcgcgcgcgcgcgtgtggcattccgacccccacctcaactggtcaacagggagcctctaataactccctatttaggttgagatatttctcgcttaaatcctgaggtggtattattatcctcaacatttattatgggcctttgagatttaatattataaattgggcctagcccaattattctaacaatccccaccaaatttcaaggctcataagaaatgttctcaatgttgtgcctgtttgatataccagggttttggtggagactgttaagttgaacttccacctagaaaatgagctacatcagaccacaactgaacaatggactatgccttgaattgtaagttttgtgtgatcaggtttcactcagaaccttgactggtactgggctgccgttcgcatcccctctgtttggagcatataagtcaaactccaggcctttcatgagtatctagagattgcccaaacctcatagactgtgactagcagtcgaactcatataggtgtgttccttctgagatgttctgcaggtcaacatctctgcttggaaaagccactcggatcacattaagacataagccatcctaccatgcaggaaagaagagaagcacatcatgaaaatgagcccttttcaagggtctcttctctcagtcacacaatagtttgtttcaccattcaaattcacgggatctccgatcacaatggacaggtttccactattatgcaaccttaggtgggtatcaagcccatttccctcgatgcactgtctatcacattacgtggtagccccttggtaaactgatctgccagatttctagccgtttggacatagtccaatgctatcactccggagtttttttgctttctgacagatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactgtcgcagtatctagtgctgtaagttctgcttccattgttgacctcgttaagatggtctgcttgcaagacttccaggaaacagcgccacctccaagtgtgaacacatatccacttgtggcttttatctcatcagcatcagatatctagtttgagtcactatacccttctagtacttttggatacccggtatagtgaattccatagctcatagtgccctttagatagcgcattactctttccagagcctgccaatgatcatctcccggatttgagacaaaccggctcagcttgcttacagcaaatgagatgtcaggcctcgttgcgctagccaagtacatcaatgaaccaatgatttgagagtatcttagttgatcccttgctattcttcggtttttccttaatagcatactggg

SEQ ID NO: 67883 - DNA, 3698 bp, Oryza sativa
acatgaagacgaaaccaaactagaactatattataccaatatttggacaatgttatattctaagcttgattgattcgtattatttatttattgagattggcatagtacagagcacaaaacaaattacctgatgggcccttaaaacttactaccctaaaaaaggagttatggtaggcattagccaattaacaaaatttgggggacaaaatttagtacacttaacacctgctctcattttgtttattattcatttcaaactttctgagcttaatgctatgtaaccttggaattacactaaataattctatattacaaatccaataagttcttaaatcaatggcttcaatataaattctccgaacaaccttatacaggattcagcgatgcgtgtacctgcagagcaatttcttactttaagggcatatggtgcacctccagtcatagtagcacttgcagcacaaggtgcttttcgtggattcatggatacaaagacaccgttgtttgccgtgggtaagataatttatgcaaactattagagcatgttttctgaaatcctgtctgatgcatacgatctgctatagtgattgcaagtgtagatatacatatttttgttgttaccatttgtcatctttttttaaagcaatagacatatttgacttcaaatgataagaaactaatagtatgatgaatacaggtgttggtagcctagtgaatgcattgctggatgccatatttatttttccacttggtctaggtgtaagtggtgctgcattggcaactgtgacttcagagtatgttgaactcatcataagactttacagaaaattgtcttttctttcatttggagcctcttcacttctttctttaatcagtattcataagcccctaaaggcctaaactatctgcataattttacatgtattcaggtacttgacagcatttatcctcctttggaagctgaacaacaaaattgttctgctctcatggaatatcattggtggagacgttgtccgctacctaaaatcaggttgtccaacatccctcatgttcatttgcaaatacattacaaatgatggttttgttttcttgtaagagagctttgatatacaatgaaccgataaaaaactatcaatcaattcaactcccttttttttttaaggcagatcaaatttcattgacctggctttgcaagaaagcctaagcaacaaacagagtcttatacagaaagggaaaaagcaaaaacaattcaactccatttagtactacctctattaaacaagtttcatcttgctgcaatatacctctatgttaacccctttcacatgaatcattctctaggtgcactgctaattgcaagaaccattgcggtagtcctgacattcacactgtcgacatccctggcagccagggaagggtctgttccaatggctggatatgagatatgtttgcaagtgtggttaacaatctctctgctcaatgatgcactagctcttgctggtcaggtgtgtacatttagaggatcatacctttagtttctaggctctaatattttacattggcctgtaaagtattcatgatacaatgcaggctctactcgcaagtgaatacgcaaaaggaaactacaagaaggcccgcgttgtcttatacagagttctccaggtatgaagacattatataatattatgttagcaaattcgtgactatcctcttctttttactcttgcaataagattctcacactgttttatatgtagattggaggcataactggtgtagcacttgctacaatcttgttccttgggtttggatatttgtccttgctgtttacagatgatccagcagttttagatgttgcccaaactggagtctgggtaatgactatcctgagaggtcaaacttgatttatcaagtgttatgcaatgatttttataataatggctgatgaatatttgcagtttgtcactgtttctcaaccgataaatgctgttgcttttgtggccgatgggctctactgtggtgtttctgactttgctttcgcggcgtactctacagttcagatttctattcttgtcatattccattgcattgttgtcagttctagctgcagcatcctaatcacataaatattttttctgtttcagttatttgctggagctgtctcatccgcagtactgcttgtggccgctcctaagtttggtcttggtggaatctgggctggccttgctctatttatgagtttgcgagcaattgctggtctgtggaggtactaaagggatgaatttgctttgggtgtacgccaattatgttagaaaaactaatttgttgatttgaatgatttagtgggtttcaggttagggagcaaaggtggaccatggaaaatagtctggtctgaaactgagtaaacaaaaaagatagttatgtgtactcaattattcgactaatttcttacagtcaacatctaaaggcaagtacagacggcaagcaagaaagcagatagctggtagtcattgccaggacaagattttctttaggagatgacagggtagctcatgtggtgatttggttacaacttacaagtagatatacttgctgctgcctctagatagatagatatagatagatagatagatagatctctttggtgttgactggtataggaagttgattcgacttgtacagtgctgtgttatagtagaatggataccctgtcagtatacaagaaagctgaaagctcatagatacaaacacattcagagccatccgtccatgtaaataagtgaatcttttccttgggagaagcatatataagtgaattcttcctctctgtttatatttcttggaatgatgtttatgtactggggattttgccaaggatcggcagcatgaacatatatattgcgtaccttgccccaggcagaccacaaagatacacagcatgaacaggaaagctatgggcctatcgtatctggaggcccaataagctccaaggatagagccggagtgggaggcagggcagcagaggcgcagccgagcagaaagaacatcaggaaggagaggctgaggcctgagggagacgacgacgagggaatcaagggattcggaatcggaatcggagaaggaaagatgccttgcctcaacgtgtccaccaacgtgaacctcgacggagtggacacctccgccgtcctcgccgacgcatccaagaccgtcgccaccatcatcggcaagcccgaggccgtacgttcatcccttttcctcttcttctctacccatacccaccctaggtttaggcgtgcctctcctggtttcttcataaattttcgcttcttgtaggcgtgctcagttcctagcttgcgattatctctattaacctggcgtttttagtggattatcgctcgcttgtctggtgattcagtctgctcgagcatgattattagggtttaagtaataagtacccccatcggtcttcggcatgcaactgatgtaattgggattttgatccgtagtttagtatcaactatggtgatgttcatttggggatacaaccttaataggacgagggacagggagggagactggttgaggggatagacaagttccctattcttcttggatttccttcacaattcacatactttgtattactggtgcctgagtaaaccattatcgctcaaaataaatagtaaaccatttactctatg

SEQ ID NO: 67884 - DNA, 1526 bp, Oryza sativa
gatatctttttcctggactgttgcttgttatgatcgtcatattgaaagatgaaatggacgaacaattttcataacagaaattggatgaaacagaactaatatagcattcctacaataaaagtaatgttcagttagtctaaactaaaatgcttataagccatgactttttcaaccacttactgaaaattttactttttccaagagtagatcgatttcatgtttttcattctaaataagtgttcttctgaaagctgtctattactagcgaatagttcttagagtgatacttgatgctgtatcagaaatagctatattgttactagtgaccagatagaggtaagatctgttgttagtggaccaaatgcgactgcagaaatggctagttttgctgttaatggactttcttttacttgaaatcaacattggttctctgattataatctgtgaatcatgatactcaatccgtcccgattgaaatgctattcgttgcaccatattgctatatagatttcagaattctatgattgcacaatgttagacctgtgctagcgacaaactgaaagttgacttccatcaattttctggtcttagcgtatgctgaagctattttgcatcgcctttattgtttagatactaattagattgcttaatgcttattcctcccacagtatgtgatggttgttctcaagggttcagtgcctatggcatttggaggtacccaggagcctgccgcttatggcgagctggtttccattggtgggctgaaccctgatgtcaacaagaagttgagtgctggcattgcctctatcctggagtcaaagctatccattcccaagggccgcttctacctcaagttctacgattccaaggtaagcaggccacatttcttattgactgttcatccatgggtcttcataaccatatagtcatgttctcattgcatctttgctgtttgttaggcccatcgtgcacaagaacatgctcaatgtttgcatgctttgcatcaagaatagatcagtgtaaatgggtcgtctgttgcttgtttaatgtcatcgtattggtttttgcagtttagtttctctctgcagtttggcagtaaacccttgccacagcacgtatactcttccatgctaattatgagcaactgagcactaataaaccccttttgattttctttttatgtagcgctcggactttggatggaacggcaccaccttttaggttaaactgtatgcctgtggcttcaagatgcatgaaacctaagaattcctaatatcttgttcattgcctattggaggacaatgcagtcgatgtatcagtttaatgtcaacaagagtcaccgtggaactggaaatatgcttctgaatgcggggcttttaactatttgccatgtttagatttggcaaataactatttgccacccctatctcaatgacatgtgggtccacatgtgtctatgacgtgtgggttcagcggcaaaaagttaattgccacatctaaatgtggcaaatggttaaatatcggtc

SEQ ID NO: 67885 - DNA, 1477 bp, Oryza sativa
  unsure (1)..(1477): unsure at all n locations
attatgacctctcttttgttgtgctcctcaacaggtagagtagccaatctctgctccatattttctcttgatgcattgccatttcacctaactaggcatatgcaaaattcacacaccctgattgtgtggactgcacatactttgggagctctggaaattcagtccgttgcattttatatctatgaataataaacaatctcaacacaagaatccacaaattttgacaatttgactctttgcaaaaactaattttacaaaaaaactgtgaccaaaacttatttaaaaatgactcttttgttcagcgcaaaatcgtatggtgctgaattaaacacctcagcgctaaatagcatggcgttgaatgcatgttggcacgccgactcagcctctcatccatggtggcacggccctcagcatcaattgatgtggcgctaaggtgtctaaattcagcgccatacgatttggtgctgaacaaaaggtcatttctgaaataagttttggccgcggtttatttgtaaaattagttttttacaaaggatcaaattgtcaaaatttgtgagaaatcagagggggtggggctaatacgcgaactttcgcgggccgcgatcacagatcagatcacaaattcactttatcgtttagtatcattaccttatgtctctaactctatgcttacgtgcttaattatctgcagaatttgcaagcaactgcatgcacgcatcttgcggctagagatcagaactggagtagcatgcaaccatgcataccgccattaattagcatgtactcacaaactctaaacacaaatttaaactttatacgtacaaacttttgatatggaaactttatatatatacttttcacatggaaactctatatataaaaactttcgatatacaaaatttatacacagatgaatttcaaaatgaaattaaaataaattcaaaaaataaaaactattaaatttcaatttgagccaaaactaggctaaatataaagtagtagactgggtacacattaagaattcccataaatcttcatagtcttatgcgtgcattgtgcagcaaacaacaacaaaaatcacatacttgattagtcctaaaaatcggtgattaaaaaaataaaaactaattacgtttagctatacaaggaaagccactgcatgcattcgaggctccagctgtacgtacgcgttagccttctcagtctttgcatatcaacctgtccgagctgatcgcgaattagagttaacgcgaacgttcgcgtattaggtatttagcgtcggtggcgtctctcctaaccttcgttgagaaatcaataatccacgcgccatttcattggtagcagatctctccttcctcctctgacctctctctccatcgcgcagatccagcaccgccatggccgccgcctcccctcccctcctncccaccaccggcctccccgccaacgccaccgccaccgnctcccccgcccccac

SEQ ID NO: 67886 - DNA, 10539 bp, Oryza sativa
agcgccaccggaggccgcgtctgatcctcctcctcgcgcatgcattccaagcaaaggtcataaattctttttatattatacctatgagacaaacactatcatttattcgtatggtgatcgatgtagaacaaaaaaaaattaggggagaatgatactgctataagatgcatatatgattttgtcgatgatctagttttgtttccttttgcatttgatgtatgagaaacttgagagcaaaaagaagaattctgttattgatcctgatattgatgtgatccgtctcatcaatcgtgccggttctgttataaaattcacaaatttgttttggtttgatggatgattcataagccatctcattctgtaaagatgatatacatgaatctaggttaatcaaataatgttggatctgatattgtacatcttcatttgaacattatacaaggatgagagatttcgtttgtctgcttcttgtcagtgtttgttatgtcaacctaaacggccgagggctcttgctggcagtaaacgtttatttaggattaggaatttgtcatgttcaacttggtgggatcaggaattggtgttgacgatgggggagagagagcgctcaagggaactaatgagaccttggtttggatacatctttagcccaagtctgttggcaaatgcattacacaaggggattgcctgaaatcttgtaatccattggtcatttttcggatggctcagattgcgaacccacgtcttccctcgcttcatgccacgcttagctctgcctccctctacctcgttgcatactagacgaaatctattcagcttatattcaggcctgtttacattattactgcctaaatgaactttatcgaaatttggcattgctatttttggaattaccgcgaaaggacctgtaacctattggttgcaagacctcagtagcaccttaggtcctgagttcgactccccatgtaagcgaattttctaggatttaatggacttcgtcaatcttaaggatttggcccagtcttggaagatgctcatagaggttggaagatgctcatagagatagggtttgcgtgtgtgtatctgcattgtactgtgtaattcaaagaggtaggtttgcgtgtgttcttgtactctaattaaaaaaaatagggtgacactcaaaaagtttatagtgacacgaacacataatgaatagtgtccaatgctgtttattactcgaggttggtttatgtccataataccttaatgttacatggcaaatcgtccaggtgggtttatgtcgtgaacatctgaaagttactccctccgtcccaaaataagtgtagttttgcactattcacgttcaacgtttgaccgttcgtcttatttgaaaattttttatgcttagtatttttattgctattagatgataaaacatgaatagtactttatgtgtaactaaatattttcaaatttttcacaaatttttcaaataagaaggacggtcaaacgttaggcacggatggaggtagtagtaatttggtggggcagaagcccctggactatttatgttctgtaaatccaacaagctggacaagatcggaatagtaggccaggcccaaagcaaaagaaatacctggtccaactaaaggacgggtccacagtccatcccacccgttgctttggcttctctccccaacattattaaacacaacaaaatctcctccttaaaaaacgacgacaaaagaaaaaaaaaagaagtagccgttagttggtagtgggggccatcgccgtcgccacatgacagcattcgtagtggtcagtactctcccgtgcactcctactagccgttgcgcctctcctctgctaatctcctcctctctctgctctggccacagcccacagacgcgcgcgcgcgctccagcttcatcttcttcctcctcgatcaccaactcacaaattccttccgctactcatctactctactctactcctccatcaaccaaatgcaaggaccacggaggcgaacaccacctgctcctgccgccaaacaaccagccatgctcatgctcggaccattccccgcccaccatcgctgcacactttttctcctcctcactgtcacactcctcccctcgctcgccgccgccgccgcggcgcaccaccaccacgtccacgccgcgggcgacggcgtcgtcatcagccaggccgactaccagggcctacaggccatcaagcacgacctctccgacccctacgccttcctccgctcctggaacgacaccggcctcggcgcctgctccggcgcatgggtcggcatcaagtgcgtccagggcaaggtcgtcgccatcaccctcccatggcgcggcctcgccggcaccctctccgagcgcatcggccagctcacccagctccgccgcctcagcctccacgacaacgccatctccggccccatcccaacctccctcggcttcctccccgacctccgcggcgtctacctcttcaacaaccgcttctccggcgccgtcccggcctccattggcaactgcgtcgcgctccaggcgttcgacgccagcaacaacctcctcaccggcgccattccgtcctcactcgccaactccaccaagctcatgcgcctcaacctcagccacaacaccatctccggcgacatcccacccgagctcgccgcctcgccctcgctcgtcttcctctccctctcgcacaacaagctgtccggccacatcccagacaccttcgccggctccaaggcgccctcctcctcctcgctcaaggaatccattaccgggacctacaacctcgccgtcctcgagctctcgcacaactcgctcgatggcccgataccggagtcgctctccgggctccagaagctgcaggtggtggacctcgctggcaacaggctcaacggcaccatccccaacaagctcggctcgctcgccgacctcaagacgctcgacctctccggcaacgccctcaccggcgagatcccggccagcctgtccaacctcactactagcctccaagcattcaacgtctccaacaacaacctctccggcgcagtgccagcctcgctcgcgcagaaattcgggccttccgccttcgccggcaacatccagctctgcggctactctgcttccgtgccctgccctacgtcgccgtctccatcaccatctgcgccggcatcacccgcgcagtcacgggaggcgacggggcgccaccggaagttcacgaccaaggagctcgcgctaatcatcgccggaatcgtggtcggcatcctgctcttcctggcgctctgctgcatgctgctctgtttcttgacgaagaagaggtccggaagcggcgggaagcagacgacgagcagcaaggcagccggtggtggcgccggagccgcggcggggggcgggcgaggggagaagccggggtcgggggcggcggaggtggagtccgggggagaggtgggagggaagctggtgcacttcgacgggccgatggcgttcacggcggacgacctgctgtgtgcgacggcggagataatggggaagagcacgtacgggacggtgtacaaggcgacgctggaggacggcagccttgtggcggtgaagcggctgagggagaagatcaccaagggacacaaggatttcgagtccgaggcggcggtgctgggcaagatccgccaccccaacctgctgccgctcagggcctactacctcggacccaagggcgagaagctcctcgtcctcgacttcatgcccaacggcagcctctcccagttcctccacggtcaatactctgtcaatgctactcttcttatcttatgcatttgatcttcatcctattaattaggaagacaatgcaattgataaactgtatgcattcttcagcttttacttctgctttcaactgaaactactctgaacatttgagaaaatgttgtagtctgaacatttgcaaattctggcagtgctaactgctaacattgattcagctctgtaatcaagtagatttgatacatctgaattttttttacagtgctgagtaccttttttatttagcataagaatgaacatcccatgccaatttagagattgagcattacatgtcttctgaaaattttggacagtggctatatgtcttcatggtcagtgcaaaaagtttagtaatagagtgtcatgttcaattaaaaaagttgacatattatgtagttttgaggctaatatgtgaacaattgttgatctaaatgacatgcttttgttttagtagcactgttttatcaacattattcagctttctggctctgaaatttcatcctgatgaactgaaaatctgcataactctgacacggtgacactaacatttcgtcctgatggcataacgtgaatgtgcagctcgcgcgcccaacactccgatcagctgggagacgcggatgacgatcgccaagggcacagcccgtggcctggctttcctccacgacgacatgaccatcgtccacggcaacctcaccgccagcaatgtcctcctcgacgaccactccaaccccaagatcgccgacttcggcctctcccgcctcatgaccactgccgccaactccaacgtcctcgccgccgccggcgccctcggctaccgcgcccccgagctgtccaagctaaagaaggccagtgccaagaccgacgtctacagcctcggcgtcatcatcctcgagctcctcaccggcaaatcccccgccgagaccaccaatggcatggacctgccgcagtgggtggcgtccattgtcaaggaggagtggaccagcgaggtgttcgacctcgagctcatgcgcgacggcgacaatgggcccgcgggcgacgagctcgtggacacgctgaagctggcgctgcactgcgtggaccagtcgccgtcggtgagacctgatgcccgggaggtgctccggcagctcgagcagatcaggccggggccggagggcggcgccgggccgagcgaagaaggtggcgcagggcatgtggctgctgcttctgcaggcaatgagtagtatgcagcagctgggctcttgagcagaatttgaagatgaaatcgaaggaaatgaacttgtcagtcagctagagactagaaacagagcaagctagagagtagaagcagagatactcctatatttcatttatgaattctttgatttatttgaaagcttagtagtagtagtattagtaagtggtagacattattcgtctatgttgtttttgaagcttcttgtataggcaaatattattatttgcaacacaactgaatcgctctatcagaatatcaattacaaataccacaatgccttccttactgatctactgtagtactcctattgtagtactgtgtgtgtgtttgtagatccatgtcgatgatgggaaacaagtgataatcatagcttgttgctgaatatgtcatgtatatcctggacaatgcatagccgcgtgcttgcatgagcttttcagattagcagaaagtgccgaccaatgcttaactgaaggtcatatcaccgaagtgcatggattgtaaaagtgtaaagttaacacgctttttcaactaatcatacagatcgtgtaaactgtttctggaacttccaaacattggacaattatatatatcgtggaaaactaactgtttttgacaggacatggataaatacttattcatgcatattcatttcatccccatcaaatgactgaggaacatgcatattcatttcatccccatcaaaatctgcattgtacggcgaagtggcggacaagtttaagtggaaggttgaatagggcatgattttaatgcgatgccccatgatatacattttgtgaagactgggttgccgattgaaaagaacaaaatcaccatcatcaaggtgcctttccacctgacaaaataaaacaccatatgaggagactaatatagaagacattattgtcatgtgaccatcagtaaaaatcagattctgaaacaaagttggtactcacattgtaacccagttccagatactgatcagttcttttcttcacataacaaagatcaagcctttgagcgtctccccagataatgtactttgcacctgtcttcccagggggggggggggggggggataagtgatcattaaaaaacagtgatcatgcttcaataacagtaaagcattttaccttggaagttatatggagtaacagtttctgggtatgtaaggttcaaagcaatactccatggcactaccaattcattataatatttgaatccggtgtgatgacagtacgagctgagaaatcaacacgcttccccatcaaatttcctctactgctgcgttcctttgcttttagatacccctggacttttgctaatctgtggcgaacagcagtctgtaacacctgcagaagaaagatttcactaatgtgaaaattttatgtaaatgtataagatataaatcatgtttaaagtactttgagtgataaaacaattcacaacaaaataaattataattacgtaaattttttgaataagatgaatgtttaaacgtgtgacaaaacgtcaacagcatcatctattaaaaaaatggaggtagtatttttttttcccgcaccaccattcaattttgcacagtgttttagtatattgttatttgctgacaccggcatgaataggtacctgaaacaaccattcatattactaacattccaacacttaatcacttcttttttttaaggttactgatcaaaattaccagattcagtaatacactcctggataaggcatttttaaaccaaatcatttgcatactaacttgcaagttacagatagatgactagcaaacatacacaagtaaataaaaaagaatttgcataagctatatatataaagaagctaacaaagtaaaaaaaagaaccttgtggctagtctaacatgggggccggcagatttgaccaatgcacactaaccaaaatggtggcgcaatcaaatatcataggtaggatgacttggccatgtgcttttcccttcaagccacggagcatacggactggctcctcctcctctaaggcgccactccgcttaaccttcaagtctaacaccaagatgccgcgcttgacaatggcaagcacaaacctcttgtttagctgacacagcttggcaatggcaacactttcaaagagcttgatttcattgggtatttgaccgacacgacaagccatagacatgtcgaagccaccgctgccacgcacttcggttatttggatgtgcatcgtggcctctatggcgttgtggagaagtgctaagctaatgttcatggcaccgtagtcgccggcaatccatcgggtgtaagcttgggcatatggcaggggtagctcggtctcactgatagtggcagctctatctatgagctggagatcatcatcttctccatctcctctcttgatccttatatcgtactcaagcagtgcaggagtttccatcccaatgcctctcttagggccagacaggagtataaagggatcggagaggctgacgacaaaaggtttgtcgcgcccgcggttgaagacatagttgcgcaagcaatccatatgatctcgaacagccatgaagccatacacctgaatggggtcatcaccaatagcaggggcagtgatggagaccagcttgagtgagaagatctgcaacatggaagaacctgagtggacgatgcaaccagaccagttgggccggcaatccgtggtcggatcagacagcatcatcggcttcaatggagctgatacaacaatcagacagcgacatgtaagaacactgaataactatataaaaattattattataatcagcgagttaaatttgtagaagcagtaagtagattgggtgatggatagcactagccattattgagtttctgtaaatttggttgtctacgcatggatttaaagaagaagaagaagaagaagaagaagaagaagaagaagaagaagaagaagaagcaccgggatgatgtacatcaggctaatataacggtttagataattttgccaattctcttccgctccggctgtctatgacgccctaggctggctcctaatctggagcagcgtagcgggagtgcgccatagccagagggggcaagaggaagaaggggaaattttgtgcaatataatagggcatctgtggacccccgtttttataacaggaatcaatcgtgtaaacagtaccatttccctggatcaagtagtttggtacacacaaattcatagctggaatatcaagtgcacatacacgagtatctaatacgaattattacatcataggcccgcaggcatagtcttaaatcatcggaccgagaggtccggaatacatccaaaagcagaaatagataaggcagcagaattcaggcagcggcatgccattgccacaggcaacgaccgtactaagacctactggacgccatcgtcttcatctccctcctgatagtaggcatagggatcctccgaggcttcatctcccgcttctgataaattttatatttgcaaggatgagtaccaaccgtaatcagcaagccaccacagcaacaatgcatatgaaagggggagttcaaaggatggccatagttcttttgcgcaaagcaagttttgtaattcttttcacaagcctaagacctagcattgactgatcaaattttagtaccagagtttgtatttaaacaacgacggttctgtccaccatccattgtgatcccaaggatagcttcccgccattgattcgtcatggttttctgaggacgtccaccttcccgcctctcaggaagtggctccaacagcataaaattcatcatgcaatatcccctcccacacaagttaagaatttagagtctagccaagtgtaatacatgtcccggtgctcaataaccgcgagcacgactattcgaatagatttggtttactcacactgcagtggatgtacactttacccgcactccgcgactgcccaacacatgagcctcgtcccaacacatgagacgcgtcacggcaaagctttttgataacctcgcattggcagtacccgctccatgaacttctcatcctcatgcactctaggcgtacacggtttctagcagtgagaggagttctggcgcacccgggaagggaagactcacacatgcattaagttataattatgttttagattctcacatggcagtcctaccgatggcgacaccactgtagacacccgcctcgcggtcctaccaatggctgccccaccgtagagcccctgcctcacacatcaagaaaccactatgcatggatactgcctccgctcagctatctactccgctaggtctatacccatacgagaagtgcggttgtacgggggtcgtttcatgcttaacttcatggctcggtccttaattgaccagggacggcactagccttttccggacaccacccaagtcctccagccgccccagtcgaaaacagttgtttaactttattttcctttcacaaatcatgtcatcaatatcatggcaatgtggcgctcatgtctccacatgccgcatctcaattaccttcccaaaggtaattacccaagcatatagcgtttgataaatatgagtatgcatgaatctaaaatagcatttctaagcaagtgtcatagttgactagggactcgtacgtatctatggctacaaagatttaaaggtgaacaataatcaaggcatggtataatcacaagtaggacgttcataattgcatgcaattttatttgtaaacaaaacaatttcgcaattgggatcaacatgttcaaagaatagtgatgacttgccttgctcaaagtcttgcgggtcttggccttcgcttggatccgcaactccctcgggctctatagttacgtgcaagaattgatttgaattcggttagaattcaaataaaaatccaaataaatccaaataaaagtcacatgcgaaagtcgattcctttttttattaattttactatctgcgaactatgacaaacccaatttcgatttaaactattttgcgggtataaatgttttattgtcacaaatttttaatttaatctacctgagcattatatccatataataggttagagatttctagcgcgagctaactatctgacaaaatcctagaaacattatatgatttaatttagtctatgactaaacgattaaatatattacacggctataatccctagtaataaaatccgaattttctatcgttaattgcttacttatagggattacccaaaataatctataataattaccgcgaattgatctaaattattaccgcgaattgatctcctatagacattactaaaaataatctataacaatctattaagattcatctaattgttttaattcgtaaataattagttctataatcaaatcttagtactttaggtattttaaatagtaggagttcatctaacgatattctcattaatcctataattaatttctaatatgttaaatattctaaatctcttaaatttttcctttttctcttttctctttctt

SEQ ID NO: 67887 - DNA, 4676 bp, Oryza sativa
tctctctcggctcttgctctcccgggcggcggcgacgatggacgcgaggggggggggaaaggttgggcggcggcttaccgacgacggcgacggcaacggcggcgacagcgacggtggcggtgttggcgcaaggcgcggcgcggcggcttcgtggcggcggcgcggcggctttaagcgatggcgtggtggcgtggagacagcggcgcggtggcgtggagacggcggcgcggtggcgtggaggagtgggtagagatagggggtggagacggaggagaagaggggaatagcggggcttatataggggaagagaaagagataaggggaggggaagacgcgacggcggcgcggggctcggggtgggggcgcgcggcacggggctcggggcgggacgcgacgggcggcggcgtgcggcgcgcggacgagcgacgacggcgacggacgagcgacgcaacggcgacggacgagcggcgacgggacgggcgacgcgacgggcgacggcgcgcggcgcgtggtgcggcagacggcagcggcgcggggcgcaaggcgcgacggcgacggacgagcggcgacgggacgggcgacgcgacgggcgacgcgacgggcgggcagcggcggcacgcggcgcgaggtgcgggcgcgggcgcggcagtggtgcgcggcgcgaggcggcgtcagcgcggcagcggcggcgcggggctcgagatgacgcgacggcagcagcggcgacgcgacggctacgcggcgcggcgatggcgacggcgacggccgagcggcgcgcggcgcggcaggcgacggcggcacggcggcaggcggcgacggcgacggctcggggcgcgaggcgcgcatggcaggggaggggaaggggctagggagcctcgtcgaacacctagaggctaatgaatagtgtctttttcctatttttccaattttagtttatttcctatatgaatttgattctataatttctaaatcttgcataaatgaagtttactcaatatgtgtattatctcaactaatgaattcaccctagattaatattactcatattttatttttatgtaatttatttgagttttatttagggttaattcttattccatcgtatttaaatttaattgatccaaatatggtcgcgataatattttatttatttctatcccacctaatctttattttaaattataatttatttatttctttaaccaaatctaattgcagggttaatttctaattaattttcccctatttgtgatcgatgaattccgaaatcaaaatccaataaaattggcatgatgcaatttatttaaaaagtttttttttttgaagatccgtatttttagagttttgattttgtcggtcgaatttttagggtgttacagcatccaaattagtatatcggctcagtgagctgagccagccaaatacacacaatcaatcaatatacttatatacatacaaaaaaacatagggaggaatcaaggggattcgaatgataatagaactaagaaaggagattggattcggtgggaatggaggaggtctcttactttcgttggtatcggcgatacgataatagatactccagtaatcggtacccctgtagatggatccatctcgatgcttcctatcctcaagaacatcagcaggttgttcgtcgtcctccttctcttcttcttgatccatcattccttccgtgtccattgtgcctgcaaggatagtcgtccctccccgccgtctcttcctcctggatttggattcgacaaccatcttcccgaactgctgggaatcgccgccgcttccgccctccatcgatccctcctcgattcgaacgactcgactcagctagggtttgtttgccgctccaaaggggatcggttcggttgccttttatttctttttttcgcttatctagcctaatcaaatacggtttcggttttattcaaacattgattctcattgaaaacacgcccgtttgtgctttttatcttttttttttgtttttgtttttcaaaaacataaatttgtattatgaaaatgctgccaacgtgttcatcaagagagattgtgaaatcaatgtgttatctatcatgttaaaattgcccactactaccacttgtaagtgtagtagaaagactttttttttaattggatccatgccactgcaactttgtgaaattaaaaaaatgccaatattattcgtcatattggctatatgccactggaaatttctaaaattggaactatgccactcccctccctttttccgtctcctctctcacgccgtctccgttcccatcccatatgtcagtttcatctccccatcttttcctccatccggcgcgactgcaaagaggacagtggcggcggctcccgagcactcctgccgtggatggcatcgaggacggcagaggcggcagctcccgagacctcccgtcgcggatcgaggacagcggcggcggctcccgagccctaccgcacggatggcatcgaggatggcgacggtgacagctccagagacctcccgccgcagatggcgtcgaggatggcggtggcggtagctcctgagacctcccatcatggatcgaggacagaggcggcgacggcggctctcgagccctcccgtcgtagatggcgtcgagtacggcggcggcggctcccgagccctccaatgtggatgactcccgagccctcccgtgtggatggtgtcgaggacggcggtagcgacagctccatagacctctcactgcagctggcgttgaggacggtggcggtggctcccgagccctccggtggtagtcgcgggtaaggtacgttagcctcactcggcgccgtcgacccgctccctcctctccctcctctgcccaccatcttcttctccgagctcgccgctactactcgggctactgggtggcgctccgttgcatcgccgtcgtcgccatcgttatcaccggcactgatggacaagagtgcagggcggcctccgcctcctcgcggaagggggatgaggacgggaacggagacggcgtgagagaggagacggaaaaagggatgggagtggcatggtttcaattttagaaattttcagtggtatggtttcaattttagaaatttccagtggcacatagccaatatgacaaatagtagtagcattttttaaaaattttgcaaagttgcagtggcatggatccaattaatctttttttttgtctatgtcaggcaggcacatatgttgttgctagttggaagtctgcagtaatgtaaaattttaacttgtgcggagactgagaagcggcctatctagacatttcagaaacagagcagccagagagtagaaacagagatactcttatatttcatttatgaattgtttgatttatttgaaagcttagtggtagtagtattagtaagtggtagacattattcgtctatgttgtttttgaagcttattatataggcaaatattattatttgcaacagaactgaatcactctatcagaatatcaattacaaataccacaatgccttccttgctgatctactctgtgtgtgtgtgtttctgaatatgttatgtatatcctggacaatgcatagccgcgtgctggcattagcttttcagattagcagaaagtgccgaccaatgcttaactgaaggtcatatcaccaaagtgcatggattgcaaagtgtaaagttaacacactttagaacaaaatcatgactaggtaactcagcaactgtttctggagcttcaaaagtggcaattatacagatcgtggaaaccattttttactggacatacataaaatgattttttttttgaaacaacataaaatgaattggtgccgagtgcgggacaactttttgtgtgatccgaaacagaagagagtaaaatgcaaaggaaaaagtacaccgaaggtccctcaacttgtaatcgagttacaaaatcgtcccccaaccacaaaactagatatatgacatccctcatcttacaaaaccgttcattttaagtccctcggtggttttgaccccggttttgtccgatgtggcagttgagtcagcatgagacccacgtaggccccacatgtcagattgtccacgtcatcactttgtctttcccctcttctctcccttcctcctttctctcactttttcttctcagtccgagcaagccagccggcggggcgagggtgccaggcaggagaggaagatgtcgggaggccggcgaacggcggcggccgcgacgatgtggaagcaggagggtctccccccacgccgccaccaccgccaccgccgacggcgcaggcgccagatctgcggtgacgtcctcgcgctccccgtcagcgccatccacgtccacctcgtcctcccgcgcccgccctcccatgccgccggcctccgtcgcctttccacgtgccaccatggatgacgaccatggatgacgacgacggcgacttccctctccccgtcggcgccatccgcctccgcctcgtccacccgcgcttgccctcccacgccgctggcccgcatcgtctctccacttgcgggcatggatgacgacggcggcgacctctctctctctgttggcgccatctgcctccgcctcgtcaacccgcgcttgccctcccacgctgccagcctccatcgtctctccacgtgcggctatggatgacaacggcgg

SEQ ID NO: 67888 - DNA, 7991 bp, Oryza sativa
catcctgtcgcgtgcgggggcgagggtgtggcggtggtgggctgcgatagcttcgaggatttcgccgacggttccacctcgcctcgcaggcctcctccccaccagccggccagcctccgcagagctcgcgtgcgctaacctcgtcgaccagggagacttcgatggggcacgccgcgtcgtggatgccgtgctctctgccgctggccctcggggcgaggttagtgaccgcctcgcgcatcactttgcccgcgtgctcctcgctctatgcagtgaagacaagggaggccatagcagtgatgaaggcacgtcagagacaagggaggccattgcggcgctcgaccgcggcgtgctcctctgttgcaccggcgaccgtgaccgtcgcaccatcctgccgcaccctggctgctctccgccggccatcgacgtggagaggagaggagagaggaagtgagttgagagggagggtaagaagtggctgacatggactgtttgacatgtggggcccacgtgggtcctacgttgactcagccgccacgtcggacaaaaccggggtaaaaaccaccgagggacctaaaatgaacggttttgtaagattacaagttgagggaccttcggtgtactttttccaaatgcaaataatcatgattgggccacaatgctctgctatgggctaactcccgttccggcctacgaagactagggtccagagttgtttgcgagctgaaacaaatgggcccatttctcattgatggaaggaaacatttccctcacaagaagcaattaaacattcagcatttcatggacatttgaaggtacccttaattctgcttccacaagtcctagttctttattgatagaatatgacatctcggaaaaagttctcaaaagtttatagagagaaaaatctttaatgtataaaacaataagatgataaaccctgtttggttgtttaattagtagcctgcatatctccagaagcacgcaaacagaaaaaagaaagtgaagatgttcctctgaaacaaagcaagaagcaaaaggtgaagaaatcaatctttccgaatgtgcctgctgctgcgcctgtaccatttcgtcaaaacgcaccactgcttcacatactcttccaatcaactcaaacagcctagtcaatacatgcagatcaaaaaatctgttgaatttaccctctgccggtagttttcctttgataaaatgttcagattaatctgctagattgacctactttacatttgtatatatgctagtccatgttgcacatatcaacatgataacccttctttacactgtgatgtggcaggtatctatgcacaccatattaatcactagtaccaaacttgggttagctaaacttgggtgtctttctgtacacacggccacacggggattcagaatccacggtaatgtgccagcatcaacatggtagcaactagcaaactcaccagtcataccaaatacaaatatgggaatggtctagcagatactagatagacagctccacaactctactccagatctaacacctgaagttaaattaggagttagagctctactaaacaggccctaatgattagaataaaaattcagcaaaaaaaattgatgtactgaaatatagaagttgttttctctgagaaatataaacgcatgttcggagaacaaatcaaccactagacatgttttccataccacgatattctactttagaggcagcacaatatttagcccgttgatcacttaccgggtcagcttttgcctggcacactacaagaaataaatgacgttccatcgtactccctctgtcccataaaaaaacgaatctagtactggatgtgacatagtgacatatctctatatccagattcgtagtactaatatatgtcacatccagtactagattcgtttttttgggacagaaggaatatatgttaaatcttaatattacactgcaatcaaggttttcaaattaaaaagtatggaccataaccatgaaacacagtttctagcccaacaggatagaaacgtctgatgtaagctcaaagtttcattgctttttctgagacctgcacaaagattaaagcaacaatgagaatgtagggggcactatgaccaaaagacattctagaagcttattatagaaaaaatatactccctccgtttcgatatatatgacgtttccgacggcatggacaaaattaaggatagagcgattttactattttgcccttcatcccttttggacgacagggaggagcacagtgcgcgcggcgcggccgtctccctccacgccggctcccttgccatctcccccgcgctgcctcgacgccggttcgctcgtcgtctcccaaacgccgctgctcgcgaccacaggaggaggaacccgctgcacaacgctcttcccggacgccgcgtcgccctttcttctccgaccttcccggtgaaagcggcgttggagcctgagatcaagcggtccttctcgattcagtcctcctcctttctcgtctccaagcagcatgtcctccccggacctcggctcctcactcgtcaccctctctgtaagtgagctcctcgatctcgccttctccaacttccagcttgtttaatttcttttttctcatttcctccaattttcattgcctaattgcctggttttgcccaatttacaatttaagcagaaggagaggagaagccctggttctggttgatctccagccgaacggcaataacgacgatgtcatctgcagatgcagtacgttctgcttggtttcagccgagtggcaagaacaacagtggcggcagcagcaagcccgacgtccggctccctgtgcgccatgctgcccgactcttgcttgccccacaggccacagctcggggtggccggttgccgccaaattggggtgcggcggcggcgcacgggaggcatgaacggcagcggcgcgtgggaggagacagtggcgagcgagtccggtcgcgatgaggacgaggcagcgccgtggcgatgttgagatggagggcaacgatggaaattaacaaacgtgactaggacggatgaactggtagcgtcaaacaaaaaaacgattctgatttgcactgtagcgtcaaataaaaagaaacggagggagtatgtgtttcaacaagcataccaccaaagattttctgtactcaagtgcgcttaaacaccttccgggacattgaagcaacagtataaagcatccttctggattcacttgacatcaaaccacgatctcccattgatttgattgtgttacacgggtggtcaatactcttggtccccttcctgctcgcttcagcacttagcaagtccttcctgcttggttgacaggatggaactatcttcagctgcaaccgacgagacaacaccgatttccagtatgggaagaacatatttctcacttcctttatggctaatcctttaggtggttgctttcccaggatctgtttacatgagaaaattagcatctgaacgtataaacaaaattataaaaacactcagatttaagtagtgagtattcattctgttgttaacaaggcaacagttgatggttatgcattatgttatcaaatatttccatatcttgttaattgattgggtcagtaggagcaaatttggaggaacaatcttgttttcatactaaattcatcgcatgaattagactcaacaaataaatttaattacgtatctcattaccattttactaacttcgcctgtatcagaagatgacttgtccgcttcaatagtttccccatagcccactgtaatcagcaatgaaattggtcatgagacagcttatgaaatggaaagcatagttccgaggttggtgtacagagtctgattgcccccccttttgcactggatgcaagccataagctttctgcaatgttccaaagttgtgcattcaccacagcaaatgactttgtaatgggtggacacataataaagtttcacagctattttcctttctagtttattttaataggatcaaccaaaatgaaacacacctctttgtgaatctgacttgccaatcggcatccccccatcatgttggtagcttcaaaacacaaataaatcaagacataaattatatgcacaaaaacatgaactgaatatatatatatatatatatatatatatatatatatataaagccaatagatgtcaaaccattcaaattttccagtgtcaatgcttttcccagaatgagcaatgccattgctttttagaattgatgaaacatgttcaacaatgtcgtcatggcgcacctacatttcaccaagaaaattgttaaaacatatcattacaaaatgttcaagggcattattccaaaaagagaattcagatatctacacttgcaggtggtggtggttgcaagacacataacagccttcaataacatcatctctcaagacaaatagtacagcacaactgaaagtcaacaatggtgttttaagcactacatttaaacaaatactaagtggtcaatagttgaatcagtaagtcattgatttggcatgctgccgacctgccatagtcaaacaactctactattacaagcttggatttatttgccatccttgctcaccgcaaacaagacaacaccaaagagcccactagggccttgtcaataacatctcttggctagatgaaaaaacaaccaaattgcccaacttatactttttgtctggaacaaatggcacattacttgacgacactatagtataacaccagaagaaaattagaacagatcttacacagtagaacagtggtatggcagcactatgccggcacacgtgtaaagcagaagaatattggcaggtgagagttgttttcggtatcaatgcacctgctacaaaccagatcccttcttgcattctgctactgagactgaagagtgttagaataattgggctaggcccaatttataatattaaatctcaaaggtccataataaatgttgaggataataataccacctcaggatttaagcgagaaatatctcaacctaaatagggagttattagaggctccctgttgaccagttgaggtgggggtcggaatgccacacgcgcgcgcgcgccgggccgggccgggccgtgggcgtgggcgaggctggcggcggcgggcgtgcatcacgtcgcgtcgcgtcgctatccttttgcagccactaacccacgttcccacgattccctccgcaactttcccggtgttagtttctccctctccgcgcctgagttgctctcgcttccccgcttctgatctcttgcgcgcacgagagattggaagaagcagtgcctccgaaaccacacctttgcttgagatctgcaccgggtaggcgggtgatcaggtttttggggagtgcctcctgcacgactgctcatcgccatgtctggagttgctgccgccgctaccggcggaggtggtgcgccgccgccgacaggagctggtgcgccgccgccgacaggagctggatccggagctggtgcgccaggaggaggtgccgtgaacgactacaacaacggaggcaattctgcctcaccatccagcggagggccattctcggggtataatcttctcctcctgctactgctgttagcgctattcctgttcccattgttagcgctatactgtgtgcgctatgttcttgttcctgttctacatgatgcctctagcatgttatcgcgttactggtatgttcctgtttctgacattcatgatgcgcatagtatgctactggttatgttaagatcaccctacactgcttatgccatgatcattgtttcaatttcttggattaaaatatgccgaataatgactatatttccaacaatccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgacgccggcagtgagctgtatgtcatggagcagttctatgactacaagatggtcgatgaccgttctgtagtagaacaagctcatgagattcagatgctggctaaggaacttgagaacaacaactgtgagttgccggacaagtttgtggcgggtggcattattgccaaactaccaccttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggttgcaaccaattttaagaagaaaggcaagggaaaggcaaagggagactgctttgtgtgtggcaagtctgggcattgggccaaggactgtcctgagcgcaaagacaggaagtctgccaacatgatcattagcgagggcggaggaacatcggggtacggtaaaatattacctacagttctctctatttttcattcacctgattggtgggtggatactggtgctaatattcatgtatgtgctgacatttctctgttttcttcttatcaggtcgggagaggttcctccttgttgatgggaaacgggtcacttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgttggtaaaggttatgacagcggaggcttgttccgtttttctttgaatgacatgtgtaataatcataatgctgtgaaccatattagcaagaatgatgagtctaatgtgtggcattcgcgactctgtcatgtgaatttcggttgtatgacgcgcttagctaacatgagtttaattccaaaattcactttggtcaaaggttccaagtgccatacttgtgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggtctgatagaggtggggagtatttttctaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgaggcagttttgactgcatgtcatgtcttgaataaaattccaatgaagcataaggaagtaacaccattcgaggaatgggaaaggaagaaattaaatctctcatacctacgaacatggtgctgtatggccaaggtaaatgtacctatagtcaaaaagcggaaacttggaccaaaaactgttgattgtgtgtttcttggttatgctatccacagtgtgggttatagattttaaatagtaaactctggagtacccgacatgcatg

SEQ ID NO: 67889 - DNA, 1897 bp, Oryza sativa
  unsure (1)..(1897): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattcaatcttgaccagatttaaatatttagaattaatgcttgtttagtatatttgctttagattgatattttgtataaggttgtatcggagctatagccaatacattatcttttcttacctaaacggtcttatcggctatgatacaaatacttgtagtttgcaatttattcaatcttggatacaagcagtttataaaatctcggtttagttcaatctatcccaattgcttgaaaatcttgaattatagattacatattgttagtttctgttgctgatggaacatgtgtaaggatctttcatatttatcttttcattccatactttatagccgattcagctcagttgcatcggctcggctaggtcatgacgatacgtcattggcttattggccaattgactatcgtttactagttcaaacatattgttattcttgttggttgcaggattgaaccaactgacatgttctgaatccgaagcgatatttggacctacactggagctaagcagaacttctaggccgctatgttttcgcataaacagactaacacactaccgtgcacaatctagtcacatcctgttttcttcaaaaacaggtagtctcttctcttcctaaatatattctgcgtaccattcaaaggttgacgctaatattataaaataagttcgttgaaggactaaaatgccaaaaactacatcctacagggaggtttggatccatgatcctactctattccctccgtcctaaaaaactcaacttctagagtttaaattttgttccacacaaaaccaacttctatcatcctacttaccctcagcacgtaaaacgagaagttttatcccttcgataccctttacctacctatcacctttactactttttccaatgattaaggacattttaatcattcttcatcttcacaaatcctaccttggaatgctaggaatagtggtaggaatagtttttttttgacagagagagtagcttccatgtatatatcattgatgtgattaatgattagccagccggccacgtcgtcatgcatgcgacctccgattcacttcaattgcttagtggaattgaagtgcaccgaccgaaacgtccaattgacaagaaaataaataaaattcaataaacaacaacgatacttttttgttagaaaaataaaacatcaccaactgctaaaggatacggcaatttattgtcgaccatacaacagtgactaactgcaaccttatttgattataaactctcgtatttctatttttaatgcgacagcaggttactgtagccatcttaaaaaccacatggccgcgttcaaaataaattagatatatatatcactggactcaaattctagccgaaaatccatggctggccggtggaaatagatcaaaccggggtgctatattgttgggtcattcaacactttgtggacctaattgactaactaattgttccggaaaatagctgcaatatatcttaagtctttgttcagtattaacattgataatcatcttctttggtgtaacaacaaatgtgtttatacagagttggttctttaaaatagccgcttgcgtacacttttccctttacaatggtgaccggcgctgtttttttctccaacaaaagttggataaa

SEQ ID NO: 67890 - DNA, 2277 bp, Oryza sativa
gaactgttggaattaatgtgtatgctaaggttcatgtcaatattaatttctaagtaaattacaaggtcccatctcatggaagggaggcatgtgaatatttgttttatggcaataattgcatttagcggcgaatctgattgccattgcgtgatttaaagagttcttcaaagttggcccatacctcagatttggaccgcttgttgctagcacttgagccggacagcgcgtcgttgccattgtcaccggcaccggtatctaggtagaaggttacctttgtttgttggtgtttcacgggttgtagaagcaggcggcaggtggtgccagcctagagctatagggcagagtttccttcgcagaccaggggtacgccagtgtcgaagaaattgatagagttttaccataacttcattaagataactaacccatgggagtcctctctatcctatacctaccatttagttgttttccttggaagaatcttgttcttagattatacacacacgttccatgtgaatacgataccttggaatacccttgggtgaaggttacaacggtatctgtgcgtttgcagactattatgtggtcagaataaataccaacaacaacccatagggggccactctcggagggtaggtgacaaatgtgccctgagcatagcccttgggggttgcaccctgctgatgtgaaattcttcgtgacacacgaaggccttggaaatatgcttatctccagtgtagggcataacaattaatttgatcctgcaactagcaagatagatagatagatagatagatagatcgtataagatcaaggagtcaatcgaccaataaactgatatgatgttgcgaggccaaccaatgtcaatagggttttgaataatcggctataggtctaatgtaaattcagataatcagataagcaatgagatttgtgttatcaccagctggaactaaactatgttatcatcggctggaactaaacaaccgttctttatcaaaagcaatcttgatagatcagaccaaactgagacaatataagatagaagttgataaatatagatttaactaaagattatacaagtttgagtgtaagccgatgtaactcagaagatgcaatgagataatataatgtgaacaaatcgtctaaaactaatataatgtggtagatgtacatctgatggttaaaacatacattggctggagatctaatgtaagtaaattaaagtgtatatcggctaactaactgatacatctgatagttgaagcccaaaataatgataacatcgggtagcgctccaatgaacgctgcataaaaaccttaccggcttacaagaattagacaaaatagcaaagatctaagagattgggcctgacagagaccagtataagagctaaagataagtgaagaaaaacctacttagccgatagatctatacaaacgtgatggatataatagagatgctatctagaagtaatagtacaattagagaactaccaacttagctagaatatgcagacccaactaagaaagtcctaactaagattatacaagctctaaacagtaatgcaattgaagatagaatcaatatatcaaataggcaatgcttgcatcaacctagatagaatattagacttaatcgagaaagttctcgccaggctgatacaagcaaagttgatggaacttccttgccggagatcgaacttaaccaatgcagccatgctcgaaactaataactcgctgggataaaagggtggcgatgcgtcgaaagtaattgcatcggtctatggagatagattacgaagaccctgggtgtacatatttataatctcgggctgatatgagtcccaatcggacatgactcacaattcctaaagataatacacaagtcttaatcagacactaatcaaactttcctaaagataaaaaggaaaaatactaaaccatgtataattaatagataaattaagctaccatgtcgtggtcttgacgattctttcttgaactcggtttcttctagataagctttccatcggttgattatgttctttccctaaccaaatccaataaagaattttatcaaattttggcattaacacactgtgggcggatatgccccgagcatagccggggaaccacattcgtgagcaggcggcaggtacgcccaagtatctgatatggagaccctggttcccatttatctgacaccataaaatatgatttgagattatttggaaattttttataacacatgttagctccatgtgtcgtgtatttagc

SEQ ID NO: 67891 - DNA, 1161 bp, Oryza sativa
tggggcttcactatactgggtatcatgcggtactggagggttatagtgattctaactggatctctgatgtggatgagatcaaagccactagtggatatgtcttcacactaggtggtggtgctgtttcgtggaggtcttccaaacagaccattttgacgaggtcaaccatggaagcagagctgacggcattggatactgctactgttgaggcagaatggatgcgtgatctattaatggatctgcctattgttgaaaaaccagtgccggctatccttatgaactgtgataatcaaacggtaattgtcaaagtgaatagttataaggataatatgaaatcgtctagacatgtgaaaagacgattgaagtctgtcaggaaattgagaaacttcggagttataacgttggattacatccaaacagctaaaaacctggcagatcccttcacgaagggactatcacgaaatgtgatagacaatgcatcgaaggagatgggtttgagacccatgtgaattatactatggttgtaacccaatctatgtgatcgaagatctcgtgaattagaatatgggaagaacaaaccattagtaaactagaggagagtactaatctatactctctctaagtgaagatgcatgtactctcatgagctgcaaggcagcttggctatgacttaatgagttctattggctttaattagcgaagatgatgtcttgcagagcattcttgaaagaactcacctttgtgagcttgactgttggtcgcagtctatggagattttgggtgaatcttctaggaagcttactaaagacctaggagtatgacttatacgctacacccgaggggtagtttatagacggtctagtaccagataagactctgagtgaaacttgcttgcacaagacttgcaattcaaggtgtagtccattgttcaagtgttgagtaagtgtagcttggagttctagatggatgttcaaccttaatcggtctccatcgaaccgctggtatataaacagtacattggaaaaggcaaatctcagtgggattttgagatttggtgggggattgttggaattaatggatgggctaaaccccactcaaagattaattcttttaaaaatcacaaaagcccacctcatgggatggcatgcatgtggagtttag

SEQ ID NO: 67892 - DNA, 1057 bp, Oryza sativa
atatgtataggtgtttccactaatttcattgtggcctagatcacagattaattatgccctttgtgtggacttgattatatttcttttctggaaggagaacacacgtacacatgatggacctaacttcacatcatcgatctcatcttttcttctttattataaagggcactaaattgcatataaagtctcacttcgcctaaccaggtttgacgactaataactgaagtaccatcagtttaagtactcgatcgatcgcccaggtctaactttaaattttaattaaataattaatgggatgtctaggtgacggccggaattctccaattagtctcgtcatacttcttttcgatccaatatattactggaagagccaggagggagatggaaccaaacatgtctagctaaaatgtaacccaacggataaggaggttcagacctatttggaagagcatagaattgctatttggtagctagttaagaatctgaaaaactgagttttccagatcctggctgctaatttatcttatggattctgtagctacatatttcaaaaagttgggtgtgaatatggacttttgatagaagagttcaagattttagtagcgcaaatcacttatgtagtgaaatctgtaaactaccgctagatttaaaaataaacatctaatatttatccgtgctgccaagagtactcttgaataaatctcggggttcccaactccccctctcgttttccgcgcgcatgcttttggaactgctaaacagtacaatttttgtaaaaagtttctatacgaaagttgctttaaaaaatcatattaaaacatttttgaaaaaaatagctaatacttaattaatgacgcgctaatggatcgttctgttttccgtgcgggaggaattagttcccatcctcctgaaacgaacacaaccttagcctctcagacaacaacccaatttgaaattcgctcatataaagatttgaactgagaattttagggtggctgtaaccgctgctacatgtatatatacgaagaggactagcctgttcaacagccatgccacc

SEQ ID NO: 67893 - DNA, 830 bp, Oryza sativa
accctatgagtgtaaacctatggggtgcaagtgggtgttcaagaagaagcttaggcctgacggtactatagaaaagtacaaggctcggcttgttgctaagggctacactcataaagaaggcgaagatttctttgacacttactcatttgttgctagattgaccacaattcgtgtgctactttccctgcagcctcacatggtcttctcgttcatcaaatggacgttaagacaacttttcttaatggagagctggatgaggagacctatatggatcaacctaatgggtttgtagttgaaggtcaagaaggcaaggtgtgcaaattgttgaagtctttgtatggtctgaaacaagctcctaagcaatggcatgagaaatttgacaaaacattgacatctgcaggcttcgcagtcaatgaggcagataaatgtgtgtactattgtcatggtgggggtaaggaagttattctgtgtttgtatgttgatgacatactgatatttgggacaaaccttgaggtgataaatgaggttaaatcattcttgtctcaaaattttgatacgaaggatttgggagtagctgatgttatcttaaacattgagctaattagaggtgagaatgggattacactcttgcagtcccattatgtggagaagatcttgaatcactttggttacattgatagtaagccttctccaacaccttatgatcctagcttgttgcttcgcaagaacaagagaattgctaggaatcaactggaatactcccaaatcattggctcgctgatgtacctggctagtgcaactaggcctgatatctcctttgctgtgagcaa

SEQ ID NO: 67894 - DNA, 1002 bp, Oryza sativa
ggatcccgctttttactgtgctgccacagatgaaatgggtgtttaaaagaatgatcgttacaggagagcttttctttggaaaggtgacgacccggagaaggttagtgcaggcagcagccttgtcaactagcaacaagtttgcaaacctaaagacttgggcggtcttggcattctaaatttggaaaagtttgctagggccctgaggttacgttggctctagttcaattggaaggaggaccaaaagccatgggcaaatatggatcttccatgcgatgagatggataggtgccttttcaaagctggaacgaagataactgttggaaatggaatcaaaacatctttctggaatgataactggatggatggacaatcgccaaaggatatagcaccagcaatctatcgattagcaaaaagaaagtcaaacagtttaaagaaggaattagaggataatcactggcttgaaatgctccacccgatcacttctttagtggaaattgaagaattaatccaactaggaggtttgttacaacacattaatctagttgctggacaaactgatgacatttcctggagatggacagcgaatggacaatattcagcaaaaagtgcataccttgcacagttccaaggatccaatgctttaactgaatttacacctttgtggagcgcgtttgcggaaccaaaacatcgtttctttggatggcttatccttcatcaacgaactcttactgctgaaaatttgcttcgacgtcactggccatgtgattggatacgtagtttgtgcaatagtgcctttgaagatgcagcccaccttgcaaaagaatgccctttcacagtgaccgtgtggacgcagatttgtatttggatgaattttcagctgcctcaacatcatttgcaaggaaatctatcggactggtggagcagtttctgcactatttcgccaagacaaaacaggaacaaggttctgagagctctcatcacaacatggtggaacgtttggct

SEQ ID NO: 67895 - DNA, 1384 bp, Oryza sativa
ttaggaccaccaattgacttgcttgctgttatgagccatttcttttagtagtctctattgacaatactctactactattattatcaccaatagaagttatcttaattgttgatttatgagttctaattaatatcagtagaataaatgattctattactgtacttgtgaggtgacagtataaattgatatgatctattggattagaaaaaatgaacgacctagattgattctactacgagcacagaccagtataaagaaaacttttaattatgtgctattgcttcttgtaatgttggggaaaaagaccagctgggcttgatagtgatagttactcctaatttatcagcttctccaacttgctgtaatttgtaagcatgcatgcatcgacaatgatgaaatttggaaatatgataatactaatataatatgaattgccttcttgttttggacatgtgcttggttggtgactagggtaattggcttgaacgtaaagaccagactgaaaacttttgaaaagagttgaatttggttcaacctgccgattatatattctggaatttacatcctgattattgatacaattaggcagcagcacatggacatgatatatatacacatctactacttagaagaagcaggcaaaaacacaagatcggtggaggaactatgattgaaatattgaattaaccaaagtaaacgcaatagaagcttcattattgatggtccaggagagatgctctttccagtggccaagggggtaccttacttagctagatgtgttaaatcagcaaccaaacttgacttgcagcgtctttgccgtgtcttccccgtaagtgtcgtgcatatgccatcggcgttttcattgatagatacagctctgcatctactctcaacctcaatctttggacactgctgtatattacatggggtatatatatatcctctctgccttccttctcccagttgcagaccaaaggagccagagcagcacaaatattgagaaaataaggagaccggccactgaagagcatgccttctctctacatattccttgggcttcttctcttctccctgcaggctcctccatgtcctgctgcaactgatactctgaaggcaggacaagtgctctctgccggtgacaagctcgtctcgaggaatggcaagttcgcgctcggcttcttcaacccaagcgcaaacatcagtaagtcatctgacaacatctcctccagttggtacattggcatatggttcaacaagatcccagtttttactgtcgtgtgggtcgctaatagggagaggtcaatcgctgagcccgacttcaagctaacacagctcaaaatatcacaagatggcaatcttgccatcgtaaaccatgccaatgaat

SEQ ID NO: 67896 - DNA, 701 bp, Oryza sativa
gcttcccatatccatcaaagggttagttaacagactgaaggggcctggcaatttggttgctgtatctgagaagcgtattccaacttataccttttttttaaaaaaaatacaggtgctactacatttttcgacaaaattcgctctgtggagaaagacgcagtttgtgttgctcgtttgcggaaatgtggagtgttattcattgggaaagctaatatgcatgagctaggccttggagtaactggaaacaatccaaactatgggtatgcattatcatcatgtgactgcttattttgttcagatcccttagctagtatctagggagcacctgacggtttgtgtggtcacaaatgagaaatatcaacaacattttcaaggccaaacagactgtattattttattagctgtttcctagaatcaaattaaattgagcattagtaaatctagttgactaaccaaagtactgggatgaaaataaatattttgagctatatcagtcacatccaaatctaacacatttttttaaaagattaggaattcaaaattttgatccaatcttaagtgatagtccaatttactgttttctgatgcctagtgtagtgcttaaccatcttgtttcttaacctttccatttgcagaacagcaagaaatccacattcaattgatagatatactggtggttcttcatcaggtccagctgcact

SEQ ID NO: 67897 - DNA, 1952 bp, Oryza sativa
cctaatgccaagattggctggaacaaggtaaccggtctgaaccgtgttggtgtttcgaagaagagcctcattgatatgggcactggctcttatagtgtacaactatacaccaatggcaccagaagggtgaccctcgagcaccgaaacccttcaatagagtactggtattggtcgccagatgaatcgggaatgaagataccagcactcaagcaactactgtacatgaatccacagaccagaggtttagtcaccccggcatatgttaacagcagtgaagaggagtactacagctacaattcatcagatgaatcatcttccacattcctcttgctagacattaatggccagatcaaattcaatgtttggtctcaagacaagcactcatggcaaagcctatatacccaacccgttgatccgtgcaggtcatatgatacttgtggaccattcaccatctgcaacggcaattcacaaccattttgtgactgtatggagaatttcactcgaaagtcacctcgggattgggaccttggtgatcgaacaggagggtgttctaggaatagtccattagattgcaccagaaacacaagttcaacagacatcttccacccattaattcatgttacattgccccgtaacccccaaaccatacaagaagctaccactcagagcgaatgtgcacaagcttgcctcagctcctgctcctgcactgcttattcctaccaaaatactagcacttgctctatctggcatgacgaattgtttagtgtaaaccaagatgatggcattgaaattcattctcaagatgttctttacctccgccttgccgccaaagatttgcagagtttgagaaaaaacaaaaggaaaccaattgttgcagttgttacaaccataagcattattattcttgtgttaataataatgctcatggtgttggtaatggtttggaggaatagattcaagtggtgtggtgtgccattacacagaagccaaggtggtagtggaattatagccttcagatatagtgatttagaccatgctactaaaaatttctcagagaagttgggagaaggaggtttcggctccgtgtttaagggagtgttgagggacttgactgttgtagcagtgaaaaggcttgatggtgcccgtcaaggcgagaagcagttcagggctgaggtgagctcaatcggattgatccaacatatcaacctagtcaagttgattggtttctgctgccaaggtgacaagaggctacttgtttatgaacacatgttaaacggttctcttgatacccatctgtttcagagcaatgctactatactgacgtggagcacgaggtatcaaatagccataggagttgctagaggactttcctacttgcatcagagttgccacgaatgcatcatacactgtgatattaagccacaaaacatacttctcgacgaatcatttactcctaaaattgcagattttgggatggcagtatttgtaggaagggattttagcagagttctgactacatttagaggaacagttggatatcttgccccggagtggattagtggtgtcgcaattacaccaaaagttgatgtttacagctatggtatggtgttgctagagatcatatcaggaatgagaagtttacctaatgtacacagtagcaacagtcatcatgctgcttacttccctgtgcaagccatcagcaagcttcatgagggagatgtgcagagtttggtggatccacgtttgagtggcgacttcaatttagaagaggctgaaagggtttgcaaagttgcttgttggtgcattcaagataatgagttcgatcggccgacaatgggtgaagtggtcctggttcttgaaggtctacaggagtttgatatgccccctatgccaagactacttgcagctataacgagatcttctaatgtagctgagatgtaaaaacaattcaa

SEQ ID NO: 67898 - DNA, 1214 bp, Oryza sativa
tattacctgacctgaattgatggtctgcacagatcctacatttgcacatcgtgctccatgtggctggccgcaggacaaggtggagtccgccagtgatggaggttgtttgctatttttcatttgctcgtcgtctctatgacatgaacaataatgtttttgctttttttttgcgcttgctagatgatggatggctgctactgcgcaacgtcgagcccatctctataccatgctgctacatcctcccttgattccatcgtcgcgtaccgttcgccactcggttgctctctccactaccagtcacaagacacagaccagcctctccatccttatagcaagatccagcaaagccaccaggatgtagtttcacgatggatttttggatgaatctttttttttcttttctagtttgattcacctgtgagtaatcttatcacttgtgtgtgattgagcctgtaatttttttcattcgtacggccattttgtgatacagactaacaatactcttagtatcagtttttactttttatactgtatattgaacacaccagtaaacatattactacatagtggatacgagatcatgggctatatagagagagggtggtaattgttttactcgcagaccacgaagcctcagtttttacccttatactgtgtattaaacacattagtaaacatattactacatggtggctacgagatcatgggctatattgagaggacggtggtaattattttagtcgcagaccacgaaatctaaataatatttataacactggtattcttttacgatcatctaggaatgatgcacgtacaatgtgagggcattcgtgcaagtaaatttgttaggtattcttttacgaccatctaggaatgatgcacatacaatgtgagggcatttgtgcaagtaaatttgttacttttgaaaggggcattcatgcgagtaaattcgttacttttgaaaaactccacaaagtaaattcgttacttttaaaacgttgtgaaacattagaaaaatgaacttggaaagaaaaactaaacggatggttaatattttaccgggtcctttgatgaagcacagataagatggaaaagagaaaaaagaaacacagaaggtggggtggtaaaaaaaacgaaaaaacgaacgagggagcattgtgcggcgctcgaactaggattagcgataccggacatttagtataataactatttga

SEQ ID NO: 67899 - DNA, 1056 bp, Oryza sativa
ttattggcattagatcggcaatgaagaataaagcaagataaagctaaatctactcaatcggctgtagatatcaatgatatataatctacctctagaaacatatttaaaccaagtgattgggatagattgatagtgagtcgagacagtataaatcacttatgcataaaagtactttaagacaaagattatatatattcatatcatagccgatgaagtagatctaacatatatcggcttgtactccgataccactctatgttaagatattaaaacaagaaaaatataccaaacagtaagcctaatatatcttagtgcaataagatcttagtataaaggtcagatttagtacgtcaagtaaacgtgtacagaacaagacaactgaatcaggtaagatcggctgaaaccccgatactatctctattgatgatcataagacaagctagatattataattctagatattgcttaatagatcgaactcgaccgatgcagcattaagcataaagaaaaacacaagatctaaacaagttgatgaaaacctctatgagatggtggatatactatataatctagatcaatatcgatatctaactctattgtctgccttccaatgatagatgttggctgatttagggttagatggtaatactgatagagattatacagcacatatgataactcgacgatttacataatcaagattagagtgtcataaagatgtatgcactaatcccgagaatacaagccgccatgacaagttttacctcttgttgaagatcgaaaccgatgtagctcaacccaaaagcaagaactcgtcgaaataatgaaaataaaaaatgtggcgatacgccgaaagtgttattgaattgtcgttatcaatatacatggtcttgggccatatttatacccaaaatacataatgtgtccttcccgggcacgactctaaatctgctacaaccgttaagatacgaacaagtctttcaggcaaactcttgccgataaatatctctaaggaaactattcaaaatatcataattaatagatacaattgcctat

SEQ ID NO: 67900 - DNA, 1846 bp, Oryza sativa
ttttccttcctttttctcttgagtcttgatgggccgtcagcctatctctctctctctcgcgccacctccctcttgctgggccggcccaagccgcctccctcctcttcccgggtcactgacaggtggggcccacctgttggccccgtcttcctcctccagccggcggcaaccgccgctgccgccccacctcttccgctcctcccgcgcccacgccgcgccgctcccatgtcctccccacgtcgccgccctctccccgcgtctcccgccccgcgcgcgcgcacgaaatgggcgggatttgatttcgaatcccaccccactctctctatctctccaccccacgtcgccggcggcttcggccaccctcccggccacgtcctcccctccctcgcccataaaaaccctccctcgagctccctctcttgtttccccattcgccgttgtcagggttatggataccacatacctaatagtagttgactaaatctcggcaggatccaccacataccatatcttatacggaaactgacctcgagggagttccggttaaggaaagacaaaccatagttctacatggaaacgacaatgactactcagattgtatccatattggtttccctagttctacttagacaaggggacacctatgggtataaatacaagaccccctaggaggagacgggagatgaccacctcaatcaacatacacggaacaacagaagccacaacatacaagccaacatacgccaagacaagacgccggatatcaacttcagggataggcacggttagtcccctacggtgtctccagatactgtcaagagagacgaaagcactatctctaatctcgccgggcacggattcgaggaggaagactaccctgttgtcgactacgagtcagaccttcagactgccatgtcgacaacagttagataggctaccccaaatattgtactggtgtgattatggtgaataagagcaacgaccggcttcggccaacatgatgtagggttattacctgacaattcaggggcccgaacctgtataaaaatcctcgtctccgtctcttttacctcagtctcgtgtatatcctagtaccaatgatccccataccatgcaaataccagaattgcgacatcaaacgtcgacagtggcgcgccaggtagggggattttggtgcttcaggatttagacgagatgggtttaagagatggattctccaacaacaagctactcgacgacttcggctgtggggagatccaacaggctgtggggagatccaacatgtccaagtacatctttcgactagatcggaaccatcatcgtcatcgacaacttggtctatcgagatcaaccaagcctcaagcctcgtggcgtaccaaaagatgttagaccgtatgatgttgaacaagtacgcaacaaggtaattagtagattggttttttaaattgatctactaatttcgtagatacatccgacatgtatctaccaaggtacgcaatattttatctgcaatttatcgtacctatttagatcatacagcattgtcagatccatgatttattatgtttacctagagcatgttctttatacaatatttattgcgcgagtgtccccgatgttaaatcgactacggtctaacgctgggggctcgctctattttcttctgtataaatcatgcttgtttacggtttacataatgcctgatatttacatctgctcgttatatcctgataatgctagaagatccatgcagttttttaagtacatactcgatattatctgctatatgtcttgccttctagaaactatttttcaggaacaattgagcactcgagtaggttgtggt

SEQ ID NO: 67901 - DNA, 738 bp, Oryza sativa
cagtacacaattacacatgcatatagtacaaagttacaagtagtaattgagattttcaatacaggaggcgatgcaagttgcaactccactctctgttgtgtttgaattgactactggtagtggtactcttatacggaagcaaaacctgaaccgaactgcagtggcatcgcatcgcgcaacgcacagcacagcacagcacatgaataaagattaccagtgatgttctccagtactcgatccgttctataaaagattacaagtgatgtgacacatcctagtgttataaatttgaacggatataaatttgttgtactaaaatatgtcacatacagttttagattttttttcagagagaatacacaatatattattcagtactactagtactacctccttgcaaacttgttggttagttcaatattgagctaaccaatattgagttaacaaatgtcaaaaaaaatataaagggagtatatgcctagctagctagtagcagtataagttactcccctcatttctataaggcataactattttttttcatgttacataatataaggcatgcatgcatgcatataattaattagaacctcttctctattaaatatacttttttaaatcctcaactctcaagatctctaattctattggatacatgcattatatttattagggtgattcaaactagaagatgataataattatttcttggtatttaggttaagggtggttgcgtat

SEQ ID NO: 67902 - DNA, 5891 bp, Oryza sativa
atcgcaaggtgaaccggtttgacattcacaatggtggcgcaccgtgcgctggatctgcacatgacggagttgaggaagatccgatgacgaagtgcaccaggtgacagacctccacctttggggccgggtggaacagatcggcgaggcggccacaagttgaaaattatagtcagtacaggttgtggtcatgtatttactgagaatcctaaatattaaacatgttgttacaagcatttctccaggtggaacagatcagcgaggcagccacaagttgaaaaatatagtctgtacaggttgtggtcaggtatttactgagaatcctaaatattatacatgttgttacaagcatgtggtcaggtataccaactgtagttcacatccttgttcaattcattatatcaaacaaattctctaggtgcgataacgagatcaactatccactactgtaaataatctatattataatgtaatcatccatcaatttgccaatgatgccggtgacaagtaaaagatttattaatgcagccaaaatttaactgtgtaaattaatttggctagcatcaaatagaacataaaaaattatttatcaaagatttatttatggaattaattaattatgaacataaaaaacaagttagcataaaatagaacaccaacaattttggaatgactaatttgaacaggaaatacccctctttactctgaagtagaatatggattctatttcacagtaaacttggcaataatatatacatggatagaaatattatgaatcaacagtgatataaagtccgctccctttccttcgtaccatgtgcaattaagaatgtggtatcacattatgacaataacccagtgattgcaatttcggttcaaaatttcagaaatttctgaatgctcggttcgaaattttcggcagattttctcaattctttgttgaaatttctcaaagtttattcaaattctaaaaaaaatcaatccaaaaagttctgaaaatcaaaaaatttcataaattttggtcctaccaaaattcgcaccaagataaaaagtgcaaaccctgcaataacttaatttgtatttcaaattatgaatagcagagcacatatacgacatcatcaaaataatagccagcactggtatatggataatggtcagaattattgcaggacattaagaactatatgtgcgcttgaaatgaaaaaccttcgacatgaaaaaatagttaacctttaacctagtacagatcaattaccaaaatatttgatttttacaatctagacagactcgagttcctcaaaaagctaagatgatgtgctgcttggttgctgactcagtgactctagtagtctagtttcatacaacagtagcagagctcataaaaaacaacacagtaaaacaatatgccaagacacttgaatggattggaaaacaagacgatgtagaggaggggctgcaagaagttaccaatgaaactgatcttgctaatctggcaatccccaagcagacctgctttgtggctgaccatgtcgttaattcacattcactgccttgcaaatcgtgggcaccactatggctgcaacagtcatggtcgtcccttgggagcagggacagctgggccctgccaacggcgccggcaccccttgcagcggccaagcctgcagtaccagccgatgccctcgccagcacaggaagaccatgcgagcagcccatattcatggagttggacagtacaacagctccctgcagtcctgcacctagggacatggagttgagcaagctgactaattatgtttcaattaagcccgagcaaaactataaaacaaaaccacactgcaatatgaaaaaaactacggagttaagcgtagaagtatcaagcggcgtgcctatgttatgtttccagggatcctttgggaccctgggtaaattagtaaattctagctaaagtacgccatgttaactactataccggtaaatagttacataattcatatgtattggactcttggtattttttgagttcatcactgaaaatatctattagcacaatgcaagcacgtggaaactgtcggcagtacacgacgaccaacattcatggtactaagtgaaagcatcataatacagagaatatcagaagaggcacctttggtctcctcgacaatattatgaagtttctttctcttgggcatctcttcatagtacttcagtttaagatcttcacactgcacaactgcagcaaaaaaaaacaaaatgtttacaaactttttcatcaaatactctaaaacctttacaataatgcaactgatggatattacctaatgcttgaacagcccctaccatcttactcagttcaggaacagcgtttgcatggccatgtgcttcaagagatagcaatgtttgctcttgtttcatgacctgaaaattaaaaagtgatataatcagtaaaacatagcacctaatgtatttatcaattcagtaaatctgcttttaccttgattttattttccaagttagatatggcagctgcccataatttattggcattttcatacttttgggaaacacttctcagttgatcagcttgtctatcaaggacttgttctgtcaggaacgtaaaacagtggtgagcatacagaaacatcttatctgaaaattagaccttgaaggagtaagttgaatctaatatattgtgtcttacctgctattgctaccgttttcgaatacaaatggcacaaaccatgggactttcccttactcctttgaagtttatgacaaaggtgccattactctcaactgtcaccctaatatcatgcatatgaaggggtctgttacctcccaccactgcatacacatcaaattcagacaaaatctgtgcatcaatcaaaagtcaaattgtttagctaaacctgaaagtaaattgtgatacaaaattaagagtctcatgaatactgtgtttgcattttcttcttgcacaaggacatcaaatgccctaattccttttggcccgtaagtgttcactatctcagcaaatgcagatgatagaaatagtctccaggagcaagaccatcgattttctagctggaatttccatatcgaactgagtggtaaagcaagggatagtcaccacttcaaattatatcctcagatgtcaatattgcatcccctccttcgaagaaagattcgtcagaaagctttgaagagggttcacaaccctcaattgcacagccaccggcattaatgaacagaacaaagtctcatcacaggcacaagaaggataataagaaacattgtggaactatgatggcatgaccaattaacatttcgataaggtacttccaattttcaatttagaattcaagattatgaaatatccattttggaagcacatgactgatgatggctatcgaagccccttctactcgatattactacagcaccacaattgatgaaaccttgtactctgacatagaaacaatcctattttcttcaaccaatccaatgcccatgactttagtactatatggtgtattattcattcactttgagagcatcaaatgaggccagcacactgatccacttaaaaatagtagctaacatggcagagaatcaagtcaatgaagaacccacaattttaagaagagaaacattactctatcaaatattcaaatctactccaaagaacctaaatcgacgcataaaagttagagcagtatgcaaatgattccacatatagatgattcctgttacatggagataccttattaagctcctagcataccacaacacctgaaggcctcaaaattgggattacaactttggaaccgatgtaggtaaagcaccagaaaataccaaatctgggtacatccaacctcctaaatttcctctgccacatgcgcacacgcacacacacaagaaaaataagagcaaatttggaagcaaactttctagggttttctaccagagccaaatcgagtactccaattcgaccatcctaaacgctcatttcccaaaaaccctttcacgaacatggtgggagggttaggatttaggaatagatcctcacctagctgctagaaccaccattgctgatcaaatgcacatagatttgcaggaatcccaccgcgggaagagggagagaggaggggacgactccgccgccgccaccgccgccgccgccgcggcgccggcgcagggccaggtggtggccgcctccgcctcgctaggattcgcggcgtgaggaggagaggagagtgagagagaggaaaaggttttttctttctttttttttttgacgggagaaaatatgaccgttttttttttgacgggagaaaatattaccgttgctttgagaggatagtgatagagaggaaaaggttttttctttcttttttttgacgggagaaaatatgaccgtttttttttacgggagaaaatatgaccgttgctttaagaggagagtgagagagatgaaaaaggttttttctttcttttttttatgaggactagaaagaaaatatgaccgttgctttaagaggagagtgagagagaggaaaaggttttttttaataggactagaaaatatgcccgttgcaacggattcattagaaactaaatatttagctacttaagaaatctaggatgtttttctcagttgttcctctgaaggtcctttgtcggtcatatatgtgcgatgtgtgtagagggaccgggtagtacagtccgacagagtctgcaaccggaccattccgaaattctcaacttgagcacgaaggtgaaagaactttaatttgtcagcaaattggaccctaaatccattcaaataaaatcattagatagatccacgggatttcaccataaagaaatagataaattgaagctaaaattgtgcatgagtgcgagtgacaagagtgtacgacaacttatgtcgagacagcttcggccaagtagaacttgtccgccaccgcaactgcatattgcagtctttcacttggttatctgtctcacacaccaccgctatcgcaggcccatggcagtcgtgctagtagcgccatcatcagcgaggtgcaccgcacggatctcctaggccactcgacgtgggtgatgtaagcggatatgcggggaactgattgagcagggctgcggtttgcgagggactcgactggtgtttgatactaatgaaaatgaatattaagtaagggcatgaaaaacaagaagctattagcatatgattaattaagttttaattattgcaaatttgaaaaatgaatttatttgatattttataccaacttctatatagaaagttttcacacgaaacatgccattgcccatttagtagtttgaaaagtgtgctaatagaaaccaaggtgaaatttgcatctaaatgaaaaaagaaccggctattgctgtgtcagtgtgttatcctgatatattttgtcgtggattgatcgagtattcaatcaagtttcatacgtattttgttaccgtcgctacaatagaaaccatctttcgtagcaacacccttttattcgtactggcggatttaataaatgcgcgcttgtaaatatacttaagacggattgcggtcaccaactttcgctggcggccacttaagatatttttacaagcggatctcttaagcgactgccagcgctggcggtcactaaagagcaccgcctttaaaatcggccgtggtgcattaaaaaaccacgcatagcaaatatcctcagatccactcctcattctcctctcctcagatcgacacctctcctcttctcctccctcactaacgcaccaccgcctcactcctctcctcccttcccaccggcggcgggtccaatggcggcggctccggcgacgacaaaggggaggggtggtggcggtgaccggtggcg

SEQ ID NO: 67903 - DNA, 3013 bp, Oryza sativa
tgtcttaacatctcgcctgttaaactcaattttccatggcggtcggctaatcgccagtgaaaatgcattattttcactggctttagttcgctcgcggcaccgtcggccgccagcaaaaaactattttagtcactagcaaaaatgattttccacgatatagattgaaagatgtacgcacgtatttggttgagacaagaagggaccagatcaccagatgggacaaagaaactaagaaaactgaaaaaattaagtacaggaaacgcgacgtgcacatacgtaccgcttgtgccacgagcatctttaacgtattaagcaggaacacccatgtgtggacgcggatgacatgttgctttacgcgagaattgagatagatgcgggcatgtgggattcggtatccatgtggtaattcgacaacataccgagctttggcaaaaacaacttatatttttataatggcaaattttgctacagaacatcgtgacttcgtggtattagctgtaagataacacacgaagtaacttttgggggaagacactctataaacgtggtaatttatcagcggacatcgcactcattaaaataataatttctgattgaagagaagagaaaaatcacgtgaaatatcagaaatacccctggacccatatgtcaacccttctctatatatgaccacctcgcattcttcctcgaggtgcctgaccccttctgtcgagcttgacccgtcggccacgtcgcagcgggaggtggaggaggggcacgaggaggagtttcgtgctcaaccaaccccctcaagtcgccgtcttcggccgcagcgcctccgtgctcccgctcgccttcgtcctctttgttacagcatatgacgcagacggtcgcggccctcaccctcacggcgagctccctggtatcgcgctccttctctgtccttggccactagaagaagtggcggaacaactccctctcccgcccacccgcattgcttcccttcagcggctgcgacctccacgaaatatttttataatggcaaattttgctacagaacatcgtgacttcgtggtattagctgtaagacaacacacgaagtaactttcattctcctctttcacagaagggatagagagagaagagagatgtgatagctgacatgtctgggtccaggggcatttgtgtacactttatactattcttctcttctcctcaaccaattaattattattttaatgagtgcggtgtccgctgacaaattatcacgtttatagagtgttttcccccaaagtcactttatgcggtgtcttatagctaaaatcgcgaagtcacgatgtcatgtagcaaaatttgccttttataatagataaaggttgagagaatgcttgtaaaggaaaggattcgtgtccgtcgtaatatgaccgttgagggttttcggcttttagggccgatttgggccctgtcttatttaatccatggaaaatgttcacttcaatccatagaaaatgttcacttcagatcctttaaatataggcccaatttgaatcgtatctctcaacgaccgttgaccctaaaatttctcttgaaataaatggagcgtaaagtcggcgctattatttcatttagacaaaacaaaagggagctaccccccccccccccccccaattgaagggactagctaggtacgcaatatactctgcagcatcaatgtggggatatatgagaaacacaaataatctgttgaattttatttagtattgtataacaatggttatattgagagaaataagattctttagaagcttaatttgcctctgaagattaagatctttatgtggtacttacttaaaggggtagtgttaactaaagataatttggcaaggagaaactggaatgggagtttgaaatgttgtttctgtatgaagaatgaaactattcagcatctttttatggaatgccattttgcaaagtttatttggagagctgtacagttctcttttggtctttaccctcctaatagcatatctcatattttttatgattgtcttctgggggtggacaagaaaaataggaaacttattctcataggagcttctgctatatgttggactctatggttgagtagaaatgatatgatttttgacaaatcaccatctgtttatatatgcaggtaattttcaggacaacgcactggctcaggtcttgggcactgctacaaaagtgtgatgaagagggcgagcgtttaaaagttgtatgtcgtaattttgagacaacggttatgcaaatgtttaccaattttggatggagattcacaaacagaattcaataattgtgtactccttatcttgggttggtaggtgtcttctttttttatgtgagaaactttttattttgtgtgttactctgtaataattggctgtagctcgttgagcaaaggctgggatattctattccattatctaaaaaaagtataataactatctcataggatataccccatccatttctaaatatatatataggacatgttcggttgtgctttgcacacataaaagtactgtactgcaacacggtggcacggtgcaaataaagacagccgaacacgccaatagagtatggaaacttgtattacaagttagtaaacctaacctccagaattatatctggagagctttattttatcttgataattcgtatttttactcttattcctaaacgtagttctaacacctggatcggcctgcttagttctaatcggttcttgggtactctcatagatccattgtctagcctttatccattgttgccgcgtccggaagagataggaggatggtgttcaccgccgggacctgaaatgaaattagattctaggcatcaaaccaaatggaactcaacatatggtgctacaagatatgcccattattttgaggaaaaaaacacagagaccgggctatcatctattctaactattgctaaaattcttttaccaattaaattgctactttctaccgatcatgattattcgacgttg

SEQ ID NO: 67904 - DNA, 2079 bp, Oryza sativa
ttgctcctttcagactatttaattaccaaagaaaagttgttgagtcaatatgataaattaatagagctgttgaaattagttggttgattggaaattcaggcatttgactacggatacctggtgtgtatgtacgcaagaaccagagaacataagatccattcggagtagaaatttaacgcgacaaagaaggtggacactacgtactaattgcttaatttggaaggtttcaactttcaacaagcgtcgatatcatattaatttcacgccgtggactcatagaattacatttattttgggattaggggtagtactattgttctccataacgcaggaagacgccatatcgaagtaaggtgcaaaatgaaggaaaacagaaaaccaagtcaagcatttactactacgactgctatcagcctcatcgatcgtttgcactaatatagaatcagctattgccaaaatttagattgtaaaattgaatttttgagttggttttatgatattttcaatgtaggtttatatatttttagaattggattttaagtcgctaggaacaaacaactaaaagttttagaattgatttttttcaatggaggttttatgatattttaaggcacgcacgaatccggcagaggaggtggcgcaggcgagggagcacgtggaagaggaggcggcacgggcgagagaggtaggggaggggaggcgaggcgatgcggaagcggaagggcacccgatattttcccctctcatcgggcgcccgagtcaaaggattttcgctttttatctagtggttgactgacaaccagcatgtttcgcagaataaatacgaagaaaacttaagtatggcaactaaacatatcatgatatacacaatacaatgttctttatacagaagtgaactttttttttcttggggagtgggggttggtctcctttattttcatcgagtgaaaaatatatgcgcatgcacatcacgcttatacacatgtgagagtacatgatatttgacacatacttttgaagtagacgtcctactataaatctataaaccttatataaccataaatttataaaccccaataaagtcatttaagtatccatatgcacacaattgtggttcctgagatttaaatctgatgcaaaggctgggatttatatcccattattcttttttaaaaataaaccttaatggatagagtttatgtcctaagactctaccaacccacacctacttccttggccgatagagagactttgttcctagctctgctcaaattcctagcaacaaggagggtagtgtcccccatctggtcctcctaaaacgtaattccaaatcagattaagtcgtgcatgcgaaagaaaatgataggagtatgctcctcagtgaagagtttcactatattcaagtattattacagttgtgtcaaaagataaaagtattctggttttcgacaatatggggttggaactttggatctgattctctcatcaacggcctctccttccattgctaacaggaggatcgtgcccacctccagggtctgaaaaaataaatcccgagtcaaataaaaccatgtatttcgctttaaaaaaaatcatacatgaaatactcgaaattaaaccatatatttttttgctgacaaacaatctggatcctctcaatatatcaggactgaacttactcgcaggaactccaccagacagaaaccgaggagaccttattgccggtggcttcctacgagtctcccggccgccggccactagctcgccggagttgccgcctgagctgccggcggcgaacaccctgggcagaaacggcaacggaagcaagaggaacatcactaggattgcttgcaactcgacgcgaatccgagaagctcctcccatggtcgatcgctttggaaatattctttgagatgttttggctcccaatctgtgtgtctcggatgtccaaattacttgctcttaatttgcagggtatttataaatccacagagagtttggtggaattgggatgtgtacgtacgtgccaaacagaatagaacaagaagaaaaatattatgcagagcctatcgatctttt

SEQ ID NO: 67905 - DNA, 4494 bp, Oryza sativa
taattagtgtcattagcagttaattaattaattattttttatttaattaacatcattagtaattaattaatcattaattatacgttaatcatgatccatgtcaggccatctcgcacgctgctcaagcgagatcgcttcttgttttgctgtcacgctggtcccgtgtcctggtgttgcgagaccgtgcggtatcgctccaacaacctgtgagaccgtggtctatcgtcacgctatcgttactttcgctgaatgaatcagcgatattgttttgctttcgcactttcaatcagcgactatggtatatttgtgtaaaaaattttacatcccgaatattaatgaaaaaaaaatgaatgaatggtatattttaaaattgattcttactttctccgtttattttcacacaattctttatttaaattcattaacacctatataaacacctatataaagaacatatataatatacgaaacacatatatgcatccgttcaaaatgtagactggaatttatagtgcaaaaccagggaaaaactataaaaaaaaacgaaactaaaactgaatgtagcatatatatatatatatagtagtataatgtcatgtgcagttttagatttgtttttttagactgagagagtaccaccaaaccaaccatatgcgttcgcgcacgacaacgacagatatacgacttttactatacggctatacgcctctctctctatcaggggcggtaccacccattaggcggggttgggcggccggcccagctacggcccgcgccaccccaaccctccatatcctttttaggccgcctaccaccatatccaattcacaattgacccataaataagcagtccaagtgtccaattttaatcctgcatatgtaatgctttcctgagtcaattcctcgacactgctcacccccgtcccctactatagttagctgcctaatgtttttctctctctctcccttctaagcaaaataataatcatcttattctgggtatgcgatatcttctcatatatttattttttaaaagatatctatcaaccatgctttatgaattgactcatatttgcaaattgatatgtttatctttttatgtatgatgaattatgtatggcgcaaaaattattactttatttttaatatcatttttgtttttgtttgccttaatttattgtttatactatatatttatatgattacaacataaatatggtattttttgcgtttagttgttcttattgagacgagcatcttcgcctcatctttattttaatcttgcgtccgccactgctctctatgaatatcgattatccatgttgcctctataaataataatgacccggcacgaaatgctggtatcagatatgagcagcgtgcagatcgtttgagcagctagcaacaaattacaagagggtggtagctaggcagctagctagttaggccggatggcgcggctgcagcgacgacgtctcgtgctgccgctcctgcagctcgccgtggtgctctggttggcggctaccagcggctgcttgtgccgccggccgccgaccccgatcgccggcgtcccgtcgccgccgattctgccggacggcgaccggacaccggagtcgcctccaggtgatcagagattcatttaaccatcatatatacatgcacctatacgcagctcaagctaaatttcaaagcccattgcgcgcatgagcaaatcaacttatatattatcttacttttcaaatatatctgaataacttgtcgtttaattatttgtcttatttagaagaactatatgtaaatgtcgtctaatttcctcgtggcttgttttattataaggaatataaataacttataattttaatatctgtatttaatttgtgataatatgaatattcaaacaccatcacaaatgtataaattcaaaagcaaagagagattatttgttaatcttaatttgtgcgacataataataaataaatacatgtgacgatatattgacgcagtttgctttttcccttgttttgcagctcccgtatccgcaaaacacccgaacttctcggtccttccgccgccgggctgctcgccggattgcaccgaccagcaacgtcagccttaattagttagggactatcaacgacgtacgttcagcatatatactctggttgcaaacgtgtaattatatagtatgctctgtaagttcgttccgatttcaaatgtaatgcaatttagcgcattgtatatttgtattctcaactacttgtaagtgtaatttctattgctagtgtaaatgtacggccgagcgatcagacttggccgctagctaatcaacgacgagactagtacgcatgcaactcctaccgccgtcaagcccggcgtgcagttagtgtgcatgaacctgcgctattaaccaccttcttcgtccacgaaaataaaacatgacaaatatttccgataatgctttaaatcgaacgtttgatacgacgaaatatcggacgcaccaccgagtgggtcccacctaaccactttcccacctttttctctctaccggtcaaacttatctctatctcaaccactcattcttctctctctcccctcaacacgagtgttcgtggtttcgccaggaagaaggagcatgccagcggccactatggctaggggtggaaacgagccaagccgagccaagctcggctcggctcgtgaaagcttggtaaagaacaggctcggctcggcttgataaagagaacgagcaaaaaatgcagctcggcttggctcgtttcaaagctcgagccagctcgagccagcttgtgatgcacaacagcaagtaaatacttcaacaatagtgcaatcaattttcagcaagttaacagcaagtgtgcattacagattctatttactacacaaaacatatggctcgaattaagtatagtatattagtgtaggtataacaattttgatctatttgcctcaacctttctgtgattgaatcattgataatagcacacactgcacacatacacatcaattcatcacgcatatacacatcaattcatcacgcatatacacagctactgagaaatgaatcacaaaaatcagaaaatacatcacgaacctcttcatcctaggctcgtcgctgtgtgaactgtcgtcgatcggttggcgtctcggcgaggtgatggacggcgtcgaccgtcgagtcagggacgcgggtagcacaggagagggaggccgaaggcggtgcagggtagagaggcggcgccgcgacggcactggggtcgagcgtcgctgggcggctggggagggaggccggagccagcgcagccgcgcagggcgcaggggagggaggcggctggctggcggaactgaggctgccgcgtcgagcggcgcgccggcgcttctgctagggactgggagggaggcggcgggccagcggccggcaactccttgcgccgcccagagggagggactcggtctcggtgcgatggagtagcggcggcgacgaactgggaagtgggaaggggaatagtttctgtagcaagggaaggttagggttttcattaggcctgggatggggaattgttaatgggccaaggtcattttttcaccagcttgacaagcctaccgagcggcttgtgagctagctcgggctcggctcaatttacaaacgagctctggaggcagctcgggctcggctcgttttcttttcgagccaagccgagctttgcgagctcgagccaagcccgagccgagctcacgagcccgagctttttgtccacccctaactatggcggtggtggggcggcacgacgcaaaaagggaggagaacaccggcgaccatgctagtggcagcgaagaaggccgacacgaaaggaaggaccggataagacattggacctttggtgtcggcagagtagccgcgagcccacgatgcgaaggaggtcgcgcgacttgccctggcaaggtcgccctcctgcatcgctacttgccatggtccacgtgaccacgtctacaccatgccaatcggttgattccggtgagcggacttgaagaagatagaggtaggcgctgctagggaattttagatgttgtagcttgtttgttctattaagttgtttcatttcattttagtgaagttggaattttagtgatgttgcagcttatttgtatttttgttgcaatttgttctattaagttgtttcattccgttttgattcattgttacataaattaatttcttggtgttacagtgagtatgtttgactattttcatttggttgaaacaattttgtttaagcactgaaacattttctctggtagtgaaacatctgaaatattttcatttaaatatttttttatcaacaagtgaaacatgtgaaacattcttaaacaacaccaacaccgtccgataatttgcacaaaattggacgtctgatccgtagcaacctccaaatacttcttaagcaaattaaagattggtataaaattattggcaaaatt

SEQ ID NO: 67906 - DNA, 2906 bp, Oryza sativa
cagcattaatatatggtcatacctatcatacacacattgcattttggagtccatgttgcagctggctacttatctgtatcctgttactctttttgttatcttttatcttctcgatatgtgtttatagttggattatagtttgctattgtaccaactctaatagatatatgcagagtgaggcgtatagtaagtatatcggtcgttgtcgtgcacggacgcatatggttggctggtcgccgttgctatggctaactagtactccctccaccctaaaatataagagattttggatgaatgtgatagattctagtattataaacctggctttctattcaaattcacagtactaggatatgtcttattcatagaaattctcttatattttagaacacaaggagtagatacttctccggtttaacactataagccattttagattttgaacggatatatatatatatatatatatatatatatatatatatatatatatatatatatatggtgagattaaactacagaggaagtactatcttcgtctaaaaataaatgcagttatgaatatttgtgtacaatgtttgaccacccatcttatttaaaaaattgttgaaaaaaataaaaaattagtattattcatgttttatcatctaataacaataaaaatcctaatcataaaaaaaaattaaataagatgaacagttcaacgttagatatgaacaatttaaaactatatttattttagggaacaattcaaaactatacttagtttgggactgaggcgcagcagtagttactgtcttactggtacgatgcatggatggtgtgcttaatttgacatgtcactaaaaccaagggtccatgcaggtctggaggagtcaagcagaagcggcaacagacttgtctgtccaaggagctctaaattaacactgtactgcgcactctacacgtctacttcctctgtcccataaaaatcaacccaataccgtataaaacactgtactgcgtatactacatgtctactccaaacataaatatttgtacaattgaaaatttatagatacaagttataaacatttttagttacttcattctcgccaactactcatgttttaatttcgttatgatttctgccaaccagggatttaacatgggcactgaaataattttggcaaaatttgctacaggacaccctaaaatcgtgtaattggctgtgggacaccgtaaaatcttggctttgcccacggacactacgaaagttgtgaaattggctgtgagacgccggaggcaatattttataatttccgaggcaaaagaggtcagaaaattttctaaatgaccaatctacccttgcgcgccgctacctctaagcctgactccatcccccctccctccacagcctgattccccattcccaaacctaaccctaggcgacggcggcggcggggccggcggcgacagcggcggtggcggggccggcggcggaggcggcagtgttgaggacggcgacgacggcggcctagtcggcttcggttggtgcggcgatggacagctcggcgtcatcttcagtggtacggcgccgtggtggtggcgagttgcccttgggcaaatgtccattgtgccactgatggggattgttggctcagaaatgaagggagttgaaggagtgggacgaattttagtgtaccttggagttgtgcaagctttattattactgttgattttggtagttgtcattagcaagtaatatggactgtaataggcaatttagtatttggaagcaatgtaatgttgaacttatgaatgccctgtggaattaatgaatgtagtatggttttcagatgaaatgcagccattcgaatttggtttgatatggcatctgagcaattggaatttttgcagtactctgtgatgttgctttgatatggcattgagtaatagtgcacagcatttgcagtagtatatggcatctgagcaatttggacaacatgttgacaaaatttggccagagaaaaatttggacagcatgttggcaaaatttggccagacaaaaaattggacagcatgttggcatctgagcagtaaatgtttgctgtctgaaacattggcaaaaaatttgcccagacagcaaattgacagtttggcaaaatttcagacagcaaactggcatacatccatacaacaaacatttacaagcatgttggacagtaaacaaaattttatacagcaataatttagaagccattccagaaatactcactgccattccacatcaactagtgccatacatccagtgccacacatggtactgccactgccattaagcttggtctatacaaaagccatacatgaaagtctttaggcacattttgcctagcaaatatgagtagtactgcccattggctccataacaaaagcagtgcacttagcacataaaggagtccatgccattaaaagctaacatcagtgaacatagcatcctacatttatacaaaagcaaatttcatgtcattgaacttcagtcttcagatggcaccagctgccttgttgcttggagcatcaacatccaaattgagagctctagccctgctccttgttattgggcttgtttgagttaccccagatgcttgtgatcttgaaggtgtggacctgcaaaaaaatgaaaatcaacataaatatgtagagtaaatatagcaaatgtatggcataaaaaagaaattttgctgttgacaacatacacagtagctgttgggacttgtatgacaggatcttgcacagaaagcacaactttcttcactctttttctcttgggctttttctcttcccagcacacttcttccttggcgacatcttcctagctgccgctcggccgcctaccaatatgacagctccatcggccaccgtcgtcg

SEQ ID NO: 67907 - DNA, 8181 bp, Oryza sativa
ctatgaacttgctcttatgcatatcgcctctataaataataacgacccagcacgaaacgcgggtataagatatgagcagtgtgcagatcgtttgagcagctagcaacaaattacaagagggtggcagctagctagttaggccggatggcgcggctgcagcgacgacgtctggtgctggcgctcctgcagctcgccgtggcgctctggttggcggctaccagcggctgcttctgccgccagccgccgagtccgatagccggcgtctcgtcgccgccgattctgccggacggcaaccggccaccgaagtcgcctccaggtgatcagagattcattttaccactacatacatacatacatacatacatacatacatacatgcatgcacctatacgaagctcaagctaaatttcaaaggccattaattgcgcgcatatataactaagcatatcaacttttatatatatatatatatatatatatatatatatatatattatcttccttttcaaatatatctgaataacatgtcgtttaattattcgtcttatttacaagaactatatgtaaatgacgtctatttcctcgtggcttgttttattataagaaatataaataacttgtattcttttaatctgtatttaatttgtgataatatgaatatccacacgccatcataaatataaattcaaaagcaaagagagtattcgttaatcttattttatgcgcgacataataataaataaatgtgacaatatactgacgcagttttgcttttcccttgttttgcagctcccgcatccgcacaacacatgaaccgctcctttcagccgggctgcccgccggattgcaccgaccagcaacgtcagccttaattagttatggactatcaacgacgtacgttcagcatatatactctggttgcaaacgtgttagtatgtactccactctgtaagttcgttccgatttcaaatgtaataatgcaaatttagcgcattgtattctcaactacttgtaagtataatttctattttactagtataaatgtagggccgagcgatcagattggtacatcttcaaaaacaatatcctagacttgattaattatatgtaaaaacgctcaaattaattactgcctctcctttcataaaagttacacctattacttttatccagtggcggatcccgaaaattggttcgttggtgtcatagcgtgtctatcggtgtcatagtatactaattatgcttagaacatgatgttatagtatatggataagcagttttgttattggttttgccgaaagtcgtcggtgtcgcctgacaccgatgattatactgtagatccgcccctgcttttatcaccaaaacttataagaaattggactctatgtcatctcccttccatgcatcgtgcatatgcaggctatgactatctcaatgactccaaaactgtacctggtggaacagtgggaaattcagcacccatatacatatccattagtttccttcaaacttccaacttttctatcatatcaaatgtttggatatatgtatggaggcattaagtatggatgaaaaaaaacaattgcacagtttgtatgtaaattgcgagacgaatcttttgatcctaattacgccatgatttgataatgtggtgctacaataaacatttgctaattacggattaattatgcttaattgattcgttttgcagtttgttttgttattagtctacgtttaatactttaaatgtgtgtccgtatacatcaaaatgtttttgccaaagcaactaaacacggccatatttggtttgccgttggtgtattgtgttagttattatatgcttatttttcaatttaagtttatgcgaaaaattaaagcctacaattagtacatattttcatgcatgaatcaaaattacaatgtgcgaaatccaagtaattaactcctataagtcgctgggctttccaatcccacccccctcaacttaatttgttcaaaacgtactccctataaatccacttactattccaacttcccacctctctatctctagttttcattgattcctcgtcacacatagagatttctcgcatcccatggatctcatgatggtgtcggtaaagttgctccttatatcttctctcctttggaatgagatttaatacaccattttcttgtagcatgtgataattatcatgtttcgttaccttaccgtttgtggaattattaaagcgtgcaacagcgaaaggtgcaaggaggattaggtgtacaccttttgtggaattattaaagcgcgtgcaacagcgaaacatgcaaggaggatgaggtgtacaactttggtttaaagggacaactttgcagtttgcacaccgtgatggaggtccatggatcatgagaaaaatagatagaggtggaaagttgaaaaaaataggagtgcacgaaattaaattataagaagagactgaaaatactagtgacttgtaggggtatttggattttcccccaattacaatttgatagaagattgaagtgcacacaggccatccctaaacttgcatagatgtatcatctagatccctgaactctcaacaaatatatttttgagtcgtcgaatttatctttgatgtcatataggtctaaacgggctccaacctcctccgtgcgccgacgtggcatgccgcaatggaatgttagtaggatccacattttagtcacatagaaaaaataaaattgaaaaacatcttttctcctcttaggttatatatgctagcaaaggatatacaggtatgatcaaattaactagggattatccagcacaattttatatggtgctagattttgagatacaattagacaattcttatattttatttataatcatacaacattatttctacaaaatagaacttaaacatataattggattccgaatacaatatgtagcttctatctcttagatataatggtattttgtacgcatgcaattatgatcgatcaatttgcaacggtataatatggcccaccaaagtcttatggttcgaacccttttctttttatctgagtaatgtggaaatttttaaccttctaaatgagacgaacgtagtgacttctttttgaattatcaatataacataacactaatgatataatagattatctatgatgttgatagtgctacggggggtatgcattatgaatcaacttgtatcacaatagtgtgagagagaacaaactttagtcaaccatacatgtacacttgtgtgaaccacctgctgctgtcaaatcctgagtacactagtgttctgttttttcttcattgagagctttctggtttctggccaaaccacggagttgtgttggacgaacatagaaaatcaagcacaccaaaagctgtccatttgtcgtatatatcactgtcaacgacgacgacgacatcaatcatcaatggatcggtgcatgcactcgatcgatcgcctctatctacaaatctttgcaagtgtgtacgtgcagacgagccggccgatgatccactgccaccgatcgagcagatgagcaggcagccagaactagctagctaggtaggtggtgttcagcgtttattagcaaaaaagaaggccatagcgtttagcgcgcgtcggcgagatggcgcttctgcagcgacgtaggcgacaccgtgtgttcgccgtcgttcagctccccctggcgctgtggccagggttggaaatttcggaccgaaatttcggtcattttggtcccctccgatacgatattagtttggccgaaatttttaaaatttttaattttttcaagaatttgggtaatatttgtttaaattcaactaaatattgtttaaattttggaaatttcggatcgaaatttcgggatttcggtgacccccgatcaaaaagccctaaaccgatatagtgaaaccctgactgtggctggcggcgacgagcggctaccggtgtaagatgggagtcgccccgccgccggcggtgggccagctggtggtggacggcagccgtattccgacgagccctccctgtgagcaccgatcatcgagctgagcactccgtttcttcttcctcaggcctttcacagtttcactcatgaatgtgacgaatagaattaatttgttttatctcgttttgcagctccacaggtgcactggccatggcgcacgcagccagagccggcgccgacgccggtctgcccgccggagggttgcatcggcggcggccacccgtctggccgacagccttagttatcagagatttggagcaaccaaagtgtcacttgggaagtcccaatggactactgtgtggctatgatacgtacgtgcacacagtagtttcgtataagtatgtaattatctgatctgaataaatttggtgcacgttatacatcaccaatttgcatcgattgaaagattgttattacttattacactactacataattaattttagtggaaaagatcctctttaatttgtagtggatcataactgctcgcatctgcaaatgtcgcttcccataaacagctcaagggtcacaagcaggccttaacaggcccgtatgtgaaaataagcatattttcgctggcagggctgttaagtggcccgcttgccaccagcctaccaggctagcttcccactcccttttccactaaaaaaaagtgtatcctctctctcacacactctcctcatactctcctccatcatcctctactccttccccatgtcctctcctcttcctgtctcctcaaatccaggcaatggaagatgggagtggtgaccacgcgactgttaacaaccaaatttagtaacatcggtgtcaggaaagaagattagatcaaagcgaagtcgaaggtggagatcgagttcggaaacagaacaggactcgactggagtccagatcggctacgattaggatcggctgggtctgagtcggactaggtaagccgatacagccgattccgacaatacgacttggtgtacaacatcggattgagacgatataattcaagatgattgccgcacatggatagagtcctgagaaggcaattgtatctattaattaggatgttttatgtaatttccttagagatatgcttaaggcaaaagtctgccgcaaagacttatggtattttagagtttgttagagatagcagtcgtgtccgttatggacatatcttgtaattcttgggtataaatagacccgagccctatgtaacttttaacacacacgttcaatacaatttcggcgcatcgccacccttttgatttagttttgtttcaacgagttcttgctttcaggttgagctgcatcggtttcgatcttcaacaagaggtaaaacttgttatgatggcttgcgttcataagattagtgcttccatcctcatgatactctaatcttgtttatgtgattcgtcgagttatcatatatcttacataatctccggcaatatcgcggtttaacctacgatcggctaacatctatcgaggaaggtagccgattaggttaaattctgacgttgactcagattatataagatatttaccactctatgaaacttccagcgacttgattgtctagatattgttcttcttttcatacttaatgctgcattaattgagtttgatctattaagtcgtgcttagaagatcaatctctagcctatcttctggttgccgattagggtagcatcagagtttcagccgatcttatctgatttaactatatttgctttatatgcttcattgatacgttaaatttgccctttaatcaagatattgctatatttaaatatattaggcctttgtttgatatattatacctattttaatatcctgatatagagtagtatcggagtattagccgatacatgctaggtctatttgatcggctatgctataaacatatatagtcctgttgttaatatatacttcgatctaagtgatttatactgtctcggcatggtgaccgatctaccccaatcacttgatttaagtatatatcgatataagaactatatattagaaatatctacagctgatcgaacagatttagttctttattgcctacttacaactgccgatcgattcatatatgacatcggctcaaggataaatgatatgtgctatcatttatagatttaaccgcggtttctttgcttctgtttcttgttgattacaggatcaaatcaactggcacgctaatacacctgaaggcgagctttggacctgcactggagttaagcagatctcccaggcctcgtgttttctgtcaacacgcttttggcacgcccagtggaacttgtaagaagtcagccgacagttcctcctcatggccgaaaaacaaccaccaccaccatctagtccaggctctgttaaggaaaagattaaggttaaaactgttaatacacagtaaaaatacacaaagagaagaaccatatcagcataattaaaatataggttaacatcactaacaaaaatctttacaaatttgcaagtcttcacataaatcaagtgtctacaaagacgagatttttcacacacagatcacaacacaattcgaaaattgcatgtaagaataatgataaaagtgatataactttgcgaaaaacatcatgcaaattacaaagtaataaaggcttgatagactgttagcaaatattaaaacaaatgatttatgataacctgtgatataaacgttcgatggaaccagctttattacatatatggataataccttaatttaaaccaaatttaagttgcacaatttgcacctctgctacattaattttacatagcacactcatatagctatatacctaggattaatgcgattctagttgcagaatgcagattttcatcctacttgtctcatcaaatacaacctagtgttctgaggcagatcgtccaaaacaaagtcaatcaacaagataaaatctcacctctttttcataataagatagtaaattttcatgtcgacattaaggttaagcacaacaaaaattgcagaacaaaacaaccattgcataaattaatcaaaacaatagtaccaaatttaggtcagcgtcttaccaggagcactccagtggctgcagggcagacagggcaaccaggacggagatgggaggcgtggggaggctgccggctcgacgagtgcactctcaccgccgtggtttgggcaaggcacaagctgtgggaggtcggatgcgggagagaataggctagggctggaggcaaggcgccggggacgagggagacgccgggcgcgtggaggttgggcttctctcggcgccggaggaatcggtacggaagcgtcggcgcgggagcgatgtgcgccaggggcagtgacgccggagacgcgagatgtgacgagaagaaacggatgacgacatccacaggaaaaactaacgaaggaaaattaatccgggtgaaattaattctctaatttaaatgaccaaaaagaccttttcagactcttacctaatactaaaactacccttgtatatactgctagtgtatactagcagtagaatgtaccataaaagtcatcttataggatgccacatggcagccttagagcatttgtagcaagtttaatgaatttttagcagataataatagatagatatactcggttggcctccttcggcaaaatgtatttctgtgaatagtcctgtacatagttcctcgtaaacaatagcaacaacacctaattactatatcacgatacacaaagtaagtttggagcaacttcagtagacttactagggcaaagttctacaaaaggaagaacataaagatgatatagagtaataaaaaatccctgatttgcgataatttgaagagagcatgttgcccaatatctctgtttctcgtgatgtgagtatttattcgttttgcagcggtcagaggatgtgaaaccaccgtatcctgttttttcttggaatctaaacaaatactggaaatgcaggacgacagtgcgcctaactgtattgggcgtgtcatccccctcggctctaaagatccaaagacgaggcctatctcctccttgtggcatttcgacaaacacctccggctcatcttgtcagcagctaaactgcaatcaaattcctgaagtacaaattgcattcccaccaagaaaaccaaatcaaacacgcacgctgccat

SEQ ID NO: 67908 - DNA, 2830 bp, Oryza sativa
tccaaacaggcaccgacacaccactgagcaaagattattacagagcccagttaaggctggcagtaagagactcgtggtatgattgaaaataacaaagcagtcagctgaattttgttccatacgaaaagtgtgaacatccatgcatgcttatgcttctaccatgctggtaaaacattatggtacactgttcacctattggcatatactcctacataatacaaaggtggtaaagatggaatgcagatctgttcatcaaattcagagtgatagaacaggggcctcaatccccatagggaaagcaaacacgatcttgaagaagcttccaaaaatatggactccttccatgttttatccatttgtgtttgtaggcaaaagctcaagaatttgacatcctcatcaaaaaggttactgctggaaaaacaatactacatgcacatgaatcctaagctccataagttgtcattgtggtaaaagctgtgctatactgctatggatgtgtcgacacaatttccgcccttaggtaagctggacaacgaggtttaggcagcagagcagtctggcagcttaacatcagaacaacctcctgcatggtgggccggttggcagggttctcctccacacacagcagtgctatgtgaatgcatcttagtatctctctcgtctccaattcatcacctgagggcgaatcgacaagcttgatcaatcttcctgttctccataagtgccatgactgaggaagtgggtaagaaaaacaaaaattctcatatagattggccattaaattagcacttggttgtgcaagttaataaatgatgacaggggcaccattaatattcaaaattcgagacaaatttcaaaaattctacacaccctcttgttcagaaatcgatagtcgtctccagaatctccactcacaagtgaaaagcatcgctttccactaatgatctcgagaaccaatgctccaaagccatacacatcagacttcgttgagaaaagtcgtctttcccgacattcgggagcaataaaaccactaaaatgtggaaacaaaaattaagagcttaaacaataagaaggataaaagagcccgctgggatatcaaaaattgtgatattgatctgataagttcttacattgaccccagtatgcgatcggcgtactcttcatctacacctggactataccttctagccaggctaaaatcggagatcttgggattcatgttggagtccagaagaatgttgcttggcttcagatctccatgtacaatatgtagtccgcagtgcttatggagataaagcagtccctcagctatcccatcaattatccgagagcgtgtagaccagtccagatgcaaccttcttgttcttgcacctataaaatggaaacacaaatgagatcattaactaagcatagtctgcacagaacttttgatccaaaattgaggtgaagtaatactgaacacatgccaaagatgaaggtatcaacgcttccaatcagcatatactcatagaccaaaatcctctctgttccctgaatacagtatcccagaagcttaactacattggtgtgctgaagcttcccaaggaagcaaatctcattttggaactccaaatcttggaaatccatttgattacgtgaacaaggtaactcaaaacatcttttaacagctacctcaagcccatcgtgcagttgaccctgactgcaaacaaaaagtgcagttgacctaaagaagaaaccaattatataataatgaagtttctaaagttacaacacattccattgtcgtttgatagctatgatttttgcaatatcctcaaagattaattaggatgaattggaatcacagtaaacacatgaataacagtaggaaaagcaaatgatctgtttcttatgatatcaaagtatggaaactgaattttgtgaagcaagcatattcattactcctccggacaagataaggtggttccttttttactttgcaaagtcaataagaagtcacttcaaccaattaatttttcttggcttgtcttcattgaagatgtatatgaaaaaaaataatcatgttattttggtaaatccaaattacatattctagatatatgtctcactaaaatgaatagaagatgattgaacgcaaatctaggatgacattttttttttctattgaagagagtaccttgtaaacacagccaaagctaccttgtccaattttatttccgtcggagaagttttctgtagcatcaactaactgggacaaatagaacttgacagaccctgttatgaaataaagagttttgggacacacaacatcattctatttggcacccatcgaactctattgtctcccttcattctactgtttaacgggacatacctgtacaacatgattgcagtgagcacctttcaacttcacaatgtgcttcaatcctgcggtggcaacattattgtgactatttacggaagaaaatgtagcctttggatattaaagatccatgtcgaaagggttatagatgccataaaatttttacatggatctttcactgaacaatttcacttaagtaggacactggaaaccatttaacaaaattctgaattatgtgacagactataattattatgtatctattgtggaccagagaatctgaagtctcaccatggatgtaaactaccattggagctttaaattcaaggaatgccacatcccactgagaaaaaatggcaacaagaaatgtgttcacaaatctcacctggcatcaggagggaagctcaagcaaccagtagaactagatgttgcataaacattaaacagccttggccccccttttacagc

SEQ ID NO: 67909 - DNA, 9341 bp, Oryza sativa
tgttgttttcaagttttaaccatgtttaaagcatatgttaggaaagaacaccctacaggagcgactggcggcggggagggcgacggcgatggcaggggcacgccgcgctgggcggcggtggctgaaggtggaggggatggcgatggcggcggggacgaagtcggccgagggcgtggaggcggcggcggcggtcccgtggcggcaacggcgcggtgcccagcggcgacggcggcggtgtcccccaaatccacgcctctcggccggatctagagggtggctagcggcagtcgcggcaggtggctgcggtgtcgactggcgacggcggtggaagacatggcgtcgaggcggctgctagctgctcggtggtggagggtgacgacgcagtggcggtttgtggaggcagtggctggtgtcggtggcagtggcgacggcggccatgactgtggaagcggtggtgatgtcggcgtcggggaaggagtcgggtgcgaggtgaggatggcgacggtgaggtggctgggtattcggcagcagcggctgtggtggtggtgagcgtgtctgcggtcaccggaggcatggcggcctcggttgactagccgagggcatgggagacggctgcatctggccggcacggcatcgttcggtggaggggtcggagactggcttggtgcaaagaagtgcagccgatggcaccggaggccggctcggcgcgagaggcgcgggcggcggagatggaggtcggcttggcgcgagaggcgcggccgatggagagaggccggattggcgtgagaggcgcgtccagtggaggaggccggcttggcgcagagaggcgcggccagcggtggaggaggagacctaggtgtgaggagctgccggtgggtgtgacgcggccttcggtgcgcgaaggctagctggcgggggacgccggtgcaggggtcccacatgtcggcaaagcttgtgtggtggtggagcatcgatgcgtcagccgtggtttcgcaggtggtgagaggcgggtgaaaacccagtctagccttggccagaccgacaacgatggttattccccctcctgaggcgttgttgtgctgtctctctcctcaagggtgattgctggtcgaaagcccagtcttggctcttttgagtcccgacggatggcggcggcggttcttccgtatggcgcgatctcgtctgtgtctctttgttggtctagtggcggtcggtcacgcttagcggcggccggtccggtgctagtcttttcctgggcttgtgtgttggcgatgtcggtgtgtgggtggtggtatatttttttctttttcctggttacgaccctccatggttgtaatcttgtaattttttccggctctatccatagaacttcgcaccgtctcgtgcgagtcgttcaaaaaaaattagtggttagactacaaggtgaaatgagcaattgccccttcttatattggaaggaacacactaaaagtctaaaactatatactctctctgttacaatttacttgtcatccaggcaaataccgtgcaaaccatgaagatgtgaaagattacatggttacccttgtcaaatagtactccctccatactcataaaggaagtcgtttaagatagcgacacggtctccaaaacacaactttgacttcttgtttctataaaaatgtttattgaaaaatgatatacgtatatttttatgaaagtatttttcaagacaaatatatttatataatctttacattttcaaactcaacaactttagagttattcatgatttatattcccaaagtttgacttgaacattgtcctaaacgacttcctttatgagtatggagggagtacatcttaattaattatcttttcaaagcagatgagccaattatgaccgcatcaatatgtattgctacattactataggtagggagggaataatatcaatcacctttaaaagttctttggatcgtgaaaacgacaaataatttaatacaaaattaaatcctagaacgacggtgatgagcaatatgaaacagaaggaagaacatgaataagcagtgcacattctagttgttcatgcctctgcttaaatccttccatgtcctttctccatttgagttatgcatgtcccggcgacataggaggattgtgtcccccgtttgggccgcctgaaatgtactcatattaagtatggacttgaagagttggagtgacatcaattccaattaatcgtatgtacaaaagaaaataatattcactctggttaaaaatacgcgtccttttggttttcaagaaaggtaatgtattttctaatgtaaaatttagtatccttaagtacatcagttacctagagatattagatggggataaacgaagacgatgacctgagggagagaggggaccgacctgagaggtgatgagcagcaagcggccaaaagctccattggatttgtaccgtcatctaggtttggagcccgcgacaacagcgaggttgagcgaagaacggcctggcaacgtacggctctcctcttgtcgctgcagccaccgccttccttgacgtctgttctgtcaccaccggcgtttcttcgatggcggcggcaatagagcgcgcagcagcagctgttgacaatggcgacgaagaatgcaatggcggcgctcagcaatggcggcggcagtgtaggacgttgctggggcagtgctcggcgatggcggtggcggaggagttggaggcagaggtggcagtgcgatgaggaggcgtaggcggcgcttggcggcaggggggggggtgtgtggaggcggcggcgcgacggggaggcggcaaaactagcgacagggacggtgtgaggggaggtggaggtggcggcgcgggagaagtagagggagtgggagtgggcggcagaggctgttagagtcatatttgtattgggttcggtttcctaattatctcctgattctgttcctataagtcgggtagagatacgggtccaccgtccctatatatgttctctatccatgatcaatctattatcgtgttgacttatacgctttcatggtatcagatgcttttagcttcggcctccaactctaaatctcgcaccgcgccatgcgctcctctgctgtgcacgcttctgtcgccgctgccgcagccgccgccgccgccgccgccgcatggctcctttgccatggccaacaacgctccccataccccctctcccgcaattgaggccaccacatctgtcatcaccaaggcagttcgggatgccttccaaccctcatctagggttaatgtcgacctagccatagccgcctccgtcgtcgacacggcgtccaccactgttgcctgcgccactaggaaagcccttgcctctttcatcgagaagctggtactgacacctccatcgccggcaacacccaccacggcggcaactcttcttcctcggccgcgactgccaccatgacggctgcgacgatgtctgccaggctcttcaccactgcccccgcaggcacgacactgccgccgacctctctcccactaccgccggagctcacggccatccttgccaccgatggcctctacggcacctccgacgcctttgcatccgctctgcctgctcaggacgtctctgccttcttcatcacgcccagcgctacatcggcaacactccctctactgggtcttcctcctccggcagccggtgcaccaccaccacctcctcccggctacggtggtttcatccctctgatgaccggtgctgctccttctgcccctaccgcctagaacttctacaacgtcgacctcgacgacgacgccaccgccaatctccacgctcaggcagtctggtgctgaacatcaagtctctcgtgcccgtcaccctcgatctcaacttcggcaatggtgtggtctcatcctcgtcaccctcgagaagtacgtgctcgccgatcatgtcctcaccaacctctacaggccggatcatcaagattggatgcgcatggactgcgttcagggccggccctaggcctagcgggttgtgcgaccgcccaggcccagccagcaggggcccatcaacccccacccccaccccattccccctcctgctgcacaggccttgcaggccaccccgcagcccagttggcgtagcgtgtgcgatgcaattagtagggaaggagagtaggagatgcgagagtgcgacgtaatcgaagcgacgcatcatcgcgccggttcgttctctgtgcttgttgttcctcctgacgatagccgacgcgacgacgtcaacgccaaatgatgcccccacacagtgagtccgcgacgcgacgccgacgagcgagggcaactgacgacggcgtgaccgcaagtgtgatcagtcacaactccggagtccggaatctctactccggcagagacggcagcagcaggcgctagcgctcccaacgccctagcctccatccaggcaggcagccagaaacctaatcgtgactggtgaggacttctaatgatttgattttctcttaatctcatttgcctctaaccatctatttagactgtgactggtgaggacttctaactaggttagggttttgttttgtgcaaaaattaggttagggtcttgttttgttcctgttgatatagtgcaataaacttctaatgatgttcttgttgtttactttagttggaaatttcaggcgtcagaatgttgcgtcagaaatgcttgaagcagagatttttatgagaggtattgtatatttgcagtttcatatttaaggtattaataatcatactattttgtttctacaattcttttagttgtttattatactatcagcaatatttattaagaataaaataccatatcgcaatttgcattgtgtaatttactgttcagtagtgtttattaatgtcactttataaaaaaaaatgatttatagagtatatattacaaataaaaaaaattagggcctatagcgtcgagtttgcctagggccctcgaaattataggaccggccctgactgcgttgtagttctgtggctctacggcaccatctccatcgacttactggagtccgtgatgacgcacaacaccacggctcgcatcgtgtggcgtggcctcaaatatcagttcttgggcaaccgcgagtccagcgctctcatccactccaccgagttttacatcttctaccaagatgatttgagcatcaacgactactgctgcctcttgaagaccatggcagatgacttgggtgatgtgggcgaccgcactctttccctaactgcaatacaagatttgaatgaaaaattcggtcaccttctgctcaacttccgaagtacatgctcaacttctgctcgaagatctgacgaagggtcgtcctcgctaagcttctactgctctcctcgccggcactggagaccgaccttccacttccggggggggggggtgccgttaggaagcaagcccgcacactccactggctatggcaacgctggaaatcgtggcaacaacaccagtcgacatggaggtaacccgcaaccgtcgctgcaacaacaacaacagaggacaacagcagcaaccgccccagcagtaccaaccacccagtagcagtggccagtcagccaattggccctcggcactcaacccgtggaacggtacgctccagatgtggccggcattggtcgattttgctccttcccgcgtcaactaccctagcctcctccgtccaccgctgcccaagaacacgcgcattgtcaggggcttcctcggcttggcgggctactaccgttgtttcatccgcaacttcgacaccattgccgcgctcctcacagcgctgctgcggaagtaggactttcactggactaacgccgcgacatcggcgttccggcagctacaacacgcactcacggcagccccagtcctccagctcccggacttggccaaggagttcatcgtggagtgcaacgcgtcgggctccggcctaggcgctgttcttcatcaaggcaccggcctggtggcattcttcagcaagctgactgcgtcgcgccacgccaagctcgctgcctacaaatgcgagttgattggcctcgtccaggcggtccgccattggcggccatacttatgggggcgccgcttcctcatccgcacggaccactacagcttgcgcttcctcttggatcagcgtctctccactgttccacagcatcagtgggcatgcaagctcctcgggtttgactttggcgtgcagtacaagtcgggaatggcgaactttgtggcggacacgctctccagacgggacgaacacctagcggaggtgttcgccttatcggcgccccaattctccctgttcgatgagctgtcccgcgaggtagcctccacacccacccagttccccattcacgaagacatcgccaagggtgccaaaccgccagcctgggcgttcacagacggcctcatcacattcaagggctgcgtcctcgtgccgctgtcgtccgcatcattgccgaccatcctcgagccggcgcatggcttgggacctgaaggaacacaaaatgatggaataagccttgtggtctttggtctttgtggtccttcccttgcttttaggttgtttttctccttttaggatagcatcctttcagttttgcttttagtatctttcagttttacttttagcattttagtacagcatctctgctagcatctcctttatgctttatgctttcaaattttgaattttagactagcttgcagccatccagccagctatggctatatatatatcatatatgtatccaacctcccccgggacggcatggctttgagtttgtgaatggaagaaaaccagaaaattgcccatctagagtgccatcctcttatcaatgagagtaaccattgaaataataacatctggtatcagagctacactttcctgtagactaaatatctcgtgttcctccccttcccaagttcgagggagcattcagccagctgctgcagcagcaccggctgctccttcccctttcccttccacttctccaagaagcagcccccggaggcgtgccatgtccgacgtacggtctcggcgttcggtcgcctcgagccctcggcgtcaacaggacgtcgagctcgccgcagcagaagagcgcaggcgagcaacggctcagaccgctgcagcagcagcgagggcggccatattggcggcagcggagttggcagcggccagggcagaggcggaagcagaggaggcagaagatgcggcacgtgcggcggaggtagaggttgacacgttgcgcagcagcatcaatggctccatcgccggtgacatcaccgccgacagggagcttgaagagctggcaagaggaagggcgcgggagcgggcagagcggtgggcagcagcccaccccacggcggcggcggcccaagagaccgcgcgcccgccgacgggaacccgagcgggcgcgggcgtgccggcggcagcccggagcacgcgcgcggcgacggtgctcccagtggaggtggctggttcgacggagagcgcggccctcgcaggcaacgcggctctccctcccctaaccggcgacatgaccaccacggtgtccagacggtggtcagggaccttggtcccggtggtgggtggcctaccctctacaaaaccaactacatcgagtgggcggcggtcatgagggtgaggctccaggtgcggtacatgtgggaggcagttcagtacggcaacagcgactacgacgaggatcaacgaccgctggatgccctcatcgccgcagtcctacccgagttgcagttctcgctttctcagaagcggactaccaaggaggcctgggacgctatcgctgcggcacgcatcggcagcgatcgcgcccgcaagtccacactgcaggcactccgcaaggagtgggagaacctggccttcaagccaggtgaggatgttgatgactttgccctccgtctcaacactcttttgcagaagatggtgcagtatggcgacgacacctacgacgaggagagagccgtcgagatgagccacagcctctctcaaggcctatcaccactggggggagctccatctcactcaagagcagtgggaggccagccagggagacgggaggaagggggagtcatctcccctgacaggcggccgcaagccgcgcaaggcgcggggaggtgtccagctacggtgggcgcggaaacgcgccgagggtggcgcttgcagaggcacccaaggcggcgccgccggcaaccacaagccggcacgagacgacgcctgccgcaactgtggcaagcttggccattgggccaaagactgtcgacagccacgacgcggccaggcccacgtcgcacaggcggaggaggaagagccggttctgctcctagcacacgcaagcatcgagctacctccagcggcaccggccgcaatagctttcctccaccttgatgagccaaaggtactcctctccctctgcaacggctctagcgacgacaaggctgatgggtggtacctcgacaccggcgcaacccatcacatgaccggccgacaggagttcttcaccgaacttgactccagcgtccaaggctctgtcaagtttggggacgcctccgacgtggagatcaagggcgttggctccgtcaccttcactgccaagtccggtgagcacaggctgctcaccagaatctactacatccctgcgttgaggaactctgtcatcagcgtggggcagctggatgagaacggctcacgcgtgttggtcgagcacggagtcatgaggatttgggatcgccgtcgtcaccttcttgccaaggtaaccagaggcaccaatcgactctacatcctcagtgtgcaggtggcacaaccggtgtgcctcgccgctcgtcgggacgacgaggcgtggcagtggcacgagcgctacgggcacctccacttcgaggccctgaggtggctcagtgccaaggagatggtgcgaggcctgctgtgccttgaccatgtggagcagctctgcgacgtctgtgtggtaacgaagcagaggcggctcccctttccccagcagacgagcttccgagctaaggagcggctcgagctcgtgcacgaggacttgtgtggcccagtgacaccggccacaccaggaggacgacgttacttcctactgctcgtcgacgacctctcccgctacatgtgggtgatggtcctcggcagcaagggagaggctgcggacgccatcaggcgtgcgcaggctgctgcggaggcggagtgcggccgcaagttgcgcgtgctgcgcaccgacaacggcggtgaattcacggcgactgaattcgcgtcgtactacgctgatgagggcattcagcgccactaca

SEQ ID NO: 67910 - DNA, 4229 bp, Oryza sativa
gtggtgacgcccgtgtacatcctcaaccgctcgcctaccaaggccctagacggcaggacaccgtacgaggcttggcatgggcgcaagtcgacggtctcccacctgtgggtcttcggctgcctcgcgttcgccaaggagcttggccacatcggcaagctcgacgataggagcacctcaggggtgttcatcagctacacggagggctcgaaggcctaccgcattctcgacccggagacacagcgtgtgcgcacggcgtgcgacgtagtgttcgacgaagggcgagggtgggcatgggacaaggcggtggacgatggttcgactccaacatacgaggacttcactgtcgagtacgtccactttgagggagctgggagagtaggcagctcttcttcaccgagcgtgtctaccccagtccccgagccaccaccgactcctacaccgacacaccctcgagccacgacttcgactacaacgagctcttcgctgacaccaccacagccggcgaccccatgcactccagcaccaacagccactcttccgggcacgtccactccgacgccagctcgcgttgagcacagcccagtggagtttgctactcctctctcccacaacgaggagcgcatcgacgcgtaccacgacggcgagctgctgcggtaccgtacgatgaaggacctcctcggcgaccagctagtgccgggactggtgcctcgcgacctggaggcgcagttgcaccttgcgtgcgacgacagtgagcctcggtctttcgtagaggccgagggacacgcggcatggcgcgccgcgatgcagtcggagatggacgcggttcaggagaaccgcacctgggagcttgctgacctccctcgtggtcaccgcgcgatcacccttaagtaggtgttcaagctaaagagggatgaagccggagccatcgtcaagcacaaggttcgcttggtggcatgtggtttcgtgcagcaggaggggatcgacatcgacgatgccttcgcccccgtggcacggatggaatccgtgcgactcctccttgcgctggctgctcaggaaggctggtgcatccatcacatggacgtcaagtcggcgcttctgaacggtgagttgaaggaggaggtctatgtgcaccagcagcggggtttcgcgatccccggcaaggagggcaaggtgctacgcctgcacaaggccctctacggcttgcggcaggcaccgaggagcacgactcaaggaggatgggcttacgatgcaaagcccggcacgagcgcgaccatctaccggcagggcaatagaggaaatgccttgctggtgggtgtctacgtcgacgacttggtgatcaccagcaccaaggatgcggaggtggcgacgttcaaggaagagatgaaggccaccttccagatgagtgatctggggcctctctccttctaccttgggatcgaggtgcaccaggacgactccgggatcacacttcgacagaccgcctacgccaagcgggttgttgagttggctgggctcaccgactgcaacccagctctcactccgatggagactgaagctatgccgcgatagcacgacggaggaggtacatgctacgctgtaccggcgtcttgtggggagctgtcgctacctcacccacacacgaccggacttggcattctccgtcggctacgttagtcggttcatgcagcgaccgatgacggagcatcagcaggctgtgaagaggatcatccgctacgttgcggggactctcgaccacggtctctactacccgaggtgtcctggcaaggcacacttcgtcgggtacagcgacagcgaccacgccggcaacatcgacaccagcaggagcacgagtaggattctcttcttcctcggcgagtgcctcgttagctggcagtcggtcaagcaacaggtggtggccctgtccagctgcgaggccgagtacatagcggccttcaccgcttcgacctaggcgctctggcttgctcaactgcttggtgatctcctcggcagagacactggagcggtggagctcagggtggacaacaagtcgctctggccctggcaaagaaccccgtttttcacgaacggagcaagcacatccgggtgaggtaccacttcatccgaggctacttagaggaagggagcatcagggcgagctacatcaacaccaaagaccaccttgcggatttgctcaccaagccccatgggaggatcaagttctttaagctttgctccaggattgggatgacccaactttcccacgagacgacgcacaagacttagggggagaatgatggaataagctaggtctttggtctttgtggtccttcccttacttttaggttgtttttctcctttttaggacaacatcctttcagttttgcttttagcatctttcagttttacttttagcatcttagtacaacatctctgctagcatctactttatgctttatgcttccaaatttcgaattttagactagcttccagccatccagccagctatggctatatatatatatgtatctaacctcccccgggacggcatggctttgagtttgtgaacggaagaaaaccagaaaattgccccatcttgggtgccatcctcttatcaatgagagtaaccattgaaatactaacacaaaagaccctatctcgcctttgtgcgtatttccatatcgcgcgggacaaagtgacggtgcaagatttcgtgcgcgcgtgccgcacgtgccaacagaacaagacggagcacctccatccagccgacctgctgcaatccttgccggtgccttcggcggagtgggctgacatcgctatggacttcgtcgaggggctcccgcgagaacatggcaagacggtcatcgtaacgttgcccacttcatcccgttctcatccgtacacggcgacatcggtagcagctgccttcttcgcggagatcgtctgcttgcacggtgttccggtctccattgtcatcgaccaagatccagtcttcagcagccctttttggcgtgaaattttccggttggcgggtgtgcagccgaatctttcatcagcccttcaccctcaatccgatggccagtccgaggtgactaacaagatcatcgtgatgtatcttcgatgtttcactaggaatcgtccgtgtcaatggcttcgatggcaaccgtgcgcggtgtattgctacaacatgtcgtatcagtcatcacttcggacatcgccgttccgcgtcgtatattgtcacgagctgccgacgctgcgtgcctacgatccgagttcatctcgtctgcccgcagttcaacagacgttacaggagcgggatgacttcctaagggcgtttcgcgatcgtttagaacaagctcaacagacttacagtttcgcgatcgtttagaacaagctcaacagacttacaaggctgcgtatgacggcaagcatcgtgcattggagttcagtgtgggcgactgggtttggcttcgtttgcttcaccgtccgattgcgtcaatcgctgtcaagggacgcgacaagctgggatgcattggcattggcgctgtggcgtatcgccttcatcttcccccgggcactcgattacttgacgtgtttcatgtggggttgttgaagccatttcacggagttccgccggagctagtaccactgttgccacccactcgtcatggtcaagtttgtttacagccggccaatgcttcctagagccgtttggcgcgtggtgttcgcgaagttcccattcattggaaggataaaccggcagctaaagcttcgtggatgtcgctggatggatttcggtcttggtatccagattttcaactcacggatgagctgcttctccagggagggagagatgtcatgtggggattatagtataaacgacaccgcaacaggagcagcgacggcaatgcgttacgaggaatagtgtgtggtccggtttagagtttgttagggagtttgttagttctatatctcttaagttgctaggattttattccttagatttgctttaaatttgtaggtcaattcaattgagatcagatcacatctcctgtatttcctgcctcgctggtgtggtgccaaacatggcttcgccgcgctgacaaggtccagggccatgcccagcaactgcgttcaaatactctcttcgccgcaatcccccttccaatctcctcgcccgtgacatcttgtccgtgttcaatctattatcgcgttgacttctatgcgctttc

SEQ ID NO: 67911 - DNA, 7315 bp, Oryza sativa
caacctttcttccttggttcatgtttctttaaaagcaaataacttggtggggagcatccctgagagcctaagtaagatcccaaccctagagaggctagttctcacatacaacaatttgtctggtcatgtgccacaggctattttcaacatatcatctttgaaatatcttagcatggccaataactcactcatcggccaactaccaccagatataggcaacagacttccaaaccttgaagcattaatcctatcaacaacacagttaaatgggccgatcccagcttctcttcgcaatatgtccaagctagaaatggtttatcttgctgctgctggtctcactggtatagtgccatcttttggatccttgccaaacttgcaggaccttgatcttggatacaaccagcttgaagcaggggactggagcttcctctcatcccttgcaaactgcactcaactgaaaaagttggccttggatgcaaattttctccaaggaaccttgcctagctcagtcggtaatcttccctcacagctcaactggttgtggctcaggcaaaacagactttctggggcaattccatcagagattggtaatcttaagagtctcagtgttctgtatttggatgagaatatgtttagtgggagcatcccacctaccattggaaatcttagcaacttactggttctaagcttggcacaaaataacctctcaggccttattcctgattctattggcaaccttgcccaactaaccgagtttcatctagatgggaacaacttcaatgggagcataccttcaaacttagggcagtggagacaattagagaagcttgatttgtcccacaattcattcggtgaaagcctgccaagtgaggtcttcaacatttcttccctgtcacaaagtttggacttgtcccacaatttgtttactgggcccataccactagaaattggcaacctcataaatcttggaagcatcagtatttcaaacaatcgcttgaccggggaaataccgtccactctagggaattgcgtgcttttggaataccttcacatggaagggaaccttcttactggaagcattccacaatctttcatgaacttaaaaagcatcaaggagctggatctctctcgtaacagcttgtcaggaaaagttccagagttcctcactctcttaagttctttgcagaaactcaacctttcattcaatgactttgaagggccaataccatcaaatggtgtctttggtaatgctagcagggctatcttggacggaaactacagattgtgtgtgaatgatccagggtatagcctgcccctttgccgtgaatcaggatcacaaagtaaacacaagtctactattttgaaaatagtaattccaatcgcagtgtctgttgtaattttattgttatgtttaatggctgttctcatcaagagaagaaaacaaaaaccatctttgcagcaatccagtgtgaacatgagaaagatatcatatgaagatattgccaatgcaacagatgggttctctcccacaaatttggttggtttgggatcctttggggctgtttacaagggcatgttgccgtttgagaccaatccagttgctattaaggttttcgatcttaacaagtacggagcacccacaagcttcaatgcggagtgcgaggcattaagatatattcgccatcgaaatcttgtcaaaatcattactttatgctctacgattgatccaaatggctatgattttaaagcacttgtctttcagtatatgccaaatggaagtctggaaatgtggctacatccagaggaccatggacatggtaaaaagagattcctaactttgggtgaaaggattagcttagccttggacattgcatacgctttagattatcttcacaaccagtgtgtatccccactaatacattgtgacatcaaaccaagcaatgttcttttggatcttgaaatgactgcatatgtcagtgactttgggttggcaagatttatgggtgctaattcaacagcagcgcctggtaactctacaagtttggctgacttaaaaggatccattggatatattgcaccaggtgagagaaattggaaacttatactgatttattgacctgtatgcttcagccatcttattaacttatccaatgttacatggattgtagttttcctccattcgccattcttatgttttcaaatgaaaatgcagagtacggaatgggtgggcaaatatcaacgaagggtgatgtctacagctatggagtgttgttgttagagatattaactggaaagcgtccaactgatgaaaaattcaatgatggtttgagcctccacgatcgtgtggatgctgcatttccccacagagtaactgagattttagaccccaacatgctacacaatgatttggatggtggaaactccgaactgatgcaaagttgtgtcctcccattggttaaggtggccctcatgtgctccatggcatcaccaaaagaccggttagggatggcacaagtttctactgaactacagtccatcaagcaagcattccttgagctttccagtggaggaaaagtagtgtgaataactccccggtggtgtgcaaagctatgttgctttgcaactactgtgtaaggctacttctattaccataactaagcctatatataaacaggggcagacacagcagggggtcaaatagggctcaggcacacctactgccgccaggccccctggaaaccataccttattcaggaaccaagtccacactaatacaagccaatctcatggcttcacggtacagtattgcgtataggctgcagccactcgttcaagggaggcaagcagacacatgtcaacacagatctaacagccattgatgctagtattggtcatcaacagatctaacccaattaaaccatttttgctaacttttcttagctcagcccatgacagtataaatcaacaacaaaagctttgataatgttcatgacttagtggtactacgtattttaatgataatcttatattggtcttttaaactagcacctcctaaaattttgttctgcgttctccactgtatataaataacctcatgaatctattatgtgtttaggaattaggacagcaccaaatgcaatgttagcaggctgtcgacacacccaagatatggttacaattccacggtagttagtcagcggcacaactcacaccacacaacaggcataataacgcgcatagagcaaaacgggcacacagctgcgcccgcccaagtgcgttagtgcgtgctgcgcgctactactttcagaggcatttccacaaacacgccacgcgcgttcgaagtccatacacgaaatccagcacacacaggcatacgcaaaaaattcagaaaagcagtagcacgctgaccttggagaagacggcgccggcctggcaaacctgccgccttccgccgcgcctgcgccgcccatcgtctcgtcttcctccgccgctccgcggcggcgcgacagggtcgacgccgtcgaagagttggagaaagagagaaagggagggtgacaaaacaaggttgggtcgggccttgttgatgttgggctgtgggcaggccgtcctcatagatgtattccattctctctcttaattaactttctagtagcaagttttttttcctctcaaaaaaatctcatgtaaattccaaacttttttttcattttattttttaaaaattacatatttttttcatttaagggaagacatacacatgcgcatatacgcatgaatgtgcgctttaacacatcctataagaaacactcttaatatagttacaattttattgaaagcattttcgtggtgtgatatttatgagcagcatgatttgaaccagatgaaccaccacatatcggtctttcctagtttcaaataattttattcgtatgagcagatagttcatctttattcaacagtttcagatacgtttggagcaaatttacatagactcgaatacaaacttttgggcatgaatttctagctatgtgctatttttttaataatgaaaatagattatatctccagtctttggcaatggacacacatcaacaagtttcagaagaatttaaaatagatgtgatctatgtgctacttaggccctgtttgggagagtttgtcccagctgcagcttttcctaaaagctgcttctgctagaagctgccccaaacagtctaagattctgaaaaatgaactaaaaagccagaagatataaaagctaggtttcagagcttttccagattctcagaagctggctaccaaacagctgcttctcaaaatttaaagctcccccaaataaacccttagattggcttgctatgtcctggggcctggccaacgatacattccacgtcgacctacggaagcaaaagcaattcagtttataataatgctgctataaatttagaggggaaaagtgaaggaatatttacatatacttttatgggtacaaacggacgattttcctaccatgttttttcgaggattcttaattatcaactttaaaaatagtaccaagtcatggtactatttataacctaggaaaagttctatgattaatatttagacaaataagttcgatacatcttattagttatatgtatataggattatatcttgtgcacccaagatggttaaagtgtcgtacttgaaaagaaagatggttaaaaggctcttcttttttctacatgtaactacattttctggtggaatacacttgcctgtcggcatgtattggttgccatgcacggacgagattggaggattgtgagccccgttgggaccactaccatatccatctccatgttctacaaagcaattatgtaaattttaaaccaagttgaatttcgtgtattagaatatgttatatttttccttaactaatagctaaccgatgttatatgtagatatttcctctggttctaatatgcagtacagttgagtagttttacagcttttatacaccttttctatttccattccatgtttattaccctttccaaaatgctactactttcaaaaataaaattgtctcatattttaaagaaaactcttacatatttttctagattgataaactattttttctacaagtagctaaattttcaagtgaaatacacttgcctataggtatgtacgggttgttgtacacgtaagagattggaggctcgtgaaccccgccgggtccaccacctccggctccacttccatatccacctccaccttttacaaaatcaacatctttaaataaatttatgcagtaaatttttaaacatggttttgttttgagtattaatatattatttttttcctttacccaataggcagcatatgttcatatatgactatttcctcttatccgaaatgcattgcaagtagtttcagaacgtctatacactattttaccttttatttcaagtttatccttttcataaataaatgtcccatatttctatagtaaaatataaatgaaagacaataaaataatctaatataccattttaaacttctattagtaatgttaaaaaccaataacttcatctgaaaccagagtacaaatcagaggaaatgttccaccggcgtgcgtcctcaccagcgaaagggccaccgccgccggccaccggcggcgcccactgcggagggaagaagggcggcggcggcggcggcgagagcgcgagcgaaagcgacgacggcagcagcagtagtaggaccgacatggccgacgccgctggcgctcgtagcccgaagcgaagccgacgagctgctcccatggccgcagatggagctcgctctactacacttgatcaatcgctctctgaaatctgaagctggtagatcactcggctgtagttctcacgtccaaggctttgccccccatatatatacaagataaacgcaacgacgcggttttgctatgacaatgcagcttctctacttgctacttgctagccagctaggagtgggcagtccatcagtcaatagagtagtatacagttcgaactgtagtgtcaaatcctgctcaatcagccacaggttctgattataatgtatactaatattatgcttgttttgagaggacgaacaagtggattgattctgcgtctgaccactgaaagattaggcctgaagtttccctaaggtataccaaacagaatctgcttgggatttgtaaaagaaaatgagccaaagagccttccaagttccaacataaaaagctctccacaataacgacggtgacaaaaatcaaggaggaagtcaagacctgagcttcaggtacaatagcaggctataagtcagctgcaaacatattttaaggagataaatgagaaaagagaagagcagcggactacatatttgtagccagctgtaacacgaactccaagacacagtgtgtacgataggtgggatcaggtattaatagtgtagtgtgtaactattgtataaatgagctattagattggctatagatgaattgtagccagtagttggctatactcctaaacttgctcttagccagagcgaaacgtctctcgaagctaggggtagtagtgaattagggcccgtgggcgctttcacaacccacttcagcctttaaatatttttagctaaaaaatgtattaatttttagtacaactctttttgaactcagcccttgcattttgccacccctgctcatagctcatccttggttttactttttgtgcggttctcctttttacttatacaaaatttttactcctactttattcaatgaaattaggacatctagtactggttcgttaaaaaaacaagaagttccccaacatcttaggctactccaaccatgagatgaacaattcttcatggttactgatcaggccacggaggatgatgcactgtcactctccctggcaactctgatgaagacatcctccagcgttgtgtcagccaagccccaggcaagaacgttcatcctgagcttcgcatgctccatggcccggaaaacttgagagatcctcacctcctgcttcgccatctcgaacttctgcgtcccggagatgtggtacacaatgttcatggtaggggagatggactggaccagtctcctcatctcctccgcctcgcctgtcgcggttgttactgtgaggacatatgagcctccatattttgctttcagctggaaaggcgagattttgggggttcaagttactaagttagcatttgggatcaatggccatatatgaaatatgtgatcagtttacatgtgtagatgtacctctttagagttcccgatgca

SEQ ID NO: 67912 - DNA, 6227 bp, Oryza sativa
agctcgggcacttgggacaaatcagctacctcaacctgagcatcaactctcttgaaggccacattccagatgaactgtctttgtgcagcaaactcaaggtactcagcttatgcaacaactccctccaaggtgagataccaccaagcttaacacaatgcactcacctccagcaagttgtgctttgcaataataagctccaaggcagaattcccaccaaatttgggatgctgcatgaattgaaaactttggatctctccaacaacgccctcacaggtgacataccaccattgttgggcagtagcccatcttttgtatatgttgatcttgggggcaatcagctcacaggaggaatcccggagttcttggcaaatagctcatcccttcaagtgcttagtctcaagcaaaataatcttacaggggggatcccactatccctcttcaacagctccacgttgacaaccatttaccttaaccgtaacaacttagtgggttccataccacctattacagcagttgctgcacctattcaataccttagtctagcacagaataaactaacaggagggataccagcttcactgggaaacctttcttccatggttcttttatctctaggagcaaatagcttggtggggagcattcctgagagcctaagtaaaatccaaaccctagagaggctagttcttacatataacaagttgtctggtaatgtgccacagaacattttcaacatgacatctttgaaatatcttggaatggccaataactcactcatcggccgactaccaccagatataggcaacaggcttccaaaccttgaaaccttgatcctatcaacaacacagttaaatgggccgatcccagcttctcttgccaatatgtccaaactagaaatgatttatcttactgctactgggctcaccggtgtagtgccgtcttttgggtccttgccaaacttgcaggaccttgatcttgcatacaaccagcttgaagcaggggactggagcttcctctcatcccttgcaaactgcactcaactgaaaaagttggccttggatggcaatattctccgaggaagcttgcctagctcagtcggtaatcttccctcacagctcaactggttgtttctcaagcaaaacaaactttctgggacaattccatcagagattggtaacctaaagagtctcactgttatgtatatggataacaatatgtttagtgggagcatcccacctaccattggaaatcttagcaacttactggttctaagctttgcacaaaataacctctctggccatattccagattctattggcagcctttcccaactaaccgagttttatatagatgggaacaacttgaatgggagtatacctgcaaacatagggcagtggagacaattagaaaagcttgatctctctcacaatttcttcggtggaagccttccaagtgaggtcttcaacatttcttccctatcaaaaagtttagatttgtcacataatttgtttactgggcccataccactagaaattggcaacctcataaatcttggaagtatcagtatttcaaacaatcgcttgaacggcgaaataccgtccactctagggaaatgcgtgcttttggaataccttcacatggaagggaaccttcttactggaagcattccacaatctttcatgaacttaaaaagcatcaaggagctggatctctctcgtaacagcttgtcaggaaaagttccagagttcctcactctcttaagttctttgcagaaactcaacctttcattcaatgattttgaaggggcaataccatcaaatggtgtctttggtaatgctagcagggttatcttgggtgggaactacaggttgtgtgcgaatgctccagggtatggcctgcccttttgccctgaatcaggatcacaaagtaaaagcaagtctactgttttgaaaatagtaattccaatcgtagtgtctgctgttgtaatttcattgttatgtttaacggttgttctcatgaagagaagaaaagaagaaccaaatttgcagcactccagtgtgaacttgaggaaaatatcatatgaagatattgccaaagcgacagatgggttctctgccacaaatttggttggtttgggatcctttggggctgtttacaagggccttctggcatttgaggacaacccagttgctattaagattttcaatctcaacaagtacggagcacccacaagcttcaatgcggagtgcgaggcattaagatatattcgccatcgaaatcttgtcaaaatcattactttatgctctacggttgatccaaatggctatgattttaaagcacttgtctttcagtatatgccaaatggaagtctagaaatgtggctacatccagaggaccatggccttggtaagcagagattcctaactttgggtgaaaggattagcttagccttggacattgcatacgctatagattatcttcacaaccagtgtgtatccccactaatacattgtgacatcaaaccaagcaatgttcttttggatcttgaaatgactgcatatgtcagtgactttgggttggcaagatttatgtgtgctaattcaacagcagagcctagtaactctacaagtttggctgacttaaaaggatccataggatatattgcaccaggtgagagaaattggaaacttatactgatttattgacttgtatgcttcagccatcctattaacttatccaatgttacatggattgtagttttccacaattcacctttcttatgttttcaaatgaaaatgcagagtacggaatgggtgggcaaatatcaacgaagggtgatgtctacagctatggagtactgttgttagagatattaactggaaagcgtccaaccgatgaaaaattcaatgatggtttgagcctccacgatcgcgtggatgctgcattaccccacagggtaaccgaggttttagaccccaatatgctacacaatgatttggatggtggaaactccgaactgatgcaaagttgtgtcctcccactggttaaggtggcgctcatgtgctccatagcatcaccgaaggacaggttagggatggcacaggtttccactgaaataaactccatcaagcaagcatttgttgatctttccagtggaggaaaaatggtttgagtaataattagacctaggcagtacatttgacactccatcaagcaagcatttctagctaagtttgccttttttttcttatttttccttcctgaaattagtgcaaagactgcaaagctgttctgcattgcaactattatgtacagctactttcattaccataattaagtccacacagaatcaacctcttggtcctaaaacttgtttgggtcagcagcaaatgcaatggtcagcaaacaacagacagcaggctggaacacaccaaaatattgttctaacttaaaaaaccaataattctgcagtggttaatcagcagcacaactcacaacatgcaggcataaggatatgcatagagcaaaatgggcacacatgtgcgtgcgtgcgtaagtactgcgtgctactcccacagaggcatttccacaaacatgccacgcgcattcaaaggaaacacaggaaattgagattacagttacaggcacacgcaaggtcagaaaagcagtaccatcctgacctcagaggacggcgccggacctgggaaaccgccatcgcggcgcctgcagtactggcttgctcgccgtcgccgtcgccgtcgcccatcgcgtcttcagcggcggcagcgtgacagactcggcgcagccattagagtcgacgccctcggaggatttggagactgggatagagatcggattaatttgattcatgccattataaatatattgaattagaataataccattactttttttttgctcttttctctttttttgcgatattttttctgttttctgatatcacctttctgcgtttttttcttttttatattatttttcaacagaaacaggccaatgatctcaaatagagacttaaatgtaaatataaatattatagggactgaaatacaaaagtcaataggaaatcctaccaaccgagcaactccaaaaccgctcgatgaaaacttctccaaaccataaaaacggaaacccggcgatggttagttcgattttttaagtcccaacaacaatcgacatgatgcaaaactacatccaaaactgacatacaactcacacgacttaactaatgaaccctaaacccgaattgacgaagagatgaaatactcaaaactaaaaaaaataaatctaaaactaaactagtactcgacacgacatgcaacataaaattcaataaagcaaaatctaatagaacaattcaatggctcaaaatttctaggtaatggatgcaataattttgtgtgaaagttttatagttataggtatatataaaagaaactaataatcttaaagaaggtatacctaacaagcaatttgtgctctgatactaactaaggacctaggtctcgatctttcgataggtgctgataactctcgatttggtggaaactagacacacgatccggcttccaatcaacacaatctgaaccctgcaattgcattaccatgtctcctttggtaatcaaccgtgcgctgctcggttgacctcgctgagaaggctaatcccttcatatgaatcataaaacacaagcaaaaacaaggtagattgcaactcaatttgtagataaatgattaagatctcaaggttggggttccacaaaccgaactagcggcgaaactgtaatggcaaaaatagtctaagcaaaacctaaccctaattcgatgacgctactgaataaatagcttatagggtcatccttgggttgtcctagggtacacaaccccttgggtttagccaacgacacaattacaagggtcaaagccaaatcagactcggactagatgaggtacatggtttattttgcatattcccgatagcccatgaggaattttgaggtgggggtggaggtggaggtggtaggggtaggggaaggggaagaggaagagctggagggagggaaggttcgtggtttggctcaagtgcaagtggtggaggtggcaggggtaggggaagagctagagggaggctagctgatcgtgtgttctttggttgatcatgtaatatgttcctactatttagtgcatgtttgtgtgatgttggacctgatggtgtgcctgtatgtgtgatgttggacctgatggtatgcttccgttggatttggtggtgtggttttgttgggcctattgatgtgtttatgttggactgttttattgttgcatgttgttggacactagtaatcgtgcacgtgcaatgcacgttatgttcaaaatataaattaaacccaatatattgtaaccaaaataatttcacataaaagttttcattttgtggggttacacaagttttaataaaatgatgtgcaactctcctgacaagaaaatatatgtgatttgtagctccttttctacactgcagtaactaataaaatatcccaacaaattaacagagcagaacgacaagatacatgtcattgaccaatagaataaaggggcaggaatgtcaaataccacaaatcttcatgtctcaaaatttttgttgccagccgtgaaccagttaataacttaatatacttgaaattgcagcaaatacttatgtaccactttgaatcttaaatgttccacttcatcatgtttgtaaaaataatttattttaggcccctatagcataaataagcaagatatatgaggctttaagagcgacaaaaaaaaaccaaaaacttcaaaggatcatttcttaatctcaaatgatccttctattgaagcattttcttgaacatgaaaaaaaaaccaagaaaaatactacatgggcaacccagattcaataccagaaagtggttgtattatttacatctcacaagcaatcctttggagtggcttcctgccatgttggcataccttgcccctgaacagatttgatacaccaccatagttcgggggaggggggggaggggggttatcaattggagtgacactctcatctcacttctatcaagtatcaacagtacagatctaactctttagaacatgaaacaactttaaatttaaccagacatacaatgatttttccttattagttcaatccagtacctcaaacaacttccattataatttgc

SEQ ID NO: 67913 - DNA, 3128 bp, Oryza sativa
tcatgaggaaatatgtcggcagattttcagcaatactagaaatttactcactgacttatatcactttctactaatgataatactggcaatgaaactaactaacaaattgtagtagttatgagtgcatgctatacataggtatagcgttgaaaatagtaaagccctctttgaaatatagaataggaaaaatataggaattaaaattgtatgttttttcaatcttataagaaatgagaacatagaaaataggaagaggtcgttttgattgcaccacatgaaaaatttaaccaaacgaaagtttcacaaaaagtctacatcttacttatttcctatggaattgatcataggaatgcctatggcaattttcctatactcttccatgaatcaaagggctctatataaaaaattcaaagaaaaatgaatcctccaaaattcctctgtcaattctccatttcaatgggatcctaattaagtagctagaataaaaatgtgattcatagtatcggtattgttaccaaaaacagtcaagtagagtaaaaatgtgattcggatccttaagcagtttgttcagcgttacaattaacgtgattaatcgtattggttgtctatttccagccagcgagagtacaaatatagccgaagcacatcagatcagttaaaattttgcaaaggaaaaaaaagagaaaagaatcctcacatcttcaatagaacaaaacaaaaacgagtccctatctaagattaatccttcatccatttcatgttttggcgccaaatcttcttgcagagtcagggagtgacgggaggatcgtgcctaggatctgaaaatatcaatcacattcaaagatgagccctgtgtgcaagtcgtaattcatcaaattactgaaattaaatgatgaattgatcagccaaaaaacagatttaatgaaattaattaattcctcgttgcaacaactaaccgtagtttgccgaaagagatcttgatgctgatcttccaagaactaaccgacggcctcctcgcttctccaagctaatgatcactgccccatccggcttgctatcaatcactgacacacatatataacggcaacattttatttaagataacgaaaaatatattcaatctggtctttactcaaaagaagctatagccaattattacatataccggcaacattaccatcaagctaaacagagcttatttaattataagttgtgtagattacatagattcagttcagggtcgacgctaattaaatacctgaattagctgagacagatccgaagagaaacattggcagcaacaagatggagaggatcagaattgcctgaagatgatgagcacctctcattgctgtaagtaagctggttttctgctgcaatttgcaatcatggagaagactgcacagagagtgcggctcaatcgcgatgttgatttagcatctcctatatatatagagatacacacacacacacacatgtctgtgcgccaatcttgatacgattttgactttgggagatgatgttctacatgagattattcagccaattgaaaggaatggaacgagtcatattattcagtcataaccagaaaagcaatagagaagtgcaagtcagcggagagagccagagaccagctgcacagaaacattgtgaacatttccattctttgtttcccctcatacaagttgtattttaagcttaaagttttattaagacatagttgacagcatcatcaaagttacaaaatatttttgaattttttcatgactatttgcttaaagtttaaaatctcgatgtttaaatcagtcatagtgctttcaacccatgtaaacagtgataaaaaaatctaaaaattatgaagaggtaatttataatgcatctatgatcttatcaaattttagtgtaaaatagaaactaaaagagaaatacagttatggagtaaggtgagtcgttttcaatagttaagagagtaaaatgagccgagaaatcacttaggggataagtgctccgaggaaatatttcaaaggagtaaaatggatttttttccattaatccccaaacaataaatgcattacaatagattgtgataatgtttaaggacggatatgtttcaattaatcctttcccctaacaaatgcattactggctatatgcatatattattactccctgcatgggaacttcaattaatattgccctccctctgatttagatatgcagttattcacagcatcagaacgcctacataaacaagaaggccacaccctccaatttccctttatctgaccgtccaaaaattcccctccaaactgaacacacaataacaaatctccatcatcaatggagccttcaggcaagctctcctcttccgccgtcgtcctcgtcctcctcctcgtcgtcgccaccggtatatttacgatcagaaagataaacaaatccggtctttttttaagtattttttagttgggcatgtagcctactggttatattgacctgagtagcaccctaaagtcttgagttcaaatctccataggagcgaatttcggattgggttgtttgatgagctaagttcctaatttaaaaaggttgcatacatcgggttggatgtataggccgggtaaaaaatactcttctctaaagaaaataatagtaaaaaaaatctcttctgtaattttgtgcagagatgacggggatggtggtggtggtgcaggcgaggttgtgcgagaagccgagcagccatttcaaggggttgtgcttgcggtcgcagaactgcgacaacgagtgcatgctggagggctacatggacggcaagtgcaagtacttgactcgacgctgcatctgctccatggagtgcgccaccatgagcaacgttggcctgacgccgacgaagtgatggagacgtacttggaatgaatgagtgagtgagtgagtgagtgagtgaatgatcgatgaaactatagctgacgcggttatattaattcaccgcttgcagtaataaactttatactagaagctggtcattagctgtggtaatacactaatactacctacggaccgtttcaggttataagactttctagcattgtccatattcatatagatgttaatgaatctagacacacatatat

SEQ ID NO: 67914 - DNA, 3738 bp, Oryza sativa
aaaattggtgggagagacaaaaatagtgtacatttcacactttatatgccctagtctgtactaagtcgttcaacgaataaatagcatattttgggagacaaatccagtggaattatatatttttatgatcaagtacatctttacacatctcattggaaaaacttaaaaacacctatattgtagataatataatggtatatggatcttgtagctgcaacatccccctttcaatctctcatcaatttccggtctatggggtggcaggagagacaggactgtagtgttccccattaggatcaaagcctgctaatcataagaatattacaaggcattttctatattttaattgttaaacacgcatgcatggaaaaaaattatgtacttctccattatataactacaaacacagactttcagtactaccgctagaaaataaattttgacatgttgttactcatgttctaaaatgtatttcaagttaataaaactaataaaatttaccacgactacgatatatttcattaagtaggcacatataatttataactggcggagaagtaacctggatttcggtagaacagaattcgacgatgcctattagttgccaagcctagaaataaccgacgtactggatgcttcttctcccagttgattactatcccgtgagatttgtctacattcactgcaaccaaaaacaaaataaagatgagcacaataagccattcgtgttttccaaaaaaagaataaaagtgaaattgtatgatttgccttaacaaacagtcgattatatgatttatcattgacgagtacgagttttataatataccatcacataagccattttttttaccgttttgtcattgtcatgagttgaccatttgttgacctctattagccccaacgaaaagtccattctgcctttaaaaaaatgtaacatacactaagcaagcacatattttcttcactgatattgaaataatagtagattttattgtattatttgcaactggcagcaaaatggcattagatattgcaagggtattttaggtattatgaaaaatacaaagagataatggaggttgactggcggtgatggaaaaaaaaagggggaaaaacagagggtatattgtagaacttgacaatataatgaaaattgtagaatttttcaaaacgtaatgtctgtttcatactatttaacaactgatcatgcatgcatttatttcattacagtagtaaatgggaaaatagctactggaagattttccatcaatttttagccatcaaaagcgataacactatatataatttccggccccttcgaagtgtaactttgttcatctccaagtcccattaatccattcaaaatcaagacaaccaaattacacctgattaataaaatgtaaaaaaagacaaaacaaaaggacatggcaattaattaaagaaacaaatttgcaagagagctcacctccggcgtgctcacgacggccggcgagacatccgggcagcagcaagagggacaccagtagtactgccacctgcaacgagacacggagcctccggcgagcagccgccattgcgatcgctcggcctctcaattcagatttcagagctaattaagagatgtgtgttctcgcaattcagatttcagagctaagagatgtgtgttcccgcaacgcatgcagggagctatttcaatggccggccggccgagaaggagacgacgaccagcagcggcgacgtcgatggaacgacggcgacgtggagctttgctacttgctactccctccgtttccaaatatttgacaccgttgactttttagcacatgtttgactgtttgtcttactaaaaaaaatttatgaaatatgtaaaactatatgtatacatataaatatatttaaccatgaatcaaatgataggaaaataattaataattacttaatttttttaataagacgaacggtcaaatatattttaaaagagtcaactgtgttaaatatttagaaacggagagaggatatctgcttaggctgattcgtgtggactcgttcagtatgaaactgatctgttttgggtggaattcctgcatgattcctacgttaattacagacaattattatacctacttggtctcggcatgtattggcttgaatatttggcatctgaatgcttcagttgtacttcaaaggtagagaaaactagtgaagtcaggtcaaggtaatattattaacttactatacattgttcacgtcagtagctgaaattgactggaatcgtgaatcgtccggtaaatatgagcattattgtcagttgatggtttcgtcagcccatagagcgaccagtttgtggtcaaactagtttagtatacgaaaataaattatggtaaggtaatcatccaaggagtcatgaacatcatcacttcatctactcgtcctgtagccttaaaagtgtcattgacattcttctaatcatggtttgaataattgaacacatttgtttgaacaatacgactgatgtatattatgtgtatcaaagtccaacaggagttacaagaccatgtcgagtacgctcctctgctttgtaatattctaatctgacgtaatagttctgaattacatacacaaggtaactagcaagtggaacaacactgtcagtaaaaattatatggtgaccatgcaaatgaaaagtcacccacatcaagtgctacctgggaaaattcaacaacggttgtctgtctgggtaaaacagaagatgcatgagattgctcgaatactattaccttgtcaatccgttctttgccttacaagaatcatgtttttttttttgtgtgggtctactgttcatctcatcttcatcaacgctcatgaacaggcaatgtctgaagtatcgtcgaatgcacagattccctcgcttgccacccgaggccaatatgaaccaggtcctgaaaagaaaagcgacaggcagattacatatagaagtacgtgttgtatggataggttcatatgcgaaccgtactgatgttttattcgaccattgcctataattttacctactggttggataagcaaggctcgttgcaaaagcgtgccttgcagatatgtatactgttaaagtgatagcaacaaaccaaactgtggcatataaaactagatcagtaagctgtttgtaaactactctctccgttctgaaatataactctttctggttatgtatctggataagggtatatccattatgtatctagacaagggtattcctagatacataactagaaattgttatattttagcatggaggtagtaaatgataagttgttaagcggtgccttgtactatttaccacataggtcactggaaattgatgtgttccatccaatgaggaaggatatggaagactgattagaaggatagttttctatgtgcatagaagtgttccatctaaaatcacttgagtagcatgtgactaaaatgtcttattagtacaggtgttcagaaaaatgattcataaaagaaactgcaggtatagcaatttgaaattacaggtcacatggataaattcacaaattacatggactcaacatgaaatacactttgtgcataatacattgcatgccaaaagtcagtttcgtttgcaagatagtaagacaggtcagaaagaaccaatatggaatggagaggattcttgtcaacacaggaagctactattatttagtgttgtgcatctatccatccaactgttta

SEQ ID NO: 67915 - DNA, 1035 bp, Oryza sativa
tttcggatatattccacctgcagtaggaaatctgagcagcatacgcgatctaatatttgcaagaaataatttctttggacatattccatctaccgtaggaaatttgagcaacctctctattctaagctttgcacagaataatctctttggacatattccagagttcgttggcaatcttgtcaaactaaccaatctttttctacatggcaacagcttcagtggaagcataccttaagtttgagtctattctctaatagcatacactcttttataatttaaaaaataccgcaaaaacaatatctttctttaatagctttgctaccatgctattctggtagaagacactcaactccaatgctctctccaattcacattcccaacatagagacaaaggcaggcctactattgagacaaggtgcactactgattcaagaaatactggagacaatctgttgtagcaacaaagatgctttaagagtttgcaagtcgcgtggctgatagttttaaggtcatacatttggtccatctgtcaatatgggagttgtaccaatggtgtcataagttgtgatgtattgcatatagaatatagaagaaagtctacttggtcttgtgaactttggtgatccatgacatgtgggaccatgacaagcatgtattgtgaatttgtgatatgatcatatgagcagcaaatcctcaaatggatcaatccttcaactgtatgcttccactgagccaaggatcatatagcaaatcaggaacagtggcggagggagctgggtacatgtaacttcaatactgtacacatgtacacaattatatactcaaataaaaatctagctgtccaagggagtaaaaaattcatttgtattaatctatatcatatgaactagtttgataattcgttgataaatgtcactattttctaatcatgccacaaatcgggccgccactgaccaggaactagaactaacacaaggataattttggtcggtgtcgctagctctctggcccctattgtccctagaatgaactgat

SEQ ID NO: 67916 - DNA, 2936 bp, Oryza sativa
ctaagctttgcaaaaaacaacctctctggccgtattccagattccattggtaacctttcccaactaaacgagtttatctagatagaaacaacctcaacgggagtatacctgcaaatatagggcagtggagacaattagagaagcttaacctctctcacaattcattcagtggaagcatgccaagtgaggtctttaaaatttcttcactgtcacaaaatttggatttgtcacataatctgtttactgggcccatactgccagaaattggcaacctcataaaccttggaagcatcagtattgcaaacaatcgcttgaccggcgatataccgtctactctagggaaatgtgtgcttttggaataccttcacatggaagggaaccttcttactggaagcattccacaatctttcatgaacttaaaaagcatcaaggagttggatctctctcgtaacagattgtcaggaaaagttccagagttcctcacactttttagttctttgcagaaactcaacctttcattcaatgactttgaagggacaataccatcaaatggtgtctttggtaatgctagcagggttatcttggacggaaactacaggttgtgtgcgaatgctccagggtacagcctgcccctttgccctgaatcaggattacaaattaaaagcaagtctactgttttgaaaatagtaattccaatcgtagtgtctgctgttgtaatttcattgttatgtttaactattgttctcatgaagagaagaaaagaagaaccaaaccagcagcactccagtgtgaacttaaggaaaatatcatatgaagatattgccaaagcaacagatgggttctctgccacaaatttggttggtttgggatcctttggggctgtttacaagggccttctggcatttgaggacaatccagttgctattaaggttttcaatctcaacaagtacggagcacccacaagcttcaatgcggagtgtgaggcattaagatatattcgccatcgaaatcttgtcaaaatcattacattatgctctacagttgatccaaatggctatgattttaaagcacttgtctttcagtatatgcctaatgggagtctagaaatgtggctacatccagaggaccatgggcatggtaagcagagattcctaactttgggtgaaaggattaacgtagccctggacatcgcatacgctttagattatcttcacaaccagtgtgtatccccactaatacattgtgacatgaagccaagcaatgttcttttggatcttgaaatgactgcatatgtcagtgactttgggttggcaagatttatgtgtgctaattcaacagaagcacctggtaactctacaagtttggctgacctaaaaggatccattggatatattgcaccgggtgagagaaattggaaacctatacttattctttacttgtatgcttcaatcattttattaactttgtgaatcatatttttctccattcacctttgttatgttttcaaatgaaaatgcagagtatggaatgggtgcgcaaatatccacgaagggtgatgtctatagctatggagtgctgttgttagagatattaactggaaagcgtccaactgatgaaaaattcaaagatggtaggagcctccatgaacttgttgataccgcatttccccacagagtaaccgagattttagaccccaatatgctacacaatgatttggatggtggaaacttcgaaatgatgcaaagttgtgtcctcccactggttaagttggccctcatgtgctcgatggcatcaccgaaagaccggttaggtatggcgcaggtttccactgaaatacactccatcaagcaagaatttcttgatctttccagtggaggaaaaatagtgtgagtaataattagacctaggcagtacatttggcactccacaaaataaacctagctaaggttgtcttccttcttatttttgcttcctgagattagtgcaaagctgttctgcattgcaactactatgtacagctacttctattaccataatgaagtccacacaaaattaacctcttggtcctaaaatttgtttggggcagcagcaaatgcaatggtcagcaaacagcagagagcaggctggcagcacgaccaaatatggctaataacttacaaactaacaattccacggtggttagtcagcagcacaactcacaacattcaggcgtaaggatacgcatagagcaaaacggccacacctgtggcgtgccttcgcgcgcgtgtactgcgtgctactttcagaggcatttccacaaacacgccacgcgcgttcggaggccgtacacgaaaccgaactcacaagcataggcaaaggcatatagaacagtagcgtgctgacctcggaatacgacggcgggccggggaaacctccatcgtcctgcgccggccgactcggcgtcgccatcgcccatcgcgtcttcggcggcggcggcggcgcgacaggctcggcgcggccatggtctcgacgccgtcggagagagaaaaagagacggtgggacaacaagattggctgggcctggctgatgttgggctcatgggcccgaattgagtttcttttagtaaagggacaatttcgtttttcccccactttgagctctaatattgattttgtagggttttcgtttttgcccccacttttttaatcgaaagagacgtttacccctggtttggatggaagtcagtgggaccgagtttgtgacagtaaaataaagagaaataaaggaaataaagatttttttagttagtgatttacctttttaccctcgctgcacacggtcaaacccgagacctacctggcggcgctggcggcagcggagagcgggcggcggccaggcgcagctcctcccggcgcgagcaggaggcgagcacgccaggcggcggggagagggcagc

SEQ ID NO: 67917 - DNA, 2112 bp, Oryza sativa
tgttgttggggtgatgaagaagtcgttgagggtagtccaaaccgaaaaaatgttaaaattacccgattcaaaatggaaagattagtttaagaaaggtccaaagtaaaattttgccaataaaagatggcctacactgtaattctctctaaaataaaatccaatgttcctgtcaaagaaaaatacctcaatcccttgcaaattcgagttaattttatttgtataagcagatagtacatatttctttgatagcttcaagggaggaggggatgaaggagagaggatgaacacgagagagaaggggatgaaacaagatccccaacaaacaatcagtcagcaaagaccacattcaaagacaaactatcggttggcaaaatttttgctgaccaacttcaatggttggaacaagtctagtcggcaaagaaatttcccaaccaacatatttttgctggtcgaccatctgaccccaatagcatatatttgccgaccgatatcattttttccgaccgacatgtttttcccgacccaccacaattaccgagctggtatcggaaactttttgccgaccgaccataagccaccaaagtttattattaccgacagattgaccgtcagtaaaaatttacataattaccgaccaacaatcggtccataaaatttgggttgccaatcatccgttggggttggttaaaaagttataccgaccaactgcctattggtatagatggatattccccgtcggaagtcgatgggaatgtatggacatggtgcagtgataggcaccgtttggacttgactggtgcacggtctatttttctccgttaataaccttatatatattttaagctgagtattattattatcatatcattataccgtagcattcgttacaactaaatctttattaacaagatcttgcatggttatatccagataaaagaaatattgatgggagcttctgcaatatgtttggctctatggttgtgtaggaatgatatggttgtgtaggaatgatatggtttttgacaaatcatcatctattacatatatgcaagcaattttcagggcaacctattggctccggttttggacacaactacaaaggtgtaatgaagatggtgagcttttaaaagttgcatgtcgtaagcttgagataacggttatgcagctttttgtcaattatggatggagattcacaaatagacttcaataatgtgttctcctgatcttgttttggttaaatttacctttgtgtggtcatttcttatgtcatttctgaactacacttgttttagagtgctagattgtaataatgagctgtagctctctttgagcaaaggccgggatgactattccattatctaaaaaagataaaagaaatatatattgtaaattaattttatcatatatataaattacttttggatttgattaaatcacttcttagatatttatgaaagtaaatttaataaagacaaaaagtattttacacaaattataaaaaataattaacacaaaaaaaagtaatttagcacagaactaaaagtaaaccagttgtggaggtaagaacatgagtctatctaaaaattaaattgaattggcgcaaactaccgaactaactaaaaacaacaataaaataacatattcataacattatgaatgcctaagaagtaatttaatcaaatcaaaaggtgatttatatatatgttaaaaagtaattttcacatataataaagcaatttataacacatgtatttcttttatcataacgtaattatataagattttgttagaaagatttaaatgcagtgaacacaatagtataatcggattatagattggataagtaatttaagagaaaattttatttgaattttatgaatattttcttttttacatgctttcatactcccacgtggagaaatcatacatattgaaatgatagctggttataactaattagtgtacagtgcatatttgtgtccttttgagttcttgtacctacatcttaacaatgccacaagcagatctccataatctaacaattccagcactcgccaccaaactttgacactactccctccgttccaatatataagaaactaggaccattcg

SEQ ID NO: 67918 - DNA, 4275 bp, Oryza sativa
cgtcgaatcctacaaaatcgtatcagctcgggtggcggtaatcctttgtggggtaagtcgtaagctaagagagattaattttatagtccttttattaaaaaaaatacatgaaggtatcaaatttttatactaaaagttttaacttgagatatctagctagttcatggatgtactaagctttacattaaaaaaatggtatctctaggtctcggtacctttaattttcaagaataataaaaataccccagttataatatgatccagaacttattgtttgtgtagtaaatggatctatatatattctgatatgtgcagtttattcaagtgttaatgtgttatcaccaggaactagactactagagaagctacgctaattaattaaactgatgagcatatatactctcctatcattttctctcacgtccacgatttaatctgacttggagttatatatatgtttcagacccgagacacgaccctccttgttgctaggatttgagcagagccaagtacaaagtttgcaccttaattttacggagaagtattgtaggtgtggtgatggagttatgggggcaaacaactccattgaccaaggttttaatccttgtgtaggcataatttgacataggtatttccttactgtcttgcaaacaaactagcaggatgatcggcatttgcgcgataagatctactaaagtttatagcttcaattcatatatatattacactcactttcttcatcgtttaattgtacaatgttatccttattctaatgtaactttatagaatgtttattttttttatttcgtcgagattgtaatactattgtaatgctaatcaagcacatctatcagtgtcgaggtctgctaatgaaaaattcctctcatttcaattaagtgaaactatttctatttcttcgtgaaaaattctatatatagtgctctttttcgatcgctttgctctcgtccttgtcaccgataattcactttgtttaaccaacctgagtacctgaccttcatgaggaatcatcctcgctaaattagatgaaaagcaaatgcgggaagggcatagaatgattcattgcggggaaaaatagcgtgttatgtgtactgtgtttctaaaacaaatagcgtgttatgtactccgtattagttctatataatagaaaaactaggtgggcacggtcacacggagaaagaggatagagtggtgctgacggggctcggggataccggatcttgtgctattaatgacgcacaagggaaatgaatgagaaacgatgcgctgatactgcccacctcactttggcttgagagaggagaggagagagatgtgaaacgagatataaacttacagccagcttaagtttaggaactaagaaaatctgtgagaaagacggatggaccatatacttataatgaaaagctaattactatatgagtgagctgagagataggctataaatatctatacaattaacagctggctgtattgttagccttgctctgatgctagctcctgtttcgccctgctccgacatagggggaagtctaattcacatatttttataatagatattttatctgtttcaaaatactataacctagaattagattatacacaatctagtactacaaatctgaatctaaagtggtcctagtgctatgaatctaagagcctgcttgggggagcttaagattctgagaagcaactgattggtagccagcttctgagaatctggagaagctagatttcctaacttctggcttctagttcattttttggattctacaactacagcttctcagaatctggaccaaaagctagactgtttggggagcttctgattctgggagaagctgcagctgctagaaggtccccagaaggccctaaataggactgtccaaattcatagtattaggtgatatctaattcgattttaaattattatattttacaatggagggcatcttccctacactcatcatggaaacatttccttcacatgcgtcattttgtaccatgaacattttgcatatctgcccccagtaaactagttttgatattttccatcaatcatgcatgctcgtcctttgaaacaagcgtgcacaataaacaaccgaagaaatcatttttaggacatgttattccagctttactcacatatgctgtgaagaaaaagttggctcacatttgacatgatgaacaattattaaacatgtttcaaaataccactaaactcataaagtgagcatagctaaactgattagatcttgtatggtggaacaaacccatgtgagtttaagttctaaacttcgcatgagtgttcacatatgcagataattattcttttagggttggcgacaaaagacaacaagacgtactagaaaacccttaatagggactggctcataggtgtcgatctaattaaaaccggcagttataatatagtataggtacccggcatttcaaaatcagtacctatactcggcacccatggtcaccctgagcaccgacgaggagcggtatgggcagcggcagcagccggatgtggtcgtaggtagaacagccaccctgagcacctcctcgttcgcaacatgattccgacgacggagatggcgatggcgcggtggaaagcgtcggccaccaggtgagatggggagtgcgctccatgccgccgctcctcatcacctatgttcctcgtccctgctctgtattgtgagtagaaggcattggcggagaccgctcctcgtcctagcttcgctccgccgccactccgtctcaaggccgagccaccgctcctagtgtcgggctccctctcttcactagctgtggaatggagggaactcgccaaccaccttgcagtgttgggctagagagagaaggaaaagagaatagaaatcaagcacatgaaaaagtgactaacatatcagaccgcatactgacttagctggttagacttggtcaacgtgccacgtcagcgaaaattgctttcaaaaccgttgaggaggttaaattacactgtttcaatagttggagggtcaagacagggttgagagatacaaattagattggagatatatttgagggagttaaagtggatttatttcggaggagaaaatgcctccaagaacaagagtgcccaattcttgtgctgtttagccacattgggccatgtaatgggttgtactcattcttcttctaactaggcgaaaccccgcgcgttattatggaaatttagtatggtaacaataaatagaaataatgtgtaagatagctggatgatataagcttacatatgttgacgtggtttacaataatttaaatagtatatataatgattatttaaatgtgaaagtataatgtgatgtggctttatgagagaaaaaaagaggaagataatttaaactatagattaatcatccaagggcaataaacaattgaagtggtatggcttaatgagagaagagagaaataatattaactaagtgatggcgaactatataagcatatataagatattaaaaaaatgatggagagatatattaaaatattatgtgaattatgtgggatgatgatttaacatgcttgcatttcaaagcactaaaatttaacaaattatagaattatagataatatagtatacttacatgatgtttaagatgtaataattgttagtggatgatgatgtgcatttttgcatgttaagctttataatttagtgggttataactttatagtaagatgggatagtggaaaaaatggctgagtggctgtagtaggtgagggggagagagagaaaaaaaggggttaaatactcgcttgataaattggaggcgtcttggtggctgcggcactggacctagttggatcgagttgctgaattactctattggtgtgtttggttgggtggaattgttaaggggaaaatgtgagtttgaagggtggcaacttttaaatctattgtttggttgaatcgacatggggggttttaggaggaatttggaaggggagtataagagcgaaccctcatcttttcaatacgtggatagagacaggtaattggaaggaaattcccatctaagtacgacgagatataccagagccatatatcatcacttagaatttaattcacatccatactccccatgattcttatctctactagtaccaaataagaaactagaagtaaaaataagactcccatgaatttccaatccccttcccatctcttaccaaagccgtgtgtccagagagagagagagggaggcgcta

SEQ ID NO: 67919 - DNA, 867 bp, Oryza sativa
agcagttggttcagcccaaggagagggagggggagaggagagagggaggggtggccgggctgggctgagggaaggagggggagagatgggctagaagtggcccaagaggaggaagaggatttcttttagcttttcctttttataaaattctttaattgttttgttgccttataattatttagaatgctctgaaaattcaagtgaaaattggttaaacatttttaagcatggggaatttattaaaaatactcacaagccaatttgatataaatctttggtgaattttaattgttggaggctcttttaggcttttaaaatttctagaaatacattaaagcacgatttaaatttagggcgattttcagggcgttacatcttattcaccataatcacaccagtacaatatttggggtagcctatctaattgttgtcgacatagcggtctgaaggtctgacacgtagtcgacaacatggtagccttcttcctcgaatccgcatctggcgagatcagatacagcgctatatctctcctgacggtagccataggcaccatatgggactagtcatgcatatctctgaagtcgatatttgacgtcttatcttagcgtatgttggcttgtatgttgtggcttctgttgtcccgtgtcttctgtattgggtgtcctcttctcctagggggccttctatttatacccataggtgtcctctttccaagtagaactagggaaaccaatatggatacaatctgagtagtcattgtcgtttccatgtagaactctggttgtctttccttattcggatctccctccatatccgaggtcagtttccatatataacatggtatgtggtgggtcctgccgagatgta

SEQ ID NO: 67920 - DNA, 1639 bp, Oryza sativa
aaaatactctcctcaacccctaaacttcacaaaagaacaagaaatcctgaaaccatcacagtttctgcaaactggaaaagcaggccgttgtatgatcttctcatattgtgttttatttcctatgaccaacatagtgtcgcatgccaaaacttgtttctcacctcccatgacctgatgtcaccaatgcagtgcacctcgatgacgaagaagatagatgacagtacagtccgcctgctggttgcactcaagctctcacatggaaggctctgcctctatatgatcagatcaatacctctgcttctgccccttgtccaatctgggaatttgtgtagaagaattcagcccccctctgagtgcaacaatttttgcctggcttatcttcaaaaatcgactaccaacaatgacaaatttgctcatgaagaacattgtgcatacggaatctgcttgcatcaagacgaagatggcaatcacttattcttcaactgctcctttgctgaagttttcagcgaatcgatgtttgcctagaaggcacagaaaagaaaagagaaactttatgatatatatagtagaaatgtgaaataaaaaataactctttgtgggtagtccaaataaaaaactttggtgaaatgaaaaaaggataatatataacacattctgatctttttacacgtcaagtgttattcggaccattttcatgagataaaccagtagctcctaaaaacatatgaacaattatatttagatgaataatagcattcgtggatactttctgaacgctagcaatatacatctagcaggctagaataaatatatgcatacaccgagtaaaagagattagtgtaaattgagataagcatctttcataaacgaaacagagcagagcataatccatgtgaaaaactgaaaaccattcaaaaaatggaacaaaatgataactattaagcctttttctttgcacggattcagcacgaaatgcagcacaaaaattgcacataatggcacaagagggagaggacaccgggagtgcattcggcaaacctgcacagggtcgctttcaaggacgacgtcgaggaagccggtggatgatcgcaaggtgaaccggtttgacattcacaacggtgacgcaccgtgcgctggatctgcacatgacggagttgaggaggaagatccgatgacgaagtgcaccaggtgacagacctccacctttggggccgggtggaacagatcggcgaggcggccacaggttgaaaattatagtcagtacaggttgtggtcatgtatttactgagaaacctaaataatatacatgttacaagcatttctccgggtggaacagatctgcgaggcggccacaggttgaaaaatatagtcagtacaggttgtggtcaggtatttactgagaatcctaaatattatacatgttgttacaagcatttctcttagcaatcagtataccagctgtagttcacatccttgttcatttcattgtatcaaacaaattctgcaggtgcgataacgagatgaactatccactaatgtaaataatctatattataatgtaatcatccatcaatttgccaatgatgctggtaacaagtaaaagatttattgatgcagccaaaattaaactgtgtaaatt

SEQ ID NO: 67921 - DNA, 1095 bp, Oryza sativa
taaattttggtcctaccaaaattcgcaccaagataaaaagtgcaaaccctgcaataacttaatttgtatttcacattatgaatagcagagcacatatacgacatcgtcaaaataatagccagcactggtatatggataatggtcagaattattgcaggacattaagaactccatcttctatatgtgcgcttgaaatgaaaaaccttcgacatgaaaaaatagttaacctttaacctagtacagatcaattaccaaaatatttgatttttactatctagacagactcaagttcctcaaaaagctaagatgatgtgctgcttggttgctgactcagtgactctagtagtctagtttcatacaacagtagcagagctcataaaaaacaacacagtaaaacaatatgccaagacactaaaatggattggaaaacaagaagatgtagaggaggggctgcaagaagttaccaatgaaactgatcttgctaatctggcaatccccaagcagacctgctttgtggctgaccatgtcgttaattcacattcactgccttgcaaagcgtgggcaccactatggctgcaacagtcatggtcgtcccttgggagcagggacagctgggccctgccgacggcgccggcaccccttgcagcggccaagcctgcagtaccagccgatgccctcgccagcacaggaagaccatgcgagcagcccatattcgtggagttgaacggtacaaaagctccctgcagtcctgaacctagggacgaacatggagttgagcaagctgactaattatgtttcaattaagcccgagcaaaactataaaacaaaaccacactgcaatatgagaaaaaactacagagttaagcgtagaagtatcaagcggcgtgcctatgttatgtttccagggatcctttgggaccctggctaaattattaaattctagctaaagtacgccatgttaactactataccggtaaatagttacataattcgtatgtattggactcttggtattttttgttctgagttcatcactgaaaatatctattagcacaatgcgagcacgtggaaactgtcggcactacatgacgacca

SEQ ID NO: 67922 - DNA, 964 bp, Oryza sativa
ttttttctttctttcttttgaccggagaaaatatgaccgttttttttacgggagaaaatatgaccgttgctttgagaggagagtgagagagaaggaaaggttttttctttctttttttatgaggactagaaagaaaatatgaccgttgctttaagaggagattgagagagaggaaaaggtttttttctttttttatgtggactagaaaatatatgaccgttgctttaataggactagaaaatatgcccgttgcaacggattcattagaaactaaatatttatctgcttaagaaatctaggatgttttttccggttgttcctcatatggtcctttgttggtcatatctgtgcgatgagtgtagagagaccgggtagtacagaccgacagagcctgcaactggaccattccgaaattctcaacttgagcatgaaggtgaaagaactttaatttgtcagcaaattggaccctaatccattcaaataaaatcattagatagatccacgggatttcaccataaagaaatagataaatggaagctaaaattgtgcaggagtgcgagtgacaagagtgtacgacaacttatgtcgagacagcttcggccaagtagaacttgtccgccactgcaactgcagattacagtctttcacttggttacccttctcacacaccatcgctatcgcaggccccatggcagtcgtgctagcagcgccatcaccagcgaggtgcaccgcacggatctcctaggccactcgacgtgggtgatgtaagcagatatgcgggggagttgattgagcagggctacggtttgcgagggacttgactggtgtttgatactaatgaaaatgaatattaagtaagggcataaaaacaaaaaactagtagcatatgattaattgagttttaattattgcaaatttgaaaaatgaatttatttgatattttatagcaacttctatataaaaa

SEQ ID NO: 67923 - DNA, 4356 bp, Oryza sativa
cctcacaccgccgccctctccctcctctctccgcggccgccgcgccgctctcttcttgtgtcgccgccgtcgcaactccggccgcccctcgccggtggtcgagactcatcggagcccggcgtcgccaccatccgcttcgtcgcttcctcctcttccccgtccacccctccgtcgagtacaaggaccgcgggaacgacgccgacgccgacgacccgaagcttctcgccgtttcttcctcaccgccggcaacaccgtcgacctctcgccgccgtgtctgctcggtgagaaccgtcgtctcctcccctttccgtttttccccttcccgtactccgtcgcaccgtcgccgcgccgttggccgtcgccggcgtgccgcctggactcgggtgcttctccttcccgggcgtgcttgtgcgccgtgagccgccctcatggtgtaccgagcggctgccaagtgggacccgcccatggacccctctctctcttctctgtgcaataaatcaatttcctttagaaaaataattcataaaattgcaaatttccatttaaacagcacataaacttcaaatggccatatcttgaccgtttgaactcagaatcgacccgttcaaatctctaatttctcctaaaaatgagtagaacccatttatgtgctttattgcttctgttcatatggtttttattagcctttttgtttttcttcgcgttggtcgtgtagatcccgccgttccggaagatcagcttttcatcgccgttgacgccgaagactttgtgagcgatcaaggcaagtcatatctaccttgaacatgttgaatcccatattgtgaaaattatgttgttttacttatattgcactgctttataaattataccgttcattattaatattgttttattagttattcctatgctctttgttatggccatgttattgatttgatatccatgatcgttgtgaaacctagtaaaattataacttgactagtctggtaccctacatgatggactgactagttgctttaggtaaatgcttagtcatgcttagttccaacctagaacttttggttaaactagactttggtggttaacaactaaaattggattagttatggactattgactggtttgtcaatagatgggtgataaaatgatttgtgcaactaaaatatatttttgggctgggcttggggtgcaagctagttactttggtagtcgcaccccggctaatataaggatcggtcttcgggcctctgttgcaaggcatcttcgtgcaaccacaagtcttgtgggtaaggcctgactggaaatttagatcttctcaaaacagagaccattggttggaagggtgtgaggccaggattaaggccgtttttaacccggcgcaagggggggcctgtctcgtcctgggggatccggcaacctttaccttgtcggggaccggcgggcagggaaaccacagcgggttctcctgttttgggtagacctagatggatagtcttgtcacgacctctatccgagtaccgtggtggtacctggcgcgtggcaacgcgtgttgaggttgggtattgtgggtaaagttgtacacctctgatcagagttagaactattcaaatagccgcgtcctcggttatgggcaagctaagcaatgtacccaaagttagttttgttttataaaaccttgggagggtgaaatcatgatggtgtagtcatgtgaagattagcctgggttaaggcaggttcgtaggctcatgcgaccttgatgatattaaaatattggcttagaacaggatcgtgttttaaaatgagctttaacttgattaaaatgtttaaattatggctttatgcaaaataaaccctattaggccattttcttgttttccctacgcattattgttgcatttccggtgtgacttgctgagtacggtggtggtactcactcttgctcacaaaaataatccagaggatggacctgaggaaggtgaaggctttgatctctagttcgctccgccgtcgagtgcctgtggctgctgctgttccgtagtcttccgctgttttatttgtttatctttgagtgtgagggcctaagtcgcccatgtaataaagtactcctttacgtttccgcaagtgtggcatgtaataaacaacaatgtctatgtgtacctcgcctcctgggacgaggattaatgcactgagcgtttggaaatggtgtatatttccaggcgtgacataagagcaatgaccggcttcggccaacaggatgtagggttattacctgacaattcaggggcccgaacctgtataaaaatcctcgtctccgtctcttttacctcaatctcacatatatcctggtaccaacgatcctcatactatgcaaataccggaattgcgacatcaaacatcgaaccaaatggaactcaacatatggtgctacaagatatgccacaggctgccgtcgcctctccgccgcgagctcgaggccagatccggccgccgcgttgacggggaagaccggatccgctgccgcgacgacgggggtggctggatccaccgccgcgatgacaggggaggccggatctgccgccaatgccgacgagcactacaagaaatatgaccttctgtgacgaattccttgtaacgtcggagctattcgtcattatcacattccattttatgacaattaatatgagatgggtggcttagtgacaaaaaaaaagtgttcgtcgttaataccaactagaaatctgtcgacgtttgatgtcgcgattccggtatttgcatagtatgggaatcgttggtaccagggtatatgcgagattgaggtaaaagagatggagacagagatttttatacaggttcaggctcctgaattgtcaggtaataactctatattctgttggccgaagccggtattgctcttattcaccataatcacaccagtacaatatttagggtaagcctatctaactgttgtcgacatggcggtctgaaagtctgactcgtagtcgacaacagggtagccttccttctcgaatccgcatccggcgagatcagagacagcgctatatctctcctgatggtggctataggcactataggggactagccatgcctatctctgaagtcgatatccggcgtcttgtcttggcgtatgttggcttgtatgttgatcttgtgtattgatctattgttctgtgtcccctctcctcctagggggccttgtatttatacccgtagatgtccccttgtctaagtagaactaggaaaaccaatatggatacaattcgagtagtttttgtcgtttccatgtaaaactctagtcatcctaccttatgcggaactcctcctatatcctaaggttgtttccatataaaacatggtatgtgatgggttctgccgagatttagtcaactactattaggtatgtggtatccatcaccctgacaaaatcatcataaaatatttcgatgagacattgtgacgaatattaatttgtcataagagtcaaaaagaaaacatcacagatttatataatgtatttctagaaaaaaatatattaaaaattgaagcaatttaatcaagtgaattaataaagaaactaaaattttcctttaaaatcatggccacaaatatttttgtaatattctacgtggtctaaattattctctaaaaatttccatgaattttcgaagctcaataactaattttaataccaccaagttcatttaacctattaaaataaatagaaaacaaattaaaatccctctctttgtccttggggctttttcggcccaagtattactctctccctccctcagcccgcagcttctttctccctcctcgggccggcttccccttccactcctccctcttcgggccgtcggcccaacccttttgctcctccctcgtcgagaagactatttgcctccctcctctcaattcaaattttttttcgtgtagtaaatgatttcaaatgaaaaaaatgtcaataataaagttgtataacttatcaacatctacaacttttgattttgttatatgactttatttcaataatttgaatttgaattttaaaatatgacaacttcaaacaacattttcaaatactaaatgattttcaaatgaaaaaatcataaacaataaagttgtataactcatcaatatctacaacttttgtttttgtcattttgctatatgactttgttgcaataatttgaatttgattctaatcatgacaacttcaaaaaaatattttcaaatactaaatgatttcaactgaaaaagtcatcaacaacaaagttgtataactcatcaatatctataacttttattttggtcatttctttgccgataaagtaaaaa

SEQ ID NO: 67924 - DNA, 2736 bp, Oryza sativa
taatgcatcgatggccatgattacgcatgtgcgagaagtccaacggctcttttttttaatgcggcagttccaattatatagataactttgcgtgctgaaaacggattaggtggatacatgcagatcattaaaacaatatgtatagcttccaatgttgactagaaaagtatgatttccacattgcttcttttttaactcccccactagcttggcacttaacttacttttggcatgcggtccataagttaaagagtccttgtaaactaggttgctgactagccaatagagattagaaagaccgacttgaagaccttgctcgcggtgacaaacgggcagaatttgaagtagatatatactagtatatattggctacagggcatcgatcgaccggaccagttcaaatttatgcattgagacccatcagacctgttgagatgggtgacttgttgctgatcaaagactgattactcagtgcagccctgtagagtcatgggttggattgatattatttgatgctgttatatatgatcctaatcttgtccttaggtacttttagtttttgttcttcatatagtgctatatatatactaagaatttataatgagtaatgcaacttttttatatgcaaatgccgcttgtttagatgcaaattgagaaacacctaggggtcttccggctagctccacaaggtggtgggctagacgacctaggttctaagcctcaccccttctaattatttgatattaggtcattccttaatatttgcgtttttttagatgcgaattgtttggatacattttatatgcaaatgatgattctaccatgaatggtgcatcgtctctctttcatcttcttccacagaacccacgagccctggtcggagtgtgggtatccgacaggtgtggagattggggacgttattcacctggtcgttggtttggggctaggggcggggacgttccaatccacctctgccctaccccgttgtcacccctactcctatgtaggttggtggacaaccatccgagctctgtatctacatctgtaattcctatgttccataaaaaattaatttatagttatgaatctagatatatatagcttacatctagatttatagtccgaagttgattttctataggacagagagagtaatgttaattgctctattggttgttgttgatgtatgaaaaaaaagttgtcagcaagccaaaaaaatgtatggaggataaacattggtagcaccttttattcacctaaaacaacttgcttgtaatctttatcaagataaggtacgtaaaataaaacttggaggaaccaagtagtgtcaattgctctgcggactattgttgatgtatgaaaaaaaagttgtctgcaagccaaaaaattgaggatgaacattaataccactttattcacctaaaacaacttgcttacaatgtttatcaagagaaggtaaaataaaacccttatctttaaacccaaagaaaccaaaacccaggttgtgaaacaaccagtagaaagaccttccttccctagctcgcagcttatgtgcaaccatgttcgccgaacgacgaacccaacaacggtattagttgcctagtggatgtggattaggagggttaattatgttctgaaacgaaactccaagtcagattaaatcatgtatgtgaaataaaatgataggagtatatacacataaatgcatgtaaaaacacattaacagtttaacaccactttttctacgcaaaacagtcagttctggatccagatacaacttacccggcccgtcccagttctcatggagtaggattcgaggagaccgtgttgatttgcttagagctaagagacgatgatggcctccatgatgcgtctccctgcccatcagtagctcgacagacttgcttccggtggcgagcgtacatggcagaaatggcataatctgcagtagtaagagggacatcactaggattgcctgcaacccaacactaaggcgagcagctgccattgaatttgcggacccaattcaccggcctctcttcgctgctgcagcatgaagcggcgtccaatttattgcgtgcaacaaattgtcttatgtgttgacctccacctaataagagtttcatcggggtttcagccgatgaggtatctagacgttgcatcggcctacaaggattggatataagttggatttagccgatgacaacaaagattttcattgtttatctaatcttgtggattttatgacatcggacttccagctgatgtatgctttaatcttcggatcagtgcttattctatcatatcattgttagccgattggtttctactggaaattattattgttatattgtattatcatcagccgatcgtctttatttatatcaagtgtcagattctacatcaaacatatagccaatagctcaaaaccctatcgctatcggctggtatcggcatcggctagaatcactccatcggcttgtcagccgatcggtagttttatctgctgtttacatatcttgtcagttgcaggatcaaactgactggcacgctcgcatctcatcaacaacttggatctgtactagagctaagcagatctcacaggccagtgtgtgtttttcgcatcaacaacgtgacaatccagacatcaattctttttttaaaaaatgatggggcccactgtcatatctctcccctcccacctctctccaccaccatgtgtcgtggccgccatcg

SEQ ID NO: 67925 - DNA, 4195 bp, Oryza sativa
caccatccccctcctcctcctcctcctcctcctcacccaccacctcgccgccgccgtgctcctcctccttgtcaactctccccttccgcccgcaagcacaggcgcctcgatgtcgaggaatgggagtccgttccgcctacctcgtctgaggccgagtaggttttgtggatggtgttggagtggcacgatgcccctgcgctgtccgtggcggcgtcctcccccaccagaagttgccgcggggagtgccttagcaccaacgcctctagcgccatgcttgtccgtaaccgcttaccgtcattgcccatagccatggcatcttcgccgtcactgctagtgccacgctcctcagcttgccatcagcaatgcgatcccgcatattcatagctgtcggcgatggtagcgctgcggcgtttgcatcacgggcagcgccaacggcaatactccccgtatccaccaccagctccttattaggtgatgaccccactagagaagccaccaccgcaaacgatgataacgacgagggtcgtccctgcatatcctcacgagatagccttccctgccgagtggagcaacgcatctacatcctcccctgtcccctcctgttgcagcgcgctcgtcatcaccatccccaactccagatacacctccatcacgcaccggcagatgcggcggcaaagagctcctcctcggccacctctagggtgtgcctcctccttggcctccgtcggcgcatgcgcgaggagagtcatagttgccatagctcctcctcggcctccgccggcacgtgcacgaggagactcgcagcaaacaaggactgaagagaggtagaggaaggttagagggggaagagagggagagtagagataatatgacagacaagtcccaccaattgtttttttaaaatatgctgataggactgccacataggacgaaaacaactccgataccccaccagcccaccccctctgttccagtcgatggctaatggggcgttccccagatcgatgaacaattctctccctgcatcagcttgacgaggtgcagacgacactcctcctctacagctcaaaacttcccgcctccatctccattttccgaggtgccagcggctcaccgtcgatgagccccagcccattttcctttcccaccatgcctggtgcgtcgtctctcttccatcttcttccacaaacccacgagcaccgttcggagtgtggggacctgatgggtgtggggacgggggacattattctcctggtcgttggttcagggccagggatggggatgttccaacccaatccgcccttgccctgccccatttcacccctactcttgggaaggtttgcatgggcagccatcggagctccgtagctacatctctactttctctgtttcactaaaaaaataattaatgatttgaatctagatatagcctatatgtagattcgttgttagaagttgattttctattggacggagggagtaatgtcaagtgctctttcagttgttgttgatgtatgaaaaaaggttgttggcaaggtaaaaaatggtatcaaggataaacattggtagcactttactcacctaaaacaacctgtttataatctttatcaagataaggtaaaataaaacctggaggaactgagtagtgtcaattgctctgccgattgttgttgatgtacgaaaaaaaagtagtcggcaagccaagaaattgaggatgaacactagtaccactttattcacctaaaacgacttgcttacaatctttatcaagagaaggtaaattacaatctttatcaagagaaaaattagaatgaaaaataaaacccttatctttatcaagataaggtaaaataaaatccggagaaaccaaaagttgtccttccttcaccagcctgcagactgcagcctatgtgctaccatgttcgtggaacgacgaacccaacagacggaattagttaccttgttgccgatgattaggagggtcatgttctgaaacgtaactacaagtcagattaaatttttttttaccgggccggccaagaaaggccaaccaaatttacttcagattgaagaatatatacaaatatacaaagtcagattaaatcatgcatgtgaaagaaaatgatatgagtatatatatatatatatatatatatatatatatatatatatatatatatatgtgctcatcagtttgattagagttgcttctctagttcctggtaaaaacacattaacaccactttctacgcaaaattaacaatcagttctggattcagatacaacttacgcggcccggaaaagttctcatggagtaggattcgacgagaccatattgatttggttggagctaagagacgatgatggccttgatgcgtctccttgcccatgatcagtagctcggcagagttacctccggtggcgagcgtacatggcagaaatggcataatctgcagtagtaagagggacatcactagaactgcctgcaacccaacactaaggcgagcagctgccatattgaatttgccgacccgattcaccggcttatcttcgctgctgcagcatgaagaggcgtccaatttattgcgcgcaacaaattgtcttatgtgttgacttagttttctcgggttagcaatatatttcgcacactttatatttaaaaaaggcttgctacctccgtttcatacgattcgctttgactattttctagtattttttagatttaaccaaatttataataaaaaattaacagcaaaacgtacatattgtcaaaaaaaagacacggatattaaggaaagatataacatcaaataattagaagggatgaaagcttcgaacttaggtcgtttaacccaccaccttgtaaagctagccggaagacctttgggtgtttctcaacatattatcaaaatatactaaattttagtttattaaaactaatttggtgttgtaaatgtctaaaatacaaagatatacttgacaaagagaatattacaagtatgtttttagaaagcaaatatcacattttctttgggaggtttctaaatgtattctaacacaaagtttttaaaagttcctcctcgtgttgggtcttagcgagcacagctagagtccaatgggtcatgggtgatgggagtaacacccgacctccaacatctgtattggtcattttttacacatttagaaacaacattgaatttattgtgagataataataaaatgctcaattaatgcacattaagttagtaaatagtacaaaatggttagcgtacagaatacatcgatggccatgattaagcatgcgagcaatcaaatggttcctttttgtttggctcaattcatgttgagttattggtttcaattatatagaaatagtagaacttgcgtgttgaaaagggataagtagacaaggctgataaacagagagattacatgcaggtaactaaaataatactagcttccaatgttgactagaatagtttgatttccacatggctgctttttgactccctcgctatcttggcacacttttggcatgcgctctattcaatgaaacaacgtacgctgtctgatgctgttcgttgaaaaaaaaatacccgtaaagtaaagagtatccttctaaactaggttgctgactgaccaatagagcttagaagactgacttcttcatgtcatgtactcatgtcatgtatattgactacatggcattgatcgaccagaacagttcaaattatacatggagacccatatcagacctgttgagatgggtgacttttgctgatcaacgactggttattactctgtttagccctataagggcatggtttggatatttcatgttgttatccaaatcttgttcttaggcacttgtagtttttgttcatgtagttgctagtaattgttactatatccatctcaaaatataagaacataaaattagataggatattttctagtactacaaatatggacaaactgcttgtagattcgtagtactaataaatgtttcattcaattttaagttctcatattttgggacggaggaagtaacatttacactgctatgtactaggacattatgatatgtagatgcaattttttatatgcaaatgacggtttttagatgcaaattattttaggaatattatttattgatcatgtttggaagactaactatcaatctgaccctgcattt

SEQ ID NO: 67926 - DNA, 1204 bp, Oryza sativa
ctccgcgcctcgctccccgtcgcctcctcgctccgcacatcgctccccgcgcgcatcctcgctctgcacctcctctcctcgcgacgatccaccgccggaccagcgacctcgcctcctcgctccgccgcaacgtcggacctccctcttcctcgcaacggttcagcgacggcgcaccaccgcaccgccataccagcgccgaggctgccgccgcccacgcctatccgccggcgccggcgccgaggaaggccccttccgccgccgccgccaccaccatcgccaccgtgcactcgaggtcgtccctcttccccatcggctgcagcctgagccgacgtcctccccatccgccaccgccgctgccgccgacggagccgaggtcgtccccagccaccgacgccaacggagccgaggtcgtctccagccgatgccgccgttttcctggtatcccattcctagcatcaacttgataatgcagcggatgccctcactttctcatctcaaataattaacaaagtgcgccattttcagctctgctactggttgaagaaatcattcctggcaagcagttgtggatccctaattctggagttctttctccttcacccatgcttacatgctgccatcctcgattactaccaccatggctgcgttgcaaggttgcaacacggtggtggatgtggacttgacagagcagtagcttcacataagtgctttgttatgttatcctcatgaggaagagattgaatggattgagggggattaatttcaggctcaatagatttggaataagtaccttccaaattcccctcaatccacatggggatggatgaactcaacaaggccgaatgcatctcaaatacaagttgtgatgtgaaggtgataatcaagattggaaaacccaggtaagatatgactttaagtggtgcaagttaatcgtgatagcaaatccgtttagtcttattaggaaatgtcatacatgaaagaatgtgattgacaaaaatatttttttagccttctgatttgcagatgctttattggagttgtgctgctcctcgcgacaaacatgaaatggagaagagaagggtatactcacatgcatatattatatattgatatttggcctattgtagaaactattggttttaagcatacatgccctaaaaagcatatggtttctatagtaagggttgataactccatattgata

SEQ ID NO: 67927 - DNA, 5576 bp, Oryza sativa
  unsure (1)..(5576): unsure at all n locations
attctttggtgaaagagctatcatgtaacacgagtaacataagggttcaggcccatcagattacgcaatctgcggcacagtcattcaaatcaaaaccaacaatggaataagacaggtaacgcatatttggcatagaaaagtaatatcacgaggtagcagcagtagtagtatagtcgcacctggtggagtaatctgctggggcaagaagcgaatgtacgtaccaccaaccacaccatttgcgccgtttgcggctttgcgcgtcgataccccacgaaagacagaagaagaaagcgaagagagccaaacctttgtcttcaagctgggaagagcgccacgcgaacccgcgaggcgttagctgtcacgacaaacgccgactgtaccaggcagcgacgcaagcgtgccgatgataaacaccggagtactccctaatactaagtaagaaaatcgtttagaacaatgtttaaattaaactttaggaatataaatcatgaataactcaagttgttgagtttgaaaatgtaaaaatttgtcttgaaaaatatttttataaaaatatacatataccacttttcaataaatatttttatataaataagaagttaaatttatgctttgaagactgtgtcgctgtccaaaataactttctttacgagtatagagggagtacagtagtagtacgtggaaccagcccgacgcgcgcgcgcgccgcgcggcggatcgcgacacgaccgggagacgcctcggcccatctgtataatttgagccacgcaatctctactgtacatgcaggcgcacatgaagggaggtggtaacgttgctggcgcgcgtagtgagacatcgccggccgcgcggggcgcgacggggcggcggggccagctgaaccaacggtaactggcagcggttggcgtctcgcgacacgtgaccgtgacggcgagctccgcgacacgatgtggggtttgggtgtgcgtgtgcggcgcgggccagtcctcccgttggtgggtcgcctttctcttggctctgcgtgctgcaaagcgaaagcatggccatactcgttggtcagctcgcctcgtgtttcgtcccgatttacggtatcagcggtcgggtccagccagcccaggatcgaggaaagggaacaaatcatcgatactacggctatgtttagagctgaaaaagttgagaggctggaagaaagttgttagtttggagaaaaaattggtagtttatatgtgtagtaaagtttttgatgtgatgtaatgtgatgaaaagttaggaatttggggaactaaacacggcctactagtacatactccctccgttctataatacaagagattttaagtttttgcttgcaacgtttgaccactcgtcttattcaatattttttgaaattattatttattttatttgtgacttactttattatctacagcactttaagcacaacttttcgctttttatatttgcaaaaaaaaaaattgaataagacgagtggttaaacgttgtaagtaaaaacttaaaatcccttatattatggaacggagggagtaatttttttactgttttctttagccaggaagactttttacagtgtagtgttattacgactgggcgctatatttgctatagcaaagtgagtagtagtactgctgctcgctgcctttgcacaggctaccaccgcgatcgcgaaataccggagtgcgggcactgtgcggcaggtgatcagcaggcaggggcgcagggcattcacgtttcacagtagtgggcatgagcgcgctgcggaacaactgtcacacactcgcacctgaggacgcgatgccaaccaaaatgcttcgacgatgccaaccaaagtcgcatggcgcaccggctgcgtcacaactcacgactacaccgcgccgccgtcgcttgtgtagttgtgttgaggatgaatagagactatagaagtacatagggaagccgtgatctactcgacggcgaacatcgggatggcctttcggcctctgacgacggcgagggcgttgggctgtaattattagcctgtaaagaagcccagatggctgtcgactgggtggcctacatacagttttgggcagcaggcgaagagaagatgaattgggccgtaatggtgatttgagccataatggtgatttgggcccaatacaaatttcgcgacaagaaaggagcccagagagatggcgggcctggggtgcacagcaccgatagttttattgggccatcatggtgaattgggcccttataaggctccgaaaaataagggcctgttcactttgatgtcatttttaaccttatcaaattttagtaaagttgccaaaaaagtggctacatttagtttgctgccaaattttggtaactatataagaaatcctgtcaaaattttggtaatgccaaaatttggtaaggttttttttttggcatcaaagtgaacaggccctaactttgcacttgagcacccaaagaattctgaacaagtctttttttcagattgttctgcagggagaataaccttacagtcttacacagcggcacatagcaacttgcccaagcttcttgaagccaggggatccagatggccttaatatattcttaggtaaatctccagcctattcttaaaaaaaatggaaaaaaaagaaattctatgacaagtaacatgcaaatgcagctttacaggagaattcttttctggcagtagccaacgggactgcgacaaccttcacggatctatatattatattattaagacagctcgaaaagaagacatcacgttcatcgtggaggctagaaattcccacattaatcgaagaaaaaaagaaatatctacaccgttagatcgtagtgggtctagattataatggttcaggttgagctatgaatatatagaaatattactgtctttctacaaacggataaagagttagagaaataatcatacacagcaaatatccccacacttttgctgtagaatgaatcggataaaacaagccgaagcagagttggattgcatatatgtttgcagccggattaacatgctgccgtacatgtgctgtccacataagcattctcatgcatgtcataacataccagtggacctacaaatgaaacaagcgatggagcaaactagcaagctgttgacccatacatgtttatgtagcctgggtaccatttatattggattcagtatcatctggattgctcattgcatgtaaattatagccttgcatgtatatatacaactacaaacatttactccctttgtatccctaaataaatcgttgactcaaaatattattgaaacactaaaatatttacatcattaagacatagcaggtttagatttccatctcgcattacccagtctatagcgaatttcctactcgaggtcgtgctcgcgaggcattgaagctaacaatcgtcacctataactcgaggcattataggtgtcaggttgttaaccctaactagcatcatatnnnnnnnnnnnnnnnnnntcacgataaagtaaccatttatggtaaaaaaaccaatcggcattaattctggaacgggaaaagcaaaaccaacttggtttgcatttatcaaaatcagacgatcagcttaaatctcaagttggcaactagaaaccacatgcatgtatatatgtatcaaccgttagttgtggtgagcacacgcacggagtctgttcgatgctcaacatacacggctggaaaacataatcgattttttcaaatcctaagacaacgattaacaaaacttaaagaaaatcatgcgtaaaaaagttagataattttatatggcttctagcagcataatgtgaggaccacctagctattacaattcagaaatttccagagccatcgtttcgcggcatatttgcaaacgaaaagtaatttgtgaataaaacttatatatatatatatatataaaggttgaaaatttaaattttggcagataagtataaggataaacgaaaagatgaggcccttcgtatgtggaagctagaaattttgacattgatcagagaaaatataagagtttaaaattaaagatagtccatgtataatacaatacaagattaattaaaattaggaaaaagaatacaatcaattcgaaaatggaaaaggagaaataagagttcaagtagaaataaaatctataaaaaaactaaatttcagaataaataataaataatattaaaataaaagaccatctcgaacataaacacgagattaagtataattcaatataaaaataaataaattcagtaattataaaaataaaaatattagttcaactagggagacaattaaaatttggaataaaaaataatttaaaaagtccatgtagaaaataggagcacaaaattaattaaaatttggaataaaaaataaaaataaaaataggaataagaaaaaagaaaataagagtaataatataatttataaatagcacatatacaaaatagaaaataaagaatattaaaaaaagtctatctatgataaagggtggcaaatgacgataaagaatgggacattatggaaaatgactatacggaacgggatatcaagcaagccgtaaaggggtaggatgataacaattgatgggacatctaatactatgaaacaacacctaaatgatgattagattcaatttttagaatcctaatgacgattaagaggaggggcgacagggtggctgtgaaggagtattgtcgcgatggttgataagacttctaaaaagtaaaaaaaagaaactaatgataatcaagtttaatttttataatcccaatgataattaagaggagtacaatgggtatgccgtaaaggagtatagtggttaagtttgataggacttctaaaaactatgaaaaagaaagcctgacgagacatgtttttaaaggttccaaagggtgatgaatagaagtcgtgataaacatgataagaaaataaaggggaggctaaggagtgtggggtgccgattagtgttacttttaagaattactactataaaatgatgatgataaggttcattttcaaaatatgtaagataacgagatgactatttagtaaattttaaagaaaaatgtgtgtaaaaaaataattttgaatggaagctagccgcgcagttgcgcgggccacccagctagaaattcccacattaatcggagagaaataaaaaaaagaaaaggagagtccaaatagaagtacaatctaaaaataacttaaattcgaaattagaaataagcaatatggaaagaggagtccatataagaagccaatacggcattaatcaaaattcgaaataaaaataaaataaaatccaaaattagaaaaggaaaggagagtccaaaaacaatatggaaagaagtgtccatataggaacccaataaatccaaaattagaaaaggaaaggagagtccaagtagaaatacaatttaaaaatagttaaaattcagaattaaaaataagcaatattgaaagaaatttccatataagaacccaatacgagattaatcaaaattcaaaataaaagtaaaataaaatccaaaattagaaaaggaaagg

SEQ ID NO: 67928 - DNA, 10195 bp, Oryza sativa
taaaaaaaaacccaatgataatcatgttcgattttaaaatctcaatgacaataaagaaggaaggcagcgagcgagccatagatgagtataatggcaaagccgctaacggtttggcaggacttctagaaagtaaaaataaacccaaacaataattattttttatttttaaaatctcaataacaataaagagaagagacagtggacgggccgtaaaggagtataatagcaacgtttgacgggatatctagaaattataaaaatgaaacccaacgtgacaataaactctaaaaactataaaatccaatttttaaaggttccaagaagaatgaatagaaatagtggtagatcgagcaagcaaataaataatgagatgacataaggggtagcaactggtgtgacttttaaaaactatataattagaaacacgatgatgataaggtttggtctttcaaagtcttaagacaatgagatagctatttaataaattttaagttaaatcatactaaaaagtatatgattttgtttaggtgctagccgcgcaattgagcggaccacccagctagtttggatgataagagcaccataaattcacaaccacgtttccagtacactagtattgttgatataatccaagtcgataaccccaaccgaaatgtttgaaccattaaaataagaaagcatctttgaaaacgtgctccaagaccttcctttctcgcaatactccagtatggtagtactaaggtggctgcaaagcttggaacaataagcaagtgttttcccctccctcttgcgcaccatgggaaaaaaaaattctgacgtgacaaatacagctactactcgcataaactacactcaccgtcgtacaccactagattgtatttaacgcagcaagttgaaaaatgttagagcaaaaacaacctccgccattccatggcaacgcacatttttttactccgttttgtttggtcatactcctgcacgtcgtccagtgttccaccagctcgacggtctcgattgaccaggcctcgcccgcacgcgagccgctgactcttcccggctgttcactctgcggccacgtccttctccgccacgtcatgctctttgctcacctggaagattttggtccaccccgtcgacgacgaggtcagcagcatgctgctgcgcgacgtcggcgtctcgctgtcgtcgtcgtcgccatcgagcgcgacgggcatcgcgggccacatgaacgccggcttcgacggcggcacgtgcggcggcggggcggcgcccgtcaggatctgcaggatggcctgcgtcctcggccgctccccggggttcgggtggctgcacgcgaggcccagcagcaggagccgctcggcctcgacctcgtcgaactcgccggcgagcctctggtcgacggcctcgaggatgccgccgccgccagccgcgccgtggagcttccagacccactccagcaggctgagccagccggggaggtcgctgcaggagacgcggcggccgcagacgatctccaggacgacggcgccgaagccgaacacgtccgactcccgcgtcgcgcggccggtgtggaagcactccggcgcgatgtaccccagcgtccccgtgacgccggccatgtcggtgtacgacgtcttgtcggactcgagcgcgcgggcgaggccgaagtcgccgagccgcgcgttgaaggcggagtcgagcatgatgttggacggcttgatgtcgcggtggatcaccatctggtcgtactcgtggtggaggtagttcagcgccgacgcgacgccggcgacgacgttgtagcgctgcttccagtccagcgccgccgcgcccggctcgccgaagatgtgcctgtccaggctgccgttcggcatgtagtcgtacactagcaacagcctgccattttggcggcaccaacctgcagacgtgcatgtcgtccaaaatgtgtttagaacttgcttacagaatttcgtatcattttgaaatttgaaaaatgaagactgaacgtacggtgtttgttttgggatatgaatgtctcctcttatggtgaattggcagctaattaaactatatatatatatagagagagatgtgcatttgcatggctgttccaagttccaactaacgaacgctatatttcttctaacacaatgcaagcaaaagatcaaatcttgcattatcatattcccaaccagagcactccaatatctatcttatgattcaatctgcttgcaaagacgtcatggactgatgattcaattttaaatttagctgccaagtggcccaagttgccacatagcgtggtgagcttcttaaaacatctatttgccgtgccaacttgtgtgccatctcagaatattatttcctactccaaattattagacaaaccgtacccaatctaatactctaatcacaacttcaatctaaactaagtatccttttcggttaaccagaacgagaaatgatcgcttaccgacgatcttgacgagattgcgatgacggaggcagttgataattctgagctcggcgaggaaatcctccttccccttggtgtttgcaccggagaactgcttcacggcgacgtccgtgctccggccatcttccccgaccacggtggcgcggtacaccacgccgtacccgccctgccccagcttcatcttctcgtcgaagttgttcgtccctctcctcagctccatgtagtcgaactccttgggcaaacctgggatcttcctgaaatcaatggcggcgttgaacgccgagctcgggtcgccgccgctccgtctcctcctcttccggatgtacagcgcggcgaccaccccgagcaccacggcgacgccgcacaacacgccgacggccaacttccagccggacgtgccggctagcttcgtggcggtggtggtggtgccgtcgtggagcctctcgacggtcatgttccacatgcgcacgcagttgagctggtacgtcgcggcgccggtggacgccgagaagccgaagtacgccgtcttgccgaggaggatggtggagaggtccagcgacgcgttgagcacggcggcggagggcttgctctcgttcttggcgatgtacaccgacatccgccgcgacgtgccattgtagtcgacccagacaaagcagatgccgtcgtcgacggtggtgttcctgggcgcgagctggatacccagtggggcgagtggcgccgcggcggtggatcggacgccgttgacgtcgaggccgacgtggttgtcgtcgatgtcgtagcgctgcttcactgtgtccagctccacggccacgaacccgttggtggcgttgccgtcggtggaggcgttggtgaggccgaggaacccgccgtggctaccgaccggcggcccgcgggcgttgctcgacgcgacgacgaacgcgagcccctcgcccttgaccgtcttgttcaggttcgagcggaacaggttaaccttgaacacggtggagaacgaggcgacgtactttccatcggcggcagcggcggcggagttggacgacgacgacgacgacttggattcccagacgacgaacggggcggtgaagaaggcgtggccggcctggttgacgaggaatatctcgggcctgttgccgctgtccggggtgagctgcaacccgtcctgggcgatggtggcgttgcctgagaaggtcaggttgtcggggagctgcaacaggggcttgtcgaacttggggaaggagaatgtggtgaactccttgccgtcgacgttgctggtgaaggtggtggcctgcgcggtggcagatgggaggagcaagaaaacggacacgcaccacactagcatgagcacggccatggcggcacggcggagacggcgcagaagcaacatggagcagtggagttggcgatgcataagtaaagggagatggagttggtgatgtactgatgtacagtcaagggggtattcgcgggaaggaattggtccagtggttgtcgacttctcccacttgcggacttgccaatcgtgccacctgccacatacattgtacataactcttcttctccaagagtccaagagagaccatgactgaacaaagagaccaagacagactgggaccagcaacttccgattgggttatgccgaaggttcatgcccttcttcggaaagcacattagcatcctttggaagttcatgacttctccgattgcagatttgcctaacaaaatacagagaaccaattggctccattaacatttgcatggtctacaatggtcaggtttgatccatgtattgctggggtaagtaatatataagcatggaagctctcacgttgcaagccacagatgtcagatttgctcccacaggtttgatccatgtattgctaaagtttgctctcacgttgcaagccacagaaaaggcagtgtgacagtgtaatgtgaagtttaaggtccagtgtcgaccagcactaagacaccgttcttttcagaaacttgaacgtgtagctttctcatcttcaaactgtaaacgatatattttgtgctttttttcacaaaaatcaaataattccatttcctaaatttataataattaatagttagttattcatgtgttaatgactcgtgttattttacgtgccgtaaaaactaacctctaacttgaaggatcgaacgcaaagaggaacatgttgcacgcgagtataaggagcaatcgcctatcatgactaatgcttacacattccgctatttggaagtgatcaagccaccattgttacaccaattgagaacattacagcttgacatcaaagtatgaagaaaatgaaacaaatctaaacaccagtagtcttgtactccactgtactaaagaagctcccagagcaaaaaaaacaaatggaaagctcgatagcatattcatggacattatttacacctttcatccgtcccatctttgttctcaacgttgtcaccaactccacggtaacgtgccaaatccgatgcgatgggtcgggtcccggccgcacgtgtgggccgtggactcgtctacggtcacaccgtcgccacgtccctgtccgccacctcgtgctccttgctgacctggtagttctgggtccaacccgacgaggacacgtagtacgacgacgacgagttcatcaccgtgctgctgcgcgacgtctcgtcgtcgtcgtcgccatcgagcgcgacgggcatcgcgggccacatgaacgccggcttcgacggcggaacgtgcggcggcggggcggcgcccgtcaggatctgcaggatggtctgcgtcctcggccgctccccggggttcgggtggctgcacgcgaggcccagcagcaggagccgctcggcctcggcctcgtcgaactcgccggcgagcctctggtcgacggcctcgaggatgcggccgccgccgccgccgccgcccgccgcgccgtggagcttccacacggcctccagcagctggctgcacccggcggggttgctgcaggagatgcggcggccgcagacgatctccaggatgacggcgccgaagccgaacacgtccgactcccgcgtcgcgcggccggtgtggaagcactccggcgcgatgtaccccagcgtccccgggacgccgatgatgtcggtgtacgacgtcttgtcggactcgagcgcgcgggcgaggccgaagtcgccgagccgcgcgttgaaggcggagtcgagcatgacgttggacggcttgatgtcgcggtggatcaccatctggtcgtactcgtggtggaggtagttcagcgccgacgcgacgccggtgacgacgttgtagcgctgctgccagttcagcacctccgactccggcccgccgaagaggtgcgtgtccaggctaccgttcggcatgtagtcgtacaccagcaacaagacgccattttggtggcaccaacctgcagacaggtcgtccaaaatattttaggattgtgtattttggtacaccactagcttattatcaatattgaatgcttatcccaagagatagaattgtgtattatttttgaaacgtgaaaaacgtagaatgaatcatgttggttttgtcaatgacccaattattcaagtcagagacaagtggttattctcaagattaaaaaaattaataggatttccttaaaaaaaaggcttaattagtgttgcaaggtatacagaccgttctacaactactccgtaccaaatatttttctccgaacaacaatgcaagcgacaaaacgatgtcaaacctttgccttgatccaacctgtattggccatgatccaatccgctcggtaatcggtgggaactggtcagtgtttaattttgaacttaggtgccaagttgccatgtggcgtgctgagctgctaaaaatatctactagtacatctgttgtgtgtaattatcttagaattttatctgctacttttcttgagataaaggcagtaatcgttgtcgtggtgtatcgttttcatgtgattgtgggtatgaaaaattgcttacttttgtctattctcagacggctactgaaatttccgacggctcggaactcggaagctttcattttcacgcaaccgtacgaaggaaattgttgctgagaatgtaacagttaaaaattggcacgagtagacaacatctacgcggtctaataacaagtacaaagtacaaagtctaaacttatcggagcatccatttcaataaaagcgaaaatatttcaaatcaaatcaaatcaaaagataatctggcgatttgggttggcatttattaaggtgatgttcttgaggaaatatttcatcacgaaattagcagttcatcagggcggcatcaatgtcctactcagctattcttaatcactaaatcacaaaaagatactatcatgcatcgaacaaaaacataaacaatatcgagctaagatttgaatgttcagaaaagtagtagagcttaccgacgagcttgacgagattacggtgccggaggcggttgatgatgctgagctcggcgaggaaatcctcctgccccttggtgttggcaccggagaactgcttcacggcgacctccatgttctggccgttctccccaacgacggtggcgcggtagaccacgccgtagccgccctgcccgagcttcatcttctcgtcgaagttgttggtccctctccttagctccctgtaatcgaactcccttggcacacccgggatgctcctgaaatcaatggtggtgttgaacacggagctcgggtcgtccccgatcctcttcctcctcttccggatgtacagcgcggcgaacagcccgagcaccacggcgacggcgcaggatgacacgccgacgaccaccccgagcttccatccgggcagggccgccttcttcttggtggcgccctcgtcggggagcatctcgacggtcatgttccacatgagcacgcagttgagctcgtacgtctcgccggtggacgccgagaagccgaagtagcccttgttgccgcggaggacggtggagaggtccagcggcgcgtcgagcaccggggtcgagggctttctggtgtcgttcttggccatgtacacccacacgtgccgcgacgtgccattgtagtcgacccagacgaagtagttgccgtcgtcagtggtggtgttgctgggcgcgagctggatgccgaagggggtgagggaggcggaggcgttggagcggacgccgttgatgtcgaggccgacgtggttgtcgtcgatgtcgtagggctgcttcacgctgtccagctccacggccgcgaacccgttggtggcgttcccgtcggtggaggcgttggtgagaccaagatactcgccgtagctgcccggcggcgggttgatggcgttggtggacgcgatgacaaacgccagcccctctcctttcatggtcgtgtttgatcggtagaggttggccctgaacaccgtggagaaggaggcgacgtacttgccatcggcggtggagttggacgagttggaggaccacaggacgaacggggtggggaagaagacgcggccggcctggttgacgaggtagtccagaggattgttgctgctgtccggggtgacttgcagcgcgctctggctgacggtggcgttgctggagaaggtcaggttggcgccgagctgcatcagggacttgtcgaacgtggggaaggagaaggtggtcgccttcttgccgtcgatggcgctggtgaaggtggtggtctgcgcgcgggcggaggggaggaacacggaggcggacacgcaccacagcagcacgacgagggcgcggccggccatggcgccgcggtggcgacggccgggaaggcccatacggaagggcaggtctgcggaggagttggccacgaaatggagaaaagggtgggggttggtgatgtagcaaggggggtttgctagctcgcgagccgcgacttataaatggaagtggacggttggttgcttccttgctcgcgccattccattccccagatctgattctctgcttgcagaaactctctgaccttcctactgatccaactaacccgcaactgcaaggctgcaacgcaaacgtccataatatgtactgttttttttccctccctcttaccgcgtcatagacaaaatgtccgtgcaacagcgatcgtgactccatccggaaagaagaaaaatagtaggccggtttgttgctcggcatgtcactgtataatctgtcaatgggaaataaaatagtaaatgtcaaggcatatatcaatttcagagtacacaaaattcagatgtctcaaacacagctaacaggtttctcccaaacgaaataaacaagatcaatttcaacactggtactgttggttctaaaaaaacaatgagagagaaaaaagaaaaaaaaagcaaacatactcataaaacacccggcgaaaacatactcatataacagaagcttgcacagaaaaaaaaaagtgattacctgcaggcgaatggctattacctccacattaaaaaattggaatcctgaaggttagaacatgtgctggtgtggctccagtgatgtttttgtctctgtgcagaaggaacgggctaatctctcgtcataccgatcggccggtcaatggtcaattttcatttgctcccagcgttgcgccttcctctatccctggtcaaagtcaaacccttgtgatcatctctctatctctttctcaaatttcaaacagggttttgcccaatgagcaagcaatgtacaccctgatcaatctcccgggaaactattataaattctcaagcgatatcccttattatttacatgtcatctaaatgattataaaaaaattaaaaaaaaattaataagatagattaatatgtgataaatcactccacaaatatgtagggtcaaatttaactttcacaagttgtaacgaaaaaaacaaatttgactgtgaaaacacgttaactagccatagtgttttctatttttttttcaacatgtagaagttgaattttaacttgcatatttgtggagtgatctatctcatattaatctatttggttgaattttttttattttttttcaaccatttgaatgatatataaataacgacggaatgttccttcgagaatttagaagcccctccctcaatctcccttattatgtgttttctttcagatgtatgcgcatctacatgctcaagtacagagaacatacgtgccttgtagacttcttatactagttcaatcactgtcatgtattagtacatagatatacaacatcatatgactagaccaagggtgtgtttagttcatatcaaaattgaaagtttggttgaaattggaatgatgtgacggaaaagttggaagtttgtacgtgtaggaaagttttgatgtgatggataagttggacgtttgaagaaaaagtttggatctaaactcagcccaaatgtagtttttgagtttgatgtgaccggttacctaaagtgtctggattagggaaattccttcgcatggacccttctgcgaagcctgctggataggcattatctttcgaggtagctctcatctggagtccggacctggaggtgcctttcactgctctggccggcaaatcctgcgtcagcaagctacaataaaaattgcaaatctgacgtatatgatcatgacgaatgattatccattttcctaaggccttgtttagttacaaattttttcttcaaacttccaacttttccatcacatcaaaactttcctacacacataaactttcaacgtt

SEQ ID NO: 67929 - DNA, 9086 bp, Oryza sativa
ccaactgcacacgcatcaatacactacggcacatgggggcgtcaattgtatgagttcatgcatagctgttactatctctaagaaaatagtgccactcaaaccccgacaagcacggttcggccagtcagcgaaacgacttcttctagtaagtgaagcagattttagtagaggtaagttctaagtaaagtgactgcaaaccttggtacgagaacatgaatgtaccatagcccagaaattcagcaggttttgtagttctctaatacaaattgcttctcttcttcttgagttaaatgtcaggtactgcctctcaactaagaagagttgacagcttgacatgtttatgtccaaggcatcacttgagaaattaccttgcttcacctgctggacatcaagagagcaacttaaaaacctgtcaaccatgcaataacaattcaacgacagctcataatggcatcagctgtggtttaaatttgtgtacctgtgtcgtttatctttacctctgaatacaaatagacaagccccctttcattttgtgattacatgacacaccttttaattaatactggggagattggtaagcaacatcagcaataatttgaattattgattttttaagtaaataattggaacaaagatgaaaattaaaacatgtaggaaaactacatttcttattaacaaaacagataaaaagcacacaaattggatcaaagtattaaacaactcgaaccaaggtggtggtctggtggagatgtacactccaccgagttaaaattagttctaccgaatacctggtatagtcctgcttgtacactttcagtacattttactgaaatatcaggaagactgatcagtaatcctcacagaacatgaatcagttgtacttatttattcagagtccatttaaactgagcaaagaaccaactagtaatgtgcaactggttgatttatataataataagaggcaacaatttcccttgtgaacacaactgaattgtctcagtttaactaagcctgtggagtcatacctttaggaagtcaccataaatgatgcaaccaaatctgtactatttcatatgaacaggagaataaagtcagcatggcatatttaatcaactgatttcttcaataatgaggtacccacacgcgtaattaattagatttctctctgagcaagtgtttcagtgatatagtatttttgtcatctaaccataaaacttaaaaaataacatactttcagtgattccatccaattaatcccgctcagttcaagcaaaatcacagcatacatgacaaacacttgttttttttgcaaaaggtctcttctgaaaataatttatcaagaaaggtcaacaaaccaatgaaatgaagatgcacatcgatcaaaaatgactagatcacctgcttcttttgatttcggtatcttgatggcttggcatcaagaaaaagcatgtgactggtgtcattttttttattaaaaaaaacagtagtctatggtagttggttgccacagtggtatcaggaggaaatatggtaaaaagttctgcatttcagtctttcagttgaaaagtgttttagagcccagtgcactcacttcttaagagctgccgatttactgcttcaacaagattaacatcgttgaagggttgaatcatacaaaaaaaacaaggataagcttggctactttgtcatcctagtcacctaattattataacactgctcagacataagagctgcaagcgtatgcagcttgtgtcacaattgtatcacgaataagcaagtagtcaaatcaatcttatatggccaattagcttttgtcctgtgcattacctaatgtctcgtatattagaaaaaaaaaagaggatcttatcatcaactaccattgaaacagcaaatagccacgttcgattataccaaactcaaagtttcataacggacgtagctaatgagcagttgagtccagcaaccattaaaaaggccatgctaatttagtactattcatgtcaatttgtagttaaatgcgtccaagcagcagaggaaatcaacccgccgcgaggcacaagtcaatgtcgcgacatgccaccaacctgaacagcgcgatactgccgagcatcacatccagattttatgcagtccaacggaagaaattgctgagataaacgcgtgattctagagtgaaagcgcaatacctgaaaacgacactggaatttgatcatttgaaccgctggtcacacatcgatgcccagccgggcaattcgacgaacaccgcaggggcatgaagctagacacagcggtgttccgcgagcgattgtgatcggcaacatccacgtagatgagaaaacaaaccgagaaaaaacgacctttttatcagagagagaatcaaagagagtcgaaaggagaagagaattcggagatggacgaacaggcagaggagcagcggcgtgcggaagagatgagagacgaacaaatccgcggagaagttgacgccgtactgccgaagcagggcgatgcgtcccaggagcctataaaagccctcttggctagccagcctagcccaacctgacttccaccgggaggagttggattctgcgtccccggctcgtcaaactcgattgggcctcggcctcgcttgatctgctagaccctgtcgccctgcgagttgtggaaaaagtacaccgaaggtccctcaacctgtcatcgagttacaaaacgttccccaaccacaaaaccagatatatggcatccctcaatttataaacgggaatgctagggttatcccgtcccctagcaggatactcctcctccacagatgcgattctcatccatgcgacgcggctgaaggcatcaacgcgcgcccgtcccccgccgccgccgtccacgtcccccatcgccgccgccatcgccgccgcgcccgcccccaccgctgccgtcgccgtccctcgccgccgccgccgccgcgcccgtccctcaccgccgccgtcgtcgccgccgcgcccgctgccgccgtcgccgctgcgcccgtccatcgctgccgccgccgtcgtcgccgtctacaagggacgactgcaggtggccggccgcgcgtcgagatgctcctctccccaacgagatgtccagttatatctagtaggaatcacctaatacctggtaggtatcatccgatacctagtaagtatcgcgtgatacatagtagaaatcatcgatatctgacatgatacctcgtgagtatcacgcgatacgtggtagaaatcgtctgatatcttacaggtatcacatgatacctcgcgagtattacacaatacgtggtagaaatcgtctgatacctgataggtatcacatgataccttgcgagtatcacgcgatacatggtagaaatcgtatgatacttgataagtatcacatgatactttgcaagtatcacctgaaacatgtgtagaatcgtctgatacctgataggtattacacctgatacctactcgggatcatcccgttcgaaaacgggattccgttatatagtagccccctttataaaaaccattcactttgggtccttcagtggttttgaccccggttttgtcccacgtggcggctgagtcaacgtgagacccacgtgggcctctgttgacagaaaacacgtggcctaggagatctgcttaactccagtgcagatccaaagctcgccttcagatgtgttagcgtgccagttgatttgatcctgtaatcaacaagaaatataagcaaaggaaccgtggttaaatctataaatgatagccgatcggctagatgccgatgacatatcatttatctttaagccgatgtcatctgtgcatcgatcgacagtcatgaataagtaaagaagaactaaatctactcgatcggctgtagatattcacgatatatactccttatatcgatgtatacttaaatcaagtgattgggatagatcggtcatcatgccgagacagtataaatcacttagatcgaaatatatatcaataacaggactatatatgtttatagcatagccgatcagatagatctagcatgtatcggctaatactccgatactactctatatcaggatattaaagtaagaataatatactgaacaagagcctaatatacttagacacaacaatatcttgatatagagggcagatttaacatgtcaatgaagcatatagaacaaatataagtaaatcagataagatcggctgaaactctgacgctattctaatcggcaactagaaggcaggctatagatcggtattctaagcacgactcaataggtcaaactcaactgatacaacattaagtatgaaaagaataacgatatctagacaatcaagccgctagaagtttcatagaatggtagatatctcttataatctagatcaacatcaagatctaacccaatcagctgccctctgcgtacagatgttagccgatagtagattaggtggcgatattgctagagattatataagatatatgataactcgacgaattatataaataagattagagtatcataaagatggaagcactaatcgtaaaaacataatccgtcataacgagttttacctcttgttgaagatcgaaaccaatgcagctcaacccgaaagcaagaactcgtcgaaacaaaactaaagcaaaagggtggcgatgcgccaagattgtattgaacgtgtgttgttaattacataaggctcggggtctatttatacctgagaattacaagatatgcccataccggacacgactattatctctatcaaactctaagataccacaagtctttgcggcagacttttgcctatatttattgacggagcgtggggctcctcaccgggagaccgcgcaggcccccctttgccggttcggccgggggcgctaagtgaggttcttcgccctcgatctgaggaacgtcagcgagagaggaagtgcacaagacacgggcgacgtagacaggtttgggccgctgagaagcgtaacaccctactcctgtgttctggtggatctgtgcgtgaaggaatacagagagccggagagcgagagagagttcaggctctagcccccattcgccagagtcccaacccctcttcctctttttctcctgtttttttctccctcctctccctctcctaggcctgggcctcctttttatctggtcaggggtcaccacatgggcctccagctgcctaagaaaggaaacatgctttttacaatgagggctagtctacagccggaagtgacctctgacaagcagagcacacgcctcctgccccgctcgccagctttcccggtggacgcccatttcaaccttcattcaatggccagcgacttccttgccatgcttgcgctgaagcctggaatggatctgaccgggactgacataccaactccaagagttagcacgccggctccggctagggacgagagccaggaagctctcatcatttcgacgggacggggcgaggcgtgtgacaggccgcctgttgccacctaacccgcgatctgaccggtctgtgaccggtcacacaccgcgaccggtcacggaccggataagcgtgcgctgcgccgcattaaatgcggcgtggcgcgctcgtccaacccgctataaatgcggttaggtgagccccgctgtgctcacctaacccacacacgtggcgccaaaaccacagggggtcggggcgccccagccctcggggccgaaacgggggcgccctagccctcggggccgaaacgggagcggcccgacccctcggggagacagagggaggggtggccacgtcaccctcgggcccgaccccccccccccgagggggtcaggccatgtgggtgaccgcggctacccaagcctctagtcacgatacccccggccccatgtcaccgacatttatctataaggaatttacataaaatattctaattaatagatacaattgccttcccaggactctattcgtgcgtggcaatcatcttgaaatacattaacttgaacccgatgtcgcgtacgattcgtattgtcggaatcggctgtatcggcttactcaacccgactcagacccagctgatcctaatcgtagccgatttggacttcagccgattcctgctctgtttccgaactcgatctccgcctccaactttgctttgatccaatcttctttcctgacatagatgttaccaaatttggttgttaacagccccacattgtcaagatgccacatcagcaccctccctcttcattctcctctcccttcctcctcctctctctctcactcttctcttctcttctctggcaagccagcggcgctgctggggaggaggccgccggggcgaggcgagaaaggaggaggcggcggctgcgacgcgagagaaggcgagggcggcggccggtcacgaatggtgttgtgtcaccaccggcggcgaagcggccccgcagcgttgggcgatgaggggaacggcggagcaggcgagcaacgacggagcgggctgatggcgcgcaggcaggcgaagcggggcgacggcgggcggagcggcgacgcacgcgaagcaagcgggggtggcagggtggcggcgggtggagtggggtgatggcgtaggaaggcgaagtggggcgacggcgggcggaatggcgatgcgcccaaagccggcggggcgacggcgcaggctggcgaaagccagcagggcggagcaacgacgcgcgaagccaaaggggcggattgggtggcggcgggtggagcgacggcgctcgaagccaaaggggcggagcagcgcggcagcgggcggagaggtagcaatccgccgtcggagccgatccccacagcagaggcgcgtctccttctcccacgttgtcgttgccgccgccgccgccacgtggcccgtcactgaccgccactgtcattcgtataagcgttttatacgtgtgtgaacattagatagagaggattgggacgatgtgcagtgggtcgccgtgcgcgtcgtgcaagctgctgcggcggcggtgcaccaaggattgcatctttgcgcccttcttcccggccgacgaaccccacaagttcaccatagtccacaaggtcttcggcgccagcatgtcacgaatcagtgagatctcccttggcgaaacgccaaactgggcacggatcgagcaattcgggaggaagaaaagaggaactgagtaagaacagagtggagaattgacttggagaggaggttggtgatattgtattttcttattcgttgcctacgaccagcgcttcggcaaagtatataaaggttccagctagtacacagctcacaactaggccttcactcacgcaccagccaccttacaaggccatcaggcccaaatcccaaatagaatagtgaagccaagcaataaaagactcctggagtctaacaattcccttccccttaagaacctgcttgaccccaagcagtagcatcaggaaaacgtgtccggagttggcgcaggttctcccaagtagccagctcctcaggcatgccaatccacttgatcagcccacagggaacaacactcttgccacgtttaatcagacttcgacgaagaaccgcttcaggctgaatggtagattgttcgtcagaatagttgagagggagatcagaactgacctgggtgcctggtttgattgccgccttgagtaaggaaacatgcaccaccggatgtatctgactagtagcaggtaaatccaagcggtaagcaacagcgccaaccctttccaacactgtatacggtccaaaataccgaaagctcagtttctgacaagatcttcgggcaacagacatctgtacaaatggttgcaatttcagataaactcgatctccaacagcaaattgcctctcagaacgcttcttatcagcctgacttttcatcctctgttgagcccttagtaattgttgatgtaaaagttcattcatatgagctctctcttggagccaaagctgcacatccggcactgtacttgcacccacatccacaaggccaaaatgtgtaggctttctggcaaacaagacctcatatggagatttattcagcacattgtggtaggaggtgttataccagtgttgagcctgggacagccaactggaccatttagatggagcaaagtgaactgtgcatctgaggaaaccttccaaacactggttaagcgctcagtttgtccatcggtttgtggatggtaagaagagctcatgttaagtttgacatccgctagtttgaacagctcctgctagaaagcactagtaaaaatcctgtctctgacagaaatgataacctgaggcatcccaaagacatcatacacctgctggataaatgcctaagcaactgtataagcagtaaaagggtgtgcaagagggataaatttagcaaacttggaaaatttgtccacgactaccatgattgtgtcatatttgcctgacttaggcagtccctctatgaagtccatactgacagtcatccaagcttgcatagggactggcaatggttgcaacagacctggagacttgcagtgttcaactttggcctgctgacaagtagtacactgagcaacatattgctgcacatccttttgcaaccctgtccatgcaaacagatttttgattctctgataggtagctgtaacaccagaatgcccaccaaccccactgttgtgtaatgcaagcaaaactgcctgttgtgcttccttatgatgcccaagccatattcttcctttgtatcgaattaccccattaaccaactggaagtggtcacatcctttaggctgaaggggcagaatttccaagagctgtttagtttttggatcatgctcattgacggagcgtggggctcctcaccgggagaccgcgctggcccccctttgccggttcggccggggactctgggtgagactctaagctcccaatctgtggaaggttcgcgagacaggaagcacacaagacgccggcgatgtatacaggttcgggccgctcagaagcgtaataccctactcctgtgttttggtggatttgtgtatgaaggaactacaaagtatgagccagcctctccctcgttctaggttcccaatctg

SEQ ID NO: 67930 - DNA, 7703 bp, Oryza sativa
  unsure (1)..(7703): unsure at all n locations
cctaacccatacacacagagcaaaaaatccacgaggggtcagggcgcctcgaccctcggggctgaggcgggtgcggtccgaccccctcggggggactaagaggagggcgaacacattaccctcgggcccgacgtcccccgagggtgccaggccacgtgggcgattgtgtctgcctcaaacctctagtcatgatactcctgatcccatgtcaccgacagtagcccccggcgttatgccagggcgatcgccctctttaagggaagcggttgggcgtgacgccactcctaaggcccggtgacaggcgggaccggtctcctcaattgggcagaaacccaacggtcacaaatcacgcacatcggcagtggtaactcggctgtcaataatgagcggtctcttcgagactgccacattactcgagtagcacacgaatctggacatggcgattcatttcgtctggagatatggtaacgtcgcttcggtcggcgagcgtaattaacgcacgcatgatatgatctatctcgactgccacaaccgcatatccacctcatgcgccgcaagcgggcgaatgggattagtggaagcgtgggcgcgagaaacgagggggcgaaatagtgggcgcgagaagcgaggagccgggcacagcgctggcaagagtataaaggcactgaggaagggatctgtttccttcctttcgccattattccccttgtcttcgccgcttgcgccctaactccttctttcctgtgccctaccttcgccacacgcgctcgctcttaatcttctcttcctccggcgccatggcacggggctccgctctgctcgatggtagcgtgctgccgccttcccgcattgtgagcgagaggcaggctgggctggcgcgccgtttcatgccgggatctgccaccggccgggagatagtcacgctgggcgagggacgcccggcgccagactacccggggcggtccgtcttctttctcccctttgcaatggcagggctggttccgccattttcttctttcttcatggatgttctggagttctacgatctccagatggcgcacctcacccccaatgcggtgatgactttggccatcttcgcgcatctgtgcgagatgttcattggggtgcgcccatctcttcggctgttccggtggttcttcaccgtacagtcggtgtcgccgccatcggtagttggtggctgctacttccagccacgggagccggtgctgaatcgctacatcccctgcgccctccgcaagaagtgggacgactggaagagcgactggttctacaccccccttgccgacgaagcgcgcctccgacttccgagccagcccccggcgcaggcctccagctggcgggcgccggtagatctgggggatggctatgacgccgtcctcgaccgcctggcgggcctgcgatcccaggggctcacaggggccatggtgtacggcgactacctccgtcgtcggattgcgccgctccagcggcgcgctcggggcgcctgggagtacaccgggtccgaagacttcatgaggacccaccagggagtgagatgggactgggctcctgaggacttcaagatattggtccaacgggtgctgaatctcaactccgtggaggcgtccctcattccccaaggaatcctccccctctgcagcgatccagaccgcgtctccatcctgaccattatgatggcggtcggggcctcagaggagcgagctccaaagggccacgacggcgcaggcgggagccgcagggggaacaatctaccccgggagggggtcgtgcttctgggtcccgcgacaggggcccggggaacagccgccctgccgagtggtgacgacggggagccgaacccacgccgtcgagctcgtactccaccgccccctccacgccaaagtcctaagcggggggaggcactcgagagggtcgaaagatccgcgacttcaccgattgcgggcgatggagaaaaacggcgagatggggagcgtcgcctcctcgtctacggtgacggcagcacgccccagggcgcgctccaagctgcgggcgcgctcctacgtcacccgcccgtcgcccatgacccggagtctccagcccaacgttggctggacgatgtggccaaattggtcatgactgcaaggcagcgtctagatgctggtgggcggtcctccgccaccaaggcctctggtgctgctaccaccggctccgcgtcgtcaagacgaagggcgcggcgagcggcagctgccgttcgccattcggccaccactccttcgtcgactccttcaacccgggaagatctgcgtggggggccggacgcccgcaccagcatcgagcggcggcgtaatgatcgacgtgctacccacgcaacggagggcgcttcctcgtccagagtgtcacctcaacacggacgcgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctaaaggggcaggcgcggggttggctaatgaacttgccacccacgtcagtccactcctgggaggatttgtgccaacagttcaccatgaactttcagggcacatatccgcgcccaggtgaagaagcggacttacacgcagtacagcgaagggatgatgagtcacttcgctaatacattcagcggttctgtcaagtccgcaacaccataccatgcatccctgcacacgcggtaatctacgcgttcagggggggcatgcggcacaaccgcatgctcgaaaagatcgcctccaaggagccccagactaccgcggagctttttcagctcgcggaccgagtggctcgcaaggaggaggcctggacttggaacccctccggttccggtgtggcagcttcggccgcccctggatccgccgctcagacagggcggcgtgacaggaggaggaagaagaggtcagtccattccgatgacgagggtcatgtcctcgccgtcgagggcgcttcgcgggccacccaaaaggggaggcctgcgagcgacaaaaagaaaaaggccggcgctcccagcagggagcgcccagccggcaagtggtgcaccgtccacaacacctccctccacgacctcgtggactgccgtgcggtcaaaagtttggctgagcgaacgaggaagtgggaggaggagaggaggcaggagcgccgagagggcaagtccccggcggttccttccggcaatcggcgaagtgaggccaagcagaaggcccccgccgaggacatcgatgacggcgatgatggcctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcgatggtcggaggttgccctcaccttcgaccagaccgaccacccaccatgcgttgcccggggaggacagatcgcaatggtggtttcccccactgtttgcaacgtgaagctggggcgtgtcctcattgatggaggagcggccctcaacatcctttcccccgcagcctttgacgctatcaaggccccggggatgatgctccggccatcccagccgattatcggtgtgacgccagggcacacgtggccgttaggtcacatcgatctcccggtcaccttcggtggacccgccaacttccgcacggagcgggtgaacttcgatgtggcagacctcagtctgccctacaacgcggtcctgaggaggcccgcgttggtgaagttcatggcggcggtccactacgcctacctacagatgaagatgccgggccccggtggccccatctctgtccatggcgacctcaaagtcgcgctcgcttgtatggagcagcgcgcggaccgcctcgccgtcgtgtccaagcccgagggtggcggcgagaggcttggcacatccacccccgccgccccgaggcagcggatagtcacgtgcaatgaggtcccggtcaaggaggttgccctgggcgacggcccgtcaaagaccacacggatcggtggtcttctggacggcaaataggaagacgcgctcgtctctttcctacgggcaaacgctgacgtcttcgcatggagaccggcggatatgcccggggtccccagggaggtgattgagcaccgtcttgctgtacggccgggcgcgaggccggtccggcagaaagtgcggcgccaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcntaaggatccttaccccctacctggcgcgccagatgacggagcgtggggctcctcaccgggagaccgcgctggcccccctttgccggttcggccggggactctgggtgagactctaagctcccaatctgtggaaggttcgcgagacaggaagcacacaagacgccggcgatgtatacaggttcgggccgctcagaagcgtaataccctactcctgtgttttggtggatttgtgtatgaaggaactacaaagtatgagccagcctctccctcgttctaggttcccaatctggaaaagtctcctcctccctctaagtgggcaaggtcctccttttttatcttaaggggataccacatgcacccttttcataaatggacggagatttgtatagttgccatccgagtcaccttctgatgggacggtccacaactacctccactttcgccgggagcagatgcgacgtggaatcgtggctgtctgctgacgacatgaccggtgtcagaccagtcatgtcggtcattcttgtccaccacgtgtcagcttagcaatctatatgttcgtccttcttcacacaacatcttgcctgtaatggttaggatgaagcctggcatatatttgaccagggctaacgtgccatctctgggaggtaacacgctagctccagctggggacaagcgcctagaagccctcgtcctgacgggatggggcgaggtgtgcgtcagatcgcctgtcgccacctaacccgcgatctgaccggtctgtgactggtcacagaccggataaatgagtgcactgcactgcgttacatgcagcgtgacacgctcagccaaaccgcaataaatgtggttaggtgagccccgctgtgctcacctaacccatacacacagagcaaaaaatccacgaggggtcagggcgcctcggccctcggggctgaggcgggtgcggtccgaccccctcggggggactaagaggagggcgaacacattaccctcgggcccgacgtcccccgagggtgccaggccacgtgggcgattgtgtctgcctcaaacctctagtcatgatactcctgatcccatgtcaccgacactcataaccttcagttacaatctccatccattttggtgaactaatagacatgaccagcacctcttcatcctcaactttcctggaaagagcatctgccacctgattatctaccccttttttgtatcgaatcttgtactgcaagcccattaatttgacaaaagctttatgctgcattgatgtgttcaactgctgctctcccagatgtgttaggcttttgtgatcagtttgaatcacaaatgcagagtgcagtaaatatggtctccatttattgactgccaacaatattgccaaacattccttttcataagttgacatggcttgcgctttgacccccaatgctttactaatgaaagccaatggatgaccttgctgcataagcactgcccctatccccttgtcactagcatcaatttccaccacaaattcctgagagaaatctggaagtgctagaactggagctgtggttaaagccttcttgacagactcaaatgcttgctgatgggtttcctcccaaacaaacttgacttcttttttaagcagatttgtaagaggttttgtcatcaggccataaccttgaatgaactttctataataccctgccagaccaaggaatcccctgagttgtttcaaattcttaggaacttgccacatttgtacagccttcagtttctaaggatcagtagccacacctctgaccccaattatgtggcccagatactccaattcctgttgtgcaaaagagcatttacttgccttcataaagagttgatgctgtcttagcagagtgaacacccatctcaaatgctccacatgttcagagagagtcctgctatagattagaatgtcatccacaaatactagcacaaactttctgatggcagcagtgaatatggtgttcattaacccctgaaaggttgctggtgcatttgtaagcccaaatggcatcaccctgaactcatatagaccttgatgagtcctgaaggcagtcttatgttcatcttgttcagccaaccttatctgatggtatcctgaccttagatccagtttagtgaaccatttagcccctgctagttcatctagcaactcatcaaccactggcattggatatttattctttactgttatgtcattgagccccctataatccacacaaaacctccaagagccattcttcttctttaccagcaacattgggaagcaaaaggactagaactggcctgaataattccctgctgtagcatctgtacaacttgttgttctatctcatccttctgctgaggggcatacctataaggtttcttagtaaccgatttagctgttggaagcagtggtatgtgatggtgaaactggcggtgtggaggcagctcagttggtttcttgaacctatcttgaaactccttcactacaagctcaactgctgctggtaactcttgcttaatatcaggaacttcctctattgcacaaagttgcaccatctgtgatattgccccatctttatgcaagcccttcaactgcttaacagatagcattgtggtctgggagaggtttggtttaactccatttagtgacaccctatctcccatatatgtgaatctgatcctcttccttctccaatctatccacatgggactgaatgattctaaccattccatacccagaatcatgtcatatccccccaaattcagtaccttaaaatcaatggtgaaagtatgcccctgacaccaccattccacaccagatacaagctgattgcactgcattttcccaccatcagcaatggtcacctgagttgctggcacagtttcacactgaagtcccaacttgttcaccacattctctgctaaaaagttgctggaactacctgaatctagcagtatcagcagttgttgtttctgtatcatcccatgaaatcgaatcgtcttccttcccatggttccagccacagcaaactcagacaaaactagctcttcatcacttttatgttcttcttcatcatcaccttgggaaccatcctcctgcaattggagcacttcaagcaattcttccaaaacatgtaattgtacagacttaggacacttg

SEQ ID NO: 67931 - DNA, 33520 bp, Oryza sativa
cagttgcagctccctggtggttcaaagctgcgccgtgcccaacgggcggaatattcaccggcatagttgtcgccggcgcctttgcctccagcgtggtcacccgcgaggcaacttgttctacagcttgacgcaggtccttgatgccttcatccaccgccggaatccacttctccataccttgtagggatcccaggatggagttgaggcttgtggtgagctccgccaccctcgtcgtcagcgattcaacctctccttccaccgccgccatgcgctccgtcaaggttggattcgccttcttccttgccaagctgccctaaaatccactgctctgataccagatttgtcacgaatcagtgagatctcccttggcgaaacgccaaactaggcacggatcgagcaactcgggaggaagaaaagaggaactgagcaagaacagagtggggaattgacttggagaggaggttggtgatattgtattttcttattcgttgcctacgaccagcgcttcggcaaagtatataaaggttccagctagtacacagctcacagctgggccttcactcacgcaccagccaccttacaaggccatcaggcccaaatcccaaatagaatagtgaagccaagcaataaaagactcctgaagtctaacacagcaatgttagcaagatgctccagcctccaggtatattaaatcaaacttcttcttacccaacatacatatatgtgtatatgtccattggcattgcatggcctatgcacgaacacgtataaggtcgtcatcaatggcggcgcccacgccaccgtgcatgcatgcttgcgtctgatgcgtgtttccaatgcaggagctgctggcgcggcagcaaggcgacgcggtgagcagcctggtgtatgaggcgaacgaccggatgcgggacccagtctacggctgcgtcggggccatctccttcatgcagaaccaggtgtcacagctacagatgcagctcgccgtcgcacagggcgagatcctctgcatccaaatgcagcaccgcgatggcaatgagaacaagaagaatgtgagagaggaggaagagagagaagatggaaaaaaagagagaaggtgctgacgtggacactgacatgtggggcccatatggggacccatactgactcagctgccacgttagacaaaaccggggtcaaaactaccgaaggatctaaagtgaatggttttgtaagttgaaggatgtcatatatttggttttgcggttggggatgattttgtatctcgatgacaagttgagggaccttgggtgtacttttttcgcgagttgtgggccctctcgtagcgttgcaggccaagctgaacgttttggtgggctccagtttataatgggccgtaatcacttttgggcctccatctggcctattggcatttgacgtcagattcggccctgtcggttgccatgtgctgcacaacagctccattagttttttttgacgaatcggcacaacagctccatcagtagtatagatggccatgtgggccgcccggcacggcacggcccaggcccggccgtgcctgggccgaggcttgtcgggccggcacggcccgaccgacgcaccgggccgtgccgtgccagcccacgtgccgcactcacagcccaggcacggcccaacacgcctcgggccgtgccgggccggcccgaaggcacgatgggccatcgtgcttttcctcagaataagtctaaattttctccctcctattgggctgtgacattgtatagctaaaaaaagtctattttacctccctcttctttgtgctgtggtatataaatagctaaaataagtctatttaaggtccctattctttagacattgacatttatatgtctatttttagtccctatactttgtgtaccgggcctggcctgccagcccatcgtgccgggtcggcccgaccgtgccgggccagcccagcgtgctggtggggaggcccaggcacgacccgacagtcgggccgggccggcacgggcccgacccaagtcgggccgtgccgtgcttgggccgggccaaaaaggcgtgccgtgggccgggccttcgggcctcgggccttatggccaactataatcagtagcttaccttagctgtactcttttcggtcttcagtcttcagggagaacatcggctctaggtcgtcaacacacttccgtgtttccggaagaacacaataggtgtaaccgtgtaagagcaagtttaatagtgtagccaaatactatctctaattcatctatagccaatctagtagtttattcatacaatatttacatactacactattaatatctagtcccacctatcataaacacactgcgttttggagtccgtgctataactggctacaaatttgtagcccgctgctcttctctctccttatttatctctttaaaatatctttgcagctggcttatatcctgctattgtacctgctctaagagcaaagtatatactactaatcagcagcttaaaacgtactcctactcagtgctgcatgtactcaaatgccattagactcaaaaagtccaaaagtaaaccatccccttttctttaattatacgcacaccttgtggctcgtgctccaaacaaaacgtgctactcctgcttttcactcatcggcccaacacggacacaaaaaggcaaaaacgacatggcgccacgccactcacccacacggccgtcagtcccagcccccagtccaccacacgtgtccccttcactcacgccccctttcccctccatgcgaagccgtgtctccttcacacacacacacacgcacgcacggtcgcggtcgtaggtgagcggccgcgcatgccacgccccgtccgccctcgtgccgagccgcgagattccgcagggcgcaccggcgcacgtacgaccaactccgtctcccgtggtagcctcggcatgagaatacgattatttcctcgcaatctcgcatcgcgcacgcgcgcgcgccatgtgttcggctccggccgtttcgccggctcacggcgtacctaaccgcgcgcgcgcggccaccatcgatcgatcgcgactttgcggatcgcgcgagcccccgtgcctgcgttgcgtgcggctcgatcgatcggcaggtgcgtggcatgcggtacgtgtggctctcctgtgacctcaagctcaacggtttgactaatcgatccaagactctaatttatgtacggacggatttttccatcgatctgcttgaaaaaagttctggaatgcatgcattgtacgtcaagagggagattgtcaaggatatgatctgacgtgtgttcttgctgtggtgttacgtgttaacgttcgttgagctgaatatatgtatgcatgaaaactgaatcgagaggacagcaacacgaaaatatttgggttgttggtcgggacaaagacgtacacaccagctggatatcagagtatccacgcacatcatttcatagtatttcaatagatatactagctcttcgctgatacgcacacagtttattattcaagttcatggggtcacaagaatcaaactgtctgcagcaactggcctcatgccggtacgaacaaactccatccacctccccatataccgtgtgccgagagatctcctgacagatccgtcatgccagtacatttgttaatggctcttttgagtttttaactagccctgccaaactcctgccaactcgcatgtttatggttaactgctgcgcttaacccctacaagtccactcactctgctggacgaaacatcactattctatacgtaatctctacgcagttacgtagaactgagcagggcgcacgcacggacgcatgcccactaattaattcactcatgtctactagtagtaacactgtcagcagctgctgtttgatctgcttggtcgatgacccaaccaatcacgcggcgaaatttggcgtgcaggctggccacccgtttcacattttacacggacacgtcacactgccccccctggcttcactggctgtttgcttgtccgtaccggcttcacatcgcgtgttaattagtggagtagcagcttaattaagctactccccgcgcatgtcgctctcgcgaaaaggctcgattcaaacctaccttcctgcctcgttcctctcccccgacacccgcgcgcgagagctatatataccccagtttgcttcgcttgctgccacttgaccagcagcagcagcggcagccggcagcggcagcatcaagcagagtatagctcgcgatccaggaggccgtacagaatcgatcgcaattcacacacgcacgtaaaggagatcgaagattcgaagagagatggagggttgtgcgtcttcgccggagagctacgtgaggatagggaggaggtggcggaggcggcggccgccggcgagggggttccggctgtgcccgaggaaccggttctcggtgcggcggctgcgggccaagctgctcacgttcctcggcctcgtcggccggtacgtgcgccagctgctggcggtgaggcggccgcggtcgtcgtcgtcgtcttcgtcgtcggctggaggcggctgctcacggagcagcagcacgaggttcctcgtcggcggcgggaagcatcacgtcgacggcgggcggcggacagtgccgccgtcgttcatgcggtccaactcgttctacgcgcaggcgatcgccgactgcctcgagttcatcaagcggaactcagtcccggtcgaggactacgccagctccagcggcaggagatcatcggtagacctgacaacaatctgatcaaagtctggaatggctgcaattttttttggaacaaagatacagattagttaaaaggttgtaaatgtgtgcttcgaatgaagtctaaattaagatgtgaaactagtttttggattgacgacactcatgtcttaatacacatgaggatgtaattaacagggcgtgaaatgtgagccgcataatctgaatttttttgccatgctcattggttcaagatagatattaacacttgttttccaactgccatctgtattagagtagaccttaattttgtgtgacaaaatttttcttccacgaacggccgtctagccgtccaggtccatgggattttattcgatagaaaaggacggggcaagaataatacaactgaatattcaaatacgtgttaacgtttcagactgttacagatatactttccatgcagcgatttccttcaaaaaaaaaaaactttccatgcagcgtgcatgctctctctttttttaatggtgcatgccaatttctttgttctgccgtgtgagtgtactccattttcttctgctgaaagtaagtgtcgatggagagtcagtttgacgatatctgtctttttttttggcaaaaaaattaatgcatgcccaaatggatggggttaatttctcaccaattacagaaagtcagaaacacatagctagtctggccaaacaaatctttgcgtctcacctgttactgatttttcttatcggcttaatttgtttgtcactagctgttctgtggacaatgctggtttatctttgtcaactagttagtgaaagcacgggagcagcggacagccggacaccgacactgctatcgatcaggtttttctttgtctgaaagtgccattgcatcatcctgaaagaactgcatttaaaattttcaatgatgtagcgtgaataaatggtaaaaatgctgaagctgagacaaggctgggtcattagccaaaagcccacgggtagtagtagaaaagcccgttgctacaattagtatcgtggatttggtcgagagaaaaatctgctcatgggccagcggctagtgttgtttattctggtccgtttgaacgaaacgctgcctctgaattttttgtttacagcaaagggatcgaaagcgagatttgatcggctgcatgaacaaaaaggattaaagcagtgggcagtcggcagcatgttcctgtgctcgtgtctctcctgcctgaatcctgaaaagctcgacaggtaatgcagcaatggaggaggacatcatcatcaattcatcatcattagaacgaccaaatccaaataaacatggcgcacgtactggccattatcttaacgaaactgcacggagagtggaagtagtgatgggaagagagtgattcactttggctgtgtcacgcagcggaagtttcgatcgatctgtttgggtttccatccgaaagataaaagatggaagccactatttctcgccatcatctgaatgaagcccttctttttttggcgggcctcatctgaatgaagctggtcggaaggagcaagatttgcagatccacgtatgtgcaaatcgcaccacgaatcctaatactccgacatgattttgcttgtgtcgtcacaccacaaactctatttttgagcttagtttgttaacatcacttgatcgctctcgcttgcgatctgtgaatctagtgcgtgcatactgtgcagttgaaaagtttgccgtcaagtgagcgtagctcaaatccaactcagatcgaagttataaagttgacacatatgctcgcttttacggttaattattctttcaacagtagacaatatagccgttgatagtaatgcactcgcaacaacttcatgaaactcaagatatgttaatccagatttctaaatgtgctaatagagataaaatgtgtgttcatatggagatatatcagttcagtttttttggaggtgtttataggagtacggcgcgtttaaaagtgtggtatgcatcgtgttgtgagtgtttgtgtgtttctttaaaaaaaaattgccatttgtcaattattgtggattttctgcaacttgttgtccaaagaaaaagaaaatagtttcggtcaacaactcaacatccatctgggggtatgaccgaccgagcgcggtggccgttgattggctcgtcgcctcctcccttctcggtctgacggtctgaccagtgccgggtaggaagcgtaattttgaggagagactccgacccgcgccgccgccgccgcagccaagccatggagggatccgccggggcgccgctccgcacgcgcgtgtgcatcatcgggagcgggccgtcggcgcacacggcggcgatctacgccgcccgcgcggagctcaagcccgtgctcttcgagggctggctcgccaacgacatcgcggcggggggccagctcaccaccaccaccgacgtcgagaacttcccggggttccccgaggggatcctcggcggcgagctcatggatcggtgccgcgcccagtccctccggttcggcaccagcatcatctccgagaccgtcaccgcggtcgacttctccgcccgccccttccgcgtcgcctccgactccaccaccgtgctcgccgacgccgtcgtcgtcgccaccggcgccgtcgcccggcgactccacttcgccggctccgacgcctactggaaccgcggcatctccgcctgcgccgtctgcgacggggccgccccaatcttcaggaacaaacccatcgccgtcatcggcggcggcgactccgccatggaggagtccaacttcctcaccaagtacggctcccatgtgtacatcatccaccgccgcaacaccttccgcgcctccaagatcatgcaggccagggcgttgtcaaaccccaagatccaggttttctgggactctgaggtcgtcgaggcctacggcggcgagggtggaggtccattggctggtgtcaaggtgaagaacttggttactgggaagatctccgaccttcaggtgtccggtctcttcttcgccatcggacatgaaccggcgacgaagtttctcggcgggcagcttgagctcgatgctgatgggtatgtggccaccaagccaggctccacgcacaccagtgtgaagggggtctttgctgctggggatgtgcaggacaagaagtatcgccaggctattactgccgctggatcaggtttgtgaattgatgatttttcaggttacctgtgattaatttttttctgcactttcttagagatcagtcgcttcatgggttgctatttgctagtgcgaattgcaatagaaattgttcagggcttgagtatgtagtgagcgaatgatgatggtcaaaattagaacctttttaagctatcatagagttaacgtgtttgagtttctgaaataagtgctttcattatgtatctagcatagttgattagatatactaactaccttttgggcatgttgaatgcgtgctctgtttccaagctaggattgggtgtattagtcctaaaaaaagttaggtgtatttgaggccggttaatgcttccaaagtaccatgtaggttcatatgtttgactaataagtagctggtagttaatcatggaatttgttgaactgggataagtgactttcaagctattctgggattttcatagttaaggcattccaaatattgttaggaataaaaaaaagtgctacttcccatttagtatagaagagtgcatttcaatttctacactacaaagtacggactgtatttttgcaaaaaaatcaaaaacagaagtatggtcagtacatcactctgtcactcctgtgatgtgagttaactttgttaagcgtttacatgctaactgatgttgcagcaagtatttttactagagtgcaagttacattttcatgtggttagagggcacatgcaaaattctccatgctcaaacttcaataattggtcatgtttcgccattctcccttcttgatcctgtcagagatggagtttgaacttattattgcataaaagaatgaattggaataaacagagactgggttcactttccctgcgtgctgtgaacatgtgttccggatgggcataaacaaagtaaactaatatgttaccaagtatggacttgctgaaataaattgacctttttgatggacaacatagtggaggaataagcagagactgggttcactttccatgcatgctctgtaaacttgagttccggatggtcataaacaaagtactccctcgatccctaaatgtttgacgccgttgacttttttaaacatgtttgaccgttcgtcttattcaaaaaatttaagtaattattaattcttttcctatcatttgattcattgttaaatatacttttatatatacatatagttttacatatttaacaaaagtttttgaataagatgaacggtcaaacatgttgtaaaaagttaacggcgtcaaacatttagggaaggagggagtaataatgttaccaagtatggtcttggtcagaaacaatccaaattggcatttttgatggacacagtcataggagactgattttaatcctgatgtctggttgtttagcaaaattggaatcagggaataaggccagtactgctgatgtagaatgaaagcagtatgccatttctatatacttcagaaagaactaccttgttacctgtcgtgtgaaaggaaaaagcctgatgataagattttcatctcagaagcagcatacagagtttttcctttgtgattttcatgttggttgatacatggtcagtatggttagtacatgatgaagccttattattattactattattttgtgctagcttgtttcaggagtttgatccaatagacatgcacttcaaaaaaagagagaaattgtctatatgcatgactctgtcgacaagatcaattctaactcatcattgatggctactgctgagcataaaatttttgtggcagacttctaactcatcattgtatccagggtgcatggctgctttggacgcggagcactatctgcaggaggtcggtgcacaggagggcaaggccgattgactatctcaggaggaagcgaccaccagcgtttcaagaagtccaacgttgtcgctgctgaaagctacactctgaacgtttatgccatgggctgttctgacttctgaatgcttctaccggattttcctgccccttattagcgtcgtattatttgatgtgctggagatttatctgtatttacgctgaagacgacgtattgcttgcgggtatccgcattttctgcatttgcttatgattgagttattgtgacatttggcgtttttagtaccaaactagcaaggaattgtgtattctgaagaccattccgatcaatgctactgatatggtggatatcactattgttttcctggaaagaggagtaattagaagttcactagcaggttgctaaccctgagagaatacagagacatgtatgtagcggtgtacacctacttgcccagccagcctatgttacaggggctcgcaggcagggcgcccagcccatatcatatcgcggcctctaggttattgccgggctatgtgaagtctcagcagtgacaacgagaactttatctgttactactaggttaaagccacgtacttattctttacgtgttttggtgaggcgtaccgcacctgcaacgttaactctgcgacatatattgatgctatgtggtgtttgcgacatacttcccctttttcatattataagactttttaacattgcccacattcatatagatgttaatgaatatatatgtatatgtatatgtatatatatatatatgtatatatatatgtatatgtatatatgtatatatatatatgtatgtctagatttataaatatttatataaatatggataatactagaaagttttataatataaaatggagggattatattgatgctacgtggtgtttgctcataacatagcacgcacgagaggcatactggcatagctccacgtcttggcacggcaagcaccgcggaccgcgcgcggtaagacgaccacggctgcagctggccgctgcaccccgcgccgacatgctttgcagtcgaggcatctgcggccaccgccacggcatgttgccgccgcgcggaagccggcgcggcgcaacgtaccatggtgggtctcacctggctgcagctgtgtacaaatctctccttccctttctcctcccaccctcctctcgttgccggcaatggggctcctccatgtcgatgcaacgtgcgaggaatcggccgctagatcaccagctgcaaagcaatcggcaaactcgcgttcggccagacatggagaggatgcagtcgatctcagcgtttacggcattcttcagatgcatctagctcccctttgttacggcggattttgaccgtgttgaccgacagtaaacacgattggctattaatggaaaaccgacggcgatgacatttctttaggaaagatggatacctccataccctaatagaagagatattcactttttcttttaacatttaaccacacgttttattaaaaaaattatacaaatataaaataaaaagttatatttaaaatactttggataataaaggataataaagtaagtcacaaataaaataaataataattttaattttttttgaataagacgaatgatcaaataatacaagcaagatgttaaaataccttatattaggggacagagggagtacaatggtatggtattttttagacgctcgccgatgacatttattagagcttaaaaaggaagtatgaaaaaaaaaattgataacttagtacgcggctttgagcccttaatacaacagttttgcatagtgattagcccttaatacagttgggaaatggatcgtagcaagcgaatgtgtccccagagcaattctgttcctcagtgcctgtctctgtttcttggtcgacgggtacctcaagggccttggattcttgcccttgcacttttcacacgccatcctcttatacaggaatatatcctcaaggttcaccgctgcatccatgacaagtctgatatacctaatcaagttttcgtcgttcgactgaaagccaaacatgactaacgttgacaggctgtggttcttgaaatctgacgcagacgcattccaatccgcgttcttattctcgctgtatgagtaggctttcctcctctcatcatccgtctctatttcgcagagatgatcccatacctgcaggccgcaaaacatatctcagaaattgcagtcaatgcaaaatgtaaaacagtggcgtagttaaaatttaaattaaaagtagtccatctatatgtaatatgtcaattaaaagggtggtccactatacaatttttactatattaaccagcacatatactataatttcaaatttttagatggtccgtgaaccacggtgccacctagctggctacgcccctgatgtaaaaggcttagcagataatcaagcatcagttgcaggtgcttaccgccacgtatagctccctcaaggagggtgcagcctcaagaaagaacattgtccacgagggatcatacccttcaggaagatcaactaaattcacaacccttagtttgtggaatgcagatgcaagtgcttttgggccttctggttgaacccaaatatgcaacaaggaaaagaacacatgagtacatgacatggtacaaacatacaagtaaagccatcagagcagaagaataatcctttttagatggaactataagaataacattgatataccttttcactattaaaatctaaagtcagatctcttatagagatattgctcagaaattcgctcaacttcaccgcattgtgccaactaagaccaacattggtgagggttacagactccagtaatggaacatgtccaaaagaaagtggatcttggaaagctatccaaccaccaaagatcatccgtgtgagttttgggagtgaactaagtttgattattccaaaacggcaattaataatactaagttcactgagttgcaagtgttcaacttccaaaaaagtggaaattcctgagctgcagttatacaaacgcaaatagtttaatcgcttgcaagtgttgaggacatcaatgatttctggttcaccaaatctcaaattctcaagttggagtcctgtgagacctccgaatgtatttggacaataactgaagaacaacgcaaaacgtctcccatagacgatgaaatcatcgtcaatgcactgattgtcatctttctctgtcaaaattgtaaattcaatcatctcaactttttgggttgccataacgtggccaacagtgtgtccaaaggatatgcagtcatcgtctctcaagtagaatctcatggataggaggctgatagtgtgctcatttgacttcctgcatgccaatatgctcttcgttgccttaaccactgttgcattgatccgacccagttcatcatcagagaagctggacatgctcttgggatcaaagtcagaaacatctattgtaagatgtgatatcatagtggggagtggcctccaacgctttgagaggaggcttgttcttgcagcatctcggacattgagtccatcaaggatggctagcaaaatatcatctggcaactggctaatcctgtcttgtaggtcagcattctgcatttggtgcgaaaacattaagcaaacttaaagatgaaatctgaaataccgaccacagtcaaagaagggaactatatgaccgcagaaaaattcgaaggaaaagttggaggattcatggacgggggagggggaagaatgacgtagatttacaaaataaaacgcttacggaagtaatgtggtcttgcttgatggttggtgtagtttcaatgggcgctaacacgcttagataccctcccttgttagccattgcagattgatgataaaccgaataaaacaggtcaccggacctgaaaaacgacacgtttcattgattgaaattggattgtgtctttccgtattcaaaacgaaattaagtaaatactatactttgtcaatttaggtgggaaaaccggaggtatgtgattccaaatagatcgctcaggagacctcaatcagcaattcagcatacagaaaaaaaaacagagagatacttaccgccgacgagaggcagcaattaggtagaagagagagtgaaaattaaaaaaacaggcgccggatacgttggattgatcttaaacgattctaccttgcctcgattcaactgaatcaaatcgataatgtcgaaatttgggttggagactgttactcggtactagcagaggtagagggacagatggcctgatttagcttggagaggtggtcggcgaccaggtacaaaggccccgatttagcttagagagggaaggagggaaggtggcggactagcggcggcgagtagcggccgtcggcgaccggagagagcaagacgatcgttctggcacactcacatctaaacaaatttatgaggcaaaatttcctgcaggtattacctcgccaaattggaagttcacctggagcagcagagcactgttgaaggtaaaactgtttgcttggctgctggttcgaaatagactgtccacaatgaaaaatctcttgaagaagaagattgttcagtcagcgtcttgcgtgatctgcaacagtggcgacgagacggcaaaccatttgtgcttcacttgcccttttgtggtcagtttctggacaaatattggagtgcaaccctcaatccaagaccttcagttcttctaccggctaagtcacacgcagcttctgccggcaaagcactgccatgtcttctacctcctctgcttttgggtgctatggaatcataggcatgatgtggttttcagggggcaacaaccttctgtagctgcatgccttcaacgagggataagcgaggcaggtttttggggacaaacactagcggtgcagaatagatccgtaatagatgattggaaacacattttctcttcctgtctacaaactctaaatccattgtaacaaaactatttttctcccttttatgcaatgacaattcagatgtttagtcaaaaaaaaaagaaaagaaaaaagctcggccctagggttggtaaagcaacgaagccctctaccattcaccccatgggccatgggcacaaaatctgttgtccctattatggaccggtttcgctcgatttttttatttttatattactagcaatagtgcccgtgcgttgcaacgggaaaaacgccgtttgatagtgtcaccctaaaaacctcaaatttgtaaaaatcaagtataatttgatatattaacaaataggtagaaccgagtctaatttgatcaattagcataggatttaggatttagttttagatttatttttcaagcctacttaagagtttatccgacggactttaatttgaaaaatgtgagccacattgtttgatcaaatttgctttcggcccaggtcttcccaagccagcccaaacttgggctggcccatcttcggcgagttgagtccattcgatggcccgcaagctgagcagctgagcgcggcccacatatgcggggacggtccgatgcacttccgtggcccattaggcgcagcgtaatcaacggcgacgacggcccgacactgggcgaatctgagccgtctgatctgatggacggctccaatcgtccccgcgccggatgaagcgccgaccgaggagaggggcaaaaccctagctcccaaatccctctctcctgatcccatttctctccggcgacgagagagcggaacgacagtggtccggcaagctggtgcgcgcgtgcagcgatgaccgctgagtggctcctgcttcgccggctggggggcgcacacgagggcgcgcaaagccatgccatgacgtcagcggtccggcaaggtgggcgtgcaaacggcgacaagcgccgagcggcctgacctcatcggcggtaggggcgacgccaagccgacgcttcccgtcttcggcaaaggacggtggaggggtgctccaggacagcgcgcatgcagggaacccgacacgactgcgaggaggtgaaggtgcggcagtgccacttcccggaaagctccaatgagctcaggggcttcaagtccggtaagtaacccggacccttggcttaattgatttggatttgactcttatggttcttacccgaaattagggttcttcgaatttagagaattttgtcgggaaatttcaatatattttattccctcttttcgagttaggggagtttcaatatcgtttatcctcttttaattttgggaacttcaatctagtttatccctctgcttaattttgttttttttctttggctggtgtttcatcgcgcgggcggggatggagggtgctgctcgtccccttggaaagattgagattaagataagataagatttttacggacaatggaagtaaattgaatcgaactttcttttttctgttttaatgtttttttcgcccttctttcgttattacggacaacggaaacgtttttaatttttttaagtagtagagatagagaaaatagagatatagtaccatgtcaaatataataggattcgatttttttactgcaccacatataattctttttttttagatttgttttttttttctcttttttttaccgcatccacgcggattcgttttttttggccggtctttttttcacctggttttttttgcgccccttttttaaggaatcggacagattccttttttatttcttttctcccttttttttaccacggaatcggattcgtttttcctttcttttttttgcccttttttgatgggacagatttggtttttcttttcttttttgcccgttttttgtccggtttttttagcccgttttgttttggatcggatggattttttcgtctggtttttttttacggacgatggaagcacatcttattttttaagtagtagagatagagatagagattttgttgaaatatttaaaaaataaatttttgttttgaaaatttacaaatttagaggtctcacgtcctttaaaaaaaaagcccttccagagagatctaaatgtaatttattttatttgtatccaaattcttttcactggttttaattgttttatttaagaaatactaatgcttatttgatactccaaatgatttgaaatgaaaaggtaatacactacaaagttgtagatctcaatgatatcaataactcttctataaagtttattttcatctgaagtgatatcatagtattttttttattatttgtggcactatctttaagctacttgcgtcaccacgccacaactaatctaaattatagcaatgttatgcattaaacaaacatccccttcacgataccatacaaagcacgccgcgccgcgctgtcataaacaagacaacagcaacactagcaaagaagaagaagggaaggtagtaccaacttaccgggttgacgattggcgtccacgggaagaagcgaaggacccgactagagatggcaatgggtacccggtccccggtcccccgtggagaattctcccattatgtgatggtgatggtatcaattgtgtctccatggggaatcaaatggagagaaagtagtctccgtcgggtctggcgggggcgggtttagttcaccgtcccccgtccccgccctccgtggaggcccgatataaaagtatgtgtgtagtaatatcctgtgcatttggcccatatggcccataaaaaccaggcccaaagcatagagtatataaagcagttgtgtaaccctaaccattccaatccttatccccttcgtccccattccccagtccacacgccaccgtccgccccgctcgtcccaatccccacgccgccacgcgccacgccaccgtccgtcggccacagcggctaagcggcgccgactcccgatctcgcacccgcacgcgcagggccgccgcgcccgccgtgccggcgaccgcgccagcgccgggccgccgcgcccgccgtgtcggtgaccgcaccagcgccgagccgcccggtcccaggtggcccagctcccagctcccgagccccgtggccaggtcccagcgccacgccgcgccgtcccgttcccttcactcgcagcctcccaggtccgaggacgccgtggactcggcaccggccaccggacgtcggcctcctcctccaccctctgtcaatatctgatccgtcatgtaggcttatttgttttgctgatggtggatgtaggtgaaggcttcggtggcaagaaaggggaaaacgacgagtccacacgacgaccagccgctcgagtccaccatggcttcgccttcaccactgctaagctccgacgacgatgcaaggtgagcacatctagctgtcctactcccaactcagtacccctccctagacgcctaactacagtaccatatccccctccccctccactaaattcctcttccatggctacatcgttgtctcgttgagtcactaactcacgttcggcgatccacaataagggacgccaatgcggagttggaccagccatcgcatgctataagcgctgcagctgcagccacacctgccgttgtgcctgttgctggatctgccattgttcatgtgggcagatctggttcctccaactccggtgcaaaggcctgcagtcggccgccgcaaccacctataaaaaggaccaccactaggcaaaaagccatcttgcaggagcaccttctgcttcgactaaggcaggagctccttctgctccaagaactccagaagcttcatcttccaccaacggcgtgcgcttattcaaatccatggggttcgatttcacgctaaccctttatatattgtagcttcacttttgtaatcctaagttcctaacaatttagcatgtgcaatttattaatttgcagcttgcttgattttcttagatattgaatgttgtatttagagtatctgtagaaaattagatatctttacatgtatattgtatggttgtacattgaatgttgttaagttataaatatgttatgaacttaagtttttgaaattaaaggaatctgaatctgtgtagtgtagctcataaaaattttattattctataggctgtagcagatttcagtatgctttatgtgtagagattcttcatttcaagttttccaagattattctataggctgaaagatatattgatctatatttatttgtcaattgtcagatttaccacgaattcaactgctggtactggttgtgggagtagcagccagcaagaatcacaatcacttccaccacaagcagagtctgttaatgattctgagccaatacaagttgaagatgatgagccagaagatgattctgagaattttggcacaaagaggaagcttacttctgttgtttggaaggatttcaagaaagtcaaagtctgtggtgatgtcaagactgaatgccttcattgccacaagcggcttggagggaagagcagcaatgggacttcacatctacatgaccatttgaaaatttgcacattgagaaagatcaagatggggccaaagacacttgcacaatcttcattgaggttcaatattacatgagtatcctttatctattgtgccatattggctttcgaagatttgtgctccctagtgaagaagaatgggcttttgctagtgaggtagttgataggctcaagttgtttaatgacatcactgcagtattttctggcacaaattatgtgacttccaatattcaactacttaaaatctgtaggctaaagagcaaattaggaagtgggctgtttgtggtgattctactatagaggaaatgtcagttgaaatgattcaaaagtttgataagtactggaaagatattcaagggccaatggggttggccaccattcttgatcctaggtttaagattgactatctccttgggttcattgaaaccatcactggtcagtcaagtgaagagtgtgcaacgaaagttgctgaggtgaaagacactctatatgatttgatggagtatgaagtggaagatgatgaggataacacggaatcttcagctcctccacttgtcaattctgatttattgtcttcaatcacagcacgtgttactagtaggacaccagcagcaatacgcgttaaatcagagctagacaggtacctagaggatgagttggtttcaattaatacagaaaactttaagattcttgattggtggaaagtggttgggacaagctttcctacattgaggaaggtagcacgagatatatttgctattcctgttagcactgttgcatctgaatctgcatttagcacaagtggaagggttcttagtgagcatcgtagccggcttacttcagaactcttggaggccttaatgtgctcacaagattgggctgcaaaacaagtatcgaggtacatatgctgttttattcatacatcatgcttagcatagattttacaatgcaatggatgcaaaataattctgataattgttatcttgtagctgataacgaagaagcagcaagcttttggagttgccttcaagatatccaagatcggattgagctattctttcaacaacttaaaattagcaatcaaactcctaccgccattatttgttatatccttataaaatctatatacctaattaaaaaatatgtaaggattctgggcgtttttttcgtctgtcccacacgtgtagctaaatccgttttaatctgattaatagacggatcggacagttttcaatctactccaaaaccgaggtttatatactatatgtaagttccatgtaatctcgtagcacatatagtaatctgcctacatggttaacatcgaaagttttcatcccggcgaccagggttcgattcccaccttcctctcccgcattttttcacctattattgctagcactatgcctatgggctaatgggcccctcctagaataagtctactttccctccctcgtgtcaaatctcccgcattttttcacctattattgctggcactatgtctatgggcccatcctagaataagtctactttccttccctcgtgtcaaatcatattaccatgcacatcccattgctgaaaaataaaaagtattgcacctctttcttcaacagattgcttctgaaatcttataatgaaccattttttaattcgaaattattgattctgaaatcttataatgaaccattttttaattcgaaaagtaaagataatcatattatatacacaaaaatatatataaatatatgcttaccgatatataggatgtaatacatattcaagtatacaaaattaatgccctttctttccatgaaagaaacaaaaggttgctgcacatgcaaaggacccacggtcactttttatggtgttaatatgtacctaataataaaaaagtatgtaaggattcgtccgtccttacctaaattttttcatccgcaacatcctgtgtccaacactggccgtgccaaagaggcaagccgagcggatggagctagcgaacaaggctgagggttgaaaagaaatgaatgggactttcagcctaaaaccaaggagtattcaactaaaaaaaccgagcaagctggataatgtatatcaattttaaaatatttttacccgttgcaacgcacgggcattttttttctagtacttgactaattgaatatcttttgctacttctttaatttagggacttgctcttgtttgaagccatgaatgtatggacatgcactgttctcgcaatgattttggatgtttgtaacccctgttatgtgtcatgataaacttgtaaaccatggcaatgcttttggatatttggcacaaaagacctactccgactatggttttgtgtatgcctggacaacatgtgttgctgctgcaatgtggtgataactaatgagtgatgactgatgaatgatgaatgatcatgtattattgtgttgttgcttaatctgggaatatgatggatattgtattcttgggcacacttttgttgcactgcttgttgctgcactgttgttgtaagtgatgaattgatgatgtgcatttgtgaactgatgatgtgcatttgcgaatttgtgaacttgtgttcttgtagttgttgttgatgtgctgaaattgatggctagaattgttattttgagtgttaatcttttgtatctaaattattgtttgatatgagaaatgcatacatgttgactgttgagtaagttgatagcggggatggaggctccacggggataaattacccgcacggaggcggtgatggggaaagatgttgccccgttgcatttcacggtgatggtgatggggaaaattctccaccgcggaggcgggtatggtggagtaacctccgatggggaattccccgttaccatatctagacccgacgaaccggaggcaggccgcacgtataagaatataagatgccactcaaaattggaccctctgtgcaaaactgctgcagagaaaagcaggcactgtactgtatcttttacatccgggctgaccgaacaggaaagggattaggtaaaaaaaaattttgccgaaacatacacgtactcgatcggataggagttccgactccaaaatctaaacaaaattggtagttccatctagtagtgccttgcctagtttacagatgctttactacgttgttattagttagtagatttagtacaatcttaatggatggctctgtctctctccccctgtgcatgcacgcgcgcttttttttgagagaaaacaccaggacatgtttgcgcctgagaaaccctgtggacatttcacgaaccaaacgacctatgcagcctagccagcctaggaaaatgttcatttgagctccttcattttattgtcaagtttcaaaaccattcctgagccggaatacaagatataacacattcttaattatacaaaatcggatcacattggatctcaaaacagtattgctttcgatatcatccctgtacccactcccgtgcaggtaacgggtacccatacccatataattgactcataccatttatagttttgttctataattagctatttttgaaccgtaacccatcaataattcttctggcaacaatgctattaacattagcgctcaaagtcgagtaaaaaaaatctacaaccatattacataatcaagaaatcaaataataatttcatataactagaatagaacttaagataagaaagaagttttatgttactcatggatttaggcttaatctacaggttttttcaccctcgggttggtaggtacgagtagataaagaatagacccatacccatgtacctaataggtaagaattttcgcccgtcggtaaactcatgggtataagagttaaaacataattagcatataatagataattagcttctaatagagtaaaaaccagtcaggtgtcgggtcatagcaccctgttgccatctctagagtctagacatgtatgtaacagtgtacacctgcttgcggggctatcagaggcctctgcatggacatcttctcttcaccttcacggcccaactacctgtgcggcccagccagcctatgttacagggctcgcaggctgggtacgctcagcccagatcatatcgcggcctctactggctttagcccttggccaccggacaccggccggtgccccctacaaaatctaaccgaccggatttctgcgtgattgcgcagcgccggccggcggccgcccaccgtacaactataccaggcatcccggcgcggcgggcgcgtgcgagtgtgcgacgcatctcgtcgcggtagcggcaagctgcacggcggaaggcccggcgtacgttctgggggagggagtttccgtacctgcgcccgcagcgtacgcctgatcatctgggcgggcagcagtacacgcggtaagttcctactttcctcttccagtcttcctcttcttcccatcgtacgcctgatcatctgggcatgataaattttgtgtgctcactgggtaatggccgggtagctaggctacctgtacgtacgtgcgttgatatagcgttgctgaaattttagaccctacgaaacgtacctcaccctagtggaaaaaggggctttaatcctagttgggaaccccctatacaaccggaactataaatccgggtatctttaatcccagttggtaatggtggaagcagtccggttgatccctagtttttttcgtttttgtttggtgtctgtgctcaaattgatctgctccctatatatccccaaatcatcctcaaatcatagcatcacagatctggaaagaaatgcatcacagattgaaaagaaatacatcagagatcacaaatacatcacatcacaaaatagaggggaaggggaggaacgggtgaggaagggaatgaaggggagaggaagggatggaggaggagatattaagaggggaggaaatcgagaggagacgcgcggataatatcgagatggtgcacggctcggggtactctttgctcccggttggtataaacaaccgggactaaagatctatttgtagtccccggttgtttataccaacgggagtaaaaataatcggggtctgtcttgaactcaacaacttcttaaaccgagactaaaaatgatctactaaagatcaaaaagtacccctcaacttttaaactggaactaaagatactttttaatcccaggttttattagaaccagaactattgtggaatttgaccgatcgagcaaagatggtttctctaccagagtcatctggctcacattatccattacccagtgagtgcacaaaatttcttgttttgttagttttctaggaaatgattttttttaaaaaaaacaatgtccatgttacagttgggagctagctaacttagctggaagctaggttgcaccgagtgtcacgctaagatctacttcaccttcaatttatttcctcccctattcctattatgcctcctccataacaaatttatccatccaactccactcatcttgtcatcgcatataaagataaagaaaaattgtattggtttatctgtgcatgtattagaaccgcatgatgctaacaaatatatatctctatatacctaataaaaaaatacataataaaatatacataaggctaataaaaagatacataaggcttctcggtatttttccatccgtattatttcgccgatccccccgcttttttttcatctacttttttcatcgcagttttctcttcacatgtttttttgccattttttcagggtttttttcatccacttttttttacatcgcggtctttttggcacgcttttttttcatcccaatttttttacattacgttttttcgcatgcggtaaggattcgtttttttatcaactaggttttcttctgtcgtcgggctgaaccctagctcagccgccacgttgatctatccctctatgcgtttcctcctctaattgattgcaaaaattgattccccacaactccctcatcattttccccttgatttctccttaaaattcgtctttaattcaccggatttaatctcaatcactatttttattctgagttttgtggattgctccattttttaaaaaggaaaagaggagatcgagtggataaaaaccctcaactaacccatcgtgaaagattcgaccgaatttgatgggaggatcggctccggtatcgtacatgcacttccggaggttgaagacgatagggctgaaaaggaagaaaataatgggctttcggtccaaaaccaaataaggagtataatgtataggcgataaaaaatatttttacccattgcaacgcatgggcattttttctagtaaaagaaaagagactagcttcagcaaccatgaaatcccaagctagttcttagaagataagtcccccctatagtcttattctggatctgcccttgctactaagttcctttagtttctttcaaatttaatgtaccataatatagagaacaacatgtatatataggaccaaattaggaaaacttggcaatctgatgcttgactccaatgtgatttgacaaaggccttcttgacgaaagaagtcataagaggtgcatcatcaggtagaaaatcgagcaagatcttagtcttacattattgtcaatgtaccgggaacaaataacatagaaatgttaacaaaactctatataaattaacgggatcaaatcaggtgaaacagtacattatttagtatgatcatctctttaaaacataagctgattaaagccatgaaaattaaaaattaatccacatgattatcactaccacccattaccaagcaaataaacggccggcattatggtgaacaaacaataatatatagtggttttttaaccaccaagttaagtatttcattcatcacaaaaatattctgtttaaggcaaagttgcaaggtacagttatcattcataagatgaatgtaggttgaactattgccgactgcatattttaatcctgtttttgcatgttctgcatcgatattttatgtttaatctgaatactaggcctctagacaatagcaaatacagtttgctcgcttgctgcaagatttagttgtagatgacacaacatccaatgccactcaatggaattccacaagatttagttgtagtcttgtagatggcagcacccaactagagacaaggtgcatgctaatacaatttaccctaatatatatgcactgttattagcacttagctagtactattagacggttagacctcgtcttaagttttcctttcgcaacttgcatttcattaataatatatccaattagagaccaaatcatgtctactataactcgcatatagtactagctagctagtaacattgaaagatatataatgccaacaagctagtgctatgcatgcatgggtgcaaaaacttaattaacacttgtgctggtttggattactccagctaatttaattcagaaaatatacttcataatctaaacagttgctttggaaaggtggctgaacacatcgacatctgaaaactaaagtgtactgaacaaatggacatgatgatgctccaaataaaggggggagagatactatgacagtatggcactagcttagtatcccggatttggagaggcttgaccaccagatattggtgtggggatgctctggcatctgatctccaggactccgagaggacaaaggttgcaaagctatgagcaagttccaaagctctgggccttctctctccccccacaaattatgcgaaagtgtgaaacgtccctctcctctttatttcccattaagggaccgagaccctatttccagatttgtacttcgagaatgcaagatgcatgatagtacaagtaccatagcagatggtgagaatcttgcagctagtgtcaattttgggcttggcatctcatggccagcagctttccagattttgcagctctgccctgctggttaaacggaacctcactgccactgccttgctacagctttgcctgttggttaaacggaacctcacctagacacagtcttaagtattgctatatatactacagtattcaatcacacatataattccaagcaatgaaacgccaaaaacatgactgaagatgtcagagattcagaggccattataaaagctgcaggtgaaacaaaaagagggagggcagaaggctcctgcctcctggtggctggttccttctggacctatatactgaatgccaaaactaagtacagtacagtatagtaggagtagcagtacaagaacgccaaaattaagcacaggatagtacagtacttgatcgtatactatcctgaatttgttgagagcaaactttaagctaggagtatactactactcctactttcttgcaaaaaaaatggtgttcaaaatgcatgcttcagatcgacctagcttagctagggttcgaaattttgaccaggtcgagaaccattcaatatcaccatctggttccaaaacaaaaaataaaaataaaaaataatattcaacgccaccaaatcgtgagcttgaattcagaccagtgaaagtgaccataagacagttctggtgttgcacatgtttcagaggttgaaaaaagggaacaagagtttttcagaaacatggttctaccgatcaaaagatacaaactagaataggatagtaccatattacagaatgcaaaagagaaaaaaatgaaaaaaaaacacttggtagaattaaacacaaaacattggataatctcactgacctttggtttattccgagcttgctcttgcaactctcctctagcttcttgcccccacagatgttaaaatatgtgtatatgataaacctcctcatgaatatgaattgaaatcttaatttgcaacgcatgcatgatagatgcatacgtatgttgcacccagtacaaaggcctgtcgatcgtccaatcaacaatccaacatgcatgtcgcaattttgtaccattagcttagcttgcatatctgcattggattgctatggcttctgcactgcgcaattcttaatttggagaatttttgaactggatgctaagacatgggtcagaacggtggcctgactccgccggcgccggcgccgctccaacctccgaagttgtctccggggagctgatagcctcccacattcccggcgaggttgtagagcgacatgccaccggcgccgccggtgccgtcgcctcctgtcacgccggaggactgtgacgccgccggttgctgccctgggggtccagctgattgtgccacttgatcttgtgcttcgcctccggcggcgggcgcggcgacctcctcttcctcgccctccagcggcagccgctcgtacacggcgttcgcgaatgaggccgccatcaggacgacgggccccgcggcgaccagcgggcccaccacgctgccgccgatcacctggccctggccgccggagaggaacacggtgaggccgctcgcgccgggtggcgcgggaggcggcaggaccgtgcccgtgagagataggatctcgaaccggccccgcagcgtggccaccatgctgcccggcggcgacgcgcccggctgccgcagcgccacgttgacgacggcgccgccgccgctcagcacgcacacgccgcgccctcggcggcgggcgtactcggccacgcagtcgacgacgtcggcgccgccggcgacctcgagcacgtgcgagtgcagcgcgttcgggctgtcgcgcgtcacgatgatgggcggcttcggcttgttcttggacccgggcgggcgcccgcgcgggcgccgcgtcggcccacccgagccactaccgccggcgctgccgctgccaccctcgacgggcaccatggccgacgacgacggctggtggtcaccgccgacgccgccgcttccactccctcccgcgtgatctccctcgcccacggggctcttgtcgggtgacatcttggagtgctccatcttgacatgggatgtcggcgacagcggtgacagcggcgacggctgctgcggtcggagcagatggtggaagtaccgtgagctgccggcgccggcgccgcccccgccagggtccatcccggccatggccgtgtcatctggccgctcccaccacttcccggccgccagcttcccggttgatcggtgcccctcctcctctacaactcgctcctcaccatcaccaccacaacctgccaagacaaagcgagattaagccccttgtaaagaatctcgaagtaatttgcatggcacagtagtgcagcccaaacccaaacagcgaagcaaagcaaagcaaccaaagcgaaatgggagatcttttcatcaacagcaaagctttggcctttgacttgtccacacatctagcagctagctctagctagcatagctaagctacccagcaatgatgaagctctcaaaacgatcgatcgctgtagctagcatgttttccttacctccgccgcacgcttctcctcctccacgcaccgctcgacacgtcgacaccccggcggcgcgcggcagaaacctccctccgacgaacctgcccagccgatcgatcgcccaagaaaaacctccccggagcagcaagcgaaacgatcgttattccaacaaagagaaggtaaggaggcacgcggtgtaggatgggggtgaagcgggcggcgcggggccgaattaaaggagaggagatgaagaagcgaggcggaggggtgagctcttggggggacggcaagggatgggatggcgctgccgataaggtcagggaggtccgcctctctctctatcaatctctctcacgatacaatgccaatcccacccacaccaactccccggtttttactagcagctcgctcgctcggggaacggaaaggccggcctgccccgcccaggccaggccaccgcgcgcgcgcgcgtgtgggggcaacccgaagtagcagaggccacgtacgccaaagcgagcgaacgaggcgcccgccgcgccgtggactcgtttgtcgcgttcgttgaacataaaaaacgtggagtacgtctccctcccccgcgcgcgcccacgggacgcgcccgcactgcagctgcacgcgacgcgttcgcccacgacgtcgtggtcgacgcgggtcgtcgtgaaattcgcgggcgcgccgttgctctcgcgcgcaggcggccgcccaaatgcgtgcgcggtagcggcagcgcggtgcatgtgcatgcaccgatcgatcggtgccaagtcgagggtagtggtgctgtcacgtagggtgtgcagggctcggtcagtcactggacagtaggcagacaagcaagcaaataattggacctacaaggcgtgttaaacaattgggtcgtcgctttttactgtaccggtgatttttatatacacccgggcaagtacaagcaatccgcataagataatactacacgggacctgcatactccctccgtcaaaaaaaaaataaaaaaagacaaaacctggtctccgtgtccaactttaactggccgtcttatataattttttttataattcgtatttttattgttgttagatgataaaacataattaatattttatacgtgacttgtctttctaattttttttataatttttttaaataagacggacgatcaaacgatggacacgtaaactagagtttgtcttttttttttttatgacggaggaagtatgtatgcaacgtacgcttccttcctgctactacttgaaaacctacgaaccggtcctgatttgtgaagcttttttatattaaaaaaaatctgcccggtttatatatatgtagtttaattatactatatagtatggggttgcagctaggacgcgtataaaataggagtagctaggtttcgcatgaaggctttttcattcgatcatatccaagagtattgggttcgtttagtactagtataggctgtgtttgatacttggggttgggaacccaactccaccgcacggaaaacggagcggtccattagcgtgtgattaattaagtattagttaattttttttaaaaatggattaatttgtttttttaaagtaactttcgtatagaaactttttgcaaaaaaacacaccatttaacagtttgaaaagcgtgcacgcggaaaacgatggaaaggggttgggaaacttgtggaaagaacgcagccgttttggcccccatttggagcactgtacgtacgtaattgtccaacgattatatacatgcgctgtgtatcgcaagcttctagagctagccttgatatgttccgttaaaccaaactgcatgtactagagcctgtttaggataagaaatcggcttacgtttggaaatatttcaacatgggtacaagcagctgttcacaattccaagattggataactttagaaatgaagtggtttctcaactaatcaaggacgactcgaggtattatcggctgcgcccaaatactggcatgtggcatgcatggataggtccggtttggtgagaggtcccattcaggaactggaaattaatcaaacgagctgggcgaaaacttgagttttgcaatttgtgaccaggcttttctcggcgtggagaagccaagataaccttgtcgctttgcgtatgctctcaagtgttcaattaatttttaatagcggattacgggtcattgtcatgtgacgcatgagagagagcaaacaaatttgaatgaccacggcctgattggctggatctcgagacgcagcggtattagtttagtgccgcgcaatcacgaacagtgacttaatgatcgtcgccacagattagcagagtggagacatgaatggtgtatatgtcaatgaaagctacacgagcatataaaaaagggaggagctagcacgcaacaaaacaggttgaaatccaaaggcgagtacgtctttcggtcggccagttttttccccgttttttacgtgcatgggccagtacacatgttgactttgatacaccaattaattaaccatctttttttgacagcggccgtatagtaacatactggagtaagcatgttactagtaatttctaaattttgactctaaacgcaggtaccacaaacacgcgctggacactcttaagttgaatctcttttgttcggagtaattcttaaaagacaagagatcatgatatcttgagatcgtttaactgttgaccagctaactattgattgcattagagcaggtacaatagcaggttataagctagctataaacatattttaaagagataaatgaagagagagaaaagtagcgggctacaaatctgtagccagatgcagcacggacttcaagacgtaatgtgtgtatgatagatagaaccaggtattaatactatagtaaacaactattgtataaattggctattatattggctatagatgatttagagctagtagttggttatactattaaacttgctcttatatgcacctggtacatatacctggcctagcatgcatcatgatttattttttatttttaaaaagcatttctgcacggtgcacagtgccatgtcacgcgtgcatgcatgtcagaacttctcggctgctagttacaatagctgtagcatcaattatagatcagttttgccactttgccctaaattaaaacagccatcggtgcagacgtaattaattaaccatcttcttgaaagtgatcggtaccataacatatcatgtcaacaaatggatacctctagcagttgtattattctttttcacagttttttttaagaatgagttactctctccgtctaaattaaatgcagttttacactattcatgttcaacatttgactgttcatcttatttgaaatatttttatgattaatatttttattgttattagataataaaacatgaatagtactttatgtgtaactattttttaaaatttttttataaacttttcaaataaaacggacggttaaacgttggacacggatttctacggctgcatttattttgggacggagatagtatatagctgcatgtagttaattggtgcagacctggcaccatgaaattaaagaaagcgctgtgcacagtgccatgtcacgcgtgcatgtcagcacttctagcatcaattagatcctaaattaaataaccaattggttactggatcggagcacataaattaactcggtcatatgatactccacagtactagtatatatgaagatgaatccatccatctatatacacggtggtattgtggtaaaattaaagccatgcatcgccattccgattcatcccaaatcagccgaaacaaacagatttatacttcaa

SEQ ID NO: 67932 - DNA, 15931 bp, Oryza sativa
gctaatagcctgctattgtaactgctatttatcactgcatcttcctctcccattcctcctgcaagtctgcagcaagataacgcaaatgtgagctctgtatacctagctgtgacgccccctgtatcaagctagatatatagcccgtatagtatcccgtgctagctgcagccttcactacttggactctctctctctctctccgtgatcactgcatatgcatttgcattgcaaacacgcgatgcaagtgatatatccatctgctttccctgatcagcggttgtgcctgtgtaaacgtatctcgcgcggtgcgccggtgcctacccaacccctctctctcgtcccatgcctccatgtctcatcccatcgatcgatcgatcgctgcaagcatggccgctggccccctgttgcaacgagacacacacagtgcgctcgcatccgtatcaatatcattatcaattatcatcaccgcccggccagcgcctttgatttctcggtctttcccgtgcatgcgcgctagctagctagcacgctcttttattgatctctgcctgcagcatactctgcacgcacgcacagtgtgatccattcgcaagcagtacgtgctgctgctgccacactgcacttacgcatgcgaggccgccgatcgagcgcctctctgatagatcggcaacatgcatgcgattgaagcattgtgttgttggatatcgtttaattgattagctaggctggtactctcctccatagtttagttactgtgcagtattaatttgggtgggtgacaagatcaaatcaaaacattatcctgcagtagcgaatagtgattgttgatttgttgtctatatagctatagctctgcctctaaattaaagcgacaaacatcgtccatgaatgcacccatgagtgacctcatgcgcatacatataggggaggggggggggggtagtttgctcttcctggtggcatatttatttactagctagtgctagtattgaatcgaagctacgagaatcatgcttccaatccaattccaaggtacgttaagttttatagcatatcaaagacaccagaacaaacgatacagtacatggcaggggtttattggctctcgcttgtatttttgcagatatagaattgtacatagggtggacaaaagcgttggaacgatctctccactggcctgtaaaataattgagcagttgtgcacttgattaagagttcattatccaaagagtgctggtgttggcttcctcaactaaacaccattgtttatgtgttcgagcttatgattaagttatctaggggggttataaaattgggcaggcgagctagatggccggccaactcggcttagctacacttggaagctatattttgatgtgacgccttgcgtggatggcgacaaaaactgccttacatgccatgccatgcccactgccatgacctaattcttctcactgttggtggctgtgcatgcaagagcatgctagctctgcctttaattatttcgtcgtttattaagtcaagtacgtacagggacataaacaatgagcggcaactcaactaaagaaaagggaatctgtgctcacctgtagtacggattatatgcgtgtaaggttttctgctttctggttgcaaagaaaattgtgttttgaatgcagaaagagagcgagaaacaaattcagttatagatacatgttgcatgttcttctggtaggtttgaaaaatcaagtagtaatactatactctaccaggcatgcatatataagacagtgctaaggtaatcgatccatgcctgcatgttatggataataaaactcatgacgacttcagactttcagagttgacgattggtgcgctgcgactagctccgctgctttgtttagtttgacgcatttgcctccggatatccagcttgtacaggcgaatagtcctgcagctaattaggttcaggtattcaactgccaatagttaaacatctacagcaaactcaatgataattaagatccaacaaaactattattactatcatggcccgcgagtagcttgctggtacttactccctccgtcccataatataaaggatttaaagtttttaattgcactgtttgaccactcgtcttatttaaaaatttttaaaattattatttatttttttacttactttattatccaaagtactttaagcacaactttttattttttatatttacacaaattcaaacaatacaaacaaaaactcaaaatctcttatattatgggacgggggagtagtaattaactagttcaccaataatttggtggaaaattaagtcgagttcaacattaatttatgcacatagccatccgtccaagaaaaaatcatcaacttctgattacgaatttggatataggctaggttcagattcgtagtcaggatgtatttattttttaacaaagaaagtaagttgatgtgcgcgtagatctaagttaatttgtctgacggctctaattaatgcactaatgccagtagtccagcagtactactgcccaagtgcccagccggccggtatagatataggggctgtttggttcccagccacactttaccattacttgccaacaaaagttgccacactttgtctaaggtgaggtgatcaaattgttagccacaacttactaagcctaagggaatcttgccacacttttttgagccattgacacgtgggacccaatttgttggaggggaatcttgccacaactgtggctacaaccaaacacctgtcaaatttgcctaaccttagagcatggccaacagtttcccgatactcttcccaatatcagttttgaggagttttgttggaaaaaatcgctccaacagtagacctaaatcacccctaaaagcttggcgtttccaaacccgcatatttcgttctccacttgtagggaagagactcggcgcccaatccttcaaccgcatgcacttcgcgcgcgctgtgtgaaaattttcctaccaggttcttctttgtgcgttcgtctacctgtgagtcaatccatcacgccagcagcctcatcttccccgcagctgtctgggaaagcagccatggctcccccaagcttccccagcgtcgacatttttttctcagcggcagcgccagacccatctccaacccaattgggcggaccttcgtcggcgctcccccagcaccaccaccgactcgaatcggccgtcgcccctattcatctccaatcgtccctcgaccctaccgcatcctgcagcacagcctgtctctcgcgtcagactggcgctgcgctccccccggtaatgtgcaggcgacaaaggccccatgcgatgcgaccagcagccggcgacaaccggaggtgcccagtctctggccttcatcgaatcatcgtgcacctcggtcggagtcgatttctgattgttgctgctgctcaaatctggagcttgctattgctgagaactgcttggtggtggtactggaaatttgttgtttgctggctgatgaaaactgttgttctttgctgctaaaaactgctgcttgctagtactgaaaagtactattgcagctgctgaaatatcttgctgcttgctgctgaaaacttcaagttgttaacaccgttcacactaaaaaagctgaaattttttttctgggctgaaaaccccattgttgatgattgcagaaccaatatttttccatgtaaaatacaggagatcgtggtaataatcaagtgaaatatcattttggggcaaatactcagatcgtacctgaagccaatggaaacattgttcaatgcttaaactgtcagttatgatgtcaaagagattgatcactgaatgtcctgaaaggagccgtgaggaggatgcagcattgcagcgtgtgcgagcgtgagtggaggagaggaatgacgattctgttggtagttgtcgatgtggcctactttttttgttttgaggattaaattttgggaatctcttggagataaaaggtattctcataccttaaatcctttttagagatctaaaaaaaatgatttaggggattgaattttgggtggctgttggtgatgctcttaggcgtggcaaactgtggcaaagtgtggcttgcaaccaaacacacccatacagccgcaagttggacatagagggatatatagctcagagatccagtactgatgttaatttgtacggcgtacgtgcctctaaaattcgcaaagatcaatgtatcgaataataatgtaattaaccatatgatggagcgcacacgcaatatcaccgccagcaggcaagataggactatattcaatgtttcgattgctgtaaattactccattcgtactcgtaaaaaaagtcgtttagaacaatgtttaaatcaaaccctaagaatataaatcatgaataacttttaagttgttgagtttaaaaatataaaaattatatgaatagatttgtcttgaaaaatactttatgaaggtatacgtatatcacttttcaataaaatatttttatagaaacaagaagtcaaagttgtgttttggagaccgtatcgctgtccaaaacgacttcctttaggccattcccaacctaagacactagatatggtttccataaactccacatcatcaagaaactagtactccctccattccataatataaggcacaaccacttttcttacatgttccataatataaggcatgcatgcaaatatgcaattaactatggcatcttcttcattaaattataacttttttaaatcctccactctcatattatctaatcctattgaatgcatgcattatatttacgaggatgatccaaactacaagatgataataattacttcttggtctttgggttaagggtggttgtgccttatattttggaatggagggagtactagacactactcttccaatgcaaacaccactattctatacttaaatttaatgctacttatctcacatgatgtcttggatgttgtgtagaaactatgtctcatgcaagacatggtttccttctctttcctcatttattcacttgtcacatcatttttcatcataggtgacagtttatttaatgctatagacaccatcctagtcattgggttgggaatgcccttatattctgagcactgagggagtatattactactaatttaaaagcacaagaaataataactaattaatcaataagatcctcagaggcaatacatgcatgaatcttacttttgccttgtcgcagaatataaggtagctttgtgatatcgagaccgtattttattccatatctattaatttttatactatttaattcatatatcaacttttgtactactccctccacttccatggttataagacatggttataaagtcaaactacttcaaatttagttaagtttatacataaatataataatatttataatacctaattagtttcattaattcaataattgaatatattttcataataaatttgtgttgaattgaaaatattattattattttttacaaacttggtcaaatttgaagcagtttgactttgttaaaagtcaaaacatcttataacctgaaacggagggagtactgatttatttattcaattattatattaacttttataccatgacttgttatttagctattttcttatttcggagagcgtgcagtttttcctatgtgttcattgaactcaaataactatagctaatttagccatcttactccagtaccagataacactatgcctgcctctaaatagtcaaagtctgcacaccctactagagcatagtacaactgaatttgaatctactccatccattttatattataagactttctagcattgcccacgttcatatatatgttaatgaatctagatatagataatgctagaaagtcttataatatgaaacggaggaagtacgatatacgaagatatgaactaaagtcattgcttaggagtattgctatacgaccagaattaatcttagagaaaaccattctttacagcctgttttggcgcacaatggttaaagcaggcagcagccaattaagcaactacagctatatgcctagctagccgcaggcaccaagttaattaatcaatctgtacgtacagaatcaaaaagcctgtcatgatgtcgcttattagccagaaaagtacttaagcaatatacaaatctgtgaaaaggcgaaactcatagctttgtttcatctttttcttccacgtccgattcccttccgtacgcgcagatcagcgcgtgcatgcatgctgaaactgcagatcgtacgatccatatatatgcaaaaatacactaccgccggaaaagaacacacacgatctatttcgggaataactcactgcgttgaaaaggacagtgcatcagaataagttaacactaattaactcccagccacgcaaatttctaggctttagttttgattaattaaccacagaatccgatcgaatttgagcacagcaaaaaatgtacatcagcttagtagctagctgcagtcaagctaattaagctaattagctcgcgactggacaggggagcaagagaaccatgatatgattaaatattttctgcaccttaaccaatcatggccaagagataagctaagctagctaggcagcatccgatggccggccggctaattaagaattagtgcctgggcgaaaggctgattaaagctgcgtggatgcaagtggggaggagtgattagattagattaggggggcaggattaagataatccgagcggcgcgctgtctcatcgccgggcatgtgctagctccctcgcctgtcgcgttgcggcgccaagcgtctctcgatcgatcggtagctcgcttgtccgtgcatggcgccatggttaacctgatgatgataatgctaatcttttcgttgaagccgtctgactttagcacttgattgttaatgaccttattaagcagccagttgattactttatcggtcgggaagagacttgaaatgatatgagatatgcgcccagttgccacccgcggggaggtcgtaatctgcggtgacctaatctgggttagagacaggcaacctctcaattgtcacattaatttgtaagcacgtactcatttgtgcctcttttgtgtctcctgtcatttcgtataatttgcctggctcccaaagcttacagtattaattctctctatatataaagctggctcgatgattcaattctactacataaataattgtttgttcaggagtagtactagtacttactaatctttattcataagtaaaccttgggaaccctaactaatgatgaaatggcatcagaaaaagccatgcgtgaagtgtcacgccaaggatatgggacaggtgtcgaccctgggattcgcctacagtttttttctttttcagggggattcgtctactgttggctgcaccgcacaggctactgcaggaggaagagagagagagagagcgcacgtaacgccgcggggaatgggtcacgcgccacacgtgggcgacggccccgcgcggtggcgaggcgaattgggtggaggggacggggggccgagatatgtcacatcgaatttttgatacgggccggccgtggccgtgggccgcgcggccacgtgacgatgccggcggatgccgcgtcccggagcggcgttggccactgtggccgcgcgcgcgcgagcccgaggccggaggccaccatcatccgtccacccacccgtgccgtcgcgtcagctgctgatcgcggtctcgatcgccttggcgcggaacgctccgatgtcgtcgcgtgcgggattgtggcggcgtccgtgcctcacgcggacgtgatcgcgcattgggggtgtggtgtactggtggtggagcaaacttttcgcaaggattgtgtatttttgtgccgtgcgagggctggttgatcttgcactagcagttgcaggagatagtgctggacggtggaggactggaggaggaggaggtgaaggagaattgactgggtgctttatgggctgttttgggctacaaatctggcccaaagtctgttcatttcggtctcttgggccggagagaagacgggagaattgttggggtgctttatgggctgttttgggctacaaatctggcccgaagactgttcgttttctcttcaacagcgtggaaatttccgggattttgatccaatctgccttttctacttgtgtattgaaagcgactacacaagaacagaagttattatatgtgcacttgtagattcgaggtaggatttatttagctactaggagtaggattttggttaaagataaggagaatcattcaagatttcaagtggttctagtgcggcgtaggaaccagcatagcgcggcgaggatattcttcagcaacaacaatagaaagcaggcgtgattgaacacgagaattttcgcaccgaaatctgtgagctcaaggaatcacagcacatttggcttttgaaatctgtgtgcttatggaacgaaccggaccagtatattcgacttaccttataaatcaaagcaagtacctgacagcaacaggcacaccattgcgaaaaaataaaaagagaaggcgttctgatttgatccacactatcaacactcggtcacaggcaacaggcagtcaggcaagatgcaatacaggctacaaaattcagaactgagggacatggagggaacaaaaggcagaacgaacagtaaaatgaacatacacagtcaggttctctatgctgtaaacaaaaattactgagctgctatactgcacaaaagcataagttaacctgacctgctgctatccagaaaaaatggaaaaataagtttgattggttacagaagaatgaaaaaaaaaactgaagggtaaaattacagtcagaagctgcactataggttaatgcctcctcacacattatgctagtataatacaggttgagtttggaactaaagaatcgctctcttatcagcagtatgtacaagcccattgctcattcgcttctccacaagctcagggcaatccctgtctaaatatgtccagcatttgaatgatgcgaagggctgctcaagaagcagccttggcgacatccttacttgatcgattgtacatcatgtggctcttgacaaggtgaccagaggcaagagcggcaaggagcgagagctcgccagcgagcacgctgccagctactatggtagccaaacgtttagcatttgcaccaggtgagccatgatttgaacccttgacaccaagcaggttcaaacaagccgcctgtgaggccagacatgtaccacctccgattgtacctacctgagagaaaaaatgaaccattttactaacatgaagaaattaaataaataaaaatcgatgcggatattgctctcacgatcaaactgcatgctaaaacaaaatattacttcagttaatacaagaagatctctatgctatagattttgcagctccatttaaggctagcaggttatgctataatctacataatgcaggtaggaacggaaagtaaaacgaataaataatcacctcaatggacggcatggtgacagagatatgaagatcatctccatcatttacttcttccaacatggtgatgcattgtgagctttcaacattttgtgcaggatcctgtcctgtagcaatgaataatgcagtaacaatattactcgcatgggcattaaaacccccaagagccccagctacagctgatccagcaagatttttgataatgttaagctcaacaagtttttctacagtcgtcttaagaactttctgcacaacatctcctttaataatagcctcacaaacaacagatttcccccggccttctatccagtttacagctgtcggcttcttgtctgagcaatagttacctgatgcacacagattaattcatcaatgtgcatgcaaagacaagaaaatacatggtgaattgatgaaaacagatagtgtgaacacccattgtttcaaaaaaagcacccccggcacaaatgcctaattgatacacgcaaatatattatcagagaatattagaccatgtttgatgcgagtctgatgaaaagtagtacattcactgttattcggtaatcagaatatattttacaattgaactaggctagtgcacaatgagcagaaaataaataaaaaggcatccaaaaatacttcttagggatgaaaaaaatccatcttataacctgctgaatcttctaagaaccgatatctgctttctgtaaatgaagccaagggtttcctctctagatcggaaaaatctaattagggacatgtttctttaagttacaaagcaataggagaggaaatattttgggtgctgatgaaatatgtttttcatcatttccttcgcaacatttccaaacagaagttaaagaatgtgattttttattcgttttctgctaaaaggaggcattgacttagagaggaaagcaaaactaactgaagcatgcaaagttcaaggggaagagttaaaaccagatacgctgatgacatccatgtcagggaagacattctgcagatagcccaagacattctcaacaccttttgacaccatgttcattcccatagcatctccagtgatacagctaaatctcatatataggttcctcccagcgagtgcacaacgaatgtcttgaagcctaccaaatctgctggacctacaccgattaaaacagtttttatgtcaattctaatagaagatgacctctatatggagttattggttctactaaggaagcgaaacaatagagcaaaaaagaaaaaaaaaggatgatgtaagaacgacttaggccctgttctattcttcaacttccttgttttccgttagcacgcttttcaaattgttaaatgatacatttttttaaaaaaagtttctatatagaagttgttttaaaaaagaaaataaatccatttttcaaatttataatagttaatacttaattaattatgtgctaatgagctttctcgttttacgtgcaaccaaaatttatctccaaatgtggagattaaatggggccttagataagcaagctgcgtgattgtctcaaatgaaaatttccacaataaagtatacattttttagataatggatatcattccggcctctacactccacaagagtgtacacagccaacaataaagtatgcatgaaatttactaaattagaacttatatagggcacagaggaggataacaatcagataagttgtacaaacagattgattctcacagtataatggatcttcaaacaatagtaccaaatcaacactgtatagcaaccatattgtgtgacatttgccacatcaaaaactaagactgaaacatatgcaatccgaaatgcagaggttgaaagaacaatgtcaatggcaaactcacacttagctccggaaaagtccctggagaatacactatgcaaaaaggtatccatggaaccatgacacttgcccatatatgcaacccatagagttgcgtcggtattgggtagatggttctagctgccaagaacaactataaaacattgtacagtttaaaagatcagaaatcaaataagatgtatagacacctttgactttgactggtagaataatatgccgatatgtacagtgtctgaataactggatacgaaaaatcaaagaaaaatatgaatatgaaaaatctgcacaacaaagttgtggaaatcacagaagtggcttgtgtggtaaaatagcacaagtgaggatattaggaaagtatactaaatgcagcatacctaggaactaactgttggacctatttggaactttgaaacacacggccacaattttttaaagagattcaataaaaacctccatattttctcagtactctcaaatgacagaaaacaatgtaagaaaagatacattaattagaaacatgaaaaccaacaataacttattggaacacaagcctactgttatctaaagtgtacttaatgacagtaaccaaagcttttgaacatgagcctacaattacgtaaaggttccagacaacaaaataaaacaaaacaacatatcgtacatttaaaaaaaaagagagagacaatagatcctctaaggatactgactacagagcgacagttactagtcagtaacacagaaaaactccaaaagacaaatgacattaatctgaaaattctaacaccgtaaactgtcagtagatgtgtgtaccctgagtccctgaacatctgaaggtgcaaagatacacactagaggttgagatcttaaatccacatattctcaagtttggagagcacaaaccaatgattcattcacattcggtattatttaagcgaacataaaaaggcaattcaaggtgaacacttcagaaaggtattatctatgagctggcattatctgcatttagctggtagctcttagaacaagtaaacatagtattgataatgcattgtccagtacctccagtgcatgtgctagcttacacactgtgggctctaccctgtcagcaatcacatgatagaagggctttccgttgtgggaaatcacctggtcttaaaataccattcagtgctagctatcaacatcagtccattactcaaacataagacgacaaccttaagatacactgaaagatcacatttttcccccattaattaacactgtgcctgcctattgtcgcgcaaagtcttataacactttgagcaagcacacaaatcaacaaactagattagtggatgatgtggagtgtacctattgaagacagcagccagcaactcaaaattcgcaggcgcctcagcaaacgccttgagctccgctgcccgcattgcggaaggcagcttgacagcaggagcgcgggacatggcgtcccggagcagaacgctgaaggcgccgccggaagcggagatggccctgcacccgcggttgacgctggcgacgaggcatccctcggtggtagccatggggacatggtactcgcggccgtccaggagcagcgggccggcgacccccacggggagctgcacgtacccgacgggcatctcgcagcattgccccagatggcctggtagtccatcccatcgaaggggaggccctccactccccgccccgtcacccgccgcagcgcctcccgcctcagcctcgccgcgcggcggcagtccccgagccgcgactccaggcggtgcgacggcagcgcgccggacgccaccgcggcgacgatctcctcgtcgtcggcctccatcatcccgccaccatgcccatgcattggcgcgggctccgcggcggcggggcgcgcgcggcgggagcccccctggccgtcgtcgtcgtcgccggtggtggtggcgggggcgtcagggtgggcgaagaggctgacgaggtagacgacggtggcgaactcccggccgccgaggggccgctccctgtcgctgcagaggcggagcaggtcgcaggaggagagcacgagggagaccatggccaggccgttggtgatccgcatcgggaggggcagcgccccccaggtgagcgccctccgcgccgccccgacgatgcgccctccgcccccgccccggcgcacgtccatccgcctccttggcccaggatcactggagacagagagagagacacaacccaacccaaggcgatcgcgaacgacgcggacctcgcctcccccctcccggctgtgcgtgtgcgtgtttgctcggtacgcgatcggagggggggatcggacggacgggagggtgtgatggtggtgtacacggaaggcgcagcgagagagaggggaggtgaccgcgggattgtctctctcgctcgcctcgggcgttcagatgttcggcgtgacaggacaggacagggggatctaagcggcaagccgcaagcagaggcgtgggcgggggagggggaacggcacggggcccgcgcgcggatgggcggcgggttctttcttttcttccaagcagaagaccgggaggagacaggagaggctcgggcgttttccacgtccgatgctgtttgcaaattgcaaatctgctcttttgtcagcagtgtgagtcatccgtcatcgatggagctcagcgagaaatgtgtttttttttcttcttctctcttttatgcagtcgatcgtttggaaaagtgtgaacgagaagcactctctactcggtaatctatgatgaaatgtgtggttgatgtgatgaactcgctcgagcatgggaatggtgtgcgagattttggtctcagtcactgctcaccttggaaatattttacatcctgactaggcagttatgtttgggttcagagactaaatcttagtacctgtcacatcggatccgatgtttgacactaatttagattattaaacatatactacttacaaaactaattatataaatgagagctaattcgcgtgacaaattttttagcctaattaattcataattatcacatgtttactgtaacatcacatagactaatcatggattaattaggcttaatagattcgtctcgctaattagtttagagttatggaatggattttgtcaataatctacgtttaatacatctaattagtgtccaacatctgatgtgacatggttccatccaaacccccagttcggtacatttggttcccaacacctctctctcatattccgcgcatatgcttttcaaactgttaaatggtattttttttcaaaaagtttctatacaaaagctgcttaaaaaatcatattgattcatttttgaaggaaaaaactaatacttaactaatcacgcgctaatggaccgctctatttttcgtgcgcaacatatatgttcccagcagtgagtgccgaacacagaatctttatcataaggcacatagttaaaacaaatattcacttcgtccaaaataaattaatttagtatgagaagttatatatctacgaatcatatattttgagacaggtggagtacagtatatgatctattccctaaaatttttttgatcaaattcgtatgagattatttcatacgttcacaggacttttactgatcacacaatataatggtggtcataaaactttctaaagtaattttgaatttctcttatgaataaagataaagaattaagaagtacatgtttcacgacaattgttgtgtgttactattatactacattagatgtttttagaagtgttaagtgcatactttaggtcttctatataacttctacttttagctcttttttcgtaaaaagggtgcgacaacttagtgagtaaaataggatatgctacggataagatcaaatgagtaacttttagccctaagttttttcatgtcattcttcggacaaaatgattcatttataggaaaagctaccatatttactgtagcagccatactatcatgtatcaagatggatgtatggaacgtactctatatatgctacggataagataaaatgagtaatttttagccctaactttttttcatgtcattctacggataagataatttatctataggaaaagctatgtttactgcagcaaccacactatcatgtataaagatatattgaatgtactatatctatccacgattataaaaattcatctaagtgtatagttagaaatccctatatttatggaaaatgtggtagtaatttatcttagcataacaccacttcaacatctcaattccactttagtatggagatgttttctccttcgcatagagatagttaattaatccttaaaaacacctttctcatgacttggtaagtcaaagaaatagctagtaagttacatgttatatatactctaatatacatgtttgtaattaattttgttagaattataaatacaacctcatcagaatatccttgaaccaaaaattaaagaaaaatgacacatcacatccattgaatccaaatagaagaggcatgtagctcttcaacttgttttatataa

SEQ ID NO: 67933 - DNA, 11584 bp, Oryza sativa
ctactcaaacatgtccgaatccaacttaccttatatcgaccaaaacttacgacaagtagcaaatttgctcatcatccacgaacacttcgattccaaattcgtttctaatatttcgaagcgcccgcaatttcgctgtcaaccgcgtgatccatttgaaaaacccaaacagctctctccctcttacactgtcacacacactggcttcttcgctggcaaacgaacgtgacttgggttcccgtagcagaagaaggcgcgccaacccaaccgtcggccccagtcacaatcccccctttcccctcctccgccgactcgcccaccttttcccccttccaaaatcccaccgccgattcgctcccactcgcgaaccctctccaatcccaaggtcggagagggggacagcgaagctagcccacccgcaccaccgatcctcgaagggattccagccgatcgctgcgtagctcgccggatggcgcagcagcagcagcagcaggggtcggggtcggggtcggcgtcggcgtcgagctccagctcggggctgcacctgctggcgtcgccgttcggggacaccacctacaccaaggtgttcgtgggcgggctcgcgtgggagaccaccagcgagaggctccgccgcttctacgaccgcttcggggagatcctcgaggccgtcgtcatcaccgaccgccactccggccgctccaagggctacggcttcgtcagtgcccttcgatttttcgccgctgttgatcctgctttttccgggtgtttgtttgtttgttcgtggaattgctggctgtaaacagtggttggcttatacaagtgtcatgttgaccttgtgcaggtgacgttccgcgatcctgagtcggcgaggaaggcatgcgaggacccgacgccggtgatcgacggcaggcgtgccaattgtaacctggcgtcgcttggccgcgctcagcctgcagttcctctcggtattgatctccctgccttgacactgatttgcactaacttattcgagtagattatgagcacattttgataccaccgtgaggatttgcttgctagcaagttactgcagtggtatctgtggtatgattgtgttgccttctgcaaacttatttgatcggttctacattgtgtttgctctagaatttagttacccgcactcgtcctcctagaataagacaactatggaaagaagaaaaattgataatcaagtgaacataggtacagtcaactatataccttctcaagtgggtttgggacttaaaataacaccacaggtgagctaaaatgatactgagcattcatttgaacagaagtactgatgatgttggtgtttggcatgtgcttgttttgttttgcaaacaaaaaactacaaattacagtatgccacccctaatggtgatacgatgactactaatataccattttggtaccttaaacagttcttggaagtgctcatgcggtgataatagttctatttctgtaagcatttgttctgaatacatgcacaatcttttcagggaggccaagatcagctgggtcctactttggcgttccagttccaaggggtgtttatgtagggggttatggtcagcaccggacacttcctcttgggtattaccaaggattcccggttccgcaatacaggtatgatgtgttaacttttccaatgcagcttcctgctcttagatggcccatttgtgacaatcttcaagtagttcttacttaggcgtccacatttggcatataatcttgtggcaattactttgtgtagattgtgcatagcctgcatcctattttttttctgctcctcttcgaaaattgccaaataaatatgttcattttcttcgtggaacataatatcgctgttttggaagtcaataaagtgtgttcggtcattcattttcctccttttgcagctacactacatatgggacagaatacatctatccacaggttgaagtgtgaaaaatattacgtttaattttccttgcgcaacataagggttttacaaagcatcgactgattctgatgagagatctctttgtagggtacattaaacccatatgttggtcagcaatatgttccaatttatggagtttcatccgcagcaaatactgctagccaaccatttagccagttcagcccgtccatttctggtgggggtaatggttatgtggctattcatggttacaatgtgccaggaaatccatttgtacagttaactggatcaaactttagcagtgcatcgcctacacctcggcccaccattcaggccccctttttagttggtaatgtggtcttctttgcctattttttttagtatttagtgattcctcttgtctttccagaaaacacaatactgtgttatgctatatgttctcacaccaaatttaccaggctaacatggatgctatcgttcattcgtcaccctgcatctttttatagtgtctgcttaagtgttctccttttgtgaataacttcatattacttggcctttgtagcagcaccggttcctactcacccgcacttggtcctcccagctcactcacctcagtttacacaggctagtggttcagaccaaagagcaagctgaactatgctgccaaacatttgtaccttgaggtttgttctgtctggactgctgttatcttttcttgtgattatctggtagtaactgttctttttctgtccctaataggtacccttagattgcagcaggacaaaagagcagtgctgctgtatttgtagtactggttcttacctggcaagtaatcccccttgcattcataaggtaccaattatgctgtactgagaagccatgcttacattcatagaatgccaatcttactcttatgggaaattagtccatcaatattctgcccttcagaagttcagatgcatttagtttcagaacaaaatgatggagttacctattggttctaacttgtcagaactcaaaagggacaaactttgatgttaatatgcttgtgttttgtctcttattctcattgttgtactccttaatctcgttatgttttttaggatctcctattatgctccaatagtattgcattcgatactgggtgatgctttcccataattaacttgaaaccaaaccaggaaattcattcttaacgttgatgttagattagttttgcatctaacagaagataagtacattgatggcatcatggcgttcatcattactctgaacatacagactaaacagccaactgaatcttaatcaatctgtttgcttgtgatatgatatggtcgacactaaatagcaaaatttcccagagaaattctttctgtttgcttcaggctttctttgtttcttgtttcaaaacattgggaaatggtttatacgtgtttgtctgaagttattgtaagccaattggatcatgtgcccgcacgtgtatactaatgtgatcatgcatcttgttttttatcatatacaagttttcattttattgacctgagttctatttctgtaattttgattattatgataatcttcgctatgaaatttctgcaggttgcccttatcatggtcatcagatgtacctggaatcatgatgttgccccgatggatgggacaatgatccaagagcaacggttgctcttgtcagttttgcttggttacatcctatgtctcaatgggactgcgaccattgctgcagcttgaagctctagatacagcattattgatcctgtatctgacagctcattagcccatggagatatactggatgctggaatggagtccagcactctgtaagatgactaatccccttggattagtcatgatgcactcatatgattgttcacctaaactcctgaagaatcatcaagctactatgtggttgattatatcccagtgttgaagtctggcacaagtccaacaaatgtagcccgtcccgtcagtcttgtgtctgtctatggtcatcgtcgtgatctatgcttgatcggcctttggaggtataaatagttattgcgtccgcttcactcatcatgtccaaaatgttggaccaagatggtccttcctcctgtatctgtaacccaagtgtctaccggaactgctcagggtcgttactcgttaccaactggtagcgaggtcacgaggactatcttctatggtgttactggtatcggtatcagaactaccgtctattgtgttactggtatcggtatcagaactgttgttatgtgtttaatttttcattgctatgtgctcagcagttcctcgacttccgagaacggcactttgttgtccgaccaaaataaatcagttcggatgagaaacccatgctttggggtcttatcggtgttgtgtaagcctggattgttaaaacttgtactatttgtacaaattgttttgctgttttgcagtgatgtgtattatgtgaaattgtttcagaaattgggtgttttctgtgtgacgacaatgctctctgctcgagttagcggtatcagtcttgatcgttaaaacttgtacaaattgttctgcggtttggcagtcttgtgtattatgtgaaatattgtttcagaaattgtgttttctgtatgacgacaagtcgacaatgctctctgcccgagtcagcgatattgttcaagtctaggttgttaaaaactttactatttgaactgatttatctgcggtttcgctgtctttattttgtgaaatattgttacagaaaattgagtgttttctgtatgacgacacaatgctctcagctcgagttagctgctgctgccaatgcactaacttggagctttggaagtacaccaggtctgtgaatatgaaccctgagatttccccttctgtgcacgattcaatcactggtgctgataatgatgtgagagaatcgtgagtaataaacaaatgtacacatttactttacatacaatgcattctattctgccaaagccaaaccaccagaggataattcgtcagtcaatacgttgccttactgaactgctgttgggaatgtggcgaatcatgtctgaagctactgaattctgattctggctcttgaactgaacacactccagcttcagtgctacgagggattgaattgatggcctaacagcataaccattttattccgtaaatccagatcattagagcttactgctggaacttacagaagccatcatagaactcttaaatggaggttgggatatccagctttagtcttgtacttctcgaacagttcttgtagtgcgacaacaaattgttcatggacttcatttatctgccacatcagggaattacccaattttaattgtaagaatatatacatttttatttttttaccattcaaaaacaattaaaacaaaaaagatcctactttccatggtaatatttatcttagaacatcatttaatttcagttttttagtgtgcagactgatcaaaaggtgtacttggcataatgtcaagatgatatttcacctcatcaaaggtaggctgagcatttttcttaacctcaattggtcttccaacaaccacgtgcatgggtgtcgcaaacggaatgggagtcctgcatcacaatgtgcaaggacatatgaactcttgaccaaataaaaaatattgaaaaaatatatataaactgcagaaagttacccaaattttccccagaacataattggagtaaatttaattgctctagcaattttgacaattaatttgccacctggtctccaccacttataaacatagctctagtcaaagtagtgccaaaaaaaaatcagcaaactgaataccatgaataaatttactatatggataaggaattttgcatttatgaacttattgggtgcaagagtagattacctgtccgaaagcgaaaacagggactaaaggggaacctgtttccatagctatcttaacgaaaccttttcttgatttaagaaaagcaacctgtcatttgcaaaaattaaccatcactattccggtaaaagatgtaagtatttcacttggttttgcacaagaaagaaggcaatgtctttattgataataaaagaagaaatccgcagttacctctgaatcatgatccatgtgaagcatctcctgcacccctcctggcactatgacgcagctataaccagctttaaggtaggagtagaaattcttcctggatgcaggaaccaaccccaaccatgtccatatttgcctcaagaatggggtatagaacacctaacaccgaccaattcaccagtaaagagcatatctttatttagaaaatggattaaaacctggcctctatatccagatggatgttcgcagccacaataaatagcatatgtagtaatagagtgtcgaaagatcaaactcttaagaatgtactcctaggaaggaaatctgggaagtgggaacctcaccgcactgcttgcaagaacctttatctttggtaatggcatgaatccaacaagctccaaaaggaccccaagggcaatgggcaaaacagaatgcggctcataaccaaacactgcaagcacagcacaatataatcaccaacccagtggacagtgccctctatataaaagactccatacttttctatatattactactcctttacttagcttttagaaataggccaaaagggtttgatactttaaagattaaaaagattcaagtatcacaatatcatctttagtagttgtttctgtttagctttaggaatcaactgaaaagcctcggtatcaatcatcaatgtgattcaagaattaatcaagattccagagatggaatgagataaagaggaagctcaccgtaagctctattgggatcaaaagccttgtagtcctcgacatgtaatgtgacggggaagtacccaatcacgcacttgctgatgaacctgaggatgcgtcgtcctccaaaatgtaagatccaacaatgcggtcaggtaaaaaaacgttggcagccgaggaaatcgaggagacgaacctggcgatcttgcgccccaacctgctcatatcattgaccggcgcgaacatgaagaagagctgcgtggcgagcaccctggataatacagcgcggagaggcgagagtgagacccaagtacccaacccgtcaacggcgagcagagcgcgaggtagggaaaagaagctggaggagagatttgggtaagaggttacatggcggcgacgcggcgggggaagaggaagagcgaggcgaggaggaggaaggcgttgaagtggatggcccccagccacagcgccagcgcaaccgtggtgcgcaccggcggctgcgccgtcccccggaacaccgtggtcccgtcgtccgccatcaccgccgcctcgccggcgccggcaccgccgccgccgtaccgcacttcaccattccccgcccccatccgccgccgccgctggcgacgagagagacgtcgcgtctcgcgtcgagggatgcttctagtattgtccgcctctctctcgcgtcgcgggcgatttcgatgcgtcgtcgcgtcgtctccgctgtggctcgcgggcttgacctgtcagtgccccacgctgccaacttatagccggcgcggctgacaggtgggccatcccttggaataagggagatgagatggagtagatgggatggttgtgctgtgcgtgcgcccgacgacgaacccgttcgtgcggatcagcgcgaatcggcgaggtaagctggacgcagggttttcggaataagtttgccgataaattttagtaccaaaatgattgcgttttgattaattttattttttattttggattcgaacggctggctaaccgagtgatttctcagtgcaaaccgggaccggctgttgctgttgctgttgctgtgattaccgtgatttatctcgctgttgctgttgccgctattgattagctcagcagctgactcgcaagatgcggacatgactagacgggatcgtgtttttttaaaagaaacgggatcggatcaggaaagcgacccgcggtgttcttttgtgttggaaatgaaaatattgttggaaatgaaaataaaaatgaaaattaaatattttacgttaaataagatggtattaatgtataattaaaaaatatttatctaatattttagaataactttcgtaagaaatatattgtttggtagtttaaaaaatatgtcacaatgataaaaattttcatccactactcgtagcagaaaaaaaggggcgtcccacgcccgtactcagaccggctggttttgcagcattcggcggcgtcacaactcacatatgaaggtctgaactttgcggttaccgagtacgcagccaacggtgacgtcactgtgactgcgggacgccctgtgatttatggccgagtttagtttctaacttttttaaaaaatttctaatttttttatcacatcaaaactttcctacacacataaacttctaacttttttttcaaactttaaattttaacgtgaaactaaacacaacctatgccaatatgccatgtagcggctactgtagcaatcgataccgtgcaatgctgtcgcattgattgctcggctagatcagatggctgtggccggcacatgcatggatggccggctaggggaggaatgcagattttctcgcacaaaggtccacacaactgtctcgtaaaaatggatcatgggcaaacagatggtagatttgtagtaccacttgtactaaatctaggcgtccagcgcgcaatgctgttcgattgggtaaatttaagcctttagaattgcaggttatatatgatcatagccagggttaggtggggaaaaaaaactgtcacaaccaacaagctgttaaaccgtgttaaactccccccggtttgaagaacttcaagaattccacccatcgaaaatgacctatacctaatccttctatgggtattaacgccaatgattgttgtacacttgcacgtaggatgtctgtactagagctatgacggtactttaataaataggagtattatggaaatatgggcagtccttccggctgcacgctgcgaactaaagtactaaacttcctgaatgctcgtcacacaaatgaggaaaaggacttgtggagttcagaaggtagcaagagtgtgacacagtaatactattatgttcagctggactgcctggacctggacacaataatactatgttcagctggctgatggaagggaattcttgaagattcaaccaagaggaagaaaaatgggtaaaaacagagcgggcttgtttggtttagtaccctaccaatatattgttagtgccaaactctaggcaagttaaatgagtgtctttggattgatgccaattgagagccaaattttaaattgtggtgaagaacattctagaattgtgctaaattgagtataggcattaccaaatatttggctttaaaccaaatcatcacatttactatttaaactaccaaaacattggtatggcaatattttgatatcaaaccaaaacggcgcagctttaccaacaagaacctcatcttggaacaaaaattaatatttcgttaattcggttcaaaggttcaaaactgagtgacaggtcctctcctttccctcaacaatttgatgggctaaccagcgtgggtttgaggacttactcattttatttatttgataggaaaaaatgatattaggtaattttttaatatttgcatttttaacctgctctatgttttaccattccaaggattatcaaatggtcatttgccaacgtatctcgagaacagtagggattcgccatcgggaaagaaaataacgtttctccaacaaaaaagaattggcctgttcggtagctctaattggcagccagctgctacagtgaaatttatagaagatcaatggtagcagctgcacagccgctgtatagggctgccgaacagacccaatactatcggttatcagcgatcagggactctagaaatttcctttttggcctttcggcttacgcagcgaatggggtcccggccaaaccttgcggccggagctttgcctcctgatcctccacaccagcgctcttccgatccacgcagttggcctcacgagttatgtaccatcagccattactcctccagtgcaaccctctcgaaggagggaagaaaaacacaaactgtaattttttgcctaccaaaatttggtttatttaagaacatcgctgtctgaacaattattattccagtccaaccaaacacatcaatagcagactcacgctaccggctcaaaaatggcaaaactctccaaagaaaaaacacgaaaaagaaagccgtggggttgcaacatcactgtttctaaccccacatgtcagatgacacaagcgaatgtggatttagtaatccatttgactcagagtggggttccctggccagtggaagacgatgtcatgatcgccaatgtctcggtcacagatgacatagcgctcagcgctgccttgagaacatcctgcgagcacccaggcttcacgatgcttttcacctgcgcagcaacaacagttagaatagacaccaacatgtgccatttgtccacaggaattcagattgttcgatacgaagatcgatcaattattgggattatggaaagtaccttctccaagtattcctggagtttcttgatcctgcccatatagtcttgatcttccacgcacagtgaaataggctttgaatcagcacctgctccttcgaattggagtggtcctgggtttctgtagatgtcgtcgattaagaagctggtagaattgttcctcaatagcctgtaaacacaagtttgttattgtcaatgagattatgcatcttctttagaccaatgacagcaactgtacagcgatcgaatataagatgggattaatagattgtgtacacacttactcgaatgctttgcctttcaagtcgacagtagccatatggacagcaggtttccctatttgagtagccgcaggaccacgtgaccatctcttcacggtcatcatagactaaagggaaaagaattgtgggttaggtgttcccttcattcatatcatactcatctaattttgccaaaagggggtgcacagtagtaatctcaccgaaatcggagccgcaccacatcgccatttgttcgcaggactcttaagatttgtcacagtagccatgtaaccattcaaaccagcagctaagatgtggtagcacacgtgcccaagaacctgaagccaaacaacatacatataattaatcaacagcaaaataaaattgctttgtccaagtagaaaggtgagctgaaacttgcataggcgtaatcgcagtcaaactttgaaggcagtgaacccctagcttggtagccaaaaaagtgacagatcgcattgaatttctttcctttgtaagtgccttccttctgcagagataccaagaacatcatgagccaatataaatattactcactccacatgtagactgagacatcagtaatgcctcagaaccaagagacagttacaagaaaggctgcagaaagcataccatacgcctgttcatttcatcctcaactaattgggccaaaagtttttcggtttcaatctgcaccggtaccatgtggaggttgtaatcagacataatgaaatgaaacaaaaa

SEQ ID NO: 67934 - DNA, 9224 bp, Oryza sativa
  unsure (1)..(9224): unsure at all n locations
aaatgaatagccatatggcatgtacaaacttacctgaagcaaagcatataattcaggaatactctccacgagtccctccggaataagtacaactccgtgatacttatctgtgcaacaaatataaggttaagtaaattcataaattttcacaaaatggcatttcattggtgaaagcaaggttacatgagcatatcacaatagaaggcccctacccttctcagcccttgcctgaactgcatcacatatctgcttcgtgatatcaaagatggtaagttttgatgcagcaacctcctcacctaggataacctgaacatatgatacaggttcaaacaaatgcaagaagaatttgcagcaactcaggaagcataagcgaaaagttgaaaagtccaaaccatattcggatgtgattgaagagcacactccaatgccacatgagaagccttccgccccatcatgcgaataaagtagtaatactgccagaaagaatacaaccacaaggcatataaaattgttacttttgtaatgtgaatttgtaaacaggaaggctcagcaggccttgctggaaaagtatgtctactgaataaccacgctgagagaaatactgaagaacaaatggaccatggaaccccaagaaaaaggataattcagttgtctaatggacctaggcgaatttgcattgttatcaatcagtattggcatcctttattgcctatacaaagattgtgtacacctgtgtgtgaagtgtgaacctcccacataggccgaattaaggagtgaaccgcaaattatagcccgtgttctatatttgtttagctctttctgtactgggacttaacagtatcaattcagagttttttttactgtctcaattcaatttgattatttaattctgagaaaaaaataaaggaattgaccatagctaaatagtatcacagacacgaaagtacatccaactaaagaagaagcggatcaaccatattagatattaccttctcagccgaaagagcatcggtgcatacattgcttataagttgtgagttcacctgttataataataaataagttcaacaataaataaaaattgcaaagtggtaaattaaatgcgtagtatttttgaatgggcaacttggaaagttatccatagcacaaaaaacacactttcgcatacataaacaacctcaattgacaaaaccaaacatgcctaacaggtcagttatgcatcatatagaggtaatggaaggacagtaaaggtaaatggagccccagcatagtaatgtaaagctaccttgcatatggtatcaaaaccaacggttgtctcaacaaactgattcttaaggtccccattcaaagttacaggaacacctacaacctgttcaataataaattgtgtcatgccatttacaggcaagtaaaacatacacttgcaatggaaatagggaatcaggaaccaaggcacggactgcaacaagaaaagggaattatgatataccttcgttgcacacttagcctcagcaaaagtctcagcaagttgagcagcatccgtattggatgtaacaccttcagaaaccagaaattaaacagatgttaggattaaaaaaaatatacacaatgtagctatttagtagactaatgccacaaagcctacctccaatgattactaaagcatccaacttcaaagcctgacaactagccatggcaccattgacctgctctgttgttctaatttgatcctttgtccggccaagcatatcataaccaccttggtttttatatgaagaaagaacttcgtcggtgatctccaaagttttctgtgcgagaagaccatcacttccacctgtttcaacaaaagaacgaaataaacacaaacataagaaacagttaaagaaaatctgtaagcattagctccaagtgttagacatgttcagaaaagcaggcatgagagacagaagcccgccttggggggattcatgcacaggatgccaatcacaaaattaacacatttgatttggattagacacttaagaaagataggtactctgtccaagatcttgtagcaaagcatcactgattgtttttttttttttagtataggtatgtcactgtgttgttaatttcattaagtggacctagcaaagttcggttgaagagctttagatgtcactacttatgtgacaaaaatactaaatgatgtattgatgctatacagttgtgatcacctgctaaggtaatgaaaacaaataaaatataacaaaaatgctgagttaattcaaattaaaacactggtggctgctaggggaagtcgacaacacatagtgtgctaagtagcttgtgaagctatttaagcaaacgctgaaagtctgattggacgcaacaagcagacatgagaacaaagggaacgaactattaatacattcatagttgcatatcaaaggactcaccaagaaaaccaataagtttgctgtttgggttgtgagccttaattgcctcatggagtccccagatgacattatggcctcccggggactgccttccgcagaaaacaacaccaaccctgcatccaaaacaaaacaatcagatgtcttatatgtgcaggcagtgagaggcgaagacaaataatttgatgtaatttctctccagcattctcttataatttgacaaatactttactactagtatttggtttctttttttcaaaacagtttcttgtcttgcagcagatggcatatcaagtaaaaaaattgaatatcacaagtaaaaaatacatatatacctgacaacaggatgctctgatatgacagtagcatcggggacattagccgtcttccggagaaaatgggccaggggctgcccgtatgtgtgggggaacgcgtggctgatcacatgagcgcctgcaggatcagcagcaattgcagcgtcaccatactccactctcacagtggtgccctgatttacatggagtgaagaaattcagagcgtgaattcacaaaatcattcatccaccaccaatcacacgcacgcgagaaaatcattcgcaaaattatcatgaattcatccgatccagccaccagtcaaacagcataactaaacaggagaaagtcttacgatttgatagcgattcatgggtcaccacaaaagtaaacaacacaacacaggaccgtgaaagctagtccaaaaagaaaagtccatggttgctgtagacgaatcaatccatctactgtttattccaagttgctacgctccactactaaactcataaataaaacagcaacacgacaataccaacacggcaaaacgagctttcaaaaaaaaaaattcccccgcgcacgcagcctcccgcaagccaggcacgccggttggatctactagtacattgctagacagagccctgcacctcgcaggcgaggtccagcacgattcagatccaatctggttccccgaaaacgagtgacagactgacagctgatacacgtaaacctatggcctaagacccccgagaaatcaaatcggaagcagacgaacagtatacacgaccagcgccggtgagatggactgatccggacgccggagcggcgcgggatctggcgccgcgcggtccggaagcacacagatctagggccgggaagccgcgccagggaccgcaatgtcgcacgcaggggaaggaggattagcggcaatgggtgggtgcggacctggaggcaggggggcagctcgggctggtagagcgcgcgcttcttctgcacctccgagagctcgcgcggcacgccgtagtcggagtccatcgccggtgacgcagcgcggcgcggcgcggcgctccgattcgttctgtgctggtagcttgggggggtgggctcggggcttggtgactggcggcgactagcggggacgatgtgccgggggtgcgggaggatttttgttatatagtcggaggcggaggaggcggctcctcccacaagtcggcaccgcacgctgccgctgccgcgatgccgatgcggtcgcgtcgggtccctgccgtttggcgaattgcgaatcgggcccaccaccggatttgtttcactactaattgatgggccctgggagttgggccgtaggatcgcagttacaagtgggctcagttactggagctattagggatgtgttcttttgccggctttctcaactcacattcctcgttttttcacatctcgaacgtattgccttttgtaaaaagtttatatatgaaatttactttaaaaaatcatattaattaatttctcataaaaaataaataagctaatacttaattaatcatacgctacaattcgttccatttgtgtgcaagggattagttcccaactcattccaacgaacgcaacctcgcattctcatcttttcgattatacttatcaaccaaaatttaaatttttcaaccttaaatttgaagttgattttgggaatttttcatcatagtttattttccagcctttgcttttggattgttgaaaacatgtatataaaagttttattcacaattattttttatttgcaaatatgccgttccgttttttcctcaagtatgccaaacgatggggctgcccttgatttcaaggggttttagtttggtatttttatcgctattatttatcaaaagcaaaagaagtctatcaaatcaacccacccaatagcattggaaaataatgcctctatcaggtaatctaatacggtataaattcgatgtagataagattgtatatgtggaatttttttcaccaaatccaacgaaattcattagagatggctcatgtaaattttagagaaaagttagcaacagcttcaatatttttggacacatgaaacaaataatccacaaacaatatctagtgaaatagctgaaaagaacatggaccttaatattcgatgatagccagcaacaaaatttagaattcaatagtccattgggacgaggaatcaaatgcaagcataaaaaatttgcttaaggacaagcattgcccagaggcacttataaacattactatgaaaatagtaaataataatgttaagaaactaatcctttgttttccaaaaaataaagaagttaagctttcatttaacctattttcatctctctattttgatatactctgcttccgactaaaaataaacaacaaaacaaaaatctccggtaggtcaaaccaaaataaaccagcctacttatgtcaactactataaacaatactattatagcagatccccaagtcttgctactgattacagcaaaattccgttgtcagctcggcattgagcgtctgctcacacaaaaacttgcttctgcaacaaaattgtctaaagcctgcatgaaaaacagaatacctgatatcaaagcatgacgagcttaatttgaagcaagggatagatgcaacggtgaatcacaaacctataaagaattccagaaataccaccgggccagtggtatctgcactcaaaggaaactatctacatatcagcatgcccaaatggtgcacgaacaaatagttggccatgaagcgtgacaacggcggatgtttgatgaggatcgatcctcaatggcagattgaccacctgagaaagagtaatcacttcatgttatctgaagagaatgcaaacgtgctcaaattagtattcaaattgctgctatcaccttcttgaatggagtgatcccccaaggattatcaggctgctctgggtccccagttataaccagacgcccagcaggatctgactgaacatgcacctgcaccatttagaacaaaattcaacaattcatttcttctcgcaggtagtgcctcagttcaagaagtggaagctttttgtttgttacgcacaaattaagtcaggtatttattttaggaaaatggaacagtttgaagtgatgcgttcaacattaaagatattttttcacctcttcgcgtagaagtccaggaaccagagcatagatttcgaaacaatctttctgcaggaaagaaacagccaaatgaagagatttctcccgaataaaaatggcaactcaacagaaaaaccagctcatatgctattaggatttcagaagagcactgaaaaacttgtctgtaatatcaatgcaccatatgagacttacagtctgtcgtacattaatcttcacccactcggcaggttctccaacatcagtgaccattgagtcatccctgaaattgagaatcccgttacataaatacaagttcaggcttcataggctaagtatccaaatatatggatttaaattctgctgagaagcttaattgaacaaaatgtaactgtaatttttaggattttcctataaaattttgtaatgacatattccgtagctaaatccaagtcattatcagccaatgctatataaccaacagaaaggaaaggaagtcttaactgtgatttgtttatttttgtacgagacaccttgatagcacactctggactagatgctttcttcctcttgagtactcctaaatgtgtcaaaacaaataaatgagaaaaaacaacagatgcactgctgaaagaaaacttatcaaacataccaaatactttaggttcttaccacgacttgaagaagggactgaatctttttcctgtacaagtttgaatcttttctgattaaatagttggtgacttgaaaaggtacatgtaaacaaagagcaagatctttttaaccttcaacatttgatctccatatatgccattggtaaggagacggtgagcatgccaaccctgcatagcacgcgctgcagaatcccttctaactctggcagaagatgattgattcataccaatctgcaaggcagtaaacaaacttgtcaagctagctaaaactagtagtttacacgcatcgacaagaaaacacttttggcaacaacgcaacaccacacatcttgatggaaaccttaacaaatggcaggcatcttaaatcagttattagtgcgtctatgtcaataaaattggatccataaccaacactcaattttcagaaggaattcagtgactaaaatcccttggtctttccggatataaccagactgtgtccttaattcagctaggttggtgtaaatatcacagctttcatttatacatgactaatgaggtgcatgctaacaaaggcgtaacaccattccataaacaaatggatataaaaaaaaaagtaaatcccctcacgcacattgtgaggaatgctagcatacgggcctgatcgacacgaaggggtatgcaattttgtttaggcttggcattcactcaggaggcccctgacaagcacattgattatgctttcccttctcttttccgttttattcttttggttttctatatgaaagttgtgtgctccaaagctttagctcgagatgaaagtctccatgtgaaagttttccgatcaaaagctctttagtctccaataggaagcttttcaatctctagtagaaagcttagtctccaaaagaaagttttcagtaaccagatgaaagttccaggtgaaagttttcagttccagatgaaagttgtccaatcaaaggtttttagtagcatctttttttttttttgcaatgagaagttgaaagtttcccttttcgggatgcagaacaagaagggctacaaattccagggaaaggattaggggagactatgcacgaaaagctataaacaaatgtgccatgcccatgcgtgactgtgactggggagttcaagaaatgagatgcaagctgcacgagttggggacacaagaactggattgaggccttctgggtgctctcgtcttactattcttccagtgatgattttttttttaaaaaaaagtcctgcgtggctgcatcctgtccgtaactgatcatgacttttggcgcaggcgcgaattagacaggtcctaaaaggacagcatgtgttcatctaattattaaagatttacacaaatagggtgaatcccgttaaattgtacagtattgaactaaaatataaactgaattaataaattagagctcttattaaaaactgcactattagaacaattacctcacggccagtaccaccaggctgtggtaaagcagacaatggtacttgaagctggccagttcggactttgtatttttcatactcgagaagaggctaagttaatgagaaacaaaaattaacaaatcaagcagaaaacaatgcataaatatgggatggaatctaagcttacaataatgcttctgtactatattccatccaaaacatgcatcagttagcatataaataactaagaaaattaatgatctaaagaattaagagtaatagcatctgaagaaagcgcaacagtttcaataaaatgatgaagggacgcatcaagtaagatattgctcgttaaactaaaagtaagaagtaagaacattaaatattccctgccaaaaaaggaagcaacattaactgacacgggaacccctaaaatttttacactaataaaggcagacccatcattttagatcaattcttatgtttgaaactaagaactatactaataagtctaacagttttgcaactaaaacttacaataaagttgatgcgatatgatactgattgcaggaaaaaaaatgattgttggtgaccatttacttgtgacagaaagaactgaaaagggggaagttctcttgtgacaagtacagaggcaaaagaaaatcatgcagcaaatgcatcaccttctcatagaaaattcggaacgaccacgatacagtagtgcacgtcctgcaaaggattacggcagcaacaaattactcacatatggaagtctttttttttctgcgaataacatgttctgtgaaaattagaggcttactttggcggcctgaaagtctctccaacttgacgccatagtttacaaattgttacctgaacaagcaaaatatttaactagaataaatataactcaggtccttgcagctcactaatcactgttgaacttatttgatcgtgatccacccggacatatgtcaccgaaaatattttactctacagtagcagcagcgagcaagctagtgacaaggagtcgaggaccatacctgctcatggcctcccaggtgggcaacctgcctccataacctggattggaaaaggaacagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 67935 - DNA, 1156 bp, Oryza sativa
cctgttagctgtgtttggatcatctgaattttgtggactctagaattgatataagccctgacattttactattttatttcccattgacagattatgcaggtgacatgccgagcaacaaaccggcacactatttttcttctttccggatggagtcacgatcgctgctgcacggacattttgtctatgacgcggtaagagggagggaaaaatagcagtacatattatgcacgtttgcgttgcagcatcgcagttgcgggttagcccgttccttctgcacagagacaaaaacatcactggagccacaccagcacatgttctaaccttcaggattccaattttttaatgtggaggtaatagccattcgcctgcaggtaatcacttttttttttctgtgcaagcttctgttatatgagtatgttttcgccgggtgttttatgagtatgtttgctttttttttcttttttctctctcattgtttttttagaaccaacagtaccagtgttgaaattgatcttgtttatttcgtttgggagaaacctgttagctgtgtttgagacatctgaattttgtgtactctgaaattgatatatgccttgacatttactattttatttcccattgacagattatacagtgacatgccgagcaacaaaccggcctactatttttcttctttccggatggagtcacgatcgctgttgcacggacattttgtctatgacgcggtaagagggagggaaaaaaaacagtacatattatggacgtttgcgttgcagccttgcagttgcgggttagcccgttctttctgcacagagtcaaaaacatctctggagccacaccagcacatgttctcaccttcaggattccaattctctaatgtggaggtaatagccattcgcctgcaggtaatcacttttttttttctgtgcaagcttctgttatatgagtatgttttcgccgggtgttttatgagcatgtaagcgcgagcattcgtgtctctctcacaatgttatctagtcggacagtaccagtgttcaaattgatcttgtctatttcgtttggcagaaacctgttagctgtgtttgagacatctgaattttgtgtactctgaaattgatacatgccttgacatttactattttatttcccattgaca

SEQ ID NO: 67936 - DNA, 890 bp, Oryza sativa
agcaaggacaagagccatcgttccatgtctcgtgggacgtacacgaggaacattgtatatagagaggttctcacgtcatagaggtactgatttctgagctagcaccactgtagtatgttggtttgaacagcaatcctctgagctagcatgcaagtagctagcttttgtcgtaccagcactatatttatgtgctgatgtttgtttttacctaatttcagatgtaagatatgtattagcacttagctttctacgcacttatgatttcctgtaacataatcacataatttgtattattctagaaatatcagttgaattcatagcactatggaaatgtttgtgtcatgcgatggtttcatttgtgaagtggttcacaatttatgtctaaccggttgagcagcccatgatatggccagtgagaaaaacaaccgggaaccatctcgaattacccctccccacctgacctactcaaactagcatgaccagtccacccgttctattcaaagccaccttggaaacaccacaagagggatggtatgacattgaagacacgcaccaaccataggacgattcgaaatgaaccctgcagatccagaatcccagaaaatccagactcgccccttcccaagcaatgttaatgggaacccagctgatgggatacaggaaccactgacaaaatagtgcctataaaaagaacctaaggcaacttcaaaaagggcacacccccctcttgaactaagccagtcaaaaaaaccttagcccatggaaaaccctaatgggtatgcccaacagttgaagtacctactccagcaagtagggtacttccaggagccggtctattgttttgagcggatcacccaaggatccttggagatctggaaggtgaaaatctt

SEQ ID NO: 67937 - DNA, 890 bp, Oryza sativa
acatttaactgctccctctattctattctaatttgatcatcctctaagcaaagtgcacaaaataaaaaaaaatgtaatatccatcattttgaaattaatccacattaatcaatgtgctccgtcacttcgtgtccaacaaaaatttattcacactttaaacattgtgagtttaactaatagaaattaatcttaattggttgcatgtatgcatgcagaacattccacaatgaacatttactctctacacaaataaataaaggaaaaagtacgaattagcacctgaactatcgcgatcgaccgaattacccccttaacccgaaaaccagatatcactcaccccaaactttttataccggacgaattaaccccccccttcaacagaatccagagcggttttgtcctacgtggcgtacgcgtggcaatccagtcagcatttccttttaaagttactaggaagatggcccacgcgcatgcacgggtacttatattttgtcaaaattgtaagattaagggtaaactaaagctgggatgatggtattttataataatttagggttctatttttcttaaggtatctaaaaaaccgttttgagtaggagatggattaagtacttaccacttttgaatcatgtttttttctcgagtaaataagaaactattactagttaattaattatcatgcaatccatccatatacatatcgtgtagtatgtccacaaatgaaaaattcgagagcaagatatgcaaaattcttgtgattaaatcgtctcatgaaggcacatgatataataagaaagggagggaagcgtatgcatggaaaaaaagaagaaaggggaaaatgaaaaagagaggggaagtgtatgtacccacttacgtaggtgcgcacctat

SEQ ID NO: 67938 - DNA, 810 bp, Oryza sativa
acccctggaatccctggaattattatgtgttgttttattatatttgtatcacaatatttcactgtatctgttgctgaatatgtaaagatcattagatcagatgtaattgttgtttatgctaaaataatattttctgttgcgatgaactgattatttcttatcatctcgctaagatttaaagttgccctaatttttttcccattgcaacgcatgggcatccaactagtcaatagaaatatttctaattcgtgagtgcttaggaacataacaatatttttatatactgttagtcttttacattgtcagcttctatggcctgaaagggagagatagagagtgtgagtgagagagagattgagagagaggtagggagagagttacatgtgatctatcattttttttttcaaaatgatcagtttgcaaagtttgtcaaatgcgtgcaattgggtaatgttttagagttgaagcttgttactatggtttagatctcatttcctatgtcaccttgatgtttatatggcacatggctatatgaggtccacatttgctggaagacattcccttgcttcagatgatacatacaaatacttcctaagttagcattagagatattggattgcatgttcaatggaagagataagtatgatctcttaggcaatataagattatttagagactgtgtctaccataaactcaaaaaaaaatattctttttattactattctttccattttttcgtcgtcatgcaaccatgttttcatattatagatgataagagtcgctgttgagctgttgttacctatagcaatg

SEQ ID NO: 67939 - DNA, 8632 bp, Oryza sativa
ttgcatctttcctcttataccgctgcatatctagacacttgtacattgatctaatggcggaatactaattttttgcatcaacccgcccctggtgatctaaccctccgtgccatgctttgatgactcttccagctcatccttaccaatggatggatacatcctaacagatggattttgcctgcatgccagaaagagccttctggaaggctcgggaaacggatagtccgctgtaagttaagcatagtaggggattatctatgtcgtgttgtgtaacaacatagttaataaagtagtgtgctataattcaaatgtttgtgtcatatgataaaccttgttataagacaaaagaaatataaaactattgcattttcccctttcctactttaatttgtctttgttatatgttatatttgtttccagtaaggactatttggataagccaaaatgctgataatcttgctgtgtaattgtggcgcaagagttttatttgtaatcctctattactatacaatcgcagcctactaattagcattaaatattttctatcttgcaccacagtcttccacgtaagcatcaaataaaaaatgtcggattcacttctacctcaaaaacacgctttcaattttttaacagctttctcagtactggcccaattctaagaccttgccaacagcccagctaaactcctgcaaaaagcccaactcacccacacccacatcatcgttaaaaacaaaaaaacaccagagagagatgcactattcctctgtttgtcgcaatgcataccaggaatgtataaccatatatgtatagatcatattgtatcattgtattccttgtattctcctccatttgaggatcttgtaccttagctatactataacaatacatggtcatcccacaacattgggtgtgtggtgttcctctaattccttctacattgtatcagattccaggatatttccctctctttctgcaccttcctggttgccgcgcctacactgtcgcctccgtagcctccgttggtagaatgccgacattccagcactcctccgtaaaattctcgaaggaactccgatatttcagggcactccttcctgaacttcccctcactctctactaagttaacaaattaaatatgaaactgtcacgtcctgataaattcatcccgaattaaaaatcattccctaaaaggaataatagaattaattaaaattcgaaaagaaattgacaaacactaaaatacgtaccagaaaaattcgaatgtggcccggagaatttttgttaaattctccttggtctaaaaggagccctcaaattttacttgaattttcagagcaccggaaataattattaagcaacaaaaacaattatcaaagtttattaaaaagaaaacctaaaaataaatcctcttcctcctttgggccaagcccagcccaaagtcctctcttcccccccccctctctttctccccctcctccctttgggccccaaagcctccctccattcctctcagcccggccgaaagtctgtttatctcccccgtgctacagtgctccttcttccagctcaggcagagcccgagctctccagccgtgccgtgcacagtgccaccgcctcctccttccaaatctcgcctccccgttgctcctttttccaaattagttgcgggaatggaatcctctcaatctcctcttcctttcccccaactttccccctttaatcccgcccccaatcaccgggatttaatccctcttctttgaccaccattgatgccgccggccacctcctccggcgccattttcggcctctcccgtgaccggcactccgtccttgccctataaaacgaagccctcctccttcctttggtccattttgctctctcccgagcccctagccacctccccatcaccttcccctctctcctgtgccgacggccatctccggccgcccctgccgcggcgcctgtgtgccggccggccgtgccgtcgccatccgcgacgtcgcagctgcctcctcttcctcggcttcgcctccgtttcgcggggaaatcaccggagacgcgtcttcgccggcaaaacagtggcgttgccgccactgtaccgccatcagtcgccccggtcgccgcgtcagagcgtcggccgatgtcgccgtctccttcgtcgacgtcgcggcgtcgccctccaccccggcctgccctcggtttcgccggaacgccgtcgcccgcgccgcctctccctcggtcttgtcggcacccactccggcagccccttccgccatgccagtgcgccggccgacgtcgccgtctccacctctggcatcgcagcggcaaggtcgtcctcggcatcgcttcccctccatccaaacccctccgcggtccatcatcgtcgcctctgttcgttctcgtcgtcgacgtcccgtcggtcgcccggctcgtcgtctcgcggcgtcgcctccgtcgtcggattcgcagcggcgcgttccacgtcgtccccgtctccgtgcagctgttgccggctgccctcgtcgcttcctcgccggccccggtcgtcgtcgtcgtcgtcctctcgtcgttcccggtcgtcgtggcgttcgtccctccgtcgagccgttctcgtccgtcgtccgcgttcgtcaagcgagccgctgcagccccgtcgtcgtcttcgtcctcggctccgcgtcgtcaagcattgcgccggccgcgtctcaccttcgtccaaggatcgccgctgaagtcgtcccctcgccatttgtctccgtcgttcccggccgcctccgccgcgcccgttcgtcgttgtcgttcccacgcctcgtcgcgtggtggtaaggatctctcctctcgctgccccgtcctcgtcctttcggtgtcgcccgtgcccgttgtgcggttgtcagccccggtatccatgtatcggtatcggtagtcgttcgcttgtccgtgtagtgtccgtgttagtgtgcccacttggtagccgcgttgtttcctcgtgtgcaacccgtgtggtgtctagtggagtccgtttgtcggccactcgcctcggttgacacacggggtccgcttccgtcgacccgtggaccgtctctgtgtacctggtctaccgcggtcctttaggttgacatgtggggttcgcatgtcaacagcgcagccttcctgtcttttccaggctagcgcttacacatgttttatagtcgcaaagcctaattataataatccgcaaatctccatataacagcattaaacttcggatgatcatatcttggtcatacgagctccgaatcgacccgttcaagtctcttaatgtttgttataacctaaagaactgtgtgctttctttttatgtgttgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctagaataaacaaaaccccaactagtggacactctattcatggttccactagtatgaatttaggtagatgcttcgctgtttaattaggcaacattaggtggttttataactttagacttggggaattctcatatcacttggatactatggaatggttggcttattgtggaattggacatacccctctcttcctctttcaaagcccctaaaacctgtttttcggtggggtttgggtgcatgctagttgtgggaagttgcaccccggccactataaggattaagctcaggccactgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctagggggctcaatcctgcctgcctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggatggctagggacgagctgggacccagggtcgggttgccagttcggtctaaatcatcgtaggccttgggttaaggcaggttcgtgcgggttcacgaccttgattaataatactgtgtagctttaggatcgtctttttaaaatggctttgggcaactaagtgacttttaaatgctgttttctgcaaaacttaacccctatatcattaccccttgtacccccttgcattaatcgtgcatccgccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttattttttattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacaagctggtatcagagccatctcgactgtaggataagccaagtggataaaacctaaggacatattttataaataaaactatttgcgaaagttccttttttctccttcccctaatgctatttgcaaaaggtttactcccttcttccttcttcgaatttccactagtactagatggttagttttgcgaagaagaagatgtcgccaattgtttgccgaagctccggaagactgcaggatccgctagcgaagcgaaggaagcagtgaagccagctgtaaagcaggagtgaagatcttggagaacctgtcgcagaacctaagccaccctctagggtagagtcgttagtcgtgtgtttccttgcttgtgtgtgtagcgcgtggttttcatcagtggggtgtgatgtaaccatgctaggttgtttgcttaatcaacttgcagaataagtgaaacaaacaacacatcaacaagaagagttagttcctttaaggtcctgtctctagttctggtctattctttcctagcttgtttcctctctcacctcaatccctgtaacagatgtttaacagagaaaaaggaaagaatgtcagagggtatgcctccagtaactcaagttttcaactcaatccaccactggcctcaagagagttaacaagggcacacccttggtccattccgagcatgctgcttggttcacagctaccattggttggaagtcaagaccaaaatcagtatgtgtttgatcgagcatttgccacccaggtcaatgagcttccaatgccagaagagcatgtccccttttgtcatgattgtagagagtaaggacactatgccctgaattgtccatgggtatatgtcaaagaagccccttcctttggtttagcagggcagacatcgctaaaccagcctcctcacaccaagtcaagcttgcagcctagtgtgcaaagtagagagcccaatggagagaatccattgaatcctgggaaatgctttcctcctagcctttcgtaccacgtggggtcacgtactaagcaagccaaaggcaagaagagtaagaatcagaagaaaaaagcaccgatgcgaactgaagaagaagtacgtaagatgactataaccagcaccgaatggcctccagcagggataactattcctagacgtcaaagaggaaataccttccgaggtgcacgaaagttgacccagcacctcctaagccatggcggcagagtatctgatagtgaagggtcagatcaagtctcctcggattatgaagatgagtctctccgacatctcggcgaggaagagatggaatcaaaagcatgcccccgttgtggagaaattggacacgttgctagcatgtgtttcacactctgccctcattgtgaggaagaccatccaccaggtgaatgtcccacccgcaaggtcacatgttttctgtgcgaaggtacaaaccatgtgcccaaggattgccaactcagtgtgttgttgaccaagaccgcagaaatccaacgaacaaccctacgattgtctcgtcagttagtcagctccaacagcaacatacgacagaatatgcatgccacaagtcagccaagtgactgcctgcttagcctggcagcctgaagctgcgtggcaattaagatgcataaggcaagtaatacccttcaagcaccaagccattctcatgcaccgacggcctcagcaaagaattgtcatcgatggaagaagttgtgtctctccccgacctactccaggccgagcgaagggcaatcaacctcaggaggatgatacgaagcagaagaccgttattcgcttcaaccagcaatcagaaggaagcttctcctgtgaatgataacaatatgcagtcctatcacatcatcacagaaccaatcaaggatgcagtcactagaacaatgccagctatatctctccagaatcaaaatgagcagccatgtttgtggttttcagttcgcgacttatcattgtgtaatggaaagtatgcagacaatcagtgtaatacataaatatattcatgtctatagacagtagacaagctatgcttatggatgattcatgttgaggatacaatgtaccgatgttgagcaccttccctttttgtttaaggcagtgcctcgtattcatgtaatatgggagaaatgtgtaataaaaacaagttctatgaggactctttcagaagatgctgatatgggattatgtgtataattgtttactgtcaaaggagacctagggtctcatttcagaggaactatgttctaacctcgagttaataaccaacctgatgatggaaaagaaaatcaagcgattaaccaaagagacatttgtttggactaagagtttcagatgtgtcttttttggatcaaaggcaatggcagtcagtatagcttttggcgaaacacttcaaggattcactgaaaggcagtagaccaaaggacctcatcgccaccagaagtgtccgcaacccacattaaagagtaccacctgttagagataggccgaaagatgattgataaaagatattggcaaagaggttctctagcaggaaagatgtaggccgaaaggtgattgataaaggataatcaaaaacatgctctgcatcactcaaggaagacccctgatagtaatcgccctgcaacagtcaccttgtcattgagagaaaaaaaaagtcgtgagtaagcaagatgacctaggtaaaagtgtttctatgaaggcaaggagtgaaatcttcaactcagtatcagatgctacacggagtgaaaactgcaagcaccggttaccaggcaatgccatgtcttgggagatgatccaatgggaaggaactcatcaaggtcaaaggagtaaaggaatacgttgaatgctaaataatgacaacctgaagataatagtgggaagtaaactgaatgtaaagaaccaagtgatatgttcgaagatagtctacagaggtcagattaaaatcacatctaacaacgaagcttcaaatttggcaggataacgatcaaacaataagaagttcagcagtaaagtcatttgggaagacgtcaaagcatgtcaagtgggataatttggttcccttgggaaacataattcaaaggcaaagttatcgaccctcacaatgaatagaggaaatatctagcaccggagaccaggaaagctaatatgagacaatcagtggcaagttgtcaatcatggtattcttagtaagcaggatatcatagtctaaagcatatggtggtaagttagaagtaaatgacaagcatggtattctcatgatgacaagcatggtatcctagtaatgacaagctgatatcggcgcaaaacgtgaagtgggtaacttgtatgaggttgacgccaaagatatgaattatgagaagttctggaactgaagccccatcttccaatgccgcagcctagtcgaagtcagctagaggtgcaaccagggaaaagtcatgtgaagagaagattccatctataacaggagatcgagccaagcagtccagagtggagaggttttgctaggcaagtttgttatagaagacgcgacggaagaagtcagataagaagagaagcccgcccaacctatcttcttgctagcctcctcgaatctcgg

SEQ ID NO: 67940 - DNA, 3794 bp, Oryza sativa
gtccgctgctgtttatgttgattgtcagccctaagtgccttgtcataatgtaaatattatcgatataataaagatgtgtcttttatatcatgtttgtatggtgtaccccggcttttcctgggacggggattaatacactagcgttcgggaaaatgcgattttctcggtcgcgacagaaactacaatttagttgtactctctggagctcaaaagttgtgtgttgaagtgtgttaggtctcctactttcatagctgccaatgatggttggaatggcggttaacccctcagaaccatcattgggactccactggagccatccacgtgtaaggtggagatgaggtgggccaggatggattctctagcagcttataggtgggcccctatggcggtttggtcccaatgtaagtcagtttcgactgacttgtggtccgtccaatccttgtactcgcacatgattggtcagaggttcatttttgtcgcatggcagatatattttctccttaaatgacctgcatacatatatttaccaaaattagttgaagtggttagtagtaaactcctaccactatgttttgagagtatatttgatatcttttatgtaggtgttaacggttaaagtttgcacttaacgaccttcaatgacaccccaacacttatcttcaactcgtccctgagtaaagctcatgaacctactagagtaatgactttttgcttcatgacatgacataccaaatattccaagacatacttgaggctgtaaacattgatgtgtttaccatgccatctttaggcgattgaagaacgtaacagtcctcgaaccaagtcccctctactacttctgatgaattaccataggattttctttgatgtttataaaaacataacttttactgtacttctcaattgactccctcaaatcactcaaagtgtttattcctcaccaaggtattgatgttgcattttctcatcctacctttctaattaggcttatatggatctcagggtagggaataagaaatgacatacttgcatcagatatatagtaaagtcaaacagaggatacaacaagataactaatcatataaccatgaccaagcttgtgcacctatgtttatgggtagaaatgaaaagggtgaaaaatctacaataaaaaatgggatggtgactctttttatctctacctttttttcatcgtgctcgagtttgatcattttcttttgagcagagttttttattttagctcatctctcatttggcatggatcatgggaggagagaccacaaaatttttagagtctttattctgtggatacattgcttaaaacatagaagtttagcatatagatatggatggattagttttctttttggctaatcctccagtgtagagaaaaagcaatatttttggtgtctaagtgcacaagactttgctcatgagaatatgaaaagaatctaagatggtcacaaccatttggcaaaactcaaaatgatagcaagcaattgagtaccaactttccgataatgtacaaggtttcatcattaagatcgatatatggctttggtaggaagggaacatcaatgaagagtacgcaaagatatttattttctttttataaaatcccaaggattcattattaagagcaaggttcatatctgttgacggtcgttagcgatcagtttcgcacgtcaatattaccaaaataaagtagaactaagttttgcttgcaaagcatattatgtcaaaataagatatattccactagcactaggctttctaacctcttgcagagaataaacataaaatggaggcgattcgacagtaaaatggacgatcaatcaatcggacgctgtcgaggatcagacttagaggaagatgggccaagaattcagaaagaacacaaccaatgggacaaaactcgcaagtctgcagaaaccaacagaagaggaggccgccagccgaaattggactaattttggcccagcccatggttcggccgaacccccttgagctccgttggatgcaggggttggtttggacggtgtggattagctccgaatgatagttggagaggtatttaccgacgcattcgcaacaagtgcacaaccgtcattggagagctatataaggccttcacctcctcacctcttccacacatctcaagcaagaagcttcatacattctctcaagtttaatatagtttctagagtatagtggaatagaaatagaatataatcttcagtccgcagagtttttggaagagttcgggtaagactctagtagcttttccttcttttgtaagacttgtactatttatagaatattcttctcaatatattctcatttttgggggttatatgctgcggatacgtcgaggagggctactgatggagacagctcagtatgggtattcctctgcgcgtgtatataatcctaagttatttttttagggagggtactcctccgtatttagccccagttggatgggcttgacgggttgttgtaagaaactcggcaaccaagggtggtctctcgaaacaccaggagggcatcataagggggtattggctatacggttatatagtagataatattgactaaagtgtatgtatgtatattagaagtataggaaatgatccttttcttattctttccacttagcatagaattagtaagtatgagaatagtgaatgcttcagctttgtgtcaccctaccctttgaattgaactaaccccttcttagactttgattattacaagtaacatataagtattagcttggttctctctattataattttcccacgggattaaaaaaatacgatacccttggaatactctcgggtgaaatgctacaattatccatgtgcttgcggatgaactctgtaaccataatataccacgagtgtttctgcgtcattgctgggaattatatttctagcaatgtcgttaagaaataccaacagtgtttagattattggatatcattatttagggttatatgctgtggaagcgaggtgggctactgatgctaacagctcagtacggttattcctccgcacgtgtatatagtcctaagttaatttcctggagagggtactccttagtatttatcctcggttggatggtcatgacggattgtcgtaaggaactcggcaatcagggtggcttctccaaccacaaggagggcatcggaaagaggatattagctataatgatatgactaggatgtatgtataatatgtatgtatactattgtcacgccctgaagtttcccccttcttctttctttaaaaatttgttaaataaatcgtccaaagagatggttcaaattaacctagagctaattccctaattaataaatgcaattaataattggaaatggcattgtgggatttttcttgggttccacatgtcgcaattgattaacaagatttttagtggaattttcagagccttggaaataattttaaccaattaaaaatgagcaagtgcaatatttaatcccaggaaaaatcctttcttctttttcttttttcttttccttctttttctcttatgggccgccggcccatctcctcccgcgccctccccctcctaccgggctggccggttccctcttcccctccagaagtccacccggtctccccctcactatcaggtgctgacaggtggggtccacctatcagcccttcccctactccagcggttggagccaagctccacgccggcgcccccacctccccacgccgcccgctcctccgctccacctcgtgcccccactccacacacgcgcc

SEQ ID NO: 67941 - DNA, 1440 bp, Oryza sativa
gcaaatcatgcattacaattgatcatattgtacccaatttacaaatatcctgcattctattaaatgttgcattcttttacaatgtcatgtgggatggttcctattactcatccattattgtttaccctatgccattgataacttgggtatcaaaatgactagatgttggtttaggaaatgcttagctatgcttagctcaactagtacacaaatggggatcatattactatatagactttgactattagcatagctttggattagtgccaccacaatggtgttagttaattaaaatacactgaatggtgggttgtgggtgcatggttttgctggtcgcacccatggcaattaaggaccggttcacgggaaaccctgggagacttaccgtgcttaccacaagcgggagtgggtaaatgcttgatttgaagtacagctcgaccctttcctaggcaccggtggcgagggtgggcatgatggagttgggtcggcgggggtgtccggttgtccagctgccggattcaccgcggcgcaagacgggaccgcccactgccttttgaggggtgggggtgaaaccttagcgtggtgtggatggttaggggagggttatgcagagggtcttgtcacgattaccccctttgcagtatcatggtgatacttcgggcatggcgacatgtgtggaatcgtgtcttgtgggtacagttgtacacgtctggccagagtaaaactattcgaatagccgtgcccgcggttatgggcgaccaaccagattcaccgtgattagtctcacccctagtttagcttaatgaactggtgtagtttaagtggttggttgggcctgttgcagcgtggtgtagcgttggacaatgattggttaatattaattaattactacaattgttttactgctttcaactactgcttttaaatgcctgctttatgcaaatgaacccttagcctcctttggatatatcctgcatcatacctcctcttctggtatgacttgctgagtacagtggatagtactcagccttgctctcttttcccccacaccagagctgaagatcttcctagttggagctgtcttattgaggttggtttcgtcgctgccgtcaaggattgcctgtggagtggagtcgccccgctgctgaagtcaagcttccaagtctagctcgttttaccttttccgctgcatttgtaatcttttatatttttgtaagatgtggatctgtgtgtcaacaattatcgtttgtgtaccctggctagtcctagacaggggtttaatgcacattcagcttagaaatcctggttcgtgaatttctgggcgtgacaactataattataggaatatgatctttctatattctttccacttagcttagataatcatgaattagagtataaatgcttctgcttagtgtcctctacccttggaattatgtt

SEQ ID NO: 67942 - DNA, 3353 bp, Oryza sativa
aactcggaattggaccgttcaagtctctaatttttccttaagaagtcaagaacccatttttgtgctttgtttctgctgttatgtggagtttgttagagtaaaagccttttcttttccgttggtcgtgtagacgctgcagcttcggaagatccgctcttcgtagaagtcgaagccgtcggttgggaaagcgagcaaggcaagtcacatcatctttgaacatattgaatcccagtttgtaaagttatgttgatttaaattattgcattatcgctttatttaaattcccgcgttatcactgttttatttagccatgcctatttacctttgttatgaccttattattgttattgttattatttccttgttcaccctagattaaataaaacccctactagtggacactctactcgtggtatccctagtttaaatttaggtagatgcttcgcaatttaattaggtaacattaggtggttttataactttagacttgggaaattctcatatcacctggacactgtgaaattgttggtttattgtggaattggcttcacaccgccccctctattcaaaatccccaaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtaaaacctattcgaatagccgcgccctcggttatgggcaagccgagcaatgtacccaagttagtgttttaattcttaaaacttgcttaacaactaaaatatggaatggttggcctgggttggcttgggacgagctgggacccagggtcgggttgccagttcggtctgaatcatcgtaggccttgggttaaggcaggttcgtgtgggttcacggccttgattaataacattgtatagctctaggatcgtgtttacaaaatagcttgagcaactaaatgtctttaaatgctgtttactgcaaccctaacccctctatgttataattcccttgtactcccttgcatttattctgcacttgtgggtgtgtcttgttgagtacggtggttgtactcagtcttgctcaatttttcccaagcccagaagaggagctccttgaagatgaaggctttggtgtctagctcgtgcctgccgtcaagtgcctgtggtcgtcgccctagtcttccgctgtttctcgtttgtctttgtgtgttctgggccttcgctgcccatgtaataaattaactatttacgcttccgcttgttaaactctgatttgtatcaacttttggtgtaccttgcctcctgggacaaggattaatgcacgcacgtaaggaatgcccgttgggttatttccggtcgtgacacaaagatatattttgtagacggtattattgtccaaaacctcaattagaatgaaaccgaagggagtaatataatttccacttaaaccattgtactactttgtactattattttcaaataatacactattttaaaataaagtttacacaattatattgtgtacctatcaaataaataatttaagatctatattaactaatttatacgtgcactcccattatttaaatcatccgatatatttttttttacattggactatcattctataataatgcattgtttcaacataaagtctacaacattatattgtgtacccactaaattaacaatttaaaatgtatatcaacgaatttacacttacactaaaaccggtggatccgttatttaaatcatcggatctattatttgctaataaataaagcatccaaagctccctttttggctcggtgcacaatgcacgtctgcacatttgccttttgcacacgtgacaaagcgtcgtgtctgaggcatgatcacgaccgctgcagcgctaccgctttgctacatgtcaaatcatatatggagataataaattttgttaataacatgaaaagaaaattaaaggtgtgatgcagcgagagaagaattaagcaccgtgggttgtgtttttggaacacttagttccatttaagctgaaccaagagttgattacataataattataatgtattatgttatgtcgtatttgaattttgtactatttgttcgtacaggtgaaagaaatcattatattataaatatgagcacaatattaaagaatatcaatagaactcttctaagacaagggagtttaagaccctctttttttttgattccatagtttggattttcgtttgcacgcttttcaagtttctaaatggtgtcttttttaaaacaatagtttaacttttagaagtcaattcattcgtttataccctcaaatagcaatcgcataaatcagataattcatcaatttcagttgtcctaaacccgcgactcatggtggacaattggggatcgacggatactcaaagtcataatatgaatatgtaagagctactatgaataactgtaaataggtgtcaaaattaattgctattaattagacatctaatggcttgcttgccatataattactttctctctacgtgtatataaacatcgacgaagctggaacaaatattaccatatgccccatacatatatattaagcggttaatattgtaattacatgtgttaagtcctttaaaatttcttaaaatgctctcaagctatcacgtggtgctctaataaattagagcaaatattagaaattctatcaaaaaaagcaaagcatatattacttgattttcacttaaatcggtacgtccaatattataaaccgttagattaaattgatcttagaacaaactaaatactatgaggtcccacctctcctcccactgcataggtgcgcacctacgtaagtgggtacatacacttaccctctcttttttcattatcccctttcttctttgttttccatgcatacgcttccctccctttcttattatatcatgtgccttatgagacgattaatcacaagaatttgcatatcttgctctc

SEQ ID NO: 67943 - DNA, 4133 bp, Oryza sativa
ttgtctttgcgatagacgtgtcggacctcgatcccatcgaacctcttctctaacttcctgacttctgcgagatattttgacaactcggggttagagcatttgtagtctttgtgcacctggtttgtgactagttcggagtcccctttgacgattagtcgcttggctccaagtacggctgcagctcgtatcccggcgagtagtccttcgtattctgcagtgttattggttgccctgaagttgaggtggattgcgtgcttgaattgatctccggagggagatgttaagataaatcctgcccctgctccttggctgttgagtgcgccatcgaacgccattgtccatgtttcattgtcaccttggttgtctgatttgttatctggcatagtccaacttgcaacgaagtcggcgagtacctgggatttgatggcagttcgcggcacaaaatggacatcaaattggcttagctcgactacccatttcgcaatgcggctgacgacgtctttgtttctcacaacttcgccaagggggaaggaggagacaactgtgactctgtgggcttgaaagtagtggcgtaatttccttgatgtcatgatgattgcgtaaagcagtttttggatctgtgggtatcttgtctttgcgtcatggagagcttcgctgacgtaataaactggtcgctgtactttctctctctcgacgataatgacggtgctaacggaatatggcgtggcggcaatatagagaaataattcttcattaggttggggagcaacaagtacaggggggtttgataggtagcgcttgaatgcaataaatgtctcttcggcttcctgtgtccatacaaatttgtcttgtttcttcaacaaagcgaagaaaggttgtcctcgttctcccatcctagcgacgaatatgcttaatgctgccatgcaaccggttagcttttgtacctccttgagtcttgtgggcgacttcatgttctcgattgctttgatcttctcgggatttgcctctattcatctgccagagacaaggaatctgagtagcttgcccgacggtactccaaacgtgcacttctcaggattgagcatgaggcgatatcgtcggagtttgtcgaacgttttcgcaatgagtcgcttgtcttggttttgacaacgatgtcgtcaacgtaagcctcgacgttgttgccgagctggttgctaagtgcaccctggaccgtgcgctggaaagtattcccggcggttatcagtccgaaaggcatcttaacatagcaaaataccccgaacggcgtgatgaacgctatcttctcttcgtcctcttttgcgatgctgatttggtggtagccagagtaagcgtcgaggaagctcaatagctcgcaaccggctgttgaatccaccaattgatctattcgagggagaggaaagtgatccttagggcacgccttgttgaggtcggtgaagtcgacacatattctccattttccgttggccttccgcaccataactggattggctagccactctggatgaagtacttctctgatgaagccagctttgagaagttcgtcgagctcttctcgtatggcttgtttccggtctggtgcaaatctctgcagtctttgcattactggcttggcatcgggtcacaccatgagtttgtgcccaatcacctccctggggacccccggcatgtcggacggctgccaagccaacacatcggcattatcacggaggaacgtgatgagcgcgagttcctatttctcgtttagtgtcgccctgatcttgacagtcttgtcggggttagccctggagagtggaacgatcttgatggtgccgtccggcttcggcgtcttatttggcttgctcactttcttgggtggctcagtcgtggcgggtgggctgggtgtttgctcgaccatgtcgaggctccgcttgtcgcactgcaccgccagctttgcgttcccttgaataatgattgttcccttcggtcccggtatcttgagcacttgatacgcgtagtgagatgcggccatgaacttcgcaagtgcagttctcccgatgatggtgttgtaagctgtatcgaattcagcaacatcgaaggtgatctgctctgttcggaagttgttggcttggccgaaagtcataggcaacgtaatcttacccaaaggtctagacgatgattggggagtaattccatggaagggttgatcggttggtgtcaactcactttgcggaagtcccattgcgtccagagtgctggtgcagagaagattgattgagctgccaccgtcgataagaactcgcgctaccttgatgttctgaatagtgggttcgaccacgatcggatatcgtcctgggatgacggaggttttggggtggtcttcctctgagaactctattttctgctcagaccacttcatcttgggtgcagccccctgccacgtcgaacagacttcacgttccactttcttgtattctcgcttggaggaatacgttgtggagccgccgaagatgtgtgagacgtggaggtcggagtctggatacgcagaatccggttcgtgaggaggcatctcttcgttcttctcgacaacgcgtactcgcttgcctttttcaaacgccatgtgcttctcgagcgactttttgaaaccaatgcaatcctccagagaatgtttgtccgttttgtgtatggggcaccatgatttctttgtgtcgctgccttgtgggtctgggcgcttgggagggttcgcgtattctgctgcgaggacttccgcttgagctttccttttcctatttttgtgatttttcttcttgcttgactcagatgcgtctgcggctggtttcttctctcccccggtcttcggtttgtcgttcttgcgtcttagcgcgtcatccacatgggcgcatcactcaacgatctcgaataatctccgagtagttgtgatgcgtcttgtcggcaactcctgggtagtgtagcgatctctgacaccggacttgaaggtgcgaattacagaagagtcggtaatttcgggaattgtgtttctgcactcgttgaagcgccgaacgtattccctcaatgattcccccgagttctgtgttaacgcgtgtaagtcgtcttcgatcgcgtggtgcttgtatgttccttggaaattggcgacgaattgttgccacaggtctgcccatgaagagattgagtaaggaggaagatgcatcagccatgaacgtgcagaacccttcaacgcggttggtaaatagttcgctaacgcgttgtcgtctgctccggcagcatagagcactgtcgagtagacttgaaggaattcttctgggtcggtgctcccatcatactttttaatggctctgggtcggaatctctcgggccatcggacatcacgtagggaacgaccgaaagccctacacccagcgttgggggcggtgggttgtcggcggtcgcgtgaccttcgtggatgtctgtctgacgatgaagaggatgcggatgatgacgatgacgatgggtcgcttggttccagcgtacggttacgaggatgatgacctggatctcgggaatcctctcgttgtctctcgctgttgtctcggcgccgatctccatcgtcgtcgtcgttgcggcgacggccatgaccagtattgtctggcccccgttgttcgcgatcgttgtaatctcggtcctcgtttgggcggtttcctcgatcatggcgccgtgaagagacatgacgccgagagcgatttgcgtcgtcccgtgtgcgtcgtgcttttcggcgaccgttgatttgatctcgaagatcgccagtgccacgaggtggaggggtagcctgtcgaggtaattccctctgctccggatcttcaccattggcgtcgccgattcgtggctgatcttggtgtgctgcggtagcggcttcttcaaacgcgttgctgaggttggtcatcgattcccgtaatcgttctatccaacacttgaggtcgtcgttcagaacgggatcgtaaggagtttccctcagtatagcttgaacagccctgatgtgctgggctggagtagtcgattgattcgccgcttcagcgttggcttgcgctgacgtgccaacgccatcgatagccaatacctcccgcggcgcacttgttgtcgatgac

SEQ ID NO: 67944 - DNA, 7031 bp, Oryza sativa
gggcgcgcccagcggctgccagatgggcccggccgtcagccgccagcgcccacgggtgcggctgacgcgtgggacccacagcgccggccggcgtcagccgcgtgcacccggtccaccgtggaccgagaggctgacgcgtgggccccactcccgtggacccggtccgcgcgccctctctcccggctgacgcaataaacgagtttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggagtttattagagtaaaagccttttctttttcgttggtcgtgtagacgctgcagcttcggaagatccgctcttcgtggaagttgaagccgtcggttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccatattattattgttattgttattattattaccttgttcaccctagattaaacaaaacctcaactagtggacactctactcatggcaccactagtttaaatttaggtagatgcttcgcaatttaattaggtaacattaggcggttttacaactatagactttgggaaatattcatatcacctggatactctggaattgttggattattgtggaattggattcacaccgccccctctattcaaaatccccaaaagtggttttaggctgggctcggggtgcatggttttgatagtagcacctcggccatataaggaccggtcttcgggcctctgttgcaaagcactaccgtacttccacatgtctagtgggtaaggcttagtttgtggctcagtctagtcataaacaatagtacacggattggagatggatgaagtcgggggtcgatggacattctccagggcaaatgaaggctacacgagctgcggcccggtagtcgagatgtcatggcagagggttggtgccctgctgctaggggctcagtcttgcctgcctgtcccgggggttccggccataggcgggattgggtcggtactcttgtctatggctaggatgggttggaaactatgtcacgtctttcgtctgtataccgtggtggtatgtggcacgtggttacacgtgaggaagatgtgtcttgtgggcaaagatgtacacctctgatcagagtataatctattcgaatagccgcgccctcggttatgggcaagccgagcaatgtacccaagttagtgttttaattcttaaaacttgcttaacaactaaaatatggaatggttggcctgggttggcttgggacgagctgggacccagggtcgggttgccagttcggtctgaatcatcataggccttgggttaaggcaggttcgtgtgggttcacggccttgattaataacattgtatagttctaggatcgtgtttacaaaatagctttgagcaactaaatgtctttaaatgctgtttactgcaaccctaaccctttatggtataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttcccgtttgtctttgtgtgtgctgggccttcgctgcccatgtaataagttaactatttacgcttccgcttgttaaactctgatttgtatcaacttttggtgtaccttgcctcctgggacaaggattaatgcacgcacgtaaggaatgcccgttgggttatttctggtcgtggcaagttggtatcagagccccccttgaccctaggacgagccgtagaccccaagccttagcaatattttcacaaataaaaatcctttgttatttgtgaaaatcctctagtctctctctgtcttgctgcttcatttatcaccaaaatctgacctttgaaaatgttgcttttctttttgtttttgtttgtagatggccggcagcgtcacccgtcgtggtttggacatgactggcttcgtcttggagctgcgaggcatgtgcgtggtcctggggtatccacatggagtggactaccaggccaggccgcttccggatcaggagggtgatgatgcggagccccccgctgcttgggaggtcactgcagtgatcctctctggctctcccgagcggacttcgctggcagtcaccgcgggtggagattccttccccgccgcttgccagaacgccgccctcctcgccatcggcactcttcaccagcgctacccggacgagttgcagcactcgccctaccgctaccaccctcgtcgcggaggagcccgcgactacgccaccttccgggatgctagctcggaggatgacgctaccatcgtgcacctggcgcgcatggtggaggcgtacgacgcggctcgtatcgacttccaccagatggtacgccgcggcatggtcgagaacaacctgaagatcctggagctgcgtcaggagaacctgcagctcaagaaggacctggacgcagtggagacgcagctgcaccagctcaagatcgcccagggagagatctgccgccccaagcgtcgccgtgtctgccgcagccagaagatcaccgcccgcaagagcacctccaggcccgagcttgttcgtcagtccctggcgtggacttgtttcgtcgagacccctcgtgccgagcctgcgcccgtggttccccaggagggggaagcctccggcgttggaagcacggaggatgcgctgttgctcaccttccgccctggcccgtcgcagcagtagacgagcagttagtaggcttgcgcgtgtgttcttcctcgtttgtcttcttgttgagtcgtgtggggcatggttatgccggtgtgtggcataactatgtcggagcctgccttattttattcgcctaagcaacttgaactttaatgaaccaattcaatagcagtaataaattcaagaattatagtagtcgtgggtggttcgtttaattgttagctctttccctgtttgctggttctgtgtggggttttcagatggtgacgaccagaagaaatgctgccaccggtgatggcaaccaacccgaaggcagcaaccacaaccaccagggtaacccacctccacctcctcctccgcctccaccaccaccaccagacaccaacgccattctcacccaaatcctcgcccagcaagccaacatgatgactgctttcctccaccacctccaaaatccaccacaacataatgctccaccacctccccaacactctaaactcgccgagttcctccgcatccgcccacctaccttctctagctccaacaaccccgtggatgcgttggattggttgcatgccgtggggaaaaagctagacacggtgcagtgcagcgatgaggagaaagttatcttcgccgcccaccagctgcagggacccgcatctctatggtgggaccatttccaggctacgcagccagaggggcagcctattacttgggcccgcttcaccgccgctttccgaagaacccatgtgcccgctggagtcgtggcccttaagaaaagggaattccgagagttgaagcaaggcaaccgctccgtgatggagtatttgcattagttcaataacctggcccgttacgctccagaggatgtgcgggaagatgaggagaaacaggagaagttcttggcaggaatggaccccgagctgtccgtccgtctagtctccggggactatccggatttccaacgactggtggacaagagcatccgcttggaagccaagcacaaggaactggagtcgcacaagtgccgcttggcgaatttccgcaatcagcagggtgctaaccagagggtccgctacaccaatccctatccagggggatcctcctcgcagcagcaacaacagcagcagcagcaacctcgctccgcgcctcgacctcaattcgtggtgcgcatcccacagccgcagcagcagcagaatcaacaagggactcgtgcgccccgtcctcctacgccaactgtgcagcctggtcaaggccgcagggacgctcaaggtcagcagcgtctgtgcttcaactgcttcgagcccgggcactttgcggataaatgcccaaagccaaggcgtcagcaaggccaagcgcctccccgctccaacaacggcgggaaggatgtcattcggggtcgtgtgaaccacgtgacggccgaggacgtgctgacaactccagacgtcatcgttggtacgttcctcgttcattccatccctgctacaattttgttcgactctggagcttcccactcgtttatatctgtgccattcgttgggagaaatcagttgggggtagaaaggcttaggaaccctctgctcatcaccacccctggaggggttatgacagcaaagtactatagccctgccgtccctatagaaattcaggggattccttttccctcggatctgattctgctagacaccaagaacttggatgtgatccttgggatgaattggttggctcaattccaaggagtagtggattgcgcgagacgcactgtcactctgtaccgagggccagaacaaccggttgttttctttgcacccccaacctctgtcagaagttcagaactgcatcagattggactgtcagaaatccccattgtcagagagttcggagacgtgtttccggaagaactacctggtatgccgcccaagcgagagattgagttccggatagatcttgctccaggaaccactcctctgcataagcgaccctaccgtatggcagcaaatgaactggccgaagtaaagaaacagttggaagagttgaaagaaaaggggtacatacgcccgagtacttccccatggggtgctcctgtgatttttgtagagaagaaagacaagacgaagaggatgtgcgtcgactacagagctctcaatgaagtcaccatcaaaaacaagtaccctcttccccggatcgatgatctgttcgatcaacttaaaggtgccactgtattctccaagattgatcttcgttccggatatcaccaattacgtattcgtgaagaagatattccgaagaccgcattcaccacgcgatacgggctgtatgaattcacggtgatgtcgttcggtttaaccaatgcacctgccttcttcatgaacttaatgaacaaagtgttcatggaatacttggataagtttgttgtggttttcattgatgacattctgatatactcacaatcagaggaagaccatcagcaccatctccgtctggtgttgggaaagttgcgggaacatcaattgtatgccaagcttagcaagtgtgagttctggttgtccgaagtcaaattcttagggcacgtgatatcagctaaaggagttgctgtggaccccgaaacagtgaccgccgtcaccgattggaaacaacccaagacagttactcaagtccgcagtttcttaggtttggcaggatactaccggagattcatcgagaacttctccaagatcgctcgacccatgacacagttgttgaagaaagaagagaaatttgtgtggagcccgcaatgcgagaaggcgtttcaaactctcaaggaaaagctggtttcctcgccggtgttaatcttgccggatactcgcaaggacttcatggtgtattgtgacgcttcgcgccaaggattggggtgcgtgctcatgcaggacggtcatgtggtagcctatgcctcacgtcagctacgacctcatgaaggcaactaccctacccatgatttggagttagcagcggtggttcatgctctaaaaatctggcggcactatctcattgggaatcgctgtgaaatctatactgatcataagagtttgaaatacatcttcactcagtcggacctgaatcttcggcaaaggagatggttagaacttatcaaagactatgatgtgggaattcactatcatcctggtaaggccaacgtggttgccgacgctctaagtcgaaagagccattgcaacactcttaacgtccgtggcattccacccgagcttaaccaacagatggaagccctgaacctaagcatagttagtcgtggattcttggccgcgttggaagccaagcccaccttgctcgatcaaatccgcgaggctcagaagaacgacccggacatgcatggactcctcaagaatatgaaacagggtaaagccgctggtttcacagaggatgaacacggaaccctatggaacggaaagcgggtatgcgttccagataacagagaacttaaacagctgatacttcaggaagctcacgaaagtccttattccatccaccctggcagtacgaagatgtacttagacttgaaggagaaatactggtgggttagtatgaagcgggagattgcagagtttgtggccctacgtgatgtgtgccagcgtgtcaaggcagagcaccagcgaccggccggacttctccaacctctccaagtacctgaatggaaatgggatgaaattgggatggatttcatcaccggacttccaaagacccaaggtggatatgattctatatgggtagttgtggatcgattaaccaaggtagctcgattcattcctgtgaagaccacctatggagggaacaaactagcggagctctacttcgctaggatcgtgagtctccatggcgttcccaagaaaatcgtatctgataggggaagccaattcacctctcacttttggaagaagctccaagaagagctgggtactcgattgaatttcagcaccgcctatcacccgcagacagatggacagaccgagcgtctaaatcagatccta

SEQ ID NO: 67945 - DNA, 793 bp, Oryza sativa
cacgcacgtccaggaatgcccgttgggttatttccggtcgtgacagatcgatatcgattaccctaacgaatcgatctgaggctggagtcgctccttgttccttgccgttatccctgatggggacgtatgacttaggagacggagttttcatggcgccgaggaggactttgcagctcgagaggtcgtgattctttgtcttgtgaataggacaataaacatcccgagttggagaagtacactgaatttgtcacgcccgaaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcatcatgaagaaaactgcagcggaaaataaaatctagcgaagctccggctccactcccacaggcagctcaactggggtataagccaaacgtcttctccttctggattctttttcttcaactgaggttgattgattattgcaaggtgagcatatgacatactcagcaagccacacagcaaatatgcaagtgcacaaggataccaaaggatggcataatatcggctcatttgcaaaagcagcatttagcaaaacatttaagagaagtaaaacagtggagtaattaatcagaaattttaaccaacactgaacagcacacccatgctgcacaggcccaaccattctgaacaaccatacccggctgaacagatctaactccaaaccaggagctaagca

SEQ ID NO: 67946 - DNA, 1949 bp, Oryza sativa
tttttattaaatacctgcttaattctataattcctagattcttctgggattatttgagctaaggaagtatttttagtaaatggaattgcatttaagaaataatttaaattgaaaaaggttttaaaagtcttcttttggctttgggccgaagtcggcccaaaacctctcttctctccctcctcggcccagccggcccagtccgcagccgcgcgcgcgcgttcggtcgctgacaggtggggcccgcttgtcggatccgtcttcctcgcgtcgccgccgccgcccgaaaccctagcgcaagccgccgccgtctccttccaaattcggccgcgtctttccttatccggccgaatcgtttgagggaaaatgatcctcgggatctcctctaccttttcttctttggaagcttcgcctaaatcggtttggaaatcgatggattcgagttcgaatcggatcggttttcctctctccaagccgagctttccttcgccgtctccgccgccgtgggccttagccgccgcctccttgcacctatttaaggacccccgagctctcctctacccgtcgccaccctcgccttcgcctctcgtcgtcggaagagctctagcgccgtgtgccctagcttcgccgtcgccgccgccgctccagccgtgcgccgccgtcgtttcagccgtcgccgtcgctcgggaagaccgccgtcgggttcgcaaggtcgtcgccgtcctcgtccgccccttcgcagccgccggagaccgccggagcttcatcgccgtcgtcaacccgaaggttcccgccgcttcctcctcgtcgccgtcgccgtccgttgcttctccgtcgctcttttggtcgtcggtgagttcgccgtgccgcccgcttcgtcccggtgccttccgtttgcgttctcgcgccgccgttcgccggcaagcgtgcgccgcccgagccgtctgcctcgccgagccgccgccgccgtcggtgacgtcattgctggcgtcatcaaggccgtccgccgtgaaccgccgtggacccgatcgatctcggccgtccatcttggatcggttagatctcggccgtccgttcgtgtgagccgtcgcccgtgcgcccggtccaccgaaaccctagccgctgacgcaataatccttcttttccttttcaaaaataattcattattgcgtcataattcaattaaaatcagtttaaaggttttaatccgatttaatctttaaaaattcatatctaattcatcttaactcagtttaatgtggttcaagttgcaaaagttgtataaaataaagatctacatattaaaattgtccataaattgaattaaatttatttaattctttttaaatgggctttaattagatttaatcttgtaaaattcataataaattcatatgaagtcagaatgaggccgttcaagtctcataattcatctaaaaatatgatctacatgtttgtttactttttatgtattgtttatttggtttttattagtctttttcctcgttttgcgtgatagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgataccttgggtgattataattggactagttgagctttatatatattggttcaactagatattagatatgattgcttagccatgcttagaaacattagcacacatttgggataactaatgtttcactatcatttatggttatatttaatggtagctcacgatggtcaatcgtgattggttaattaattacttgcc

SEQ ID NO: 67947 - DNA, 861 bp, Oryza sativa
aaagagaagagaaaagctactagagccatacccgaactcttccgaaggcttccggacacctgatttcaacactatttctattccaccagctagatactactaaactaaacttgagagaaatgagagagctattgcttgaggtctgtgagtgaagtgagaaggcgaggggtttatatagcctcccaatgatggttgtgatggttggaatggtcggaatgatgtgcactagggttcccgaccttccgaaaggttctgataaacaacgatttgggcggagtcgcgacacaaatagatctggcttcttgaatgcgcacgctcttgagccccgcaattgcagcaccatgtctcctttggttatcacccgtgtcgaaacgcggatgacctcgccgagaaggctaatccctgtttgccaatcgaagaacacaaacaagaacgagatagaaaacaaccaaaattgcagatgaatgattaagctcacaagttggggtcttacaaaccgatctagcggcgaaactgttctcgacagaataatctaagcaaaacccaactctaaacgatgacggctactgaataaatgtgattagggacgtcctagggttgtcctagggcacacacccccttgggctaagcccaagacacaattacaaggcccaaaacccaaatcaaattcggactggatgagatacgtggcttgttttgaagattcccggtagctcgataggaattttgatgtgggaccacaaccatctgaaagtagactccataagctttccaacaagtactcatgggccccgaaattccttctagatcagcggctaggaccgttcgaaattgatggtgtcaggagaacaaggggatcca

SEQ ID NO: 67948 - DNA, 1296 bp, Oryza sativa
agctcgcacctcggtatgtgggtcctttccgtatcattgctcggcgcggagaagtcgcttatcagttggagctgcccgcctccttgggcaacgtgcatgatgtgttccatgtgtcgcaactcaagaaatgtctccgagtgccatccgagcaggccgactcagggcaaattgaagttcgcgaagatttgacctacgtggagaggccagtgaaaatcctggacaccatggagcgcaggaccaggaaccgagtaatccgtttttgcaaggtccaatggagcaaccatgccgaagaagaagctacctgggagcgtgaagacgagctgaaggcagcccatcccgatctcttcgccagttcttccgaatctcggggtcgagattccgtttaaggggggtaggtttgtcacgtcccaaatcgactctaaaatacatcctcgaaattgtgccgagaataattaaaattcatgtgaaagcctccaacaagtaaaatgtgcaaatttaaaagtcaaataaggcttggaggatttttgtatatttcctaaaagcctaaaatgcgtaaataaattttagtggaattttcagagcacaaataataattgagaagaaataaacaaagttgaaaaggtttataaaaagaaaaaccctaaaagtcttctttccccccctttccctcgtgggccggctcggcccaactctccctccctctctctctcctctcctccgcggcacatcggcctcctccccgcgcgcgcgccgctgacaggcgggcccgcccaccaccctcgctgacgggtggggcccacctgtcatcccccacctcgcgccgcgcccgccgcccgcccgtgccctagcgccgccgccgccgccgaatccgccgcatcccgccgtccccgcgcgcattaaagtgggggggattattccccgcgattccctctcccgtttcccccactttcccctctctctctccctcggattcgctcggattcattcccgaaatcctcgccggcgtcatcaatggagccgagatctccgcgcccgtttcctccctctccggccgctctctctcactcccgacgctatataattgttccccgtgcctctctcctccgtttccgccgctcgccgctcgctctccccgtcggattcgtgctcgcgccgattgtacctctctctccgccgtcgccgccgagctccggttcgccgccgtcgtcgctccggacttcctcccgtctcggcgtcacctccatcggcttcgccgcgtcgtcgtcgacctcgtccgccccttcatttcgcccgccg

SEQ ID NO: 67949 - DNA, 3524 bp, Oryza sativa
ttttatggaatttctagaatttattttaaaagtcttgaaaagaaaatctaagtttaattaataaattccaatataaaaagtggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaacctctcttctctctcctcggcccagccggcccagtcagccgcgcgcgcgcgccctcgctgtcgctgacaggtgggtcccacctgtcaggcccgtcgtcttcctcgggccgaaaccctagtttcgcgccgccgagctgccgccgccgtcggtgacgtcattgctggcgtcatcagggccgttcgccgtgaaccaccgtggacccgatcgatctcggccgtccgatttggatcggatcaatctcggccgtccgttcgtgtgaaccgccgcccatgcgccggtccaccaaaccctagcccgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaaaaatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacactgattaccttattccttgataccttgggttatattaatttgactagttgagctttatttatattggttcaactagatattagatataattgcttagccctgcttagaaacattagtacacttatgggataactaatgactcactattatttcatgatggcttattgatagttcacgatggtcaatcgtgattagttaattaattaatgtgccaactaaaacctggtaatggtgggttgtgagcacatggttttgatggtcgtgctcatggcaattaaggaccggttcacgagtttcggttgtgaaacatttatcgtgccaaccacaagccagcatgggcaacagctttatcttttgtatagcatggttcattgcggggcaccagactgagaagtggcggagataagcccacgggggtcgctggggagtccatgccttgtttataagggggtgattatgatccaggaaggtgcgctgtagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaataaccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccggggtggttgttcagaatggttgggcctatacaacagggtatgttgtatagcgttggattaatattgcttaattattacttaactgttttatcaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgctagaactttattgattgagaggaactatctacctctgtaatgacattatattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcacttcttaaatctcttttaatggttctcattcgaaaatttattccagtattattagtactgtacatccattactgtactaatggctcatttttcagcaaaagttttacaatattgttttatttaatcctgctgcaataaaataaatttaacaagttgattttataactttcttttgaaacctgttgttaaaaagtacaaaatttgtaactttgttttcaactatttcaaattatcttgcaagtttggtttactttatttacttaccttttactttgatttctaaactttattcaaattaatccaaaaacttgtgctattaattggatagatgtcttaactctctcctttcacttgtctttagatgccgcgctacaagcctgagtacctgtttggtgttgaagggtttgtccaggagttgcgtactatgtcctttgtcattggatttggaactgcccctttttatgcccagattcgtcatgatcgtcatgaagagaggtgccgtgtcaaagtcaccttaaacagtaatagtgaagatattccatcagtgatgttcgaagctggaggaagaaattatatccatgcatgtcaggaagtggcaaggatcgccataggagagctccgtgaccgctacagtgatcagttggccgatactgagtatcgctaccatcctcgccaaccacagggaagtgaccgtggcagttaccttgagactgaaggaattgagaatgatgctaccacaaggcatttggttgagatgctgtgggctatggatgaaagtcgtgcggagactgtgttagcggctcaagatcgtgaagaccggaatcgtggtaagatttgcaagctagaagacaaggtggatcgcttggagaaggaattagccgcattgaagggagaagcaccgccgcagaaggccaggattcgtctcaccgcaaggaagagaactttgtttgtccctcgttatcaattggcgccaaagatccgcgtggtggagaaagaagttgccccagcaaatcctccggtcatcatcataagtagtgatgaagaagaagaatctaagcgcaaccattccaagattgagtgggtagcaa

SEQ ID NO: 67950 - DNA, 2876 bp, Oryza sativa
catttgcatcacatcagttgcatggccctgcctctgaatggtgggatcacttccgccttaacaggactactgctgaacctatcacttggcttgaattcaccgctgctttccgaaagacgcatataccatcgggagtagtgtctctcaagaagaaggagttcaggtcgctttcccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtacaatcgcatggagcagaagaaacgtcggattgctcaattcaagacacaacagggaaataatcagaagccgcgtcttactttaggaccccagcccatgccacagggaggttcttcgtctgttgttcgtccgcaacgtcagttcttcaacaacaatgctggcaacaacatccgtaatctagctccacgtcctgttgcagttccagcacagcaacaacctgccaagagggagcaaggcaacaagcccgtggtgtgtttcaactgtggagatccaggacattatgctgacaaatgtccgaagccccgacgcgtgaaggttgtccctgcccagaataactctgctgtaccaacatccaaggctcgtgtaaatcatgtcgctgctgcagaagctcaagatgctccagatgtgattttgggtatgttccttgttaactcagttcctgcaacagtgcttttcgattctggtgctacacattcattcttatctatgagttttgcgggaaatcatgggatggaagtagaagaccttagatgtcctttgatggttagtaccccaagtaatcaagcactctctttgcaacgtagcccctctgtcagaatagaaattcaaggagtaccatttctggccaatcttatcttgttagaatccaaagaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaagagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactattaagaataagtatccactacccaggattgatgatttgtttgatcaacttaaaggtgccactgttttctccaagatagatcttcgatcagggtatcatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacttagacaagttcgtggtggtctttatagatgatattcttatctactctcgaaccaaagaagagcatgaagaacatcttcgccttgcattggagaagctacgagaacatcaactgtatgctaagtttagcaagtgtgaattttggttgtccgaagtgaaattccttggtcacatcatctcagccggaggagttgccgtcgatcctagtaacgtggaatccgtaaccaattggaagcaaccaaagacagtttcagagattcgcagtttcctaggccttgcaggatattatcggaggtttatagagaatttttccaagattgctaagcccatgacacgactgcttcagaaagatgtgaagtacaagtggtcggaagaatgtgagcagagttttcaagagttgaaaagtcgcttaatatcagctcctattttgattttgcctgatccaaagaagggttttcaagtgtattgtgatgcatccaaacttgggttaggttgtgttctgatgcaagatgggaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagtcggatctgaacatgagacaacggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcggtagaggtttcgttgcagccttagaagcgaagcccactctaattgatcaagttagagaagcccaaattaatgatcctgatattcaagagatcaagaagaatatgagaagaggaaaagctattggtttcttggaggatgagcacggaactgtatggttgggtgagagaatctgtgtccccgacaacaaagatttaaaggatgcaattctgaaagaagctcatgatactttatactccattcaccctggtagtactaagatg

SEQ ID NO: 67951 - DNA, 911 bp, Oryza sativa
ttagagacaaagcatagtggaaacaatgttgaaatacctttgtcacaaaacaatttgcttgatgtttcttgtgataaagaagagttgtgcgatgcttcacttatatccatgccacaactagtgaatgaacatgttagttctatagtacagccactgtgtgttgagtttaaacatattattcacattgctagtgagaacgaagagattaaattgctatcttctttaaatacttggggttaaattcaatttgatgatctttgtccactcaactgctaagagaagaaattatttgctagatttgaattgccatgcccatctgatgtgatttttcatattattggcaattacgataataaagaagaatataatgtgcatcgagtatatatatgttcgaatttgactatacctccttttcataatgaaatgcattgtctagaggacctcatgcgtataagtaattctctatctatttcctctagttgttcaaatgagttacaggttggtttgcaagaaggggagtgttgtggtgtttcgactacaaagattttaggatccaaccatatgtccatcaagaaatggtcctcaccagatgttgtgatagataaatataagtacaatacgctccatgataaggtgaaaccgaggacggtttccaatcaagaaggggaggatggtaaggacataactagcttggatatgaccatgactactttatatattcatcaaccaaaggttcatatgttctatgttagatttacttattatatatttgaacaaacgttgctacacaatgagtttcgtgtgttttcgtttgcagaggtccttgcttgggtgaaggaaaagaaatcgagcgtaaggaatacttggacgatcaaagaagttgattggggaccaaaccaagaccttttcca

SEQ ID NO: 67952 - DNA, 3006 bp, Oryza sativa
tatggaggttgacagcaggccgcacctcccccctcctgccaaaaggagcaagagggcgaaatcttctccacccaagcttgacacacgcagaaaagctgctggaatggggagaggaaaaataaaggtgccattagtcccaaagaagcttgatcttggcaaggcgccagtagctcctccaaagcctccagccgaattcacattgggcatgccattggtcggagacgatgccttattcaagatgggccctgcatgcaaggagttgcacgggtactacatggagaagtccaacgcaaggaggaagaatagagagacctccatgttgggccagcacgatggtcagccgttcctcgggcctactgccttcatcgccgtagacttcaaagatctctgggatctctacagggtgcgagcgatcgacaccaacctccttaaatgctactccttgtaagtatttcttggtacgcgatatagtactgactgtccataaattacgcttaccctgactcttgtcttgctcgtaggttaacctggaagcatgtccatcgtaaagcaccccatgttgccttactcgatccagctgtcgacaacgagacaacactgaaaaacgatcgagcaaacatggtggcctatatcaaggactgcttatttgcccgtcaagacaaggacttcattatgtgcgcctacaatcaacagtaagcgtgtaccgtacttatactcaaatactaaacacgtacaactgtagtatgtaactggcaatttaataatttcgcaggcgacattggattcttctggtaataacgccgaagtggagtttggtacactaccttaactccaatatcaagccagaaatatacgattggtcggccatcgaatctgccttgaacgaggcttgggaccaatatgtggcaagaggcgggaggcataaggatgggcatcccaaactcggtcacaggaaagacttcccaatacgtcaacaagttggcgaccagtgtgggttccatgtctgccataacatgaggagcttcgcagaaaaggtgacattgctcgaccctgaggtgtgtaattcaattgtttatacacacataggaagacaaatttacaagtatgtagactaatttggcaccgaacatgcaggaatttatttcaaggattccggaaatcaacttcgaaatcattagagaggagctagcacaattcatactagatgatatcttgtcaccgaaagggatgtttagagtgaagtcctaggtagctcgtctcgtaatggcagaacattcgcaatgcatatgcgacaaacatttgatttttgtaaatattctttgtaatacaattatattctttagagtaaagtcctaggtagctcgtctctgtatatacttgcatttctagttacatataaaattgttccaatttataacttatttttgtaggttttgatgcatgtcggcggtttggagagaaaaatggatgtgaatgacatatatgtgaatgggttgtggatgtgaatgtatatgtgtttgattttgtgaattcgctgtgctgtgatggaatatgaatgtgaattggctgatgtgatgctgggaatgattctatatgaaatggctgtgatggaatatgtgaattgatgctgggaatggggttgctgggaatgggactatgtatatgcttctgtcatttttgcagcgggcatggctagcaaaggcctgaggctagccaaaaagccaaattttattttttttggttccaaactcatccctgacgggcatttagctaatgcccgaaagagataacttatccgtgacaggctatactgtcctgcccgttagagattagtcatccgtgacgggcttttagaatacacccgatagagataagtcgtccgaaccgggactagtttgactcaacacgtggggtcaaacctatcggtgatgggctctagctaaatgcctgatggagatgactactcatccatgacgggcttagtggtgtgcccgattgagattagtcatccgtgacgggctccttactacgctggtttgactggtcagactcatctgtgaagggctttgttttcggcccgattgagataacatccatccgtgacgggcttttgcccgattgagatttttcctcacatcagtgacctttgcccactgacgggggccttacccgatagtgatgatgctttcagcccgtcacagataagcgatcccgttctagtgtaagctttattttcttcctttgaatcgtgcgtagtacagacagttatatatttcttgtgtgggaggaatgtattattttttttaataatagatctaatataatggtaaaaatttaggggccaccaatttaaatgaaaatcgacggtgagattagatactgctacgtggcgatctaagagcgtttgcagtggtgccacatggcgacttaagagcatttataggaggtttaatggacttttagtatataatagatagctaatagatagatagatagatagacggtaggagccacatgtcataccggccttctcttccccacttcctctttctctctctcctctctctctccctctctctcgggcgccaccgcgcatggcgtgcacggcgaaggcggacgggccggtggcggagctggagggcggagctcgcttgggcggccgacggcggagactgggctctcccaggcggctggaggccagtggcggagcgggcggtcgaaggcagcagctgaggcggagctcgcataggcggccacggcggggcgttgtggagacagagctcacccgagcagccatggcgcggcgtccccatggtagccacggcggcgctgagacggagctttgcccgagcaatcacggtgcggcgtccccatggcagccacaatggcgttgaggagacggagcttgctcaggcgacggcggcggctgaggcaaagctcgcctgggcggctggcaacggaggcggagcatgccccggtgaccggtggctgaggcggaccaggcgg

SEQ ID NO: 67953 - DNA, 1382 bp, Oryza sativa
tctaagacagtcagaggagccgtcgacttcatagagaagatggtctccaacatggactggagcaaagaacgactccagacccgtaagtgaggaatgcacaccataaaggagaccaagatgctcgctgcaaaactggacctcctcatgaaacatttggacgaccacgagaagaagccccagggcactgttaaggcattggactcacatgtaacgtgcgaggtctgcggcagcatgggtcattgtggaaatgactatccggaaacacgtgaagaagcgatgtacatggataacaacacaacgggttccgtccacagggaggtcaggggtgaaaccaaccccacccatatttccaaggagccaacaataacggtaacctttctaaccaaccttccttgaaggatctcgtctttgcacaagccaaaacaacttacgcacttagcaaaaagctagctgctaatgacaagatactagagaatataaacgtcaagctagatggctttggttctgcatttcagaacaagcttagttttaaaagatgattgaaacccagctggcgtagcttgctgcattaattcccgctaatgaataagggagggttccggagcaaccggaaccttatgttgaaaatgctaaggcgattacaacgaggggaggtaagtccactcgcaatctgccatatcctaaccctgcagggaccggcaacaacagcaacagggaagcaccatctagtgacacaactgaagaagaggttcagtcaaagaagaccgtgctgcaggagtattgtgacacgagaccgctgccactcccccagagatacaagaagccgtcggtggacgagtagttcgctcgttttgttgaggtgatccaaaagattcacattcacgtgccgctgctagacgtcatgcaagtgcccacttatgcacgatacctcaaggatatcctcaacaaaggccactaccgacgactaaagtggtcaaactaatggaggaatgcagcaatgccatactccacaagctcccggaaaagaagaagggtccagggtatctcatgatcacctgctcgatcgagacacagaaattcaaccaggccctctacgaccttggagcaagcgtgagcatcatgcccaaggatgtcttcgacaaactcaactttacagtgttggcaccaacaccaatgcgtctgcagctgggcgattcattggtccattacccaactggcatagtggaatacgtaccggtcaagatacgggatttcttcatcccggttgacttcgtggtgttggatatggaatctgacaaggagacgccaatcatcttggggcgtccgttcgttagtaccgcagatactaacattgatgtgggaacgggaagcatccgtttttg

SEQ ID NO: 67954 - DNA, 1442 bp, Oryza sativa
cagcaaacgataaggattatacagaggcatataacttaaccatttgtagcaaggaattggaaacttataggatcaagcagaatgccattgattaaataatgtaaactactgtacgttcatgaagttctcttaactgttttgcaataggctcatgatcattaaatcaagtgcaattcaggctgaaattcaagaaatccctgcaaactaaaacttttgaaacggtgaagtgaacgaaatctaaaaagcattatactcatctaaattacagcactgccattacctaaactacagcattacacctactacaactactacatctgaacatgaaaagggggagcattacacctactacagccactacatctgaacatgaaaaggggtttttgagttgtacctcgaatgagctatagaacaagatgacagtgagcctaggaggcagctaatgcagtgtgccaagcaaataatatatatagttgtagccgaaaatatttgaatatttgaagttttgaactccacccgccaagaatccaagcccgccatcctcttctcccagattgtgaccaaataataggtcgattttgtgctttccccatgaagagagaggtctactgccctaacccgtgctcctgtcataccagccagcagtactccttggtagtatcatctatcaagtcttaagagagggagagacatgctgtgtagaccactcttctccaatcagacctgctacatttccaatcaaaggagtgtgtgtggttagagagggggattgaatgcagcgaatcagacacctgctagatttccaatcaacggagggtgtggggtaaattgttagagatgggggattgaatggagcgtgcactggaatggatgagactgatcttaccttggattcagagagtgatgtagtactccatagaggacttgtacgctcatggatcctgttgcaggcaagttctaccaatgtgacttgtgaggtccttcacagtacgacgacatggcctctggattcgattggtgcacgagtgctccgctgcgacgtggtccccacaatccgccgccgctccgagccctgcgcctccacgtcgcccttgtccgccactgctccgccccactggcagccgccgacagcaaaggaagcgacggtcggaggacgggaggaggggcggagggaacgacgtcggctcggtagggggagcgcgctgctggccccgctgtcgcccttgctcgaccgggccatcgcctccgagatctccctcatccaaatcctgcaagcccacggaagagggaggggcgtcggctgggaaacgcgtgctggccggggaaggaggaagggggcgccggccggaggaagtggaacggcggcgctggccgggggaggaggagaagaagcgctgaggcgctggcggccgggggataaggagaagatgcgctggggctgg

SEQ ID NO: 67955 - DNA, 1084 bp, Oryza sativa
gtgtcctagcacttctatgctggcatcacgagggtccactgtttggcgcttaagatttttgaactcaggtgtagcttctgtttctgtggaagatcttaggtgtttatttggcgtcgatactggagttgataggtctagatattgttcaatgtggtccaataatggttgcattcggtggttataacagttatccatggcaataaacaaggttgagagcggttacttagccattgcactggtttatacacatacttactattgcctcgtgcgctcgggtacgcgtctcattgagcacgtatttataggggagaggaggggggtccgggtgtggttactttggcctgcttttgtcgagcacgtgggcaagagagaggagaggggaaaatggagaggagggctggcgggggcttacttcgccggcggtcggggccgaaggtggcggagatcgaggtgcagcggcgagctattccaccggtgcaagtgacgggtggcgctgccgttggcgagggcgctggagcagttgtgcctaagcgttcccgtcgaggggaaaccttcctggcaggggtggccattgttttgcgctgggtgtgctccagtatgcgatttgtcggggcaaccatcttcaccatcttagcttggatggttcgcccgctggtcttgctctggaaatggtggcgagatctgatcgatgatggccactctgattacttatgcgaggcagtttgtctcttcattgtgttggcaccgattgtttttgtttctactcttaaagcgctactggagtagataatttatgaaatggttgccaagtcttggcatgtatcccttatgtatcaacttgcataatctctactttaatgctttctacacatgtgcctgatttgtgttgcctgtgaatgtgggatttctagttttttctcaacattcttaggcgcttttaggtttggcatcctctttattcggcgggataatccattcttactcgataaatgatttaatgttagaagggcacttcggcgtaagggtgattatggacaaccatttctgaaccactaagtcatgggggcaagagattgcattactc

SEQ ID NO: 67956 - DNA, 711 bp, Oryza sativa
gaccatctcgtacaactctggatacttatgcttgtttggaagttcagcggaaatgatacaatcatattgctcgggagaagtgagcttgtattttccgtccatgatcaaaaggaaatgtgcatgtggaagacccctcttttggaactcaaccacatacgcataagcaatcactttgccaaggatatgcttctcaagtaattgtttcttgaggtcctctagtttcgctcgaaacacgcgcactatgagatcaggcctatcttggggtgtctgcccaggctcaaggttacctattatctcttcccagttagggttgcatgtcattgtcaaaaaaatgtccggcttcccatatttttgcactaatgccatagcgtccatataccgacgcttcatgtcccgattgcccccaatgaatgatgctgggagcacagtacgtttgcctacctggcttgcacggctctctccagcatgaatgctatcaaccacacctttgtataggtcagcccttatctctacctggtgacgccttatgaagtctagtcgagtgctttctactttgatgtacatatcaactgcaaattgttggaacaagcgcttcccatacaatagtggattgaatataccacgacgcatttggaatttgtagcaatagtagtctctaacggagacacatagtctgctattttgaatctgcacaaagaatgagagcaaaaa

SEQ ID NO: 67957 - DNA, 1343 bp, Oryza sativa
aactaagggtgtgtttagttcacgctaaaattgaaaatttgattgaaattggaacgatgtgacgaaaaagttgaaagtttgtgtgtatgaaagttttgatgtgatggaaaagttggaagtatgaaaaaaaagttgagaactaaaccaggcctaagcacggcctatctggtctaagctttcacaccttctaagccttatattcctttcatcttccatctaagaaaaattttcactattgtactagaaaaccgttgctccttgtattgagattgttgctacattgaaactgttgctgattgagctaattgaggtggtttgctaatgaactggtgtcagaactacctattttgcaccaaatctaccataagtagccaagagtctatggaatccaagtgtacgcaagagaagattgattgttgtatattttggagagactaaaagaaatggaagcaaaatagggacaaattctttgaggagatcagtgcctccattaaggcaactactgttgtacgtcctcatggtttcaatcatcttcaccgcctatggcactgtctcctttagcacttacaaaattgttgatgatgtacccaaacaacagcatcacttgggtaacggcaaaacacggacacaatttattaggtcacaagccaaaacacggatggcccaaattaatttgaaggaagactccatttgaaagacaccaattagacatgaatttttttagagggtacgggataccgttagaatggtacactttaataaatccttttcttttctctacctacctgagcaaccacgcataaaacaaataaagcagcggtgctcatcttgctgcctcgctcagccacatcaattgcaaggaaggaggcaggcattgagaagaggaaggatgaagaagagccaatgggaggtccatcgtcaggcgaccaaaaagcaatgacatgtgtcccctctctccttgacttgataccaggtacctagggtaccagacatgatacatataggtaggtactaggtatcggataccttgatactagactttggtaactttggtatcgagtgggtaccagaccatggtacccaaataccaagcctgatacttgtaggtatcacttatgatatcattaggtatcatgcctgatacctgagtatcatggtaccagagtaccaaaccatgtacctaaaaccaagcctgatacttgtaggtatcacctataatattgttaggtatcatgcctgatacctaagtattatgataccaggttaccagaccatggtatccaaatatcaagcctgatatttgtaggcatcacctatgatatcgttaggtatcatgcctgata

SEQ ID NO: 67958 - DNA, 1210 bp, Oryza sativa
atcgactcaagcgtgaagatggttcagatgtcgacaattcttagaacatcgagcatcttcgtcgtttttatgcttagacattatttgtgtatactttttcctctttgactgccaacatcaagttgtttcttgaagttaccagtcgggggctatcataataatactggagtatgatttttatcaattcaatttgtttacttgatttatcattgtcttgtttgattttttggcttagttaatgaggacttagatttttttgacaacttttgcaggttctaagctcaataaggtttgacaaaaacgtttaagaaatcagcgactaaatttaaattatcaagcacagcataaatttatcagtattgtacagattgagcctccatcatcaaagattacatcatatggaatcaaccagactcagttttctcatcatcagacccagtctgaccaagattggtatcttgaaatctctctacaatgtctgcagcaattttgtcagcagccttttgggcatcattaatgatgtcaacggcatcttcttcgcttgttccatctgcaaagccatcaatggcatcaatatcgatcttcggatacaaggacttagtcatcgctagagccatggttgctcccatgcttccagcctccatgatattcttgaaacatgtgtccggagcagctctcaatttgtcgaagacttcaacagcatcgattgtactcgggccattgttattgtagaacatggcttggatcagcggtgtagcagcattggcgacttcatctctagcctcttcaagttttttaatcttggtaatcaagacatcaaactgagcctgtgatttaattttgcgatctgcatgaagcaattgtgttagcattgaggatgcggagacaagtctatttctggacttccgattgcaattaccttcgacatctttgatggccaagtctctttcctttgcgagatcacccttgtccttttcgagagctttgattcgtttctccagctcggtgatcttggcagcttggactattgtacatcttggcggttagctgagtacaaacaccaactcagaatgaattgagcaaggacagatgttaccttttgacgaaccagtcaactcgaagttgctatcttgaagctcatcactccgatccctgagatcgtgttcagttttcctggctagttacctagtttcatggagttgagctctga

SEQ ID NO: 67959 - DNA, 2052 bp, Oryza sativa
gagaaaattcctacagatgacatttcaaattttcagccagcattgcaaaagatgcgaaagatcagatgattcaatacttaccagaggagggggttgaaggcatgataaggcaccattggcagtatgtgcgagtaatcgactacaatgccggatgagaaaatcttatacatcctgtctttcataatcttaaattcaagagactctggatcttcgcgtttgggatcactcttgccatcaaactcaaaggcagtacgggatctttccttaataggcgccagccagctcttgataaagtgccgagtgatttgctccccatgcagaccttgttccttgagcttcagcatgcgatttagcagagtgagggcttgagcagcttcatcttctattggaagcgagttccatgtatcttgatatgttggaggaagacaagagtactcgggaagcgctggcttaggattttgcatataaaaccaatttgcatgccaacccttattggatgttttgaaaggcatggaaaaatatttctggctcaaagtgcccctcagttgaaaaccggctcccccaacaacacactgcttgctcttgtttggttggggcttcaggaagaagatgcaacggaatagggcaaagtgcggcctaatccctagaaaggcttcacaagcatgaatgaagtttgcaatatgaacaatggagttggggttgagatggtgcaaactaatcccgtagaattcaagaatccccctgaataatttcgaagttgggagagaaaaaccaccatagaagaaatgggagaataccacgacctcatgcatgtccgaggtcgggaatgcttcgccacacgccggacgccagccgatgatttccttcgccggaagaacaccgtgctccaccatttccttcaagttctctgttacatcggtgggtgcccattgactctcaaagctttctctctcctccgccatggatgcgagatgggtgatgggatatggagcaagggcggcagcgaatgaaaggaaaattgaagcggcaattgcgcagatgattttcgcaagcccacgaagcttcgggagaggtggattgatgtggatttgctagccctaattttcgccggcgtggttgctacactatagcgaaggatagggagagtggaggagatctcggcggggaagacgaagcggcgttttgttcagcggttttttcgctggggtatcggaagatgctaatgggcctgggccttcttagtattttcagcccatttttattatcggcgtggctagttgtgatccttagggattttggcgtatattttttctttggtaaaaattgctcacgacagaatagcctagtgccgttaaaatcctttttgacgcagttagataattcttgggaattactacgatgcaaataaaaaggtgcccaacagaaaagtgttatactaattttgttggcctttttaggctacaaagttgtttgggttttattaaggtgactaatggtcattctctcggcatgttatatgcttcatttgataatggcgtgggtcgtagcttaggctatttatacttgccatttatcattttttatacaacatttgataaatcctttaagagttttactcggatttttaatcatatatgttgattaacagatctttagagtgttttcactcggatctacctatgccttttgagcatactcaagctaaagcagtcggctgaatgtttatcaagtgcctcatatgcttagctatatcattgctttggtaattcagttataaattcactcggatggatgtttaatatacaactaatcacatagtcgggggctacacctaattaggtgcatctaatcgatgcacccgatttttttttttattttagcccttcacagtctttgattcaagtactaggtagcccaaggcaggaatagttgaagcactcggattatcatcttgaagattacaagagaagattatttcgtcgtctgtaaaggtctcaggggctactgtggagactatgcacaccccatacccacatggcatgtatatccgac

SEQ ID NO: 67960 - DNA, 20613 bp, Oryza sativa
aacagtacatataagtaatttgttacaaaatacttcctggatacagtaatggaaacctacttgcttaactagatgtcacaagctaatgacatagaaaagtcaaatcatttttggggcaatatagttgctggcgactaatcctaacaggattaaccaaaacagatatttccagaacctaacagagctttggcatctgtcagtttgttcttgcagctccactcgattctgttcgttgtccttcaacttagcagcattgtcctcaatcagaacatggcacttctcaatgtcgtcttgaagacgatgaacctggtttctcttctcttccaactcatacttcaaagtactaatgatttcttcgccggattgtctggcgccattgattcagtatgcaaccatatcatcgacatactgaaaaaggatgtcctcccaaatccaaaccttgcaatgatacttcgaaatgtctgaacttaccttctttgcgcatttgagaaaacgcctattgggattccgagctgtatgggatgcgaaggttcgtattgggtcctcacacgcacacttgagctggggcggggataagccatagaagaatgtatggacctgcaagaatgtagaatagaactgggtggattgttgggtggatggaggaagatgcactgtgcatcgccatggctgctctaccaacagagtgcaggatgctagggtggagaatagtcaagatattcaggctgctagggtgcagaggagtaaagacgagagagagaaattcattcaaaagtacagaacggtacatttatgggcccggttgacttgacatatatgtttggtacacgggggtagaaaatgtgtgaaacagcgatatacgaaggaatacgcctggtgtgtgggaccaggagcacaaatctcaaagagaaacgggcggtgatgcatgtaggggaacgtccccttaaccgatcagaatagtttgccggctaatactctctccattccaaaatctaagtatttttagtataatgacaagtcaaatatttttaactttaactattaataacataaaaataaacaagatcatacatgttactatatttatcattaaacagactatcataatatataactctttttatttaaaatatctttttatagatatttttagttaaaacagaatctctaaagccatggcagagtctaaaaatatttatattttgggagtgggagagtactcatcaaagcagaaaatatatatggccttgtttagttccaaattttttcttcaatttttcaattttttcatcatatcaaaactttcctacacacaaacttccaacttttccgtcacatcgtttaaatttcaaccaaacttccaattttgatgtgaactaaacacacacactatatatacatatatacatatatatatatacatatatatatatatatgtatatacatatatatgtatatacacatatatgtatatatgtatatacatatatatatatgtgtgtatatatatgtatatacatatatacacatatatatatatgtatatacatatatacacatatatatatatatatatatgtatatacatatagtgacagaccgacagtatgctactagagcagaagttcagactgagagaacagtaaagtgagctgcaaggtgaaacagaccgaaaaaatcatgcttaagcatgcagagctgtgcctatgggcaaaaaaacattacaaaatatacacagcaaaaggaattcatacgaggcagaatcagtgggctttgttcactgtcaaatgttgatgcacacattgcaaggccaaaatacacactcctctgaatctctgatgcatcaatcagtttgcgaaaagaaaggcagggaagagggggcagcggccatgccataccgtagctggctaggcaggtactctgagtgccctggggagcaaagtgggcagggaaagacgacagcggagcgagcaggtggtcccgcctccgtcgagaaggcgcttctggcaccatctgcaccgctgggccgtcctgccacggatggggatcaatctcgtgctggtggcgctgctgtggagaatgtccgcggcgagttcggcgtcggcgatgctctcccagacggaccatagccaatgaccacgcgaaatctgcacgcacagacccatccttgagtggaacacgagtgggagcagatggtgatggtggtcgtcgcagtggcagtccccatagagaaaggcctcgcgacacgtggtgcagaataggtccagcagctgctcaggctgagctgagcagccaacttccaagagagacagaacccacgggtgcgccgccgcagcagcagcgtggtcagcatgcgcccagcaagatatcgtacagagcgtggccagcctgctgtagagaccatcgagcgaggcaatgtcggagcagaccctgcagcgggtgcccggtgatggctgaagcaagtacggccggccaagaaacggagacgggagccggtcactctgcacccatcaccattggcattgcaaacaacacatgagcaaaattttcaattcctccacaagcacaagcacaactgcacaagaagaagcaacaagtcaagcatttcaattacctcgattcctaggaagatgggcgccatcctctcggcccctgtcaaccatgcgcaccagtcacctcggaacatgccgaggacgagcacctcgtgatcgtggacgccgccacggccgaacgcgtcgcaggacgggcagtagtagagcatgcccactcctgcggtcgcgtcggcgacggcgctcatgtcgtcgacgcagaccaccgatgatagcatcctcctcctcaggcatactgagcagacgcctccctcaccctcatcggccacctgccgccgacgacagacgacgcacctcgccacgagcgcctcctcctgaacgccatccgcgccatcaccatccgggcccacctcgccaccgccgccatgaccgcgcgccgccgccgcgccggcctcgcccgcctcgccgtggtcgcctgcagcgccgccgtcatgcgtgccctccgtgccatccaatccggtctccttggccgcggatgaggaacgtctgcaaaaaaccatttccaatcaagaaccattcttttggtcaagaaatctggcaagaatcgatttcttaatgaaaccatggaattcagttctcttcttacctcggggagctgtcggccaacaagaaatccgccacctcgccaccgccaccggtcgccgcgtcgccggcgccgctgctcttgccgagctgggccacgggtacccccatcctgaaagaacgcaggagagatcgaaacaggcgcgcgtcgggaggcgaactcgaggcgccggtgcggaggaggaagaagaggagagccaagaaaggggagacgaagggcgcgcgtcgggaggcgagttcgtctgagacgaagacgaagcggagacaaggaagatgggcgcttgtcagtcagtatacatggccatatgggccgcccggccgtgcctgggccgaggcttgtcgggtcggcacggcccgacggacgcaccgggccgtgccgtgccagcccacgtgccgcactcacggcccaggcacggcccaacacgcctcgggccgtgctgggccggccccaaggcactacggcccatcgcgctttacctcagcataagtctaatttttctccctcctattgggctgtgacatatatagctaaaaaaagtctattttacctccctcttctttgggctgtgatatataaggaaaaagtacaccgaaggtccctcaacttgtcatcgagatacaaaatcgtcccctaattacaaaaccagatacgtggcatcctcaacttacaaaccattcactcagtggttttaaccccggttttgtccgacgtggacgctgagtcagcgggacccacatgggccccacatgtcagacagaccacgccggccaagtcccggccgcgccgctcgccctcaccggcgccggtccatgaggctgagggtgcacccagcgtcgcggaagcgcaccatcgcctgcagcggtggtgcggggtctccgcagtggcggcggggatggccggcgggaagaagctgaggccgctcgcccgcgtcggctgagtcccggccgcgccgctcgccctcgccgtccctctctgctctctactctcgcagggcatggggatgccggtgctagggcacccacggcggcgcgcgcggccggcgacggtggctcccgaggcgacgcgagcttcccccaggcggcgcgcgggctcagggcagcgcgagctcaagacgtgggtctccgaccgcctcgcggtccagctcgtcggtggagatgaggagggagcgggagtggcggcgggtgcgggagcagcagtcgcggtgcggggaggtggcgggcgggacggcggcggagtgcgccgcggtttgctgctgcttccccttcgccgtcgttgagcttgtcgtcctcgcggccgtccacgtccccgccacgccgtctgtggtgggcgccgccgcggtgtccgctccacgaagcggaaggagatgggcgagctcctcgccctggacgtcgcctccccaaggtcgctggccgtcgcggccaccaaggctaggaaggtagaggccgagttcccagccacgcccatgaccgaacacctcgtcgacatggagaagcaggtgtgggcgagcttctacagcgccggcttctggaggagcccctcgcaacgagaggacaggaggtgatcgccgccgccgctctcttcttcttctcctccttccccacggttgttggtttcttggctttctcctcccttttcttcagaaaagagaagacaaataactcgatcttgtgattaatttaaccgcaattgacaatttttttttttttttgcaactggctgtgttcttctctccttccaaaaaatttgtcgattgggaggaaagatacctgctcgtgctcattgatgtcctcttctttgccgtgccgattatctccattccattgtgcttttgttattttggtgctcatcgttggcgatgccgtcgtgcgtggcaacgcctatagcacgaggcggatgacgctcagcctgatggcgccgtcgttcttgacgaggcccagcatgaggctcgccggcaccccgtcgatcagcagcaccagccatcggcctcgttgccggcgacaacctcaccgtcccgctcagctgcgcctgcccctcgctgccgcaggtcgccgtggtggtggctcggcagcgccatcgttgagctcgccggcgagggcgagcggcacggccgggacgcggccggcgagggcgagcggcgccgccgggactcagccggcgagggcgagcggcgtcgctgggactcagccggcaagggcgagcggcgctaccgggactcggccagcgtgggcgagcggtgcggtctcctccccgcccgtcgcacgccatgccatgagagaagagagagacgaggaagggagaggagagggaatagagaaagctgacgtggattgtctgatatgtggggctcacgcatttgaccactcctcttatttaaaattttttaaaattattatttattttatttgtgacttactttattatttcaatactttaagcacaccttttcgttttttatatttgcaaaaaaaaatgaataagacgagtagtcaaacgttgcaagaaaaactagaaatctcttatattggatggagggagtagcaaagattagttccaacaaccggtagtcattaattaccaaaacttcttctaacacacggttataggacttgctctttcactggccggggcggtgaagcctaaccaacggtgtggtgagggattaatcggccgacagcatggggagggagggcaagctatagagagagacaggaaaattatcaactcattttcaaaaactttttaaccgaatcatttatttattatattacaaaaaataatgatatgcactatatttaacattcacgctaatgaacagggacatgtcagcgtttgacggaacttctaaaaatcataaaaatgaaatccaacgagacaataaatctaaaaacgacagggtctactttttaaaagttccaaggagaatgaatagaaagagtggtagatcgcgcaagcaaataaaggagacgtgacaaacatgtaaggggtataaattttaaaaactataaaattaaaaatacaaggataataaagtttggtctttcatagtgttaaaacaacgagatagctatttaacaaattttaagtaaaatcatattaaaaatagataattttgtatgggtgctagccgtgcaattgcacgggctacctagctagtttatttattatattataaacaaaataatgatatgcactattattaacatcaacgctaatgagcgcgggacatgactttgtgagcatcggcgggagcgttacacagacaacgaacgcaggccaactaaagcgtcctggcaggggacacgtaaaaaatgaaaaggaaatcggaatccgattgggaggcgagtaggcgaccggccggcctgatcgagttcggaatcggaatctgaatcggcgcggttgtacgtctcgtgtggacatatatatataccacctgtccacccgtcaccagaagacaagcgtacgtgcgtcgaactatggcaatccgcaagcaattagtgcaagtgcaaccgaaaaagatcgagatgtggcagtggcagcctccgcctctccatccaggggtcgtcaccatggcgaagcacaagctacagttggaggacctgtcgcagacgtgccggcgagaccactactgcgtcaggtgcgtccacgccttctgctcccactgctgcgatgaccaccacttcgtcccgctcggctcccacatcgtcatccccatcgccggtgtcgacgccgccaccggcaagcccgtcatccccgcgcactaccctcgccgccccgacctgcccatcaccgacttcgtcatcggtctcatcaacgccaacgacttcgccgaggagcaccccagggacgcctactgcatgtactgcttcatggccttctccaccgcgctctgccaccaccaccacacctgcgccgccgactgcgtcctccgcatcgtccgaagccacgacggccgccactgcgtccgctgcaccggcgacgagccgtggttcccttacatggagagcgtcctgggcgaccccgtggctgtcgaggaggaggagggcgacgacggcgaggtggtggctgtgctgctgctgctgcccgtgctgaggaggagctcaccgaccgcgtgcgtacactgcggcggcgaggtgcccaaacacatgcgccgctcggtgctctgctcgccggcctgcgacgcggcccaccaactggaggtcgcccagcgcagggagcgcagggacgccgtgctcgccgcgcgccgcctcgccaagctgaacatccatgccgtttgatcaattcttgtactgtattagcgctcattgatttgatctcgtaattctcatatctgtatgttgacccgtgtcttttttttttcgactccccgtgtctataaactattattagtaaattactttcgtgccggcaatatcttttaattcttctcttgtgcattggggttgattaaccgcctaatgatgcaattttcatttcacaaagctaaagctattcatctacaggaacgtttagcagggctatagtttcagctttatctcttttgaagctaaaactcaactaaactgtttcagttttatcaaacaagaaagcggagcaaactaagtgataaaaaaggaaaatttttatatgcatatctttaacgatttaaaagttaatataaaaaagggagtagctatatttatggcgccaaatttttcgtcaaaaaatagtcggcatgtatttacattataagtccctaaattacatttgtaattttagtgtatttacaatgtaaattccaaaattacatatgtaagtcctaaaattacatatgtaattctcaaaattacgtatgtaagttgatgtaattcccaaaactataaatttgtaatgacacagatatttagtttttaagattacatatgtaagcccacctatcatactcctattccactattcctctctctcttctctctctcacccttcctctctcttctctcactctctgtctcacacgcgcacagcggcgaaggaggtggcgagcggcggcggggtgcggcggaggaggcgaggcgaggcgaggctgcggcggtggaggcgaggcgaggctgcggcggaggaggcgagacgaggcggcggcggcgggagctcgcgctgctcaaggcgaagtgaggtggtgccggcgggggtgcggcggaggaggcgagcgcggcggcagaggaggcgagcgcggcgacggaggaggcgaggcagcagtggcggcaaggcggttggccggggcgacggacgaggcgcgcggcgtgggcggggctcgagaggagatggccacggcgcgcgggcggcggggttgagatgccgtggaccgggtgctggcggtggtactcgccatcgtagccgacgatgcggcgggacctcctcgcgtggtccgcgtggagcccgtcatcctcctcatccgccgcgcgggggaggcccgaggaggaggtggcaatggcgtggcccgagtaggagacgaggctgcgggcggcggggatgactggctcgggcgcgtcatcgtcggtagtcgcgtagctccgtgcgcccacgctgtcgcgtagtcattcagctccgctagccgtcgcgacgagctcccgccgtggagggccggcaccgctcgtgccagctgctgctccgcgtggcgcgccggagaaggcaacgatggcgaggcagtcggatcgcatcctgctccgagctccgtccgagagggaagagggaagccgcgccgagctccgtccgcccgcatgccaccgagatggaggggagaagccgcgccgagctcctcatcccccgccgtcaccgccgccgcgtcacgcgctgccgccgccgacccgtgagactgtgccgcgagagagaggaagagtgagagagagtgagtgagagaaagagaggagagagtagtgacaggtgggtaccacaatttttttataaatagaatgctgattggactaccacgtgtacgccacgtagaccaaaaccaccgcggattgggtcgagggggtaattcgtccggtattcatagttgggggtgaaaaatgtctggttttgtggttcgggggtggggggtaattcggatgaccgcgatagttcggggggtaatttgtactttttcctagataatatgaaagagcatactacggatacatatggcgttcatcgtgcaatatattccttttgattcatagatcacaacatgtgttacacgcgtatggttactagtagggttaatttgattcatgtcattacaaatatggcatattagaaaaatatcattacaattcacgttattgattagattccactgaaaaattttaaatttggaaccatgccacttccttcattgtttccgtactaatccctcacgtcctcaccctcacctaggggtggacagaaagctcgtggctcgtatgctcgctcggctcgtgacaagctcggatcggctcggctcgtttgattttcctaacgaaccgagctggaagtttagctcgttagagataacgagccagctcgagctagctcgcgagccttaacgagataggctgccagaccacaaaccccttaggcccatttatttagaaggcccaatagaccaaaaaccaaaaccctagcttcccttcccctttccctggtggtggcggctgagctccccgtctcccccacacgccggcgccacgcgacgcggcccacgcggccacgcccaacgccgccgctctgcgcctccaccctagcaaccgacgccgccacctaaccccagcgcccgacgccgccgatccgtcgctctccgcctctccctacccccacgcccgacgccgtcggcgagctcaagctcgtcccacgcgccgccgccactctccgcccctccccttgtgcctgacgccgccggcaagctcgagctcgtcccctccgccgccaagttcctccccgtggtcgccgcctcgccggcgagctcgagctcgtcccctccaccgccaagctcctccccgtggtcgccggcgagctgtcaaggtgccggcgaggttgagctgcttccgtgcctccgtggtcaccggctgcccccaaagctcacgagcctaacgagctggctcgagctttcaaacgagccgagccgagctgggttttttgctcgttaggataacgagccgagccgagctagcttgttaggataacgagccagaggtctggccaagccgagccgagccaagccggctggcccaactcgacatccaccacccctaccctcaccgtcagtccgtcacgtgagcgcgcggggagaacgctcgccagcgccggcaccggcaagcatcgagaggacgaggcggcgcaggcgagcggtgagaggacggggagatggagagacggtgccggcgagcggcgaggacgaggcggcagccgcaccctctcaccacgccctctccacaactgtcctcgccgccgaagccgccaccgtcgcagccggctggaacccttcagcgtgttggatagtataggaagaggggaataatgcaaatattggatacattgtattgagcctcagggggccgatatatataggagtacatggggaagagataaggaaggattacagatatggaaggaatccaaacaaaccaatcctatcctaatatgactctaactaccatatactctaacatcccccgcagtccaagcgtgagcagcgcggacacttggactggagaataaaccggcaagagtgctcaacacggatgatagccctttgtgccatggtcgacgtagccaaagcgaaggagccgagagagccgtggtcgatgaagccgtgcgcagaatagccgtggtcgatgtagccgaagtcgggaagctgatgtcgaggtagccgagccgcagggagcgcatggggcgccgtagagtggtcgtggatggactagagggcgtcgtggaccaaggtgcgtgaggacacgcaggagacgaagacggggacgcgatcacgacggtcgttgaggaagatgacgtcgaagagccgatgtagtcgaaccgtgaaggacaagacgtcacaccaggtttgccagacccggggacaactcgggacgaacatgcgcgccggtgttgccaataccgcgcgggcgagatagaggaccaccatgaatcatacaccaatgtcggagaagaccagcagagaaggcctccgggacggtcgcggcgcgagaacggcgtagagggagaattgccggagcagcacgcagttgccggagaagagcgaagtgtagtcgaggaagatacagcaacgctggcgatgagtcatgctggacgaagtagaaggcgaagtagcgggaccaacggcctggacggcgacgtcggtagccttgtagaggtagctgcaccaccggcctagagtggcgacagtggcagcttggagatgcggcggcgatgctcgaagtagaggaagaagaccctgagcggctgacgatgaccagtgcggacgacgaggttgtcgatgcgtgaacggcgatgaagacgacgaaagcggcgaagctgcggtccgagaggacaacacagctgcagctccatgtcgatgcagcgacgagaagtccaccggtgatgtagccatgcttaggagggcacctctcagcactgcaacaaccagtggaggcgtggaccacaggcggcggcactgtggcccgagggggcgacgcagcggcaatccaaagcttgatggtgtagacgcgtgctcgatgacgattggttgtagaagtcgacgaggcggtgggcgacgcaaaccgatctctgatcggaaaaggaaaataacagcagcaagcagcagcgcagtacggtagcacatcctctgttcctccatggtcccgatccatagaccaagtccagcagccttgcagcctcagccgtgccagcaggaagccatgaccaagtcaacgaggagattaaatccttcacttggccacagcctattcaccttctcccgaatatccatccacacacatgcagacagacagagataagggagggagaggagctgtgcgcctgtgctgggagacgcattgtggggaggtagcagcggctggacgtggagtcggcgttgacgacgaaccggcagcctgcccccaagcagcgtcggagacggtggggagggcccagattcgatctgcatgtaggtagccgatggtttggtagctgctgcatgtttatgaagatgaacgacgacgcagaacgctagagattgatctctccagcacgatggaacagcgacgaacaaaacgtccaccggaggtgatcgagatcagtccctcgcagcggtggaacaagacgatgaaaaaaaaaacgaaaaacggtggccgcccccaggagcgagatcacctccgggggcgacggcagcggaagtggtgagcggcggccgtaggtcgtccgctctgatactatgttggatagtataggaagaggggaataatgcgaatattggatacattgtattgagcctcagggagccgatatatataggagtacattggggaagagataaggaaggattacagatatggaagaaatccaaacaaaccaatcatatcctaatatgactctagctaccgtatactctagcaccgcgctcggtggtggtggtcacgcccgcaaacaaggtcgcattgacggtgcgctgctcctgaaatcactgaaacaagcagccaagcaaacacccaacaatctgagctaaatcaaatcaagttgggatgaggagagagagcaagcgagcattagatcgatctcactggacagcagcagcgcgggctgcgcgtgcaccggagacatccgggtcgcaaagcatggagaccaccttgtgctcctccttgtgcccgtgcgactcaccgccgtgccccgcacctgagctccaccgccagaggatggttttttttagagaagagtattttctacccggcctctatatccaaccggatatatacggccattgagatagggaacttagccccgcaaataacccaatctaaaattcgctccataggagatttgaactcaggaccttgggccagaggatggatggtcccgacttctctctgatttggggaagctggcggctcgcttcgctcgggcagtcgtcgtgctcgccggagagctaggatgggagaagggcacgctgccgctgccgctactcctcccgctccccgcgtgcaccgtgccgccgccaccgctgctgctgccgctgaaatatttttgaagcgctgtcgccgctgctcctccagcgtgaggatgatgacgtaagggagtaggacggaaacatccgaccaataacgtgaattgtaacgatattttttaatatgccatatttgtaatggcatggatcaaattaacccttactagtaggagtaaaatgtgtatttgtaagagcgagtgtgcttgagcatgtatgagtgaatcagtttgtttgcgatgttaaaaaaacaaaattaaacaaaagccaccaacatttaagtaattagatcacgtccactgtgtttctactttctaaaagaatctgaataaaccaagaaaaaagcaactccaatgacatatcttttcaatattcgttactccgctacttcctccgtccaaagaaaaatacaaccaatactaaaatatgacatatcgtagtataataaattgggacatactctgtgtttagactcattgtactaaaatgtatcacattctaatattagattgtctttttttttttaacagagcgagtgaagcaataagaatggatattatgaaccgtggagcactagcagctacgatttctctgatgatgtcctcatgcgcgtgaactactttgtaggagcaatcatattcatacctagtgagcgataattacacggaagtagattagtaaactaatctgtgccaagaagcaggaacatcttgtgattcctctaatatttgtacacaaatgttaaataattgcccacacactagctaagagggctatgtttggggagctttatgaagcagctgtttggtagctagcttctgagaatctggaaaagctctgaaacccagtttctccaacttctggcttcttagtttatttttcagaatcagtaactacagattcttagaaactgtggattgtttggggctgcttctagcagaagcagctttttccaaaagctgcagctgggagaaactccccaaacagggcctaggacccattgtagtacctcggaaaattacctcgcgcacgtgtcgcggcgcgcgttttctggggagcagcttggcctagattagttctagataatgatgatattttctgaaagattttttttttacagattgaaaacttttgaaataaaatttaaaattttaacttaaattttgaatactttcaactcaaactttaaaaattttcaacttgtaagacaaattttataaactttcaactcagatttaaaaattttcaactttagatttgaaaactatcaagtcagatattagaaaacatgtatgctaaggattaaaaaaaaagcagaaaaaagcagaaaaaaaggaaaatcgcaaaaaaaaaaaaatggagcgggagggcgtgcttgctggcgcgcgccctccaattagccatccccactatacattggccgcctcttcttgttaaggcactcaccatgatccaaattcccgctcggctttctcctctcgaatggcctcctgccgccagaagccacgacgaactgctgcgctcttcccatgtcgcacgttgctacgtagctgcagtgcggtggtatgggagatcgccacaccagcacgtcgaagcgcggcgtgtccacgccgggcaccacgcggccgctgagcaggtcctgcatcgtcaccgtcggtgtcgtgctcgccgccggcgtccacgtcgtcagcttgcgcctgccgtagaacaggcagtgcggaccgtccatggacggcctgtacaagtagtacgagtcgtcctcgtccctgaccgggccgtgctcgccgcggccgccgtgggcgtcgatggccgcccgcgcgatccggcgccacgaacgcgcggtcatgtcggcgcgcagcgccgcggcgtgcgcgttcacggcggcgatcatcgcgaagtgcttgacgccctcgaagagctccgcggcgatggcgaccagctccggccgatcctccgggtcggcgccgccgaacgcgaggacgcggaacatgtaccagagctcaggccggcgcaggttgtccagtgtgaccggccgcggcgccgtgcccaggcgcgccgcgtgctccgccgtcctgcagatgatgaccaccttgccgtccccgttctcccggcgaacggacgagcacaacctcctccatggctcctcttccacgtcgccgacgacgtcgaccacgacaagggaccttgcgctaggatcgatgccgaatctccggtgctcgtcgtcgtcgccggccgccatcagatcatcgctgctgagacggtggatcttggcgaagtactgcctaatccgctcgtcgatgcagacgtgttcgaccagcgtccgcttcccgacctccggaccaccgacgacggggaggacgccgggattcgggtcaccggccgacgagcacgccgggcgcagcaggaagtcgacgatctgctccttctccatctgccgcccaaacatgcaccgctccatgaacaggtaggcgctgtacggctgccggctcaggcgagggcagccggccaggagcacgacgagctccttggcgccgcccagcgcggcctccaggctctccatgaccgtggcgtcgccgtcgccgcccaagctgagcagcagcggctggcaccggcgacgacgacggcggctcgccgccgccgccgcggcgttccgtatcctcagcgcgtcgagcgcgtacgcggcgcggcacatctcccacctcagctgcctgcgctgccgcagcatggccgggctggtgacccgcctcccctcggcctcctccatgacgacgcgtgctcgcagcagcgctcgctgcagcctgcttgcgccgtcgtcgtcgccggcgcgatgctcctgccacttgctgatgaggaaggagatgagccgaccgacgaggtcgctggccgccgccgcgagcagagcgtcctttgctgctgcgtgcgtcctctgcaacttcgtctctcggctgtgatttgttaaggttggagggaggagatttttgttcttctaaacaaatcgacgagggtacaggagaaaactgtacaaagaaaacaaatttataagtaaacacccggagacctgtggactcggtcttgagtcttgactaaaggtagccagtccgcgagcttccttgcgcccgcgagggcctagtttttgctgagggacgagattctcaggtggtgtttacgtccagggactccctgtctctagacattaatttagagtattaaatatagactacttacaaaactaattacataaataaaagataattcacgagacaaattttttaagcctaattaatctataattagagaatgtttactgtagcatcacataggctaatcatggattaattaggctcattagattcgtctcgcaaattagtccaagattatggatgagttttattaatagtctacgtttaatatttataattaattttcaaacatccgatgtgatagggacttaaaagttttagtcccatctaaacagggcctcagcagcacacaaacgagataactcattaagggcttgtttagttccaaacttttttttaaaacttttaacttttccatcacatcaaaacttttctacacacataaactttcaacttttcaatcatatcgttccaatttcaaccaaacttccaattttgacgtgaactaaacacacccaaacacatattcgttgaaaaattcaaattctaaaaattgaatttaaacatataatttaaatcattttgagacgtatgattaattaatttaagtattgactattacaaaccagaaaattagatttatttgattttttaaagaaatttttatataattcttttcaaatagtttgaaaatgatgctagaaaaaaaaaagaggaatttatagtttggagtggaagaaaaaaacatgctctcagtgagcacttatgagtggtacgcatttatatatgagatgcattttaaaagaatttgaaaataaaaaaaaggtgaagaataccgtattaccgtagagcgtagtttatggtttctacaccgagtttctttcgcatatttaaccatgcggccctctttcggcttcgcaagcgtaaccacgaagagtttgaccgtaagacgagcatgtttgtgttgttctgttaaagtttgtaaatacgtatgctgaccggcatgtggttaatttgactgtttagtacttcagtggaagctaggtattcgaataaatcaagcgaagaaaattcaattcaagcattgttacattttgctaattgcaaggacagagaggacgctggcctggttttgcaagttgccatcgcaatgcaggttttgcaggctggcctagaaaaaaaaatagtggagaaaataaatactccctctgttttttttatagatgatgccgttgatttttaacatgtgtttggtcattcgtcttatttaaaaattttatacaaatgcataagatataaagcatgcttaaaatatttttagtgataaaacaactcataaatgatacttatgtacttcctccgtttcacaatataagtcattctagcattttccacattcatattgatgttaataaattattctagcatttctcacattcatattgatgttaacgaatcgtgggaaatgatagaatgacttatattgtgaaacagagggagtaaatgttttgaataagttaacaacggcgtccattaaaaaatactaaagatagtatcacaaagtttgctagaagtaggcatgttttgacaataactaattgttcactgctgcatttttgggattcagctagtacagctcaccaattccatgctaattatgttattggccaatgcaaagaaattttttccctactaatattaagtagcataaaaaaaaaccttgtccgtttttggcataactaaatttgatagcaaatgaaacatcatggggtactcttgtttgaaattttttatgcaaattaatatggttttaatccaagctagtccagtatggttcgagaattcacccaacatttatcttaagaaaacgaccttgagtttttctacagaatacttaacgtagacaagaagtataatgacactcttgtggatggggcatggttcccctagcttgggatgacgacttcttggaatggtgactatcgtcttgaaagcagatgtacaagtcaagcatgaagtacttgacagttgacatggatgataatcctaaacacctgattgatacaaaatggacgtaaagaacccaactactctacgatcgcagaggaatggagaacctggaacgaagtaagggccctttgaatcaaaaggatttatattaaaattttatattattcaaattttataaaaaaaaatattatttgacactatgatctaaaggattcaagctttacaaatcttataaaattcctatggaataactcattgcatgtagattttggaggaaacttagcaaaagctccgatctcttggaaaattttctgagcctatctctccgatccaattcttctgtttttccaaacgatcatttctatgtttttcctgtgttttgcaatcatctgttttacacttgtattcctatcagaatcctatattttttctattcctccgtttttttcaatcttatgatccaaaggctaatagttagagacttagaaggctagaatagagtgtagagacatggggcatgcattggtcataaactcataatgtaagagtaagactacgatgcaagatcttttagtgcatgactaactccgttgggcgtccaatagggttcgaggacgtcagcaagccgggcgtcgttggcaacaagttggagttagcttgaccacaagaatgaccgaatcgactccatggtgtggcggaggacggtgaggaagcggtgggaatgaggccagagaggtggagtttgtcgaatccttcgccacatccggcgccacctacggcggagtagcttggtgaaggtgcggaccaggttgaccgccttctgctattgctgatgcggcagcggatgtaccgcggtcgccatttgtacgtccatctagtggcctctcgtagctagcgggaggatttctcctcctcaacatccgaccgaaggggcaattccgtctcatcatcgggtggaggagcgaaaatctatttgggaatgaataaaacggcgaaaatgacaaagtgacagtaggcacacgcttcatgttgacattttatcgaatcgtgttctgagaataatattccaacgaaatcacgttttaagcgtgtccaaatgtccaattttttctcgacgacggtagcactgccctagagactgcccattttcgagctggaactggaagtggaggaattggctcgccctccccccttccccttgaacccccacccccgccgcgcctgcactccgctggtacgcccacgcccacggtctcgtctccccgaccaccacaatccctacccttttcaaaaagaggagagaggggatcggaggagaatttctccacttcacccccaacaagcatcccgaccaccaccaccccccgctaccccaggagagattcacccgcaatgtccgacgaggccaccaggcgcttggccgggggcggcgggggcggcgcggcgctgagggcctcctccgacgtcgaccgcaagccggccgccgcgggctccccgcctcctggcgccgccgccgccgcggggcacaagatccagctcaagagcgccgacatgaaggaggagatgcgccaggaggccttcgacatcgcccgcgtcgtaaccactcgatcccccgcacctccctcctctcgattcccttgttccctgattcggattgctcggtttgcgatgtgaaatggtttttgtgttttttggttcgctaggcgttcgagaagcacaccatggagaaggacatcgcggagtacatcaagaaggagttcgacaagaaccacggccctacctggcactgcatcgtcggccgcaacttcggtactcctctctctctctctctcgcctccccctcttcttgctggaaatttctttggtaccgcatcatctggtgatttatgtcttgtcctctcctgttgattggggtatccgcggcacaattccatgtgctctagagcttgtaggctaccgaatggtatagaagtcgatgtgtgtttggtcgataatgacaaagaaacaaccctcgtgaaatcttcctccttgtgttttggttaaggcaagccaagttagcactagggcataca

SEQ ID NO: 67961 - DNA, 3719 bp, Oryza sativa
gctttcctcgcatccggaaaagggctaagtgtatcatgaaaacataggactttaatcctgttactgcttcggttaatctagcattttcgtatatattttatttagttgtaatattatactccctccatcccataatataagggattattcctttttgggtaagattaaggatagcatgcaaatactagaatacctctattaaatgaggtttgcttatggtgagtgggtagtggggggttaaagtaggtagaaatttgaattggagttgatagacatgacaagtagtataccaaaatcccttatattgtgggataactagaaggggcaaatcccttatattatgggacgaagggagtatgtactgatgaacccatgatagtcttattgaactcaacatgataataggtggcaaatctcaaactgatgcccatcggagtatttgaacatgacatactagtttaattttacaagctgtgttaattttcaagtgtttctactttctaattgactccagtaacatgagagaaatcctaccttccatcgcttctcaaaccttgtaggaggttaaaattttcccttagtaaattggatttgttaaatagaagagagttagcatccagccatccgtagacatgacgggtggaattgttcattatattttatcttttatccttagctgacacttatctgccatcttgtttgctattgtggagcgtgtacataccatttttgtaaaccatggatagttttagtctttgccgactatctagatggcctcaacttctcaaggcttgtgtgatatgaaataccacagtgtaactagtccggtctgttatggattagtttggttcctgttggttaatctataagaaaaagaaaaggtggggtctcagtttctatggctcatgatccgaggggttagcctccaaagcttgtattattctctggaattcattgaccttatggcttatgcttgcttggtaatgaaaagccaagatgaaaaacactataatggaattgaattcactttttatcctattcctttggttggtttatgggagatgtgatcatgggagttggctgacttctcagcatgattgggaaaacctaagtacctaactgctgaaattgtagaacacttaacttaaaactgagctatttttccattcttcctatttctattatgtcattgtattataagccgtcttcagtaggtttgtggtgcattcaggtatttaatgttgctatggtgtgtcgatttctgaaatggttggcaaatataaatctgtactcaactactttatctgatctcctggtttctctgttctctctaagatgctcttgtatgcaaccaattccaaaaggacaaaatatccttgatctgaaacagctccatttcgctggttacataatctacttcacaactttagtaatgaatttatgcccttgtttccatttgatgcgtattgaatgttatgccctgcaatttcacccaagcctttttgcctggtgcagggtcctacgtaacacacgagacgaactactttgtgtatttttacatcgattctaaagccgtcttgctattcaaatctgggtgattggcgtagctaatatcccctgcgcttgttgtcttgtatgcctctttcctccgcgttgtctgcaaccaaagctggaagcctggaattctgagagcctgcatgttgttgatgtatcagccgcggatcttttccatattccagcaaatgtgagattagattgtgtgtctattttacgtctgatacatctaggtggtgtcctgacattgccttattgtaatctgattgccggaaagtcagacagaggttgtcatcaacaaggtaaaacttgtgctgatctgcttatattatgcattctctggccaccgggttgcagaaattgcaatgatttcaatgaatgataccctacatgaactgcctatatatgatatgccaatgtggattaagttacaaaaagggaaaatactttttgcattgttgcatcatgtgaaattctactagaccataacatggccattttttgctgagcaatccctgtgaaaatcgtactaaattattattgatggatgcctatgataaatccatggtatcacttaaatttctggttaagcttaattgtatgtgtgattatggatagtaggaattgaatttggtgggtgcactatactgatctgcttaaattatgactgtctggaaagaggttttcattctctggcatggtttccatgaatgacatgaactgcctacatatgatttgtctcgtgggttaggttccacagaggaaaaaaaaaatactacgtatccttttggttgcatcatttgaaattgctacaataaatctatgatgtcagtattttctgcaatttatgggtatcaggaattgacctatacaatcacgactctaccgctacactgtactgtttgtgttaaagtcaagttgtactgttcattcgtgtacaaccagaaacatagcgcattctcagaatttttattatttttaaaacctttttaatttcacaaaataaatcatcttaaacttatttctgaaatctaaactttttagccatgccccgcatgatgtggtaaaataatatagctatgtcaaccatgctggcatggcaaaataacactgttacgttagtctatgtcagcattgtttcgccacataaatttggctggtgtggttgaaaggttcatatttgaatataaaaaatttaaaagttttagaaaacttaaaaaagatcgcattctcatccttgcaaaagccaaagtttgcgactttgcgttcgtcttacgacaaagaatacggaattccctagtactttccacgattccatcctccatcaattttgtagagcaagtatcatgtgcgcatatataaacaacctgtccctggattctttgcctacaatcatatcgtactgactcctctagggaattgagccctccccctaccctaaaattattcatgacctacccacacaaaagatggccgtccccatcacccgcgcggatgacgatggccttgtaaagagaagaaaaaaaaaacgaagcgaaggtgataaggctcgttcatggacggcgacagcttgacctaacttcgcgccgtgatgcgcccacatgctggagccctccgccgtccacgtgtccagatcactagcaacgtggcaccaggatcacgcgcgagggtgcactggtttactagtggttactagtggccccggcggcccagctgagccgagagagaagaaaacgagttcaagtttgcagctcgaaatgaaatctcctcgtgccaaagctcaagatggcgattgcgaaatgttacatcgacaccgcaaaatgtccagattcaggcatcgtttgatatatgcacagtaatgtccgtaatgtttaaaatgattcaacacaaatttgacgtgaagcagatgaaattgaaaggaaattaaactgatttattacttgttccattaaaaccatcacactcgggtacgtggtgaaaccgtgaaagttaaaaaacaaaaacagtagtagtagagtgaggccctgctcgctgttacatgagaggtgcacgaagaaccagcacacgagcagagcatccagcccacacgcagcaaggaaacggtagggatgccgccgccgccgccggccgatccgccgcccggcgatgatgcgtcgtcgtcgtcg

SEQ ID NO: 67962 - DNA, 14488 bp, Oryza sativa
tcggcggcgtcggcgccgccggcgaagttggagggccggtagtggcccgtcacggggtcgggcacccacgacacctccctcgccgccgacacgacgacccgtccttcgcctgcgtcatccccgcagcgcccttcccttccaccgccgccgccgcccgcctcatcgccgacgacgccgccgacgcggcgtaacccctcgtcgtcgtcaccctcgccgcgagcgcccgcgccgcggcggcagcggcagcagcagcagaggtggagagagcgagagccatcggatcactcgatcggacggctgatggcgctccgctcctctccttctctactctgcttcggtgcgacgcgacttgggcttgtgagctctgtgtggggaggagggaggcggaggcggacgcgcatttaaagaggcgagaccgggggggagggggctcgattttattattttttataaaatattttttggtggggtgccacgtggcgtgggaaagcacgtgacgggtcgagggaaacgtcgccgcgggttcgggctgtcggcgacgcgacgcgccgcggagacggtggacgggtcgagtcgtggtctggctatgcagcggtttgcgggtcggtggacgtggtccaccacgccaacgtgagtaaaccgatgatgatgagcgtctctggtttgtctttgtccactgtgaggaagtgagggcatcacattgtgatccataggtaaattataatattttattcacgttgtgtaattagttcctataaaaaacaaccaaagatacctatatacatatattgaataaaaaaaatagtagtattatctatgtctacttctctcttcagataatattacttcgtgtctatatacaatgttgggattgctatagttaaaatctatttacatagattctgtctatattgatcacatttgccatataaattggtgatgccttattattggtggctttttatataagctaaccgatgagtacatttacgttttttaagctgctaaacgatactcccttcatcccaatatataagagattttagatggatgtgatatatcctagtaccatattcagattcgtattactagtgtgttttacatccacctaaaatctcttatattgttggacggaaagaatatattgcaacgtgaaaattttctgtgtagaagttcttttaaaatatcaaatagttttatttaagtttgtaataattaaaattagattaatcatgtgttaatgattttttttcatcgctttatcttccctagaaaaacgaagaccacgtagcatttctctttattctctccatttcaaattacttgtttaaaatactagttattattataattttaaatttctaagcactttttactaaaatgtttcctgtttgctcctcataaatgcattaacacctgtgaccgtaatgtacaggggttgtttcttttgttgcttgatttagatcggcgcaaagtttggcttttggttgaaattagatataatgtgactgaaaagttaggtgtgtatgataggttgatgtgatagaaaatgactgaagtttggatccaaactttggatctaaacacagccttgctatatctctgtgttgtatctaaaagttgatcgaatggtagtacgcaggagtaactaaattgaaacggagggagtttatggtggtgagtcgcgtttgcgttgaaggggggaagttgagttggtgctcttgttcggttttgataggtgatgggggtgtttaattagtctatgtaaggtagagattgagttgacttgcggcatgaataaaaattcaatcttatctcccttgttgtttgcgtattttagccgaaacagctccttcacgataacattaactatacttcagatgaatacaatttggccaccccataacacttaaatatcgaaaattatcaacactaaatgagcactttttattatgcattgtgaccatcaccaccgcccgcgtaaaataaccaggagaaagggcttgtttgtttcgttgctagaatcagccttatcaatttttttttatatatagatgaatgtgcatttagtttaatatccttttaaactttactagtagtgtctttatgagagaatctatggaaccactaaattttgataacgcatcattggcaaaccttacctaaaataggtgggttaaaaagtgacaataaaatggacatgtggatgtggtagggttaaaagtggtaataatgtgaacatatccaaagtagcaataatgttatgataatggaagttcaaccagtgactgggcaagctcccggcaggtcgggcagccactcgggctccattatcgccatctccattgctgaatgccatcaatgtttgtaaaaatcggtcaatcgcggtaaaaagtattagtcacttatagctcggtaacgccatctctttctcaaccatctccatcatctcagcaagacagaagttgatttgcagcattcaagtgctccatcgttgaaggttggctactcttcggattcacccttcctattgttctctaacagaagaaaccatgctggatttatcattcgggttgagctcggaccacctgcacaatttcggttgacagggttgatgttagagctcctcagattcaatgatgagcctcgtggggatccttcgctaagtccggtgacgcacacaccaaaatctacagctcaacaacaaacctcagtcttgtgccgtttccgtggaggcagccgatggggatcaacggtttgtcaagcggagtgcacatcttttgaggcccagggtagcggtcgtcgcggcttcgtcgcagatccctgccgacttgctcatttttctaatgttaggttatttcaggaagattgtttccgtagttcagttaaccctcccttctcaggggtggctcttttgctttcagtttttatccttggttatgtattggggtttatcctctaattctgctcttgcttaataaagttgatgtgtttttttaaaaaaaaaaacctcaacctgtgcagctggccatgttaagattaaggctgtgtttttttttcaagttttcaactcatttcctctttttcgcacgtccattgctgagtgccatcgatgtttaaatcggtcaatcgcggtaaaaagtattagtcactcaggctcggtaatgccgctagcttcgtcactgagtccaacctcaacctgtgcagctggccatattaagggcaagtacaacgggtcggcgagacctataggtgtccaaacgggcggcacggcccggcccggcacgggcacggttccggcacgggcacggttccggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccgtgaaggcaggccgccagcccgccagcctgcagtgcacagtgtttttttttaaaaaaaaaagcaaaggaaatgtataaggaaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaagggactccccaaagttcaggggtaaatcttgcctggcgattaaccggacaagagattcccgagcaaccatgggatcgtactcccaactgtgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttaaatattacttacatctttccaactgcgagctcttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccgcgcctgacgggccgccggcgtgccgtgccgttgcgtgccgcgggccgtgccgtgccggcccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccatttggccacctctagcgagacccgtcgacatgcactgcttttttgcaaaaaacaccccccacggtgctagcttcgacccatccgtcgtctcgttcgtcgacgatgccagcgcgtgctcccaggcgacgcgacggcgatgaagcccgttgtacgacgcgatgcggggaggcgacggaagtgcgggatcagctgcgtgggatcagctctctcgcgcgcggaatatttaaatgtactatgcattgtcttatgtatgcaacaaaataactacaaagatcaattatacactagatcatcatgatttgtgtgtcaaaggatgaattaaacactctacggacagccaaaccaacaacccattatataagccgtctgtttaagctgtctatctgtgtaaaaagacagcaagctgtctacacggttgtacttgccctaaggctgtgtttttcttttccaagttctcaactcatttactcgtttttcgtacgtactttttccaaactgctaaacgctgtgtttttttttaaaaaaagaatttttgcggaaagtgctttaaaaaatcatattaatttatccttttaaaaaataactcttaattagttaagtgctaataagtcgttctattttatgtgtgagagattattttccaaccgcatggattgagaacatagcctaaaggaatgtagcagactagcagcagtggaagtaagatcaggtacaataacaggctataagccaactataaacataatttaaagatataaaggaagagaaataagatcagcgggctacagatctgtagccagctgcagcacggactccaaagcgtactatgtgtatgacaggtaggaccaggtattaataggatagtaagcaactattatatgaattggctattatattggttatagatgatttggagttagtagttggctacgctattaaacttgctctaaggccatctgaagattaaggaatgtagcagcagcggaagtaaaggccgtggatgttaggaatgtagcaggctagcagcacagcgttccgcaggaaaatccacggcgctaattggtgacgcgccgagggaatggaaatcacggcggacggcgatcgaatcgaatcgaatcgacgcgacgcgggcgtttttgtcgggtcgccatcgacgggaggacaggacacagccgcgggcccgcgccggcgaagacgctgctgcatctgcatctggacaggccgcaaccggccgccccctcgcccgccgacggccatcggaaaaaggaaaatgctgaagcgaatcaagtagggccgccgcgcggcgcgtctagtgcaggaaatcgggacgacgacgtgcgtgcgatgcgaccgcgatacctcgcttggttgttgttttcggccattcaaaaaccttttacagaagatgggagaagatgccaagcagcgacgcatgccaaactaaacgtggccatgaattgtactaatactatttctcatgtatttgcttgcaacatcgtccaactaaacgtgcccattggttataatgcttcttctattcgctcgcaacatcattggaataataattcattccaatcatgtccatgcggaaaaccagcaaacgtgtccttgccaactaaatgttcacgctctccgccgcagcagcaacaacaacaaaaacgttcaaccagaagcaggctcagctttgcttctcagatgagaacatcaccatcttgtgccaatggttcagtgaccgcttcctaccaatgcacatcatcacatgaattcgaacatatcagaattaagatacaaaagtctccggtatcaacatccataacactatttgatgataacattgaaattgaatcgcaagctccttcgtaacactaaatgatgagttgctcctacatatctttcatgatccgtgctcactaaattgtaagtacaactttgccaataattacgaaaactctttcaagggagcatatgagtaaagttaccgatgataaaataacttttttttgtcccagtagtcaatagtacaaaatcctttattcaccaggaacatctccacataggccatctagccctcaataccgaaatgaaaatttcctgtctgatccgacatctttcagattttgcctgagattcagaggaacaagcttgcagaaattttaataaaagattctactgttttagagactacaacagcttgactccagcttctctaacagagtcaatgacagccctgaccttcccatggtacttctgctctctcttcatgtggatgcacacagcgggtatgcccttctgcagcagccgctcgccgagcagcttaccgatcttggcagcggcagcgacatcgcgagtggactccatgttcggcctcagcagcttctcctgcgagctcgcggaacaggcgaccgtcgccgttggggtgtgaaccacctgagcggatacatacttgttcgagaaatgcatcctcagaaggtagggcttcagaaagcgcgtgatcctagccgccctttccggtggagggatcaccatagttgctaggatctctctctgcagcaaaataacaagcgagacaggggacaatttcagttggcgaaaaatgcatacaggtattcacattaagacaacacaagtgaataatggtttaccactgatttgtaaacaatttgaattgtaagctgaaattcaaaaccaggagacaaacaaacagtacatatgaaaaggaacagtgtttagtccggccatgctgatcgacgataaacagttaagtattccaaaaaggttctacttcaatcagcactgcaattgcatatttgaatggccatatagcatcagcagcagcagcagcaacttatgcttactaaagctcacaaaaaaatgcatcaattccaccatggcgttattatccaagattattacaacaaattcaggcctgaaccagcgcatcaaaaacagattcgggcatgtccaccagacgcaggtgaaagctcacctcgagactcagaggctaacttaacgtgcgggcatggccatggcggatcagccaaactaatcccccacccgaaaagaacctccttggaaacaaacagctaatagtagtagttgggttaggcaaagatttagcttttccagatatagaagagaagctagggatggcaacacgttcccgcccctgcgaaatgcaacggggcatagttttctcccatcgccccccatggattctccatccccgctgtcaggaacaacaaactcaataggtacatttcacatctcaaataataacaatattcagtcaagagatattattgccatccaaaagaaaaaaaaaacaaaaactgctagtattttcagccggagcatgaccatcagtccaaaatcaacaatactaataatcaacatgaagtaagttcacatctcacatctagatgagtaagttcacatctcacatgcaagcaagcagcgggatcaaatctagacaggcgtacacacacggtaggagcgaccagccgacgacggagaggggggcgagcatgcgaggagaaagggagcgaggcgaggcgatgcctgacgactgccgcccgcgccgccctgctcgccgcgtcggcccctccctcggccgctcggcgggttaacgcgaggagaaaaaggggtatgggaggagaggcatgaggaggagtatgtgcgtacgtgcgtgtgcccaccggcggctgggtgtggggagcaggacgacgccggcgccgcttgcccgccggggtgggtggggatcggcgctgctcggcggcggcggcggcggcgcgaggagacgggaggggagtcggaggccgaagggatacacgggggagatcgagatcgactaatgctgggctgtttgaggtccagcgatatgggctttttctatggccggcctgggcctggctgaaaaacaatggtgaagaaagcccttcatcttttgatctatctatatgagggaataagtttacataaagtcctcacttacctctcccgattgaataaactgagccccatcgtttggcctaaacagtcaaagaataaggagtaaattccttgtgtgcccctgaaaagttacccaatcccttacatgcccctgaaacttactcgattccttctatacccctgaattttcgattggatcccctacatacccctaccgtttgggttccgtcagatgtttgtgttcatgtgtgtgttagcttgtcagtattttcataaaatgcgaaaatgcccctgtcaaccctaggtaacacagggccacatccgatccccaaatcctccaaaatagttcccacacgcacggtgccgcacatcgccagctttcagccatcgttgcacgcgcatcgccgcccttctcccacatcccggcggcggcagcggctctgcatcccgccgcggtctcggctctgcttgcggtcggcggcggcggctgggtccgcatcccatcggtggcgtggcggggtccgtatctggtgggcggcggcggctttgcatcctgccgcggcgacgagtccgcatcccgccgcggcctcgactctgcttgcggtcatggcgacgccgtctcctccctgcctcctccgcgccctccctcttgtcacctcaccctcttctcgggggctccgacgccggcctattacctccttgctccgctgctcctcgccgtcggtaagatacacccttgcgttgattagcaaaatgcgaatagctgctgctgctagtgtttcttcattaatttgtttgactttatgcaggcagatgccttgaactgttatgggcttgtgccattatgctcatgatgtaaaaagtaatatatttgtgtactgctgatggtgtatgaatgcttttagatgtattttcattttcttcctattaaatggtgctaccgatgctcttgatatgctgatgaattgcaatggtgtttgagtaaacgggtaggggtactgtcttttacccccaggctgtatcggttagtggtcatgaaagatccaatgtcatgttatatttttttataaaatactgaatgctataacaaaagaaaatgaaattaattttatgcactatttttttagtctcacggaatacatactgtgcagtcatgaatgtttcaaacccagctgccaaacatgttcttagttttcagctcctccaacctcaagggtattatagacattttcaaccaaactaaccagggaatgctgctaaatctaacggtaggggtatgtaggggatccaatcaaaaattcaagggtatagaaggaatcgagtaagtttcaggggcatgtaagagattgaataacttttcaggggcactcaaggaatttactcaagaataagccaaaatttgaatttttgaacttgattttgaagtgattttgaaatgcttttaacgtaatttttgttaatgttggcttttaagtcgctacgaacaaatctataaaagttttacttataaattaattttaattttctaataagccaaataagccattttggccaaatgggcaaccgatgggagcctgagtataacatattttccctttttttgaaaagaggagcaaattgactggtttcgaaagctgtttatgatgacgtgccaagtttaacatggttgatttgttgagtcaacaggttggacccacgtatgagtcacctctcttcccgtctttccatccctcccggtgatatccaggatggccaccgggggaagaggagcaggcatggaagcatcagccacagtttcaatggccaccaccatagcctgatgctacaactcgcccgactattcgccatcactgcgcgtcctctgcaccacataaaactaggggtgctagtgggcaaggttacccacttatttgtactataggtggtttcgtgtacctgcccgtttttacccctacatacaatataaacacgctggacccggcggcgcaccccggagttggtgttcgtcgccttgccgtcctacaccatcgaagtgtccgggtgcgcccccgacgcgctcgcggagtcggagccagcagcgttggtcggcggcatgcatggtcatcctcagtgcgcacaaggctgagctttgcctcggcctggggttggaaatttcggaccgaaatttccgaaatttcggaaattccggtcatttcggtcacctccgatacgatattattttggccgaaaattttcatttttttcatgaatttggataatatttgttcaaattcaactaaagtttactcaaaatttcggatatttcagaccgaaattttagaatttcggtgaccccctatacaaacgcctctaccgatagagtaaaccctggctgcacgtacgatatggctcagcgatacagatgccaccactgtccactgtgagtatcaggcgtacatgttcaacccagccaattaagtacgctccacttcatcaacgagtaaaatggccaacaaaagtgtactggctctctcagtagaaacctaaacaaactcctctggcacagtggtcaacacgttcgatgctcgctagcagcagcaacagccgccgtctggccctttctccgtcgcccatcggtaagagcgatggatggaaaaaaaaaagaaaagaaaggaaaatagagaggaaggggagggaagtggatcctacagatttttttttttcgttgagaggcttacacgcgagtctttgatgtgtgggtccagcttgctgatttaacgaatcaattgtgattaacttaccacgtcagtagaaaccgctttaaaaataactgaaggagtttaatttgcactggtttttaaaaatgggcgagaagttatacccagttttatggttgagagaggcgattcgatcgggagcagtagctaagggaagcaaaattgacttatttcatctatgtgaagccatagaaaaaatgaacaaagtaactaaaaataatttaatttagagcacatttcatagcatacacaaagtaactaaaaataatttaatttcatagcatacacatttcatagcatataaccaaccccagatattatgtttttaaagttttacaaaatctcacccttgagtatgaatttacttaaaattttaaaacataaagcgtatatagtttcactctgcactacttttaaaaagtattgtttcaaatatgctgaaattaattgagatttgaataaagatagttttatgtataataaagttatataatgaagtctgatcgtaatcattagactaagttgtggggccctgtccgcaccttcagtatcatcagactgtccttcaattttgttttaatccctggctgacatattatcagacgaaacttttctcattagaatatgaccatgaggtcaataaaccaaatccatgaggtcaaagaaacatatccacatcagtgccacgtttgatgatacagttgaggatgaaaaaaagttaagttactgatgttacggaatgataagggattgcacattaacataacaagctttcagttcaggaaatttggcatcaatttaagttcggaaccaacatttaaaacagcatcccttcagttaaagttccctagtgaattctaattcagatagcactcaagtaagccttacacttctgtaaaagctgaactgaccaaaaaattacagttcgcaaaatggcttgaccaaagctattcacatg

SEQ ID NO: 67963 - DNA, 1870 bp, Oryza sativa
ccaaaagaagcagtctaacttgaaacatgtattacacattaaataggaagttgtttttagctgaatagtgtgagtgaagggaatttgaatttgtaatagaacttgagaatttacctgtaactgaacaaattttgcgttattcatgatcacgatgacctgcaaatctgacatcttttctgacaaggtcttgatggcaatatgctggaaaaacttctgcaagacaacttgctcgctaattgattcgttggaatcaatatcagcaaaccaaaatactcgactcaattttgtccatggaactgatagtttatgttcacctccaatgaatagataagagggatcagccaaattctgtagaatcttgaggcccttagtcactgaatcagactcgaatgaatgaggaccaggtgtacaggcaataatcttagtggggtcataatagttacaaagtttacaagcgaactgtaaacttttatcattcatgacaagaatatgcccatcaccagcagcaggcagcaaccttttacaacatactgaagtagctctgttttcctgagagcagattccagatgtgatagatgaagaaaccaaagagccagagtcatgtgaaaatgaacacgagttaccatttcgacaaccctgatcaaaataaacaacatgtcagaaatagaaaagaggataaaaaataccacacaagcgctttagggttcgaaagttatagcaactctttttgtttctaaaagtcgacatttgtacctgtaatgtgaggaagaacttgcatattggtcttggagcacgagaagaatgagaaaaatggcatgtatcacctcgattacaagatccattaagaaagaacacacacatctcattttccaacgctggttgaacataaccatgaactagttctctataagttaccctgtctgccgcagattgtgtcttcatctgtgaagaaaacaggaaccattattgatggttgcatatataatgtatttcatatatataagaataatcatatgcataaaacttataccgcacctccttgataagtgtcttcagtgttttaacaacagtagtggttccaaaatcagctggagaaacataaggggttgcagcacacctgcgatgtgaatccaagtgagaattctcagcttctaatggaagtgaattcacattctctagttccagcacttcatggcgaagacacatgtggtggaattcggaaggctgaaggtacattggaggatttattttcacaagaaaactaggtctaaatcggtgaagtgtgcccataatatcatcatctgttcaaaaggaagggttagcaacacatatatcatattggaaacacaataggacacatgcctcatactaggtatgtttctttacacaaagcacatttatacataactgcaaggtgcaccctttctactatgtcttgtacattttcaaaatcatattggaaaaccttacatggaaagtaagaaaggtaatcagcatatatttaaaaaatgtgaacatatgtgcaaccaaaatatacagcagatgaagagtgagattacctactgctacaagagtgcaattcacttcataaaatttttataatgaggtacaggtaaaggacgtacaaatttcagagatgtagttaagtgctgttggcacaaggttatgaaatgcacaccactcatcttcaggtttagcaacaaaaccattagatgccttcggttcatgagtgttcaccacatttatcagacaatccagacgatacttgtcctgcaacatatgaagacatcactttactaatgtaataaacatttccaaaagcagataaacaaaaataattgccctgagtcttatataataatgttttctg

SEQ ID NO: 67964 - DNA, 1087 bp, Oryza sativa
caatgcacggacatttttttagtatatacatatattgtcgacgttggatgtctcgactacggtatttggacagtatggggatcgttggtgctaggatatacacgagactgaggtaaaagagatggagacagggatttttatacaggttcgggcccctgagttgtcaggtaataaccctacatcctgttggccgaagccggtattgctcttattcactataatcacaccagtacaatatgtaggtagcctatctaactgttgtcgacatgtcggtctgaaggtctgactcgtagtcgacaacagggtagtcttcctcctcgaatccgtgcccagcgagatcagagatagcgctttcgtatctcctgacggtatccggagacactgtaggggaatagccatgcctatccttgaagtcgatatccggcggcgtgtcttggcgtatgtaggcttgtatgttgtggcttctagtgggcgtgtgttgattgtcatgggtgtcttccatggtcctttcatggtggttgtctctccctctgtcctcctaggagggcttgtatttatacccataggtgtccccttgtccaagtagaactagggaaaccaatatggatacaattcgagtagtccttgtcgtttccatgtagaactctggttgtctttccttatctggaactccctcgaggtcagtttccgtataagacatggtatgtggtggatcctgccgagatttagtcaactactattatgtatgtggtatccataaccctaacagtagcccccgacttcgatgcaaatgaacgaattcatattctcaaccgcgcgcagacattggagtaactgttatcgagctcatgtgaccgttctcggtgagtttagagataacgttgaacttcctttgtcagcctcgtgcgggcaccgaaagggtttgtctaagttaatctctgatgtcgactgagaaagtatagagcgtacgactaagtctcatgtcttgctgtaatcgagaatttggattgaagtcaagaaattttatctcggcgggtacaccatctcttcattccgtattccttgtcgagatccagcaaccattctc

SEQ ID NO: 67965 - DNA, 13591 bp, Oryza sativa
  unsure (1)..(13591): unsure at all n locations
agaagtgaaagtagtgggagaaacgttacatcgctggtcgaggaccaggcagtagtcgtaactcgaccacttgaagcaaatgtacgagagatcactacgatcaactggttgagaaccggtgagtaggtgtccatcgatcatttggagtcgtggtacgaggaccgctacgctgccggtcgaagaccagtcgtagctgttcctcaaccatctgaagtcatggtgcgaggaacgctacgctgccgtagtcgtacctcaaccatctgaagttaaggtgcgagagattgctagagcagaattatctctcgaacaccaatggaagttgcggtgtgagagattgctacgtactggtgcgagaaccagtgagcgagcagaattatctcttgaacaccaatggaagtgctagagttggtttattgcaagtgtatctcatgtggccagcatgacttacgtacccaacttatagcatatctggatgtccgttcgcaatcatgtcgggtgatcaagccgacgacgttcgcgaggaattatccgttaacaaccttttctcgagtagtccagccatggccgatgctatgagataggtcatcggtctttgttggtaggttgggtgcgatatctccgcatttgtcgagaatgttctcgataatggagtgtactcgaccataacctactcgagtgctcaattgttcctgaaattattttctagaaggcaagacatatagcagataatatcgagtatgtactcaaaaactgtgtggatcttctagtattatcatgatataacgagcagattaaatatcaggcattatgtaaaccataaacaagcatgatttatacagaagagaacggagtgagcccctagcgttagaccatagttggcctatcatcggaagtactcgcacaacggatattgtataagaagcatgctctaggtaaacataataaattatagatctgacaatgctgtatgatctgaataggtacgataaattgcatataaaatattgcgtacctttgtagatatatgccggatatatctacggcattagtagatcaatttgaaaaatcaatctaccaattaccttattgcgtactcgttcgacatcatatgatctgacatcttttggtacgccgcggagcttgagggttggataatctcgatagaccaagttgtcgatgacgatgatggttccgatctggtcggaagatgtattttagtcgggttagatctcctcacagccgaagtcgtcgagtagcttgttgtcggagagtccatctcttaaacctatctcgtcgaaatcctagagcaccaaaatccccctacctggcgcgccactgtcgacgtttgatgtctcgactatggtatttggacagtatggggatcgtcggtactaggatatacacgagactgaggtaaaagagatggagacaaagatttttatacaggttcgggcccctgaattgtcaggtaataaccctacatcctgttggccgaagccggtattgcttttattcaccataatcacaccagtacaatatgtgggtagcctatctaactgttgtggacatgtcggtctgaaggtctgactcgtagtcgacaacagggtagtcttcctcctcgaatctgtgcccggcgagatcagagatagcgctttcgtatctcctgacggtatccggagacaccgtaggggaatagccatgcctatccttcaagtcgatatccggcggcgtgtcttggcgtatgtaggcttgtatgttgtggcttctggtaggcgtgtgttgattgtcatgggtgtctttcactttcatggtggttgtctctccccctgtcctcctaggagggcttgtatttatacctataggtgtccccttgtccaagtagaactagggaaaccaatatggatacaatctgagtagtacttgtcgtttccatgtagaactctggttatctttccttatccagaactccctcgaggtcagtttccgtataagacatggtatgtagtgtatcctgccgatatttagtcaactactattaggtatatgtggtatctataaccctgacatatatatatatatatactgttatacacatacgtatacgcaggggcgaagctacagccattcataggggtcagttgaccccgacgatgtttcacgaacctctcgtacctctctttattttaccatctatgaccccagcgaacagaaaaactagaccccggtgattttgttgattgttccgtcaaagccaaactagcgactgggaacgatactaacaaacaacaaatagaaaatttgctagcacttatgatttatacgtgagcccaacatacatatacgatagagatttgggtaaaaaaaatccacaaattctcttgttgcgtcatcgtattccttcgatcactttaatttgtcctgctccggcgctgcacatcttaacatcttaattatatcatcttatttctagcagaacgaaaggcaagaaattagtggatttgataatctttggtgcatttggtgtctttaacaaattaataatgtatactccctccatactggtaaaggaagtcgtttaggacagcgacacggtctccaaaacacaactttaacttcttgtttctacaaaaatatttattaaaaagtgatatatgtatacttttatgaaagtatttttcaagacaaatctatacatatattttttacattttcaaactcaagagagttattcatgatttatattcctaaggtttgactaaacgacttcctttatgagtatggagggagtagtttttaacaaatttgtagacatttcattttatcataatgtatttcattaattttgttttgtattatatatagtcttagatcattaattacaaactagatgacatttccgatttagtgttggattccaatgtagcgatatgacatttttcaccaaattttaataagttttgatatagttttgtcgtgaattctcaaaaaacattcaaaactccgctcagaatatacttttcgtcccacgtcgaaacatcaaaattacatgatttttggtgggttttggtcgaaaacataaaccctggttaatactgaccccggtgaccatttatcctggcttcgcccctccgtatacgtatattggactgttggactggaggggcgcgcatcagccacccccgacggtgaagcggcgtcctgactcctgacactcatttggcagctacaacctgctggcggccattcatgtcatggtcatgggaactgggagcaggtgggcagaaccagaagcggagcctgtcgaggcggcggtacttgatgccgacggtgagcacggccatgacggcgccccagatcaccacgtccatggcgagcggcgtccgcgactgcgacgtgatgaacgtgagcacgaggctggagtaggacaccaggaacggccactgcacggcgcgcgacctcgacggcacgccggtgagcagccccagcgtgagcagcatcgagctcccgaacccggcccagctcgctgccatgaacagccagtaccgccgccggttcttgtcccgcatgatcgggtcgccggcggcgtggctcccgtcggcggcgtcgtcctgccagtacccgcccgggacgttcgtccccagctggtacgtcagcgccgtgatcagcgtcgccaccaccagcagcgtgtcgttcttgttcgcctcgaaccccggcgcgtgactgcggcgcccgccgccgttctcccgccgccggttgtcacccagctcagcgtcgtcgacaccgttcttctgccggctggtctcacccagctcagcgtcgtcgacaccgttttgccggctgttgtcacacagctcgccgccggcgcggccgtcctcaactgcgccggtgtccatcttacctaaccactcttaagcctatgtcaaagtgcaaaacttagatcagagaaagaacagtaaaattctagcaggaatttgatgacgccaatgcttcgcaagaatcacaaagcctgtgttcttgttgtgtcaaacatgctatgcatacgcacacaaaaacacacatttatactggaaattttcttagttaggctatgtttagttcccacacaaaaatttataccctatcacattaaacgtttgaacacatatatgaaatattaaatataagctaaaaaaataacaaattgcacagattgcgactaatatgcgagatgaatcttttaagcctaattgctccatgatttgacaatgttgtgctacagtaaatatttactaatgacggagtaattaggcttaataaattcgtctcgctgtttgctgacggattctataattagtttttctattagtgcctgaacaccccatacgacaccatatataatacctgatgtgacacgccaaaactttacacccctgattaaaacacccccttaattactttgcttatctctaacaatcattgagaggtaatttctcagaagcagatgggaagcacaaggagtggctcgtttagggcctgtttagttcactaaaagaaaatttctgggtgtcacatcggatgtttgtccagatatcggaaggagttttcagacataaatgaaaaaactaatttcagaactcccctgtaaaccgcgagacaaatcttttgagcctaattaatccggcattagtacatgtgggttattattgtactagcacttatagctaatcatggattaattaggctcaaaagattcgtctcgtgatttcccccctaactgtgtaattagtttttttaatctatatttaatgctccatacatgtgtctacatattgatgtgatatttttggaaaaaaaatttggaactggccttacttgtccgagagctgcaactctagtcgagcgaggacttctatgctctaactagtcagtcgtcatcaagttgccgtggaatttatgcagttagaagttagaacaaacagaagctgatgtagtggatatcttattcaaaacctaaatcaacgcatcccctctcccccatttcacacctcggaatccctctgattatcttagtcaattcaaaataatctgaacttggatttccttatctgacagagaattcaggaatatccaacttgtcatcacagcttatctcatcttatgtacaactgtaacctccgttgtataatatatgacgaagttgaattttctcttaaaccattgctgaagcatatctcatttcatcacgattaatggctaagattgcatcgataatgccatgggatcctggtggctgctgcttcctcaagttattagctatatcagctttgtgggcaagctacattttccaggccatcggattgttgttggacagttgagtgatagttctatccttcacaagccaaacatttcgatttgcttgagctgtcttttgggatgctcgctctgttggcaagctgagaaatgaagtccacatttctaaagctttatgacagatagagggtttgtaatgtcaaaagttcacttgccgtaaacttgtagacaagtcgaatttgaaggagagatttgaacgagaggagattgaatttgtaggagagggggattctcaggagttattgggtttagggatggcaataggttaggtcaggcacgagcatagcaaatccatacttggcttgagactcacgtgcccgtgtccgacccacgcctgcgaagtctcttgggcaaaaccccatgcccgttgggcacgggcatgcccaacggatacccattgggtatcacagtaaatatcttaaccccatgcccgtgcattgccgtgtcgccagccgccgcctgctcccatgcgccgccacctgtgccctggcgccgccgcgtcgccatccacagcagtgccgccagccatcgccttcgcccgtgcgccaccacatcgacgcctgcgcttgtgcgccgctgcgtcacgctgccaatagcctcccgcttccttcccgtgctccaccgtcgccgtgtgaagacactggagaagagtagaagactgagagagtgagaggtggcagtggggaggaggataaggttaggggcttggggattttcaggctagggttttattgagtgaatatatattgatgctgtatacaaataggtcaaatgagctattgggtcataagagaaaggttaaactattgaaggtctcaaggatatacatggactaaaaaaaattaatttttggctcaagctgtcaagcatgggttacccgcgagtgaagtataaaacccgtatgcttctaataaattcgcaggtatcgggtgggatatgcccaatgataaaaataggtacccactcccatatccattggttcgagtatcatgaatacgcgaacctaattggattgcactttgcacccttggctgttcggaactgcgaaggtcacattggtgtgtttcaaacggagtctcttttcgaattaattttgcccgtccgtgcttgggctcgtgacctgagaaattgtgtccaatgggctgtcgcccacgctcttcgccagcttggtccatgggctctctctctctctctctctctctctctctctctctctctctctctctctcattcatcctggaggaatggcactaattcgatcaagccaatctatgtaaccgcataaacccatttgcataaccactcggaatcgatggactcactgggggggcaggcagtgtgtgtgatgatgcgaatccaggaggagcctgcagcggcaagcaatgcaaaaacgaagcgaataaccaaccttgagtgtccgtgctgctgccaccgcccactgaagtggctgctcgtctctacggagtaggagtatgtgggatgtggcctacgcctatggtttttttggtcggtccagctagcctagctcatatgccctcgtccacccatgtaaaccgcgacggaagcatggcacaatccggcacaccaactcgtcgattcttccggcaaattcttgcttgcgtgaggcccgatcgagcatcgaccgacactagctaccaacatgtcctaacaacaaactgtcagtacacaacagcaatagttagtgatcgatactggtcgcattgttatcttgtactctagaatgtcatggtcaaatatcaaatatttgtccaaaatcgttcgtttcgtttgacctctgacgacctcagccgagttttgtgctatccatatttagttttcttcttcttcttcttcttcttcttcagcagcgaagccggtgacagtcacgcttttatttacaggagtattttttacccgtcctctacatctaattagatatgtacagtattttaaaattgaaaacttagctcctaaaacaacacaatccaaaattcgctctttttaaattagaaccatagccacttaaataacacaatctaaaattcgcttatatagagatttgaattcaatatcttaggatgctacttaggttaccgcaatcactagactttgcctttgacaataacgctagccgtgctgcacaatcacacgaagttagttaaattaagccaatcattgggctcaaatccgtgtccctttcctcgaaggcgaaaaggagttgttgataaaggcttcgatgctgcacacgacctttcttctgcagcaaactataccttgcctccatttgcaccaagaccagagcacgcacgcttgccactctatatactggcacacctcgcggccatggcgagacacactcctcgctcgccagcaaactgctgcttgcgaccgcgacaatggcgtccaccggcgcgctgcttctgttgctcttgtttgtgcttgcgtgcggcggcaatggcggcgcggccgccgcggtgttctccgggtgttcgttcgagagccaggaggaggccgaggcgttcgaggccgcgctgctgcagcaggcgtgcttcaacgtgacggcgttcggtggaggcggaggtggaggtgggggcgagggcggctgcgtgtcgcggctcgacacggcgcgcggcggcgcggggagtggccccgtgccggtgctccgcgcggcggtccgggacacgctcggcgaggcggtgggcgccgtggcggccgtggcggggctcgcgtcgctgtccaaccacgcgcgggaggagatggccgtgcgcgactgcgtcgagctggtggggtactccgtcgacgagctcgggtgggcgctcgacgccatggccgaccccgacggcggcgtcgccgcggcggaggaggaggatgagacggagccggagacgaggcgccgccgccgccgcggcgcgcgcgccgaggacgacatccacgcctggctcagcgcggcgatgggcaaccagggcacctgcctcgacggcttccacggcaccgacagccgcctcctccgccgcgtcgagtcggccgtgacgcagctcactcagctcgtcagcaacctcctcgccatgcacaagaagctccgcgacatcacgccgcagcaccaacaccaacaccaccaccaccccggcaacaacaacaacaagaacggcacagccgacggcgccgccgccggaggggatgacaccggcccgtcgtcggatctaccgccatgggtgacggacgtcgtcaacgatgtcgaggaggaggtcacggcgacgcgcggacgagggaggtcgtcgtcgtcgggaaggaaggcgatgcgcgtggacgtggtggtggcgcaggacgggagcgggcggtggcggacggtgagcgaggcggtggcgcgggcgccgagccacagcaggaggaggtacgtgatctacgtgaagcgaggggtgtacgaggagaacgtggaggtgaggaagaagaagacgaacatcgtcatcgtcggcgaggggatgggggagacggtcatcaccggcagccggagcatggccgccggctggaccaccttccggagcgccacgtttggtaaattctagtgcaccgcagtgatttaatttgtctttttgctaattactcctacttttgctactcattttggttacacactcgttacttcgttagtattcatatacgaataccccgctgcgttgctgcaaaaaattaagatgcatatactatatacaaataaaatataatttaattaaaaactaaaacaatttgatataattgagcttaaaataattgagattgtagattttttttagagaagaaaaaagagacaatttagactatagatctatcatccaaatgctagaaataatttaagtgatgtggtttaatgagagaagagaaaaatatcattaactatacttagtgggatgaactatatgagtatataggattagaccaacatgatcgccaaatatatagttttgaaaggctacatatatccagttggatatagaggctgggtaaaaaaatatcattctctaaaaaataaaaaaaataaaaatatagttttgaaaatatttttgttatttaaacatgtttgcaaaacatatagcccaatacctatgaatgtatatcaaccaaaagtcattgattcgagagtattgtatagaaccatgatatttgtggtctcaaggttttactaaacccttcacttttagcaagaaaatacggagttctctaaaaaaattagtgataaggaacatcctttatactctagaacaatcataaaagcgatcatacgtgcatgtatagcagcttatacctttccagcctattatctactcctatagatcgaaccgaccgaccacaatcgtgaccgcatgcaaaagtgcgcggcggcacccagtaaattagccgcacacgaaccattatgacagcaagattcacgtgtgctttgcttgcatcaagccctcatctaggctggcagataaaccggctcgtgcatatgcatgcgcgctaagaaaagaatatccttagagcatcaccaaccgtctatctatataattccccaaaactaattttgagggattttaatccaaaaatcagctccaacagatcccctactctcctacctgagttttggagttcccttcccccgattcctcgctccgtttatatgcggacgcgaaagtcgcacccaatcacgcaatcccgcctctctcccttgttcccgcgtgtggaaaatagcgatctttctacgcgtgaaagaaaaaaaacagaattttctcttggtagtttaacaaaagggtccacttttaagttttggggattaaatttaggctatctgttggaggaaggagttttttcacttcctattttcagtttagaaaacccaaaaacaaatttttaggagaaaattatagataatctgttggtgatgctttaagatgtcctcttgcaaaaagttttccatcctccacatatctagggtttgtttgttcggtttattccggactattgactattacgatgtagtagaattaattattcccttttcaaaccccctctaattcatgctacttagggattaaccgagcaatgccttagagttgatgttgtacttaaatttaaaccgcggcacaatgaaatcaaaacataaatttgaatgagattttaagtggagttaaatttgtacttcatccgtttaagttatttgaccttttcttagtcaaacttttttttaagatttgatcaagtttgcataaaaatataataacacttttaatacaaaataaacatattatcagaatatatccaatgttaaatttaattaaactaatttggtattatatatgttattgttttttcttataaatttgatcgaacctaaattttgactaactcaaatgttttataatataaaacggagggagtaactgaatttggtttgtgtgtgcgtgcgtgcagcggtgtcgggggcggggttcatcgcacgggacatgacgattcggaacacggcggggccggcggcgcaccaggcggtggcgctgcgcgtcgactccgatcgctccgccttcttccgcatcgccgtcgagggccaccaggacacgctctacgcgcactccctccgccagttctaccgcgactgccgcgtctccggcaccgtcgacttcatcttcggcaacggcatcgccgtcatccagcgcaccaccatctctaccctcccgcccgccgccggccagaacgccggcagcgtcacggcgcagggccggagggaccccaaccagaacaccggcttcgccctccatgcttgcatcgtggaggccaagtacccgacctacctcggacgcccgtggaagcccttctcccgggtggtcgtcatggagtcctacctcggcgcaggtgtccagccgcgcggatggctggagtgggacggcgacggcggcgagctcgccacgctattctacggggagtaccgcaactatgggcctggcgccaacatcggcggccgggtgcggtggcccggataccacgtgatcatggacgccgccgtcgctgtgcgcttcaccgtgcggcggttcatcgacggcctcgcttggctaccctccaccggcgtcaccttcaccgctgacctcaacaggaaatgacgacgtatacacggatgcagatgctctgattgaacttccccctgatatgtgggcccgcgaacggtggggcccacatatcagtcactacgttcctctgactttacgtcagagaatcccaaataccacatacacacacaaaatcagttattcatttggtttggttaattataaattggatatataccagaaagaatatgtttttttttgaattaagtatatactaagctagttatacgcatagctcatatatatggattcatgtaattgatgaacaatagatatatatacaagtttcatgtgaacatcctccaaacaaaaatttctgggagtacttttttaggtctatattaaaaaacttccgtaaattttgttggtgaaaacgtttaaatgtaactacaatgtcatttatagtgtatattttgatccttgccctcgctcgatcctgtcaatttttattcacccaccctagcacaaatcttcaacatctgacggttagaaaatcgcaagtttttttaaaaaaaaatcaccattttttttaaacaaatcctttttttttctagagattttggaaatgtattagaacttgagaaaagtggttgcaaaatcatttggtcaaaggaggcaaggcccaagaaaagtctaaggcccaggaaaagtccaaggcccaaggactgccctgaccctgacacgcgccaagctgttcctccagtttccacgattcttcgtcgtcttctctacttctccctctccgccttcaaaagcgacgctctccacctgcgtcctcgtcatcctcccctagacagacaaactccagctcctcctcctcctccgcgctcgagatcccgcctccgcctccgcctcccccagtcgccggcgagcaactccggtgaagcgcgagctacggattaaggtgcgccctccccctcctcctcctctcgctaccgagcaagtggtcacggatcttggaattggattggattggattgttcacggatcgggggatctcatctcccccttgtccccggttggatccaactcctcctcctgttgttgttggtggtggtggtggtgatgtgagggggttcgctccaagcataggtagatctccccacctttgctgtttgtttgctcgctccccgggtcgtcgtcgcctcgcgcggacccgatctgatcccgcctagagcctcgaggggggatggtggatcatggggggggggggagtggtgagaggatctgtctctgtcttacggattgtggcgtggagcgctgttctcgtgggcgtattacgtatttacgtgttgccttgctttgatcccatggattgttttgggtttgggggggcttcgctgagatttggagctagaattttggtagtggaatacttgcttatgtgccaaacaggttgattatatactgtgccctccaaatttcgctatgaacagcattggggaataatgtctggtgatttgaggcgacatgctggtgtagattacactcgtgcggtggattacacctaaagagcaaatggtccatatgtttgttgctgctagcatgaactggagcaagatagagcttgctgttgtacttttactagcgaaaacgtttgctgtctgcaaacctgtttatcacataatcacattgttacatcctcccccaagttattcttaatgatttagatgttttttttttcacataacatttagatttatctttcctcgttttaatctgtcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 67966 - DNA, 2956 bp, Oryza sativa
  unsure (1)..(2956): unsure at all n locations
catggtattatatttttctatactttcataaatataatgcaattgaatcgtaacaaaattggcttgatttttaagtgaagtgatcaaatttgtgtatggaaggccattgaaagttaaaaaggaacaattaagtacaccaaatataaacaatacaatgtaaagttttaatatgatgagaaagtaatatggaatcctgaaaattaaataaaagggaaaatgtacaaatacagaaagaatagtaatttctaattactataaattaaccttgacatgttatgccaaaacaccagaaactacttgcactcagttttttagaataaaatagtgcaacagtggctaagatacttatgtacggttcaccagatttgtgtttgtagaacaaatatactatcatttacatgtgtccagagtccagactaaatgcaagataaccaagtttagatgcaaacccttaacttcctagaactggctgcatagacactagaactattttcactggaaagtatcgaatgcatgatacaaacaattatcattgaaagaaaaatagttaaccaactgtacagtgcttaattatactacaggacatgattttatcataacttagtatcctgcatttacaaaaagatgctgttctaaaatgcatgcaggcaaaccttcatcttaaatcactaatatatgcaaaacaaatatatattaaatatgtacatgatattagtagatttttcatgaaaaatacttcatttagctatagtatcgatattttttataaacactcaattagaaaaaaaaagtattaaactaatgataaaaacatgtgctaagactatcgatatcctagatgacaagtaaaaaagagtggacagaaccttagtaaataaaagaaggaaaatcaattgtagcttctcaagaatataaataatgctaatggtgctccatcacaaaacattaaaaaacatggagcataaatttatgcaaatgtaacaaaggctgaacttgtcagaaaaaagacacgaatgaaatatatgcatgaaaagaattaccatgaggatcgttcatagctctggactctgcacaacaaatcatgagtacttgctctcttaaggacaatcttaaaatggcaggatactcatgatcagttaaactgttataaaatggcccagttaccaagcgataaatttgaccatcacaggttcgccctgtcctgcctttccgctgttcagcctagaaataattacaaaaaaattgtaacgtacaatctttagggtcaaactttagttgcaaacgaaaaacatcagtatatttgtgagatatacctgagatttggaaacccatacaagctcagctgagtctgttttcctgattggatcccaataaacttgcagtgatctacaggagtcaataacataagcaactcctggaatagtgactgatgattctgcaatgtttgttgccagtataacctgcaacaaagatacaaacaagaagattatagttcaatcgcatttgagtgagttcaatcgaaaccaattagacagaggagaatattcaatcatgtaaattttgaacattacaggccaaatcaatgttacattatttttaagtgcaaattatatgattatcagggtcacttggtactcctggtctctggatctgttgctgtgggaggatgcagtggacagagcccctgtagccggggactgaatcctgtgttctaaagctagtgctagtggaaaacaatgttggaaaggaaaataaatcagaacttgctttttgcagatgatggcaaagtggcaaacctcattaatatattcagaacacaactttaaaggtaattaaaaacatgcaatgggttttaaataaatttgcaatttatgctgaagagtattgcaggcttgcagctatgtacctgcaagtagaaaacaaggatagtgataacaggacagcaataattctatgcactgtctatataatgtctatcattgtgtctgttcataggagaaaatcttaacagttcagaaacatttaactaaaacacaaagctgaatttcaatgcagaaaattgtaccttacgacaggactttgagaccttcatagtttgaagagcttcatcggtgtcaatgctgcgatggagaatgtgtactttgaacattgaactagcagatagcagacgaatccattgctgctccaaagcatagtatgtaggaaggaacaccaaaatactcttcccaatgtctggctcattttggtgtatatgcaacaataacctatgaataagttcatacacatctggttttagaccagcatcagctgcagtgttgggtccagagcagtattttgttgatagtgattccgagtccatcttgagaatatcaacaatctgtccagcatttcatagcattacgtactaaacatgtgagcgataagctatacagtagattacattaaaatagaaaacaactagcagcgacaggtaaaggaacatacttctaatgatgacgataatagtaaaactcatgttgtttcggccttgcaaaccgtgcgagaagctgtcatttcgagtctacatcgcctgatctccacttcctttgtccgttttagtatccagttagtgaacgtaagttcccgtgcattttgtttaagaaaagtagagttgtttaaaggcccttatttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 67967 - DNA, 2726 bp, Oryza sativa
ctcgaggcgtcggatgtttcattatgtttgtttgatgacttgaattattcacttcatccctcaactataatgaaaggtccggagagcctgcgacacgaggcatcggcgtttgggagttgtggagatcgctagtgctgatgctgtgtcttcgggagtaggagctttgctatgcgagagaacataatagataatatcaggcatgccaagctgttgggcattatatctgttgggaatctctcctctctgaatgtttaagtactaatcactagcactaacataaacacttgtatttactcggtggacacaaacacacaagaactgaacaaaacacacaggcttttggttgatgtggccactagctcacatcgttttcttgtttatatagactcagtacatacaaagagattacaatggccaaacccactcagccacaactcacgccatgcacacagacgtgggatgcccatgcactaagtaactaactaatcctacttatttgccaagaaatcccaatacatgattaccactaatcgcagcatatgcggctaatcactagcaacaactaaatctcatgtacagctaggaccgattcactcggctcatactgaccttgtcttgcttgcaattcggctacttctcgcagcactccacatgcagttgagcttggtcttcatgaacgttgtttgctccattctcgcaccaccgcatcgcacggcacgtcggcatctcgccaatgagctggagccaaactaaatatgcagtgacatatactacatgtaaacaaaatagaaccatgcatatattctaattaatgacaagattaaactctatcaatatctatacagtatatataccaggattggggccctcgtttgggctgggcccttggccgtcgcccttatggccctgctctagagatggcactgcgtccacaccttcaccaaattcggcaagcagcggagctccctcctcgccgtcaacccgagacagccacctctccatctccgtcgtcgtcatctcctcgctgcctgaagaccccaaaacgtcgctcccatcaccattgtctccctccggccgttgttcctgccaagacgaactgctgcccatcatcgtcgtcaagtccgcagcaccgagtcctttgtcatccacctcctcgtcaagcccgaagatcaccagagccgccttctcgccgtcaatccaaagcatcgtcgctatcttgagctcactgccatcaaaacctcgtcgccaatccctctgtctccgcttcgtcgtcatcttcatggtgaggatccgctttctaatctctccctcctattgtcctcatcttactacgctgtcgtgccactgtgtgtcggtgacctccggtcccgtgctgccgatgtcggttgtcgtcttcctccagtgtacattcacgtgtttgtgcacgtggttttacgcataattgtatagttgcaaaaataatttaacaatacgaaaatatccacttaaacagaatataacttcggatgttcacttcttggccatacatactctaaattgacatgttcaagtctttaatttcaagttaaatcatgacgcacatatttaggtgctttttatgtaatgtttaggtcctttacttagtgttttagtcttgttttgtttaagtcactttgatcctacaactgataagatgcataaattgaagatcaaatagtcgatgggccaataagccgatatagcaatgctagctgatgccgataccatccgatgttgatagggttttgaacaatcggctatatgtcgttggactcattcagattacaatagtttcatgagatttttgaaggaatactattgatagattttttttttccttttcctaccattcagaccacaaaaaccaatcaaaggaaaatcgcaggaagatttcctacactgttaattccatgggaaaagcacggggaagaatcaatccactccgaccctttttttggttttcttcgcgttggaacgaggcaatcaaacactatcagtgaagaacggactgaactggaggtgcttgcgtcaacgaatgaactgacctgaagaacttgaaaaacatgtggaggaggcatcgaggagactggacggcgcagtcagcgacgtcgaggaggccgcgcgtggaggtcgacggtgatgggattgaggctggcgtccggcgtggagtggatgtcgtgctggaggttgacggcagcgagcttggcgccggagtcagaaaggaggagaaaaaggttgtgtggtgctaaggaagctgggcagcactgtcatcggcatcgaggaggctgcgccgcgaaggccggtggtgatggggattgaagccaacgtccagcctatagtcggagttgaggggaggaagctaggtggcgcagccaaagcgttgtggcctgctgttgttcggctcgtaaagaaaacaacgggaaaagatgggtgtcggggttatccggattatattcatattgttctatctagttctacttggacaaggaaacacctatgggtataaatagaacactagaaggagagggaacattccacaagaccaagatcaacatagaccaatacacaagccaacacacgccaaggcaagccaccggatatcgatattagagataagtctagacaaacccaatatgatgtctacggaggccaacaagagggatctagcactatgtctaatctcgccaagtgcagactcgaggaggaag

SEQ ID NO: 67968 - DNA, 2537 bp, Oryza sativa
cgatatcgaacgtcgacgaagagtttgtgcattactgttttttcggctcgtcaagaaaacaacgggaaaagaagagtttatgcattactatttttatagttcggctcggtgagttagtgatattttccacactcatattccattgttttcaatcctctgttttacctataaatttttttcctatttttatgatttttctatcttatgttttttctagattatttttgaaaacttatgtgccaaactaatttaatgatctggtgtgctttggtcccatattttcagctatattagatagacctatcatataacataagcatattccactcaatatggtgagctactttagtgatttggtgaaggaattttatgattcttaattgttgcaataaatgattcagtaataaatttgttttttcattgcagacaagaagatccgttattacaagtggtggtgtgttcacgctcctcattatatgttatgagtggtggcggggatacatattatgaaaaaaatatatctcttaatattattgcaaataattttgataactacttctccataaccatccttcggagctttaagatcctcagtattgacaatggttgagaaaacaatctcccatatcatggcggtttgtaattttatagcaatattttaaatataatttttccaaattcataaactatataaaattacaaaactaatagttaaataattttaaagcagaaaaataaataataagactacaagattgataaggaatatatagatataagtgtttattgtaatctctctctatctttccgtatgttatgaacaacattttttttaatagttatattatttagcttacaaaaaagataattatttaccgcttagcacaaaacttaaaggaagtaacgataattttagtaataacatcaaattataaatagggtaacaaaagaagaaaagcttagagaaatttttactaaagtaacattcgttgaaaaaagattatttgcaactataagtagtaagaatataccaactatttacaaataagttgatgtccaacaatatcattgtcaacaataactggtttactcataaaatcttacttaatctctcaaaatattagactgtttatcttttttagttttgtatcagcagaatcactgtatatttttgttatttatattatttaaaacattttgttaagaaaatctaaatgcatttaaaataaaaaattaataatagagggtttctttttataaatcatatagtttctttaatatattttttaaatatgcgtgattttattatttattctttatacttaatttaaaataatttttattttacatcaataataaacaacacactaaccatcatctctcatatttcaaaagcgtttaatagcattttatatcttaatgatattttaggattatatattgtcattgtaatgcataattttttggtgttgttgctgcaattatcgctaaatatattcttctcattttctcttatttcataattttgtcagactcttattcctttgtctttcctaatcaattttgaatattctttgattagtcatttttacctagcaagagaggggtttaaatttattttgttgattggcaagaaaggactagaaagggagggtcttatatagttatgcttatctgttggatttggctgatacagcttatgttgatgggatgccatttggcagtttcataaacgcgtagttagggatgcttctctcctcaacctcaaaaccacatgataccctcaacctcctcggtacggccttgtggggaggacgtaaatatatacgtttgatgaagcccgcgtaagcagggtatgcccatatcaattcaagagtattcatatgtataccaaataattttgaaaacataggtataacctatgtgtatttaaaaaaattaaaaagaggcctcaaacaggccaagaaacaagcatgccaatcttcatggggaaaaattcatctaaggtcccttaacttgtcaacgaatccgattttcgtccttcaaccggaaaaccagatataatgggtccctcaactgttaaaatcggtgcaaaataagtcctaaggcggttttaacggcggtttcagctaacgtggcacctacgtggctaatttaacttggtcttcatctaacgtggcacttacgtggcaatttgatttggaaaataataaaaaccgtgggcccgcataccagttacacaaaaatattttaaaaatggtggggcccacgtggacctagggatggcaacggggcggggcggggccgggttgggctggaacggccccacacctgacccccgacttcatcccccgcccccggccccgattggagatgcggggacaaatctggccccgtccccgatccctccggagccccgcattgggtagcatctccatccaatcaacacaaaaattataagacaatcatcaattcggcaagaacaaatattgtacataattaacaccataaaaaataaatagcatcaaaaaattcag

SEQ ID NO: 67969 - DNA, 6672 bp, Oryza sativa
accccacatgtcattctcaccccctcctttcttcctcctctctcccatttccccatgggagagggcgcggagagctcgtgagagttggggaaaaggtgaaggggagaacggggaagctttttatagagcggggaggcggcgaggaggtcgggatgaggtaacaacgaccagcggagtggggcatcgacgtggggtagtggtggctcgagttggcgacagtttttgcgggagagtgggggaagaggggcgagagatgtagatgagtggaggggactcggtgctatgtgatttggacgaggatgtgggcggcagcgcgcgtgaagggcattgacgtgggcgtcgaccatgtgacggggtgacgggaggtagaagaagaagctgacaggtggggcccacagcgagattgctatttggctatcagtcacgcgcagtgagggggcggcggacgcgccacgtgggaggaggagggaggagcgggttttccgattttttctggttttttttgggttttttttcctttttttccaatttctcttctgttctggtttttttttaagatgtatgaatacaaagtttgtattagtacgtatagaaagtttgtatacgtgatgtattttctagttttttttattatgtatgtatataaatacatacatacatacatacatatatatatatatatatatatatatatatatatatatatatatatatatatatatatatatatagtaaatttgtttggtgctccatggtgcccgggctccatgattcaaattgtgtatatacccaattcaaatgagtataaaactttttaaaatgtttaggtattaacattaactactttactaactagttcaaagcaagtttgaactgaatttaaacatgtttttattagaatttgattctaggtatatagcatccaaatatataattagttaggtatgtaatattggattgtgaaataaagttaaatttgagttgttttgtttctaggtataggtataaatcgaatacttataactagatatatactcacaatttgaaaaatttaggttagtttgtgtatttcataccatggtgccccatatgagtgtcctatatatatatatagacacacacatatacacgtatgtgtgtatatatagtatatacatatgatgtatatagtacatatgagggagactagaggggggcgactaaccgcgcgcgcgcggctgatcgcatatcagcgcccctcgggcccacggtcccacctttcggcgatagggagagaggaaggaggcggtgtggactttgagggagaggggggggcgaacgggccaaggaggcatgggctgtcggagggagaggagaggggctcggcctgtgagagaagagataaggatgagcgagtgagctgagggaggaaaggcagacttgggccggaaacagcccaagaacaaggaaggagaattttagtttgttttctttttatttaattaattaaatgaagtttgttttattaaaattacttcttgagctctgaaaattcatgagaaatttcagagagtactatagggcatggaaaataatattacaaaaatatttgtagccatgatttttaaaagagattttaattccctcattaattatcttaattaattgcaatagaaaatcggcgcgtgacaaacatgtccatcaattcatgatgggatctcaccaagcattctcattatatatcaacatttgactctctttgatttctaatgtgtgaggtatcatctttcttgtcatccatccacaatcctatcagttgatccttacatatgagccatcaaccttattgcttgatgcctggacaaactcacagcaaagattagttccaacaaccgttgtcattaatcaccaaaactcctctcaaaaaagggttagaggactgacagcgtgggtggtgatgcctaaccaatggcgtggtgagggattaatcggctgacagcgtggggagggagggcaagggatagagagagatacaagaattatgaactcatttgcaaaaacttttttactgtatcatttatttattatattgtaaaaaaattaatgatgtgcactatatttaacattgacgctaatgagcacgggacatgtcagcgttcgagggaacttctaaaaatcataaaaatgaaatctaacgagacaataaactctaaaaactattagctctaatttttaaaagttataaggagaatgaatagaaagagtgatagatggagcaagcaattaaaggagaggtgacaaagatgtaaggggtagcaactgacgtaaattttaaaaattataaattagaacattagggaaaataaattttggtctttcaaagtcttaaaacaatgagatagctatttaacaaattctaagtaaaatcatattaaaaatagatgattttgtatgggtgctaggcgcataatttatttattatattataaacaaataatgatacgcactatcattaacatcaacgctaatgagcgtgggacatgactttatgagcatcggcgggggcgttgcacgacttacacagacaacgcacgcgggccaatctctagtctctactaagatgtttttgtcagaattatggtatgtcattcgtgtttgaaacggttttaattttatgtttcgattttaatctatatctctacttaaaaacaagaaattcccgtcttctgtaaaaagggaaaaaaaagtccgactcaaaaaaggtaaaaaaaaaagtccgaattaacaagcgataaaaaaaagcttccgtcgtcgtcagtaaaaaaaaaagaaaaaaatcatctcttgtccgactcatgtagaaaaaggaaaaaaaatctcccagtaaaaaaaagtccgttgtttttttggcaccagtattttttctgttgttctttgcacgcaaaagagttttttatgcgcacatgctaaggctttaggttttttttttgtcccgttttattaatctgatctgtccactgcgcgcctcctgggcgcatttagtttttttcgtcaatcttttttgtcgccagttttttcttccgtgcgctttttctttttctcatccggtttataatcccatctgttcgccgcatgccttccaaggtgaaccctagcgccgtgccgccgccatatcgatcatgtgatttctcctccaatttgattgcaaaaaccgattccccactcctctctcatcattttctccatgattttcccttcgattcgtctttaattgccggatttaatatctgctttacagttgctaatgatgacggcaatcttccccggtcatttttatctcgagttttacgctctgattttggggaaaacggaaagagtacatcgaggggatatcgatcaaaaaccctcgaccaattttggctaaccgagaaagattcggctggatttgatggggatatttgctccggcaaacgtacgggcacgggcacgagattatcttcgggaggttgaagatgatagtcatatttggaaagttgaagatggtagggtcgaagagaagcaaaccaaatggaggtatagatggccatatggcccgaggcccacagcccgacccaagcacggcacagcccgactgggtcgtgcccgtgctggcccggcccgacagccgggccatgcctgggctacatcctcgacacgatgggtcggcccggcatggcccgatcaaataaaaaaatatagggacgcaaaatagacttatataaccatataaggcaacccaaagaaaagaggaatacaaaatagacttattttccagccatttgaacacagccacagagttgagggatgaaaaatagactttttatgtggagaagcacgatggaccatcgtgccttcgggccggcccggcacggcccgagtagtattgggccgtgtgtttacgaccaaatttagtaagatatgaaccaggtttgatgttgggatcgaggcggattcagcaaagagatgaattcgaagaacagagtatgcatcggctggaatctgcatcggctgatatggatcggacagaggacagccgatagaggtgatgcagccgattccaatgacgatggtttcagagctgtttctagaatcgatcaatatgcttcatgaggattgccacgatagagataaagctatcagataggcaattgtatctattaattaggatgtctcgtgtaattttcttagagataagtttgggcaaaagtctgtcgcaaagacttatgatatcttagagtttgttagagataggggtcgtgtccggcaaggacatattttgtatttcgggtataaatagaatccgaacccatgtaatcaattaacaacagttcaatataatatcggcgcatcgccaccctttttttttgttctatttcgacgagttcttgctttcgggttgagctgcatcgattcgatctttaactagaggtaagcttgtcatggcagcttgcgttatcgggattagtgcttccatctttacgacactctaatcttgtttaagtaattcgtcgagttatcatatacacattgtaatctttgttagttgcactatataacttgttatcggctggttcttatcgttaggaagtgaccgatagtgttatgttttgctattaatctagattatatcatgtatttatcatctcttatagtttttatcatcttgcctagatcttatacttatctttatgcttgatgctcatcggttgagttcgatctattaagtaatatctataattgtaacatctggcttgctttatgatcattgagagagagatagcatcggggtttcagctgatcttacctgatttagctactttacgtcctatatgcttgattgatatgctaaatccgccctttatattaagatcttattgcattaaaatatattaggcttcttgtttgatatattctatctgtaatatagagtggtatcggagtattagccgatacatgctagatctatctgatcggctatgctataaacgtttataatctttgtgttaatgtatacttcgatctaagtgatttatactgtctcggcatgacgaccgatctatcccaatcaattggtttaaatatacatcaacagaaggattatatatcgttaatatctacaacagttaatatctacaacagatcgagtagatttagtcttatcttatttacttatgactgctgatcgatcccaatatgacatcggctcaaagataaatgatatgtcatcggcagctagccgattggctatcttttatggatttaaccgtgatttttcttgtctttttttcttgttgattgtaggatcaaatcaactggcacgctcacgaacctaaaagcaaggttttggacctgcacggaagttaagcagatcttccaggccagtgtatgtttttcgcatcaacaccgtgcatgggccgtgtatgccactcgtggactggcacggcatggcccgccgactgtggactggcacggcatggcccaccgtgtcggtcgggccgtgccggcctgactagccttggcccaggcacggccgggcttgggtcatgacgtgccaggcggcccagtcagctatctataaatggagggaggagcggactagcctagggctgaaaaagaaggaatgctttcggccgaaaacccaggaaatattttcattaactttttttaattataatctatagcgatcccaatgttaagatttttattaactttttcaattatagtgtatagtaatcccaatatttcaatttattacttagctcttaatatatcactacaaaaagtctttacccgttgcaacgcacgggcatcttttgtagtattataaaaattgaaaatgtttttgctgttatttttagtacgtcatctgtgtatgagtcgatttttaagttcgtttgcttttggaaatacatatccgtatttaagtcggttttaacatcgttcacttttgataatacagaaggaatcatataagaaatctgtttaaaaaaactcgcatgctaactaagacgatcggactactaactgcacctaataattttctaaaaatatatatatccaagcgaactctcacattgaatttcgtattaactaaaccatataacaataataataagattaaaataaacttcactcgtcgcaacgcacaggcatttttttctagtaataaaaaaatgttagggacacgtaaaaaatgaaaaggaaatcggaatccgattgggaggcgagtaggcgaccggccggcctgatcgagttcggaatcggaatctgaatcggcgcggttgtacgtctcgtgtggacatatatatataccacctgtccacccgtcaccagaagacaagcgtacgtgcgtcgaactatggcaatccgcaagcaattagtgcaagtgcaaccgaaaaagatcgagatgtggcagtggcagcctccgcctctccatccaggggtcgtcaccatggcgaagcacaagctacagttggaggacctgtcgcagacgtgccggcgagaccactactgcgtcaggtgcgtccacgccttctgctcccactgctgcgatgaccaccacttcgtcccgctcggctcccacatcgtcatccccatcgccggtgtcgacgccgccaccggcaagcccgtcatccccgcgcactaccctcgccg

SEQ ID NO: 67970 - DNA, 5242 bp, Oryza sativa
cgccgctcggtgctctgctcgccggcctgcgacgcggcccaccaactggaggtcgcccagcgcagggagcgcagggacgccgtgctcgccgcgcgccgcctcgccaagctgaacatccatgccgtttgatcaattcttgtactgtattagcgctcattgatttgatctcgtaattctcatatctgtatgttgacccgtgtcttttttttttcgactccccgtgtctataaactattattagtaaattactttcgtgccggcaatatcttttaattcttctcttgtgcattggggttgattaaccgcctaatgatgcaattttcatttcacaaagctaaagctattcatctacaggaacgtttagcagggctatagtttcagctttatctcttttgaagctaaaactcaactaaactgtttcagttttatcaaacaagaaagcggagtatagttatgcaaagttaagtgtgcgattttacagtttagtgtttccaatatttattatcggctttcgatgggtaccgatatgtttccgtcagtatagttggtttcaggttttccgatattttcaatatcgttttcgtttctagatttactattttcgattccgttttgaaaaaaaaattatggtcatgaaaatggttgagacgttttccgaccgttttcatcgctacgttacaccatgggcctgtcgttgtctaaagaagtatcacgattcaaagaattcacacaaattttactgtaaaaaagtggccatgatattttatttggagatttttagtaccgtggaattcatgtctgtagtcgacatacagacatgtactagactccaccagatttcgtttacatcagaaacttgctaaagaactcacagatgtgttcagaaacctcatcaggcttctcctggttgatgaagtggccaactccctccaggacaaccacatcctccagattcggcacattggctttgaatccacccttgtgaatgtaatccttcacacctggtgtgttgtatgtgagatccaggtcaccgacgatgaattttatcggaacatttatcagagccccagtccatggtgcagtcagctcccaatccctgcaagaacaatacatttggctgacgatgaacggcatgaacgaagcagtgaacgggaaaccatgagagtgagacatacaggtcaatgcatctgtagtagttgaatcctcctgtgaaccctgttttgccgaatttgtcagcgtagtaggaaatgtcttcctctgatagccatggagggcaagtaccatctgaatcaattgcatcaaagaatgtcttgtcctggggtagaataatagttgccggtttgcgcattccaaacaccattttaaacagatggtttaaatcgagtcgagcaaattcagcttcagccactccgggtttctgcatatgcatcaaaattcctataagcgtaatcgtttccaacaaaaacatcaatagctgatgcttcagaattcagatcactgcaggcagtggtggccacaaggatttgaattatgaatttatgattcaaatccaaaatttgaattgaccgtccaaatttgaatttcgacaggtaactgcacgcgttctttctgccttgctcacctggaagcggcacacgtagtgatcgtccccgcagagaaccctgacggcctggagcacgctcatccggggatgcctcggctggtactccacgctgaggctgacatgcgccgtcaccaggtccgcccggagcaggcacagctgccacgccacgacggcgccccagtcgtgccccgcgacgaacaccttgagagcaccaaccaaatcaccctcgagcaatcaaacaaacaatggggactgatgctgctaatgctactaactgctaataaggatggtaaaccgtaaacgtaaaccaacctggggccggccgaggtcggcgatgagggcgacgaggtcgccgacgaggtggaggacggtgtaggagtccctgccctgcggcgcgtcggagtcgccgtagccgcggaggtcgggcgccacggcgcggaacccccgcgcggcgagcgcgcgcatctggtggcgccacgagtaccagagctccgggaagccgtgcacgagcagcgccacgggcccgccctccggtcccgactccgccacgtgcagccgcaccccgctcgccacctccacctcgcggtgccgcaccgccgccgccgccatctcgtagagggctcctcctcgatcgatcgatcgatcggcgcgcgccgcggcgagcgtttgaaaatccagcccgtcctctgcctgctctgcctttgtagccgcgcgcgccggccgctcggcatcggtgtgtcagccagtttgggggaggcatctggttgtacggggcgaaaccggccagaggcagagccccgtcgtggtttccgccggcgcgaccggccggtggcttggggttcggcatctccgccgggattctccgtttgccggcgctggcgctcggtttcctcccgtgtaggtggtgctcgacgtggccccagtatacagccaggaatcgcttaggagagaatgggaccacatgtcagtgacagtttctgccgagaatcccatcccagattgtgcttctagtgctttttactcgctcggtaaaaaaaagaccaacttttaattactctctcggtttctaaatatttgatgccgttgatttttttaaatatgtttgaccattcgtcttattcaaaaaatttaagtaattattaattcttttcctgtcatttgattcattgttaaatatacttatatgtatatatatagttttatatatttcacaaaaattttttgaataagacgaacggtcaaacatatgctaaaaagtcaatggtgtcaaatatttagaaacagagggagtataaatctgagcatagctttaaatttatagattttagaaaattcagaagttaatttttttctggaacggagagtatagttctaagtggagaaaatatcagctctttagaataaacaatgcaaccaaaataatttgtgagtaaaatttttatatattatctatataattaacgattaataatcaatactacgatggaaaaaaaacctaaaatcaactccaaaattacattctgaaaatttaaattttgactatagttaataagctaagaggtaaatgagaaggtcagcgtatggaaccctggtgatgtcttacgtttattattctgtgctatatttcacatgaaataatacattactagttttaaatggacataacacaattcaatttgagttgaaattaatcccagcaaattcaggattccttcaaattttctggaatatttagcttccccaacgaaaaaaaaaaacttataacatcacatagctttataggagcctaggagagccattcttcaatcttcatcgcctttagtccacaatccaaactggttatgacacactatcggccatgtgaacagaaactgcttgattttgaaattcacaatatatttggaagatatcagtactggcataatggttctagtttttacagtacaattagcaagcaggctccaagagattttgcacatatcagaacttgctaaagaacccgcaaatatggtcggagacctcatcaggcttctcctggttgatgaaatgggcaacaccctccatgataaccacatcttcgagatttggcacacatgcctttagaccacccttgtggatgtaatcttttacacctggaatgttgtacgtaaggtcctgatctccaacgatgaattttgtcggaacttttattggaactccagtccatggtgcagtcagctcccagttcctgcatgaacagaaaactactgagggtgacatcataaatgactaaaatagctcaggtaaaagccttctttcattttaaattcttgaagacaccggcaccaatggaaatgtagttcagccatatatatcaaatttactgttgtttgaaaagaacatgtttcagtggagttagagccagcatttcgaatgactttccctgtacaatgctaaacaatatcatgttgctttcctcacttaacagcaatgaaggatgaataaaacaatgaactgtataaccaagagaattacaagtctatgcatctgtagtagttcaatcctccagtaaatccagtcttctcaaatttctcggcatagtaggaaatgtcttcttctgacagccatgcagggcaagtaccatctgaatcaattgagtcaaataaagtcttgcctgggggtataatcagaggtgctgccttgcgcattccatagaatttcttcaagagacactttatatcacctctaccaaattcagcttcggccactccaggtttctgcacacataattcggtaatttgtaagcataattatttccaacaaacaaaatataaaacgatgttaggatgacagattgttatcaaggataaacagctgattaaaactccagataccctttccctctgaataaacagtatggactgctgtattcaatatccaaaagggtaaagagaatgtcaagataaggctattaatatctgagacaggagtcatcaatgttcttcaagatcgactatactctcatgcttctgaataaactatttatagctccacataaaaaaagaatagttatagctctccaagcaggagttactgttatgttaagctcggcataatattggaatttagagctaccaagcatattacccaataggatcatgagaagaacatagttcaaaggatggccagtcttcagagaacaacatggttacttcgaagcaataattctttggacccttaagaacccagtaacttggcaatgcaatagggatacattccgatttccctacctaggatgttgaggtcattcaacattcgttgtaattaactaatctattcgttgtaatctatttcaattgagcaaagaattcaaatctaacccttctgaagtctcaatagtcaagaacacctacaactacaagtaatggggtttttttttggaaatactcaaaaggattgctcacctttgtattaagaggaataaaatttacaggaatgaccaaacaaagatgagagggagggggcggggagaaaaggaagggaaaaaaaaagaaggaaatggaaaacaaggacttgagcctactctcatgcagtcatgctcacaacgtgacgacctagcaaccaagaatgctactacctccgtttcaagttataagactt

SEQ ID NO: 67971 - DNA, 23149 bp, Oryza sativa
gaaagtcttataacttgaaacggaggaagtatctaggaagcgcgggcgacgagggatgagcaagctgccagagggcgtcctcttgcgccatagctgcaacaacgtcagccaggactgtgtgcaattgttgaaaacgccgctgttcttctccttccaaatggaccaagcgccaagggtcacgactgtgtcgaacccgcgacagcactccctctgaaccttgagcagactggagcagagccgctcgtggaaggccgctgctccagaagggaagcattgggggaaggccgctgcagacagcgatgtagtggtcatccccggaaggccgctgcgcacaagcgtcaccgacaaacactcgcctaattgtcctaacaaagattgtaaaatcgttccagcagacagcagctgttcaccacttttaagttgcgtggaacaacaaccatcaatgttgctaggacagaagaacatagcttcataattgctctgatttttctactacgagtactaacttgcaacccaacccatcaatcttaattgctaggggacctcaataatttcattgttctgcctgcgtcgtacaaaaattcagaaaagggattaaatggttgctgttcacctggaagaagcagatgtagtggccgtccccgcacacggccctgagggtttgtacggggctcctcgtggggttccgcgggtggtactcgacgctgagggcgacgaacgccgtgacgaggtcggggcggagcaggcacagttgccacgccacggcggcgccccagtcgtgcgccgccacgaacacccggggctggccgacgtcggcgatgagcgcgacgaggtcgcccacgaggtggagcacggtgtaggagtcccggcccggcggggcgtcggagtcgccgtagccgcggaggtcgggcgccacggcgcggaacccccgcgcggcgagggcgcgcatctggtggcgccacgagtaccagagctccgggaagccgtggacgagcagcacggcgggcccgtcctccgggcccgcctccgccacgtgcaggcgcaccccgcttgccacctccaccgtccggtgcctcacctccgccgccgccatgtcgcgcgctcgctaccacggcggtggttgggcacctcacctggccgagtagtagacgactagtaggagagtagagtagtagcggggagctttgcgttccgaggatttgggcggtgtgggtcgcatgactcgcgctctgctgccgcttgcttggttgctttgctcaatgctcgagagaatatcgggtgctaccgtgctaccaacgtcagaaaatacatccaaaaagttgcaaaaaaatgtaaaaaaaaatcagagatgtgtagctctaagacatgtagcatcacacaaaaaaatcagtttaaaatatgatgtaggagaaaaataataataaatttgtgctccaacagtgttcaagcatgtcactttaccaatcaactgtgatttatctttttttccctacctacatagtattttgatttgattttttttatattttttaatatttttcatacctacacatctccgaattttttcatatttcttttgcaactttttggatgtattttttaacattgatagtacagtagcacttgatattcttctctcctcaaggctcgtagacccaaaagtcagaaactcctggacatatatatcgttttgggaaggggtgagggtggtacgaaaattttctgaccacgccgataactttctgtaaactaatatcataataatatttttatcgactattattgtttctaaaaaaatagtttttctcaattctgttacattgaagttaatactagatagttaaattcaaaactatgaaattttccgactgttttcatagaaataataaaataatgatattgtttccgaccatttttatcccagtttggatattcttacgatctttgagatatagttctaatcacgcatttataccttttcataattaggtaactacaagattgcctcattcagttttacgcggagctatataatgcatgtggagttagacttaatatacaactctaattttttatattcataccattatatgtaggggtatatttgattttatataccacacttagcttctatttttctattaggtctggatttgcttaaattttatatacaactcacagcttctatttctatttatttaattatgttttgtatacaattatatcaatcaatatgtatcattgtagtttggacttaccataatttaattcttaagatcttttttttctttttatttgattaatgtgataatttctagccttcagaattaatgcggtgcttactttcaaagctatttttaataatatactactttcgtttctcatattatatgtcacttctatagaaaaatatattagcatttccaatatgaaacaaatatattatcaaaatatattcaatgttatatttaatgaaactaattcgatctataacaacgtttgattagaaaaaattaaagtaagttataatatgaatcggaggaagtaatagatagatagtgttacgaaacttatctcccgaaaaaatcggatttgtagtgaccgtgaggtcggcgccgtgatcatgatggtcatagtaccctcctgcctcctccttttattcttcactatccttagggatgaagtaggcttatacaaaatatataaatatacatgtatgtattcttatagcactctattctatcatgggtataaatacagtagaggggttgagggaaaagttaacctgtaacagagagaagacagcaataaaagtttatagcccctccacttttgtgttccgtgtattcgtgtgtgtgtttgtgttctattgttgacaacgtgaacaatgtagatagatacggtaatatcatggtattggaaaaggtgctttttaccacaagaaatccataccttcggttattgtatatttaatccaaatatttctatcaaagtagcagctttcaagacaacaacatgcaactgtacccgacctcctcattgcaacgtgttacacggtgatattgttccggtgtggtcgctgtcgcgccgagatcccgcagtactacctttgtcccaaaaataagtgcagccatgagaatccgtgtctaacgtttgaccatccgtcttatttaaaaaatttatgagaaaattaaaataaattagtcacatacaaagtactatttatattttatcatctaataacaataaaaatattaatcataaaaaaaattacaaataagatgaacggttaaacgtgacacatgaacagtgcaaaactgcacttattttgggacggagggaatacgagtgtactacagaccaggttcgacatttgggactgaaattaatttgggagatttcggtcatttctaaccccttcaatacgatattatttcggccaaaacttctagtatttttttaattttggtaatatttgttcaaatttaactaaattttattccaaagttcgaatatcggcaccgctcgatacaaacacacggtaaacgaaaagttgaaccctgcgagagactggtcggtttgcactgcggcaccgcccctccagtcagtctcgcgccttcgagttatgctaaggacgcggtgtcacgttcctaaatagcgggaaatgtatatcttcgtaaaatttttaaatgcatatatgcaagatcgaggataacaatgtatattttaaaatttaattgtctattacattgctcttgatcgtttcagtcggctgtgggttccatagtttagctaaatatggataatacaccgtacgacataaaaaataatttgtgagtaatatatgtatatatatatatatatatatatatatatatatatatgtatatgtatatatatatacatatatgtgtgtgttctcttacgacttaaatatcaatactggaaaataaactttgataaaaaaattaaaatcaattttaaatttaaattttggaagcaagtaatgctgtatacaggaaacaatgagacgtctcctgctgcctacagctataacagtcagtttgttccactcacgcaaagtgaggtactgaggtgaggtgatctcgccatctcgctagctacctccgtcgatctctgaaaaatttggagagagaaagacctattagtgttactctggtcaagagaacacagaattttgcattggaaaagaaaagagagaaatataaaagagggtatgtttagttcacactaaaattaaaagtttggttaaaatttgaaccgatcaaagcagtagactgtacgcatgcattgactcaaaaaacatgcgaaggttcacggtgctcatgaatgaccggcaagcgtgttgccacattgaacaattcaagtcaactagtcaagcatgttttggcggaagttatgtcatttctgcaagcacgcatgtaaattttgctagaatttcataggaaacaaaagctctgcataggtgggattgaccagaatttttaagctccaaattaacatgtctgtagagtgtagaaatataatactactatctccgttttttaatacatgacgccgttgatttttttataaacgtttgaccactcgtcttatgtaaattttttgtgcaaatataaaatattgtaagtcatacttaaaaacatttaataaatcagatcataataaaaaaaataatgattatataaatttttttaataaaataaatgatcaaatatatcttaaaaaatcagcgacgctatatattaaaaacaaagggaatatcatttataaagtaagtgtatacatgttcgctcctcttgtagtacgtactccctctctttctccgttatctagatttatccattaatcaataaatatatatattttgtatatatgtctagatttattaatatttatataaatttaggtaatgctagaaagtattacatcgtgtaacggaggaagcagtgattattgacattgcttctccatctttgcaatcttggtaagatgtaacggtctgaacggatctaatgtactaccatgcatagatcacgaatgcgtcgaatgtctcatgcgtgacaaaattttccggccattttaactaccgccgatgaatttttcctaggagacctgatcaagtccacggacaccatgctcgcctcgccggggagtaggtagctcggttgggcattgagggatttgagtcaaacagtaaattgaaaagaaagtttaacttcaaaccgaaagtaattaatcacacgaaaggaaaccggttttgcagtaaccggatgtacaattgattgtacacagagcaacatgaattcctgtttaatttcttacacttttcacaatgcaaagcaaggtgctgcaaagaaggttccgtttcattaaaattctgaatgagtacgccgttcgtgagtaactgccagttttttttttttttgagttgtcaagctttgaccaatggtatcaatttaaatatgcaacaataaaacagtgtcattagatagcgatcaaatatacctttttccaatatcttttgcagaacaacgtcggtttcttatgttgcttggctctgttctttttagattatcgtaacagattatttactctacgcttcaaaaaaattcattttctaaagaaactttcttctactatattatttagattatcgttttaagctgttttataaatctattttctaaacatttgatttatttatgtaactaagtagataatctatcataatatttcgttgaataatccaaaaggaacagagttagtaagtcgaagccgggatggcatgaatataatacaagaaattaagaaaaaggtatggcgtcaagtttcagcagctagcgtataatcgatgaacggaggtagcatgcatcctagtagcacatctgttcgatatcttgatgagaagacgagatggagaagagaactcggctacgttgtccattcatttcacggcctgcccatcattagtccatgcccgtgtcacaccgagacagagaagacagggtttcacagttgcgaaaaagcagaacatccatgatcgatccagattcaaaggcacctggttcctcaaaaaaagattcaaaggcaccttgtcccctctggctaaatttttagtgtcatcaaggagaatttgctggttgtgcttacaataggttcactgagcgacgaaagccggttttcgtgttttttcgatgcggctcgaaattaattttcggttagaatttgaaatgcttttggaatctaaatgccaaacagtaattttaatctaaatttaatcagaatttattgaaaactgtgataccgacatggctcgaaatttaatggtcaattggtatggtaaaccctactaccttacgtataaagctctggatcataacttctctaaataaaaattctttttatctaaatatataatgttattgtctttattctgttaaacctatttaggtgtatttttgtctagagatagcagactttctatcctaacatcaaaatacacagcgatcaatgttacacactaaatatacacaacaaagtaaaacaatatcatatattaaaatacaaaggcaatactttataaaataacatctcacataagcggatctaacacgagttaagtagagaacctcatccggcaaaaaccatgaacgaacagaacaatgcttaaaggagtcaattcaattaagagaaaaaaaactcaatttatcatgttcacaataggccatggaaaatgacgtgcaatatcaaaagattttatagtcggccgccgtgccatccacaattcctcaggttgaactgataatcatccaaaggttccccatccttctcactaatctgctttcctcctgccttgggtttcacgtcgccgttgccgccggtctctcccatccgacaaatagattgttaattactcttaccacttgctcaaatcaaaagcccaacctgtcaagctcttacttaaatcaaaattaacccacgatgctgtcccaaactacctaagagtttcagatgtactccaactgataaatattatcgaaaattctaaaaataaataaacacgttactttcattagtattatacgttcatgtaaaattttattttcaaacaaaattgctgtagtagagaaagaagagtatcagtggtattactattagagcctgtttaattcccaattaaaaatttttacgctgtcacatcgaatgtttgtatatatatagagtattaaatgtagacaaaaaatatataaaattacatagttcgccatgaaattgcgagacgaatcttttaagcctaattgcgccatgatttaacaatatgatgctacagtaaatatttgctaatgacagattaattaggcttaataaattcatctcgcatattcctggcgggatctgtaatttgttttgttattaggctacatttaatacttttaaatatgtgtccgcatatccgatgtgacatgtaggggcaaatttttttctaactaaatagacccttagttgatttacaaattccacgtgcaccgaagtgggcgtagctcaaaagttgtgtggtagaatcaatccactcaggttcaaatacatactcgatatgagtattcacatttacagttatttattctttcagtgatagatagcgtatccatggacaacgagacgactcatagggggttggatgtatgtgttttttttatatttatgtatgtttattcatttagtggtagacatatgtagtcgatagtgagacgactcatatgggtcgaatgcacatatgtgttcatagagatgagtgatacgacttatagagctgtttaatttttcagtggtagacaacatatatatatacaggtaataaggcaattcatagagatcggatgtgtatgtatttataggggtaagtgagaagactcatggatatcgatctgcgggtgtattcataggggtgagcgaccgcacgtttgagggtgtgtacagtgtactgcgttgtaaaagaaaaatccacgtgcacagttaacagctcaattaattaatcgcccacaccgaagcgcgcaccacgaaaggcagcgccagcgccagcgaggctgacctgacccggacggacggaccctgccgtgtggggcccggatcccagcgcggaacaccataatttagcagcagcgccagcgtcccgagccttggctccacccggtatcccaacccgagggaattgcggaatccaacaccaccaaatcccccaaattaactccacgccaaggaaacaaaacgcccccccaattccagacgccaacgcgaggtcgacgaaggccacgtctccgactccggctcgatttccaccccccccaaatcctcctccggcgagcggccggccgcgagacaccccggactctcccgcgcggcgattcttcggtaccccgatcggaggaggaggcggcggggagggaggaggaggatgagcttccaggacctggaggcggggaacgcccgcgggctgccgcggaggggcggtggcggcagggcgggcgccgcggccgccggggcgggggcgtcgcaggccgtggcgtcgggggtgttccagatcaacacggcggtgtcgacgttccagcggctggtcaacacgctcggcacgcccaaggacacccccgacctccgcgagaggatgtgaggctccccccgcgccatactctctacctaccccacgtctgtttggttttggtttgatttggagcgggggtcgggggatcgattttggttcgatttggagcgggggattgggggattttgcgatccggggctccgattttggatgcgcgtgatgaattttgggggggaattgtgcggctccgctgcatgatttgcgatctcgattaggttatatgtttatgcggtcgattcgcgtgatgaacctatgtctctcatattatgtgttgcttagggatcgcttctccccttctcttcgtgatatctctcttattacgtgttgcttaggattgcttctcccttctcttcgtgataattatgtattagtgataattagggattcaatttgcgagccctgcctgtagtttatctactagcaactcatgtttgggtgatagccgctgaacttaggtagaattgatgaatcatgccattcctggtatatgaatagatccgatggcctcgaataagatgttttctccattcctttctactgaaattgattcaatttatgccatgtatggcctggcatgctgtcttatagtgtagtaacttgtattatgccttaaccctttttctgtactttagactagttatttttttggtttgatgggtcgatttactttctgttggtgttgcttgcagacacaagacacgtcaacacataacacaactggtgaaggacacatcggagaagcttaaacaagctagcgaggctgatcatcgtgtcgaagtcagcgtaagtattctcttgcatctttgtccaagttgcttttttctcaaaacagaattggaactgtttctatcttgtatgtttgaaaccagaattatttcagtactcttcaccttttgcatcaaaatgaaatggaattgcaacatgtgatgctactttttgaaccagaaaaccttcaattttgacattttccttcaaagtacagaagagtgtaataatgcatattggtttggaaactgaacctacccagtccttatattctgactggaaacatcacttctaatttgggcattttttatctgtatcagtcttagttttgcctgactactgtgaacagtgatttgcctcagcacataaaacaaattgttttcttaaatactcaatatgctccagtcatgatattttcaagtgtgttgccatgccactggagaaataatctacaagcagattttagaatcatgtagagatcaaatgtagcatttgcatttcttatatgagctgctttatgtagtattgattgcctatgaatctatgatcattactattttaaggaacatttctatgttccatttttgctgatgtattacacaatgtgtgttgatgacctcgtttggaactacaggccagcaaaaagattgctgatgcgaagctagcaaaggatttccaagcagttctgaaagaatttcagaaagctcaacggttagcggtagaaagagaagctgcttatgcacccttcatttctcaagcgggcttgccacaaaggtagtttgctagtcagctggtgtacttctttctgtaaatacttgcttatttttcttcctggcatcttatgtttttgaacaaaagtgcacttactacaataatataattcatggcatattgtttatcattttcttggtagtgtactaatgctacagcatcctgttacattttacttactctgcagaataattttgttgcatactctctcttgaacaaataaattattctacgtcaagttttaaaaaaatttcatgaaaaaaatattttcagtttgactggacttaacactggattatgttttctgaggtaaatggaataataataacactggattagtgcttttaatctgccaagtgcttgatgaccctaatagttaatgccctggtttattccaacctaatacaataccttctggtgcgcatttacaggatgagcattcatatttgatcctatccaaatagttcgtattgctgttttgatctactgtagcgtataagtttctctgcctgttttacccttaaatatctagcgttttgttcatggtccactttctcagcccccaggccctagctttcaatatcataaattcattttctgactaaacttgcgatgaagtttgtcttattcatagaactcagaataataaaaccactttcaagtgtagcctgtcttcttgggtcttccaagtaaaacagcaaaacattattttcttaaaattatctccattcaatggtactttagatcattgcaaaattttgtacctcacattcattatatgttaattttctgtaataataataacaacatatttttgaggctggtctatgataatatattgtcaaagtttttccagtatgttgtcaacatatgagtaatctaggatggcttgttctttgcagctataactcgagcgaggtgaacaatggtgctgataagttggctgagcaacgcacggcgcttctagaatcaagaaggtgaattgatagtactatttggttatgctttggactatttgttttcgaacatttctataaagtattcacttgttttgaaatgaatgaacaaattcactcctttgcaaatgtgtgaacatgataacctcaatttttttctttactgtaggcaagaattagtcttcttggataatgagatcgtgttcaatgaggccgtcattgaggagagggatcagggaatacaagaaattcagcaccaaattactgaagtaaatgaaatcttcaaagatcttgctgttctagtccacgatcaaggacaaatgattggtatgtggtaccgttggggatgatagatgggattatgtgctatttgatacgttgaagcacgaggctgctcatatatctggtatgttatatctgattgtgtatctcctcctatactgcagatgacattgacacccatatcgagaatgctgttatagcgactacacaagcaaaaggccaactctctaaggctgctaaaactcagaagtcgaactcttcgctggtacttttagactcctttagcactcattaatatatttcactggcactcacttcaacatgtgaaacattgttcgattctcattttatgttgcagatatgcttgttgctggttatattcggggtggtcctgctcatagtgataatcgtcctcgcagcctaggcagcagcctggaagaacatgggactcctagatctggttgagcttagagcgaagtattccttcctgatttaattttgctgtgaagtcgggaatgtatcctgatctcctgcctggaggagggggttgcgttctggtcttgtgccatggtggtgtatgtgatgatgaatggtgtgtctggaatgcatggtttatatataagtaattaagtataatcgcttggtgtcactctagtgcctcctgccttgctcgctcgcccctgtttatatcttgtgatgtatcgttgagtgagtgttgtaagaacgaggagtttggtctttgcattataatagttgcttaagttggtcagtaaccgtcgcaatttgttgaaacatttcgtttttctctcccttctctcctgtcctcgttctactgttagtatcttgttttcgcgcataaaactgctcctgtcctcgttctactgttagtatcttgttttagtgcataaaactgagttgtggatgttcactgttcagtatatgtaattacttcctccgtcccaaaagcatctaacctagttagggatgagacatattcgttagggatgagacatattctagtatgatgaatatatgttggggatgagacatattctagtatgacgaatatagatatatgtttatctatatttatcgtattagaatatgcttcatgtttcatcctctaagatttctgttttttttttggacgaagcgaatatgtatttgtagccacgtccaggggatccagagccgtatgtgtaagttacagatttgcgcttcgccactttggctgtggttagttcagcgtaaagtttggattttggttgaaattagagatgatgtgactgaaaaattgtgtgtgtatgacaggttgatgcgatgaaaaatgactgaagtttggatccaaactttgatctaaacacagcctttaccatgctatgaccaagagctgtgacgcgcttggaccctgtgcaagtcaaggtcagctcaactctggttttgtctcagttttcttgtcttgatatgaaaatggaacagaattagagtgagcatcttcagaaatccgatcatctttttcacattcgtacatcttgataatgtacgtgtaactctgaacttctctttcagatgagtttttgtttaagctgtgtttcttttttttttgttgaagttccaacacatctttctcgttttccaaactattaaacggtgtatttttttaaacaaaattatacgaaagttgctttaaaaaatcatattaatcattttttaaaaagctaatacttaattaattatgtgctaatgatcattccgttttacgtgcacgatatattagttccgtcagcaaggaacgaaagcaacctacgagtgtactccctttataaaaaaaaaaaagctaacctaaagagatctctctcctactagtacaatgaaaatgaatctggacaactatgaggggttagtttttttttttttggcataggggagtatttgaaggggggagaaaaaaagaaatttgagaaatatgtaaaacgatttaaaccattagcgtataattaattaagtattaattattttatattttttaaaaaaataaatattatgattttttaaagggagaatagctaatatggtccttaaagtttcgctcctgggtcattttagtccttaatatttcatattgtccaaacaagtcctttaaatttatcatgtggactgatatagtccttggtcccaccaaaatcaccacatggacattgtcggtgatatgggaccgggagtatcatgaccagaggcttgaggcagacgcaatcgcccacatggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcgactggcggtctgacgcacaccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgagatataaaaggaggaccttgcccatttagtggggggactttttcccttttggaaggcagaggggaaaggaagtgaatactttgtagctccctcatacacagatccactaaaaacacaggagtagggtattacgcttcccagcggcccgaacctgtatacatcgtccgtgtctcgcgtttcttccgggcacgcgatcttcccacatacagagagagcttgagatctcaccctaagcccccggccgaactggcaaaggggggcctgcgcggtctcccggtgaggagccacgagctccgtcagacatgccatgtcacattcctatgcaaaatctatatgatttgtccaatttacccttacgcacaggaaaataaaaaacaaaaggaaaaagttaaaaaaaatacatggtatatgtaagagcaaaaatatacctctaaagggtgaaaaaaagagtatttttttcctatggctatgtctaattcacttttatatttatttttctatgatatacataaggttaaattagacaattcatcatagattttgcatgaatgatgacatggcatatccatatgatgattttggtggacctaaggagtattctaggccttatgacaaagtttaaggatttctttagactatttaaaaggttaggactaaactgattctataaagaaattttagggactaaagtagctgttctccttttttaaactaattctcttaaaagaattttataaaaaaacacatcgtttagcataagcgtcagtgcgggaaaacagaaaacagatatattttttcctctctcagtctggtgcaacaaacgcagccgtacgagtgtgttcgggaggaggtagagtggaaaacggaacttgcattcggtatgatttaaaatactttaaaaatggattaatatgataagcagaacccagcatgtagtagactccacgtggacttggcgttgacgaggagagactgaatagttcagtcttcgcccgatcggaccagagctccaggtcctttttacctgaacgcgcgatatccacggagctcaaggtcgtcggacagaagacttgagtggactagcaactccgtgctgtgcttcccatctccttcagagaaattacctcccaaaccgattggcagcgatcaagaaagtacgtgatttaactatgaaatttctcctctatatatggcggtgcgtgtgtttgtgtgcatatgcactcagcatgtttgaaaacaagaacacaagataggagtagaaaagaagatcttagtagacaagaagtattggcttcgtctaaattgctgcaaaaattttactgttctttctccgatctaattaagctttgcagctggacattgagttaggggccggcgtggtgaggtaagatggacgccggagcagttgaggacggccgcgccggccacctggcggaggtcggcggggagctgggcgacaaccaccggcgggagaacggcagtgtcgccgccggcggcggcgggcggcggccgcagtcacgcgccggggttcggggcgaacaagaacgacacgctgctggtggtggcgacgctgatcacggcgctgacgtaccagctggggacgaacatcccgggagggtactggcaggacgacggcgccggcgacccgatcatgcgggacaagcaccggcggcggtactggctgttcatggcggcgagctgggccgggttcgggagctcgatgctgctcacgctggcgctgctcaccggcgtgccgccgcggtcgcgcgccgtgcagtggccgttcctggtgtcctactccagcctcgtgctcacgttcgtcacgtcgcagtcggggacgtcgctcgccatggacgtgctgatctgggccgccgtcatggccgtgctcgccgtcggcatcaagtaccgacgcctcgacaggctccgcttcttgttctgcccacctgctccgtgaccaaacgttgatctacaaattaatattggcatgattagttagctcttttctgttctcgttgggctagccgagcaccctgcgtggtggcagcggtagcgcgtccgagtccgagtccgagtcgcgcgctacgacggcacacgcgggtcgcggagcgctcatggcgcgcatatggaatccgggtcgtgtgcactctgagcgggatgcgtgggatggcgcgtgtcgtcaaccgcggagtgtcgtggaacgctgcatgaccatctcacggccaccgccatcgcagtgacgaggccggcatagaggggaaggtgggttggggaaagtcccacacactctcatagcggattggcggtcgacggtaggagctgacttggctctaatactacttgttggctcttgtctatgaatcacacacgcgaacgtgtggttgaaacatcaggtgtttgtcccaaggttcgtgtgtgttatttgtatcgagagccaacaaatcatatcagagccatatcggctcctaccacgaattgtctcgtgtgtagatcaaagaccctattatggaccccgcaaaaaaaaaagatcccattatgggccccaagggtgctccacctccctacatcagccttggtcgtgcaacgcttggtcaaggaggttagagggtcaacttcgtacccaatgctcacgaaaacggcctataccgatggagtgctgatgacttgctcacgaggtttttgttgtaaaatttagaaaataaattagaagccaaaagctgagaaatttagctttgttatattctcatatcgaagctgattgccaatcgactgctttttagaattttaaagctcctcaaatatgttatatatattggccaccaaatagggtatgattttacaagaccaagttagatatgaccatgacttgtcatgagctgatcaaaattctctctacgagtacctcaagagtacaggaacttagagatacgaataccctgtaaggtcaagacaccaaggccctgtttagttcacatcaaactttctccaaactcccaacttttcatcacctcacatcacatccaaaactttcctactcacataaactcctaacttttttccaaactaccaactttccccaaacttctcccaaatttcaggaactaaacacaactcaagaaatcaccgaagtaccgaactatcatgcataagaagccatcaacaacctcaagccgaagaccatatcattgaccacatcttgccactgcttacctcgtcgagttagtcgactaggtctagataggggtgtgatcggtcaatttcaaattggataatggctaaactatatcatacacgatataagttgagacggattggaaaatgaatcgaatgtgtgtcaagtgagaatacaaatatgatgtgtggagaatatgtgaactagaatcagttagtaatctattttggtccgaatcgaatacctaagtagtttcatttcaagttttcaactatacaataataacaatgtaagcacttacatgagataatttagaatatttgatactaaattgatatattttgctaactattaatggtattgcgacaaaaaaaggtaactaattatattctcaaattcaaccggatgtagacttagacggacaaaaatgttatttggatgtcaaaatcaaaaccattatcgctcccatttatttagaccgttcaaacatgaattcgagtggatgagattttattattcagatcagatgtgaaaattattatcattccatttatttccattatgtaattatcaggttcattaatcacataaattgagataataaatatctaacttgcactcatatatcttactctatagttcaacaaggtgtttcactcatcactcattctttcattactcatggaacggtccagatcatctctgtgtaaaatccaacgctcaggatcgtctccacctctccaccgcgccatcctctccgccccctttctctcgctctcacgcgtccccgcccctccccaaccgcgcgccgctccccaaccctaatctctccctctcacgcggcaccaccgccgtcgttgccgccctcgactgccgcagctccgccgtcgtcgcatccgtcgtctcgccgccaccgatccccgcgccaccaccgtcgccgccgccctcgactgccgccactccgccgtcacccatcgtcgcatccgtcgtcgccgccgccctcgactgccgccgctccgccgtcgtcgcatccgtcgtcgccgccaccctcgactgccgccgctccgccttcgtcgcatccgtcgtctcgccgccaccgatccccgccgccggctcgccctcaaccaatccccatcaccgtcgtcgcatccgtcgtcgtccaggatttacgtcaccgttccgtcaccgcacccacacgatgatccccggcgacggaacgggtcatggtggccttggaggatactcgggcccgacgagctctcggcgtctcaggtaatgtcgccgaagacaagaactccggtcaagctcctcggccgtgaggacgcaagcgtgtgagtgtatcccttttccctcaaatttaattatgtactctgttacttagttctataattcatctgctcagttagtgtcccatcacaatcgcttggtcaggattgaatgttctgtggattggattgggagttgtttgctcaaggagcaattagggaatattttagttggttgcggctgcaaataccatcagaacaacaatggagtatttaacaagagccaacagccttttgtttcagatgaattccctctgaagtcacccgtcaattgactaatgttagacaatctaccatctagaggagatcattcctgaacccaatatggtgataagccgcctctgttgatgtgttacactcattgttacttgttctgaggtgtacaccttgcttgctatattggaagaatgaatttaattcacatggatataatattttgcaatttttgtatatgaaattatatgcatgttcttgtgatgtgagaaggttaaattcctttgtgggatgcccatttaatttctggttgctaattttactgaagaatgagagtaggttatgatgtcttgggttttgataagtagggtgtaaatttttatagtacaataaacatgcgtgctggtcattctgttatgtgggattgaaacaagtgatgctggcaattcaggtgcagaccagcttttggttctgtaaattattttctcaatttaaatagatcatgtattgtgatgatgcgaatataatattatgatgttatcatgtgttcaacagagcttaaaaaatactcacaaactggattctcgtagttatacagtttaaataagttataagcacgatttgggtttgatgtcttccatttgatttttagcgctcctccctcttgctccgatctggccttagtgatgccgccctgttttcgcggttgatcccggcaccagccccttcctctggccgcgtgcgagttcgagattccaagtcccggtggtcggatttctcaaccccggcactggcctcgcacaggctgcgatccgctcgccaacaaggtaagtcattattgggatgtttatatctgaaaatttagataatttcttttgaacttcattgcttggtcaacaacataacccaggaaaccaattaaattgatagacatgttgtgtgctctcttaagagatcaacatccaaattgacatccaagttaaaagaagaatttaattatctaaatcatgatgccaatattgagagcttcttttactttccgttgtatacattttctgtgatgtgtaccgaaggttatatacataatgagattttacttcaatggtggaattgtgctctattgaaccacatggaaagttctgatttgtgcagtgataatttttccctttaaaaagtcaaatttggtttacatttttattcatgacacctgaatatgtagaatgccatgcattagtaatgtgcaagcactttcaatgtattgtctaaactctaaaggaacaacttaccagtttattagtgaatttatgaaaaaaaaatcagatgtttaatgtctgaataaattcagattctcttctctgcttcatgccttcatcaggatgaggtagttagtgttgtactgtagttgacgaatcgatttgttcgcatcgtgataaggcgcagaaggtaaggcggaaattgccttggtttatcctctccccctaaatttcctctgctgcgattggttgattggttaatgaaaaacccaatacttgcaagcagattctgattagattcttaattattgggattttctagagttagtttaaggaaaagtgagttaattatcgacgatgaaatatacacttccatgattagaattatatatcgtatagacaaatatgtgtatgtattaaaaatatctgacaaattggactgtatgattataatgcctttcaaccattgctttgtgcaatgctcattatatctcccggaaattaatcgatttctgcttttgtaccatgtgcaatgtttacttttaaactgctcaggttcattctatcttattttctggtgcttctgaagcgatgtatatttcttcatttttaaactgctcaggttcatgaatgccaccatcactgaatgcacatctggtcctcccttattttcgttcgtatgtagtatgtacgtaagaactaacaagtttattcattcaaagaaaaactaacaagtttatgttaagcttcctttttaataatattttacattactgatatttagtgcagtgaaaaatgctgcaaatctctgatatttagtgcagtgcaaaaatgatacatagcttgattggatgctctttctcattatggccaactgcttgatggaattttttccatgtgaaaacaaatgtttactctgtttcaggcttgtgtagagaagaaaaggtggaattgtggaaggtaatcgcggggagttttggttcattttttgaagatttctctaattggtacgtactaattaaccaattggagttttggtctcgttactcactgtaaaaacatgatggtaaaaaaacagtttaatcctattggtactcttttatcccattgaacattttgtcgttgtgtcattgactactatcaaaaaggaaaaacagtggatgactctttcaggaaatataggatagccccattgatggcacattttgaaccgttcatgatccctgatttattctcttgaccatattctgcactgctatgcttgctaagtaatacaaatatatttatatccctgtagcatgtcagttactctataagacaattttttttacataactaattaacatttttactaaactcttttattttgacaatcactctaagacgtatgcaattgcgtcttacgaaagcaagtgaccctgagagcactgatctttgtaaagatgcacacagcttactgcaggagaggataacaaaatagaagtctataaaaatctatagaagggatcaaatatgcttgactgaatgatagagatggaaaaatgaagaagtgatgactgttgtttcacaatgtattcatttcatctatcctataattgtagtggtgtgtcaatgtgtgatacttctagattttcccagctccattttgccagctccgtgtgtgttaatgattcagaagtcgtggaattgcttggaacatgtaatttattctcaaccattttttgtggaagtgtggatgtgcattgtctaatatattggtattgaagtgattaaatatgattattgatcgttttgaattaatattttagataatataatatcactgtactttgccttgatatctgacctagatcaaaataaagctcaattgggtggattctaggaaacatatttttactacttcctccatttcacattatgtgtctagattcattaacatctatatgaatgtgggcaatgctagaaagttctataatatgaaacggaggaaataacgtgtaattcgttaacaaaaatgtattataacaccgtagagttagcacgggcagattactagtctacattagtgtcatatatgtactttttatactttgtatatatatcctagtgggccgtaggggtatttccttgaatgggggcatgaacctatataaaatcttctcggaaaatatagggattgatacctttctagtttgtacaattaatcacatctaggtatatgtaaaacatttattccgctactaatcattgacaaaaatctttaaaaaatcagaaaatctagagaacggagtcccgtagacacgggatactactagtaaatatccagcaccactactcacaccacctatttaatcttatcctctccttaatctcttccccttcccctccacacactctttctctctctctaccacccacatgagcacggaggcaatgacggcagctggtcatgcagggtggcgcgtcgggcgtcgaggaagttgccgtcttgatcgccgccgttgctgttggtggaggtgtaaactgagtagaggaggagatcacgaagttgtttgtggggtaggtgtccgagcacatgacggaggtggagctgctcaccacgttccaagatgcagccatcgtcaacgaggtcactaccatcaaggacaatgcccttttgtggtgtagatatgtagaccaagatctgggttcatgaccctcaagctcctgccttggcttgctttggggtttgatttaggtttttctacatgttctatgggtgtttctacag

SEQ ID NO: 67972 - DNA, 3045 bp, Oryza sativa
ttcttgacactccgtccacttggcaacgaaatacgctaaagcttgggacttgatggaagtacatggcttgaaggatagatccagagacatcaactccaaagcccattttgcaatccgcccatttgcctcgcaattatgaagtatatctccgagtggaaacgatatgaccaccgtgaccgagtgactttgaaaataatgggataatttcctaacggtaattaaaacaccatataacaacttttgtacatgaggatatcttgtcgtggagtcggccaaaacctcgctaatgaagtaaatcggtcgttgaaccttttggacgtggccatcctcctctcgctcgacgaccatgaccgtgctcacaacttgagatgtcgccgacacatataataacaacgtctcttgcggatgtggtgatgctaggaccggcggagttgtgagaagtttcttgaaatcttcaaaggcttgctgggcctcgggtccccactggaaattgtcggtcttcttcaaaagcttgaaaaagggcatcccccgctcgccgagtcgtgagacaaaccggctgagcgccgccatacatccagtcggtttctgaaaatctttctgagaacttggcggtttcatgttaaggatggcatttattttctccgggttggcttgtaaacccctacgggataccataaagccaagcagcttccctgacagtactccgaaggtgcacttttcaagattcaactttatcccgaagaaacggatgctagcaaaggtctcttctagatcggcgatcagatcatccttctgcttggtcttgacaactacatcatcaacataagcttcaacattgcgaccaatctgagttgaaaaacatctatggatcatgcgttgataggttgctcccgcgttctttaatcaaaagggcatggtgatgtagcaataggccccaaaaggtgtgataaacgaggtcttcaagcagtcggattcctttaggttgatctgatgataacccgagtagcaatccaaaaagctgagtaactcgcagccaaccgttgagtcaactacctggtcaatgcgaggcaacccaaagggatctttaggacaatatttgttgaggtcggtgtaatcaacacatatatgccattgcatgtcttcttccaaaccaaaattgggtttgccagccagtcacggtgtaaatcttccttgatgaagccttcctgtcttgtgtgaaacgacggagtcgttgcttgatgggtttagcatcttctttaacatttaagaagtgctcaatcacctatctaggaataccaggcatatcagatggtttccacgcaaaagtatctttattagcttgaagaaaggtgatgagcgcgctttcctatttacaatctaactcagcgcctattacagcagttttggaaggatcagagggatcaaggggaaatttcttggtcttggcgtcgctttctccggtctttgatatcttgggtgcaggcacttctccttcggttgcagttgatgcagtcagttggatctcatcccgaacaagtgtaatctcatgcgtctgggccatctcacagctttccttgtcgcaggtgacggcttgcttgatgttgctccgcaaagatatgactcctcggggtcttggcatcttcatcatcatgtaggtatagtgtgggactgctatgaatttggctaacgccgggcgtccaagtatagcgtgataagtcgtcttgaaatcagcaacttcgaagcatatattctctgtacgaaagttctcccgagtgccgaaggtgaccagcagagtgatctggccgagtggagtagaagacagcccggggatgactccgtgaaagggcgcactactcggcttcagctcagtacgagggatttgtatatcgtccagagtcttggcgaaaagaatattgagtgcactgccaccatcaatgagggatcgtcggagcttgacgttgcgaaccactgggtctagtaccagggggtaccgccccgggtggaccactcggtcaggatgatccgagcggtcaaacttgattgctgtctctgaccaccgaagatattggggcgtatcgggctggacggcattgatctccctttcaattagcttttgcttccgcttggactcgtaagcttggggtccaccgaaagtatggttgaattccttgcgagagtcttggaaaccagtcggtccgtcatcttcgtcatccttcttttttgaagtgctttgttctccatcagtcggcttccgtgctttcttggcgtattgctctgcgaactgctgatagatgaagcaatctttggccgcatgatttgaattcgggtgatgtgagcactgagcattcatgatcttgtcgaaagtattgatgcgcgatctctatcgagaaaaaggtgctgtagttgccacaaggtcctcgggcttacgcttgcgatccttatggttggtacttccgctcccccctattgctggcgcatctttcttgggcttccaatcgcttcccgactgcttggacgcggtgacggcatcatcggctttggcgtactcattggctttttcaaacatctgcttgaatgtcctggaggcttgcgtccgaatttgccgactaagagttcatgacgaacacccttagtgaaatcggctatgatgacgtcgtcggtaatgtcagagatcttattgcgttgctcagaaaagcgttggatataatctcgaagggattcaccgggcatctggatcacgttgtagatgtcgcactgggtgccaggactttcgaaggtgccttgaaagttggcgatgaagtgttcgcgaagctctgcccaagatccaatcgtaccacagggtaacctgagaagccaggatcgagcagaatccgctaaagccactgacaggtaatttgccatggccttgctatctcctcctgctgcacgaattgcgagaccgtagacggtgagccaagactcaggatttgttttgccgtcatacttcacgatcccagtcggcttgaagccggccggccagtccactcgacgcaggtcacttgtgaa
